United States Patent 11,913,074 (METHODS FOR ASSESSING RISK OF DEVELOPING A VIRAL DISEASE USING A GENETIC TEST) - sequence listing, part 14

SEQ ID NO: 1515 - DNA, 532816 bp, Homo sapiens
  source 1..532816: mol_type = genomic DNA
cggccatttttggggcgggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcaggtaacgagcgggcggctgccttgactgctccgagctgggcgttagcctcccgagcgcgtgagcactgtcgctccttctcgcgggtggtctggagcctgcctccgcctctggtccccctcgtgttgggggttccctccgcacttttcatttgggcatttctgctttcctcagaagttttcgggtctgtggcacattgcggagttctgtgtgtcgctgcttggtcgaggtgaccctcgcccaaattccagggttgcaagcgttcttgggtgtgtagtggatttcccatgaaaaatgtgccccacccgcgcccccgggggcggcccagggccggagggagcgtggcgtgcacagtgtgtgtcatgcctgcgtgtcatgccctctgacagaacttcattgttggccgggagcagacctgcaaagttggcccttctctgatgcaggtatattgccctcaagttgtgaaattgtgtgtctctaaaatgtttgctcatgactggaattaggaccctggttcccgaaggtaccatcttgtttctttactccttttatctcagagtcacaagtgaaatgagttgagagatactgggcatgtagcgaaatccatgaaactggagactttcccccaattgctcttccagtttggaaggttctttttttgttaatgaggacaggataatgggcttgtccactttctcccagtagccttgactgaatgtttaatttacgctagttcaactatttataaaaagagataaattgccttatatacccagtgttctgactggcctttttaaaagcagaacttgggctttgttgtcccagagaaagggaggccccagcacaaaaatgtgaagagaaataaaataagctcatttttggtctatgagctttccaggctccacccgtcctggtgatttgagggcttctcaatgccaatttttactacattgtgtttaagagacagcttgggaacctaaccctcagtaagatctaactgtgctgaactcggacatagtctgtctcttaaattgcataattatatatatatatatatatatatttttttttttttgagacagagtttcgctcttgttgcccaggctggagtgcaatggcgcgctctctgctcactgcaatctccgcctcccgggttcaaacgattctcctgcctcagccatccaagtagctggaattataggcgccagccaccacacccagctaattttgtagttttagtagagatgggggtttcaccatattggccaggctggtctcgaactcctgacctcaagtgatccacctgccttagcctcccaaagtgttgggattacaggagtgagccaccgctactggtctaaattgcttcattctgtactaacatagacaaagtacttatctcattatgcagaaggagattcaggtgctgaaacatggagacccacatggaaggatttcacagtaaattatattggggcatataaatctagcttttaaagctaacagtattttaggatgaattagaattaggctattatacccagagttaattccccttcttcccattcccactcttattatcacagaatgctactaattaggtgtaggggtcaaatactttctgtgttaagaatcagttgttatgtggattcagttttaattgactatcatcttcctgaccgtgcctcattggagaaacatccaaatctaaagcttctgctgtttaataagtgacagcaggatgtatcttttactgtaggggttgatagttttttttaaaagactgatgtaaaggttgacaccagccttacttgacatgttttgaaaggatggataactgataataaaatttatttatgcttgtttcttcagatgtcagtctgtattttacataatcttgaactatggtaacatggctcgagaaagctcttttagatgttatttaaaccagctattacattttacacctgaggaaactgagacaaaagttgagtgccttgtgcaaaatcagcggcaaaattaggaattgaatccagatttccatgatttagtgctctgcatggtgcctttgtagaaacaatatactatttaaacttcctgaaaaagctgtttctgtggacagaaattgtaaagtatcatgagagacaactatagtaactcttttgctttcttcttatcctgcaacgaacttgataactggggtttagaagtaggcagggttagccaagagaacacaactactgggtgttgggaagtgcagggaggccattgaaagtgaagtgactctgtatggtgatagttttgaatgagttggtcatcctacagataccagccatttcctggtgaacactacatttaatacaattatgtcatatctttagtttttgcaataatgatgtcagacatgttcctatcagaggcatttgagccagagcgactccatcttgaatagggtctgggtaaaataaggctgagacctaccagggtgcattcctaggaggttaggcattcttagtcacaggatgagataggagatagtcagaagatacaggtcacaaagaccctacaacaggatgcagtaaagaagccagcaaaaactcaccaaaaccaagatggtgatgagagtgacttctggtcatcctcactgcttattatacactaattataatgtattagcatgctaaaatacactcccaccagtgccattgacagtttacaaatgccatggcaacgttcagaccttaccctatatagtctaaaaaggtgagagaccttcagttctgagatatcagaactgatttcttcctttcctggaaaactcatgattaatccaccccttgtttagcatacaatcaagaaataacaagatacttagttgagcagcccatacccgtgctctgtctttggaatcgtcatccttttgtttctttatttctctaataaacttgctttcactttatggacttgccttgaattctttcttgcatgatgtctaagaaccctcttggggtctagatcgggacccctttctgttaacattcccattttgtgctcagtctaacagtagcctaaaaggtaggtattattgacccccttttactgataagctgaatgattacaagatatccaactctgactttgtgtccaatgttcttgttttataccacccttaattgttgctaaatatagtagtatgtgactcttttcatagcaatggctatgaaagaatacaggattggaaatcaatgaggaccaatggtcagaatatcttgggccccactgagggccttttctgagttactgagcttccatttctcttttctttttattattattattattattattattgttattattaattattattttgagacagtgtcttgctctgtcgcccaggctggagtgcagtggcgcgatctcggctcattgcaacctccacctcctgggttgaagccattctcctgcctcagcctcccgagtagctgggtttacagacgcctgcctcacgcccagctaatttttttctatttttggtagagacggagtttcatcatgttggccaggctagtctttttttttttttttttttttgagacggagtctcgctctgtcacccaggctggagtgcagtggtgcgatccggctcacttgaagctccgcctcctgggttcatgccattctcctgcctcagcctctctagtagctgggactacaggcgcccgccaccacgcccagctaattttttgtatttttagtagagacggggtttcaccgtgttagccaggatggtctcgatctcctgacctcatgatctgcccgcctcagcctcccaaagtactgggattacaggcgtgagcaaccgtgcccggctggccatgctagtcttgaattcctgacgtcgtgatccccccacttcggcctcccaaagtgctgggattacaggcgtgagccaccgcccccagccccatttctcttttctattctggacatttgtttaatgaaataactcagtagcagagatactaatatgcatcctaccagtgttgttggataagtgtaaaagtgcttttaaattttaaagcattttaaaaatagaataaaagcactttgagccctctagagaatggtgtcatctgaggaaaaaaatgtttaaatcttaaatttttagacaggaaacaaatttacctatctaattttctcattttacagttgaattaaagcccagagatagtgtgacatgttcaagttcacacagttacatatcttgaactagatatgagatctctagataccttgttcagttccctttctagtatagcattcaactctgaggaattcctaaataatgatttttttttggggggggtctctttaggaattcctaaataataattttaaatgaaaacttttctttttttttaacttaagatctttgaatttggctggagttagtatttcatcatttgtattctattctacttaattactgattaagagtctaaatttacagcctctgaaaccagatatccttggggaacaacttatatcctttgttatgtatatcagattcctactggtcttcatttgggaaatgatagaacatatttgataaattgatgcttttgtcattttaaattggcccaatagttaagttggcgcctgagttaagttcaggagacagaggaagatgcagaatgtcaggattcaaagaggatcttagcattttactttttttccttttctatactggatcttgtgtccaaagtaaagtgaaatgtcctacttagacctagtggtagagcctaagatagaatttagaccttctgactcctaatttatgtatttttcactgagcaacactatttcaaaattcccctctgaatattgccttgttttcctaacatcagtgtctagtctggttttgggcatcgcttacagcttgggtttgcgccagggaagactaggaaatggagttggggaatatttgttgtagagctaatgagccctattctttggtctgcccagataggtcaggtttggtctaaaactattctgggactctggacatcactgtgccctacatgatgattctggaacccacttttgtgggttaagcctacattggaaaatttatgtgggcagtgggtggggtcgtggggtattttccttctaacactcgaaactttttgaggtatgtccaatagaatctgccaagccactcagaacattcatatggagactaaaatctggctaagattgaaactgtctttgttgagttggtttctttagagccttaaagttttcaaactcatttttacctgtgtttttaaaatacgaattgtaaattcacattactgcacaattttttttatgctgtgggatgtttttagagaggtaagtgagcttttaaactaaaattgtttcatttatggaatattttgaagaagtaaaacagaaatctttttatttatttatttatttatttatttatttatttttgagacacagttatactcttattgcccaggctggagtgcaatggcacaatatctgctcactgcaacctccgcctcccgggttcaagcaattatcctctctcagcctcctgagtagctggaattacaggcacatgccaccatgcccggctaatttttgtatttttagtagagatggggtttcatcgtattggtcaggctggcctcgaacttctgacctcaggtgattctcctgccttggcctcccaaagtgctcacaggcatgagctaccgtgccggccaggaatcttttatgtgcaacgttgtcagctgttaatgctcctatttatgaataggtcacctttgtttgaaaaaagcgtacaaggttttctaactccaaatctttccagccacaatattgctacgttaagcagaactgtcaaagataaaacttgaaccaaagtgattttctagactgtttgaatgttaaccctttcctgcaatattggttaacagtcacgtctccctacctcttcatacctccttggttttattttattatttttattttttgaggcacggtcttgccctgttgcccttgctggagtgtggtggcatgaacacagttcactgcaacgtcaacctctgggcttaagtgatcctaccacctcagcctcctgagcagctgggagtagtcccacttgtagtccctacagtcccacctgtagtcctgtagtcccacctttgtattttttgtagagatggggtttaaccatattgtccaggctggctttgaactcctgagctcaagtgatccacctgctttgacctcacaaagtgctgggcctcccaaaatgctgggattacaggcatgagccgctgtgcccagccacatccttggttttaaattgttatttaaaaaatactgttgctgggcacggtggcacatgcctataatctcagcactccgggaggccgaggtgggaggatcactttgaggccaggagttcaaggccagcctgggcaatatgataaaaccccgtctctacaaaaaatacgaaaatttgcagggtatgatggtattgtgcctgtagtcccagctacttcagaagctgagtcaggaggatcccttgatcctgtaatgaaatatactatttttttttttttgagatggagttttgctcttgctgcccaggctggagtgcagtggcgccatcttggctcaccgcaacctccacttcccaggttcaagcaattcacctgacacagcctccctagtagctgggattacaagcgtgtgccaccacacctggctgattttgcatttttagtagagatggggtttctccatgttggtcaggctggtctcgaacccagcctcagcttacccacccacctcggcctcccaaagtgctgggattataggcacaagccaccacgcctggccatgaaatatactactaataaaataaaatactgtgataaaacataaataaacatttttattttttactttttacttttttagctggcattctggtctgagattattttattttatttttattttattcgagacagagtctcgctctgtcacccaggctggagtgcagtggcacaatctcagctcaccgcaacctccgcctcccggattcaagcaattctccctgcctcagcctcccgagtagctgggattacaggtgcccaccaccacgccctgccaatttttgtatttttagtagagacggggtttcacaatgttggcaaggctggtcttgaactcctgacctcaggtgatccacccaccttggcctcccaaaatgctgggactacaggtgtgagccactgtgcccggcagagatttttattttttaaatggcaaagctaggttatgaacaggatgaccatatgttccagtttgcccaggacaattctggatcatgcctgttatcctgacattattatttattattattttttcttttgtagacacagggtcttgctctgctgcccagctggagtgcagtagtgcaatcatggctcactgtaaccttgaaatcctgggctcaagtgatcctcccacctcagccctccagagaggctgggactataaacacacaccaccatgcctggctatattttgtgtgtgtgtgtgtgtgtgtgtgtgtgtgtgtgtgtgtgtgtcaggggggtgggtaaagatggggtcttgccatgttgcccaggctggtcttgaacctcctggcctcaaactcttggtcaagtgatcctcccgcctcagccacctaaagtgctgggattataggcatgagccattgtccccggctatcctgacacaattattaatagacacataaatgtgtctcatttactctcaaaagtgtcccatttggataataaattatctggtcacctacatatgcattacaatcattttgttgtactaggttttgtttgttgaaatgttatttgaactaggaccataagataatggaattttggcctattttgggtacatttggatgtttttcattggtcagacatttttattgtatggagagttctgagtgtacaaatgtatattaaatagtaatgcacatgatttgaaattagggattatttgttatcttacttttgggaggttacataaccttgaggaacctcttgtttcctcatccgttaaaaagagataatagcgatacctatcctacatgggtgttttgaagatattaaagaggtgacataccaaaaaatgcattttaagttgaaaattgttatataagtgttagtcatgtcacacatgtgcctttctgcaattgaatttaaaatgaataattttacctagtttggggaacttactatttgatagagcactggtagtgttttgctgtaaaggagagcagggaaataatggtagttggaagtacatgctgggctaaggttttctgcggggaggttttgaaattttcacatttgtgtgctgaaaagagtggtccaatagaaagcagaaaaaatagatgatgcttgacagaaggaagaaatcaatgttgagtaggaaagaaggatagaatctagaatacatatggaaggattggctttacgtaaccaagaaacacatttccctagtctgttcactttaaaaaaaaatgccaacaatataatttttttttttttttgaagcagagtcgtcggccgggcgcggtggctcacgcctgtaatcccagcactttgggaggccgaggcgggtagatcacgaggtcaggagatcgagactatcctggctaacacagtgaaaccccgtctctactaaaaatacaaaaaaaaaattagccaggcgtggtagcgggcgcctgtagtcccagctactcgggaggctgaggcaggagaatgccgtgaacccgggaggcggagcttgcaagtgagccgagatcgtgccagtgcagtgcagcctgggcgacaaagcgagactccgtctcaaaaagaaaaaaaaaaaaaaaaaaaaaaagaaacagatcctccctctgttgcccaggctggagtgcagctgcccgatctcggctcactgcaacctacctctcctggggtcaagggattcttctgcctcagccccctgagtagctgggattacaggtgcgccccaccgtgccaggctaatttttgtatatttttgtagagatggagtttcaccatgtcggccaggctgctctggaactcctgacctcaagtgatctgcctacctcggcctcccaaagtgctgggattacaggcgttagccactgtgcctggctctctcagtataatttacctaaagtcaaatcagccttccctttccttcccttcccttcccttcccttcctttcccttcccctcctttcccttccccttccgcctttcccctttcccttctcccttctcccctttcccttctcctttcctttccacagggtcttactttgtcgcccgggcttgagtgcaatggggcaaacacgtctcactgcaaccttgacctccccagcccaagccatctacttgcctcagtcccccaagtagctggggctacaggtgtgcaccaccacgcctggctattttttttgtattttttgtaacaatgccgggggagtggggtgggggtggggtcttgctatgttgcccagggtggtcttgaactcctgagcccaagtgatccacccacctcggccttccaaagtgctgggattacaggtgtgagccactgtgcctgatccagcctctttttaattaattctgtcccccttctcacccaggcaaccacttttggacttcttttactatagatgttagttctgcctgttctagaacttcacataaatggaatcatacagcaaggagtattttgtgtctgattacttttgttcaatataatattttttagattcacccattttggtgtgtgtatcagtagtttttcccttttattgtgaagtaatattccattatatgtatgtagcaacaagtcttctattgatgggctttgggttatttccagtttttggttactatgagtaaagttgctatgaacatttttgtatatatctttatgtggacttgggtaaatatctaggagtgaaattgctgtgtactagggtagatttatgtttaactttagaaaccactaaacttttccaaaatggaaaatttaacactttttacattcccaccagttttttttttatgagagttcagttttccacattcttcacaatgtttggcattttaaaatttaggcattctcctgagtgtgtacttgtatttcatcatggtttttgtttatatttccttgatggctaatatgtgattattggccatttgcttatcttttattttgaagtgtcaattcatttctgaaatattatcactgaataatatttcattgtatagatatgccacaatttatccatttatcacttgatagatatttggattattttcacttttgggctattatgaacaatggtgctataaacatttatgtacaagtttttattaaacttttatgtgcaaccctattttattgggttgtctttttgttgctgatttgtaggagttctctttatatctgaatgcaggttatttgccaggtttctcagattttacacgcacatacacacacacacacactctttctctctctctctctaaatattttctcctggtctgagctatgttgttgcattttcttaatgccttttgagagcagaacttttaagttttgagcaagttgaatttgttgatttattttattttatggtattaccttttctgttctaagaagtctttccttactctctgctaggcttgtgaaactattctctcatggtttttttctagaagctttatgtttttgtcttttgtatttaggcctatgatctatcttaaactactcttttgctatcatgtaagggtttctcaaaaggattttcaattaattgattagatagctgtgggtcttttcttggatttgttctattctgttgatttatttgtatcttcttatgtcaatgccacactgtcttaattattgtagctttataagattggtattgttactttaaattttgatagaattaatcagtgcagccgtgtgggcctggagtgtttttgtgggaaaaagcagaaggttttaaattagtgtaattacttttacaggtttaattactttagctgatatataagcattcaggttcttcactttttcctgtggcagttttaagaagttgaatttttaaatgaatttattctcaattgttgagttgttataaagttcataaaatttcctaatattctgttattgcctgtatgaactgctgtatgtctccatttgcattcttgatgttggtacttcttttgaatttttggatcagttttgctaggggtttagcaattaatcttttcaaaaacccagattttgttttgttgaatttctattttggacatgtatttttaatttttttttttttttttttttttgagacggggtcttgctttgtcacccaggctggagtgcagtggcgcgatcttggctcactgcaagctccgcctcccgggttcacaccattctcctgcctcagcctcccgagtagcagggactaccggcacccgccaccacacccggctaattttttttgtgtgtttttagcagagacggggtttcaccgtgttagccaggatggtctccatctcctgacctcgtgacctgcctgcctcggcctctcaaagtgctggtattaggggcatgagccactgcgcccggccaccttgctctcctcttgtggatttgatttgctctcttttttctaccttttttgagttagaagtttagattattgtttttaaacctttcttgttttctaatgtgcatttcatttcattcattcattcatacattcattcagagacggagtcttgctctgttgcccaggctggagtgcagtggtacgatcttcgtttactgcaaccttcgcctcccaggttcaagcgattcttctgcctcaggctcccgagtagctgggactataggcgtgcaccaccacgccaggctgatttttgtatttttagtagagacggggttttaccatgttggccaggctggtctctaactcctgacctcgtgatccgcccaccttggccccccaaagtgccaccgctcccagccacatttctttcattattattattttttctttgctaacccctagtagtcattctaatgtacatttcttatataattaacattttcttctaagtactcctttagctgcagcatacaatttcgatgtgttcaattcaaatttctatttccattgtgatttttctggtccacaggtcatttagaagtttattgtttcttaatatttggggattttttagctattttcaattttacatggtgttcagggaatgcgttgttgacatattgtgtacatatctgtaccatatatctgtaaatgataagttgtttatcattttaatcctttgatagctactgagattagttttaaggcctaccctgtggtggtctgttttggtgaatgttacctgtgtctctaattccgctctgcaatattttgaggttttcagtgtagatattttatgtatcttttattaaatacggtgtatactgcagttattgaatttagtgttctataatttatcaattaggtcagatagttttatgtgtttgttactatataactgagatataattcagctactgtaaaatgcaccacttaaaaattgcacagctcagtagttttcagtatattcacaaggttgtacagccatcggcactatttaattccagaacgtttttgtcccccaaaatgaaaacccatacccgttagcagttactcttcatgtctccctaacctctaacccctggcaaccactaatctaccttgtccctacaaatttgcctattctgaacatttcctaagtggaatcatataatatttggccttttgtagctggcttttttttttaactaagtatgttttcaaagttcatacatgttgtagcgtgtatcagtatttcattctttcttatgactgaaataatatttcattgtatagatatgccccaatttatccatttatcacttgagagatatatgggttattttcacttttgggctgctatgaataatggtgctataaacattcatctacaagtttttgtggtgttctatttttctatttcccctaagggtagaattgctggggcatgtggtaattttatgtttactttttgagcaactgccaaactattttccaaagcggctgaatcactttataatttgcaacagcaatgtatgaagattccagtttctccacattcttgtcaatacttgttactgttctagtcttcgctgagaggctctgtgtgcttgttggagcacactttcagcactcaaccaggctttcagttcatccatagccttgacttcctgttttgccgagcttcatgctcagtcagtggtgattgcttagggccttctcaggtctttcttgagtatgcccataggcctgggcacactgttttcatcttccagggtcttaggaatttcagaacttttcaaaactccctatggacatctcattctcctacttttccttttgtgttttttggttagcttgtttgccccagctgcttcagggagctgaaatgttaagcaattgtagctgattgtttttgacaaataaataccttgggggaaaagcctgttagcaatgggcaagctctgaatcaggttaaatattaggaagtcttgggagtggggtttttcagggaattgctagtcagctcaaataataactgtactctgaaaatgggactttgaaggaactctagccctgttctgtcacctccactggctgctaggctccaggattccacagattgtggtttgctgcttttcagggctagcctggagctgggaagaggggcatgggaataaggcatgttaaaatgccacaaagcttgctattcttactgagatgcagccatctttttttgaataaatgctccttggattgttgcaaactttttggttaatattcagagttctgaaaaaggctatttttgactttttttttttttttttgagatgcagtcttgcattgtcgcccaggctgaagtgcaatggtgtaattttggctcactgcaacctctgcctcccaggttcaaacgattcccctgcttcagcctctggagtatctgggattataggcacctgccaccatgcccagctaatttttgtatttttagtagcgacggggtttcaccaggttggccaggctggtctcgaactcctgaccttgtgatctgcccgccttggccttccaaagtgctgggattacaggtgtgagccactatgcccggcccaagtcttgacatttttttgccagtgttcttgttggttttatggaagagaggatttttggaggtccttactctgccattcccaatgatgtcacccaatttgttttttaagcattaaaaaaaattattttaaaatataaagacagggtctcactatgtcaattaaaaagacagggtctcgcccaggctggtctcgaactcttgggctcaagtgattgtcctgccttggcctcccaaagtgctgagactacaggtgtgagccaccacacctggcctaaacatttttaatatatctgtttttatatcctgttcctcccttttcttttgaaatacaactcacagaaattgcaaaaatagtacagaaagttcctgtgcaccattcactcaacttcccccaatgatatatcttttataactatagtgtgttaccaaaaccaggaagctgatttcggtgttatacaatagtattaaattaactatagacgttattagaatttcacgggtttttgtatatactgtttttaattgaggaggtggtggtgtatagttctataaagttttatcatgtccagattcatgtagctattaccacattcagggtattaaactattctgttaccacaaagaaatttcttcatattatttctttatggttatgcttttctctgaaccctaacccctggcaactactgatctgatttccatcactgtaattttgtaacttcgagagtgttatataaatggaatcatatagtaggtaacccgtagatacggcttttttctcacttagcacaatgcctttgagatccgtttaagttgttgtgtgtgtcatagttcattcctttttattgtttctcttttatgggtgtaccatagtttgtttacctatttacttgttgaaggacatttattatgtttccagatttttaccatttttttttctttttctttcttttatttgttttttttgagacagagtcttgctctgtcacccaggctggagtgcagtgccgcgatcttggctcaccacaacctccgcctcccgggttcaagtgatttttctgcctcagcctcctgagtagctgggattacaggcgcacactaccacacccagctaatttttctgtttttagtagaagcaagttttcactatgttggtcaggctagtctcgaactcctgaccttgtgatccgcccgcctcggcctcccaaagtgctgggattacaggcgtgagccactgcacctggcccattttttttttttttcaaacagatatggttttgctctctctgtcactcaggccagagtgtattggcatgatcattgcacactacagtcctcctgggcttaaagaattctcccacctcagcttcctgaggaactaggagtagagacatgcacaactgcacccagctagtaattttaatttttgtagagatgaggtcttactatgttgcccaggctggtcttgagctctggcctcaagtgatcctcctacctcagcctcccaaagtgctgggattacaggtgtgagccaccatggctggcctagtgttttacaaataaatctgttaggaacatttgtgtacagatttctctgtgtacttaagtttttcttcctctgggataaatgctgtgtagtgtgattctttaatttttggtgtgtctgcctgttttactaattactgaaagaagggtgctaaactaagattatgtatttgcctatttcttttgtttctaagtttttaaaaaagtattttgaagccattttatttggtgtgtacatattttgtattgttacctttagcatttcttttcttgatgatttgacctattttcatgaaatccctttgtatctggtgatactctgtattttaaagcttaccttgtctgtgtcttaatatagccactgtatagtgtctatatagtgtcttaatatagccactgtaatttatgattagtgttttctttttttttcttttttttattatactttaagttttaaggtacatgtgcacaacatgcaggtttgttacatatgtatacatgtgccatgttggtgtgctgcacccattaactcgtcatttaacattaggtatatctcctaatgctatccctccctcctcccgcctccccccaccccagtgtgattagtgttttcatggtgtgtctttttgctaactttttattttcaaaacttctttgtctttataaaagtgtatcttgtgctaggcatgctggctcatgcctgtaatcctagaacctagggaggctgaggcagaagtatagcttgagcccaagagtttgagatgagcctgggcaacagagggagacccagtctctattaaaaagaaaaaaattaactgggtatggtggctatagtcccaacttattgggaggctgaggtgggagagcttgggaggttgagcctgcagtgagctgtgattgcaccactgccctccagcctgggcaacagaacaggagcctgtctcaaaaaaagaaagaaacaaaagatcagaacctataatcacagaatcactgaaaacccatggaattatcatatgctagccattgggaatacaaatgtaaatgagatttcaaaaaaatctttaccctttgttgtctaggtggttaagatcagttgattgagataaagttcaaagcaacccctaaaatcaactaaaaagttcatcaaaggacttttagaactgagcaggagggaatgaataaatctttgggagggagggatgcagtgccttgatatacagtaccaggagccattttctacattgttaacagcactcttgagtgatgttggtggcagcttgtatatcttatgtggaagcccttgggtaggagtcgatcaggaaaaacttcccaagacaggtagcatacagggaattttaaaaagatgaatgggagtttgccaggcaaaggaagcaggagaagaactttacaagcagagtcttattcaaagaacagtaaggcattatgattaaaatagtttgtatatattagaatggtgagaggtaaggttaaagaattactgaattttgattatcttagtgtgcacatttcttcccattttaacaactctgaaattggcatacatcttacaactgattgtgttttgcatcaccattggaaattgggattattttatgaataatggcatcttagatatgatgaaatatggtaagtttgagtagattcaatgtcctttaagttatgcttttggattttatcctattaataatcagaagctaggtagattttaagtagaaaaatattatgtctagaattgtttaaaataatatgattttggtgatattgtgcaggatttattgtggctaaaacaattgctaacaatgtagaaattcaggcaatgtctgcagagggcctagtgctagtgggtgtattgtgggaaatccaggtacaggaagcgtttgataaaaccaagatgatgtcgttactagtaagatggggctagttgacgtagagagaagagtcatataaagctgaggtttctggatttaaagagaagatgactggtgtaacagttaaaggcagtcattgttagtgtttattctggcatcataattaaatgtttctattactgagagggctaatcaacattcaaacattaatatatcaatagccaagaaaagattttctcaggaactcttactgtaaaatatatgtcagtataaaatttgttgactgtccaataaaataataattatagtgtaggtttatgttggctgcaagcctaaattatgagacatttataaaattactgaccgctcccccccccaaaaaaaaaagattgttcagaatctctcatcctagcatccattccaagaaaaagatattgctaacatttggaataaaaagtaatcccagtacgggttagtcatagtttttggctatagactaaacctcatcttgttcacattctagtagaacaagataaaaacaaatgcttattcatatagtatgttcatcatttaagaaggtcatagtatttactggcctggacactagtttatatgtgtttgtatttaagaaactagccattataatctcaattatgtgcagtgaaggagagagaaacgtgacatgagcaaagttttatttgcttttgaaaataattgtatcttttttacttaacttactatttcaagatatcttttatatgctactttatttaattaatttgtttttaagacagggtcttattctgtcacccagggctggagtgcaatggtgcaattacagcttactgcaacctcgaccttccaggcttaagcgatcctcccacctcagcctccctggtagctgggattatgggtgtgcaccaccatgcctggctcaattttttatatttttctttttctttctttctttctttctttctttttcttttctttcttttttttttttttttttttgaggtagtagcatactcatggctcactgtagcctcaacctcctgggctcaaggattcttccacctcagcttccctagtaactggggctataggcacatgccaccacacgcggctaatttttgtattttttgtagagatggagtctcgccatgttgcccaggctggtcttgaactcctgtgcagaggcaatgcgcccgcctcagcctcccaaagtgctgagattacaggtgtgagccactgtgcccagccaattttttgtagagatggagttttggcatgttgccctggctggccttgaactcctggactcaaaccatctacatgcctcagcctcccaaagtgctgggattacaggtgtgagccaccacgtccagcctgtgctaatttaaattattttctcctcactgctgtactagccacaacttctgcaaccagtttcatgtgggctttggacaattgcagcctaacagcatcactcatcagggtctatgttgcatacgttctcccttggggaactgtaatgttaagattaggctgggtgcggtggctcacacctgtaatcccagcactttgggaggccaaggagggcagatcacgaggtcaagagatggagaccatcctggccaacatggtaaaaccccatctctactaaaaatacagaaattagctgggcatagtggtgcgtgcctgtaatcccagctacttgggaggctgaggcaggagaatcgcttgaacctgggaggcggagtttgcagtgaaccgagattgcgctactgcattccagcctggtgacagagcgagattctgtctcaaaaaaaagaaaatgagcactaataatcttttctatattacagttttataataaaaatgcattacatattaaacagattcacaaagtgaactaatgacaatttacgtctgtccctatactttcagttgtaagtaactaaaaaccagcctcaaatggaaataaacaaaactaccgacatatgtaattgaaaagtccagatacctgggtgatgaaataacctgtacaacaaacccccatgacacaagtttacctatgtaacagacctgcacttgtacccctttacttaaaaaagcaaaacaaaacaacagaaaagttcagatggagtataggtttcaggtaaagctttattaggtggtccaacaacttcattaatgacctggtttctttcagttttcgcactctgctttctgtggtgttaaatttatcccaaggcagccacattgaagccattaggtttttaaggcttctagcaccttcttcatttatatctattagggaaaaatatgttctgtatctgagcatcatagaaaaaaatcttgggttcattctgattttcctggcttaggttacatgccagtctctgaactgattactaaggctagagaaatatattgtgctgattggcttaggtttgccccagggatcaattccacccaaattccattcttgagtgaggaaatttggggtaaaagagggaggatagcaaggaaaagatgacagacacacaattccagtttattataagaatgacttcaaatgaccttaactgaattgtaatattatttgggaacaagtcaaacattattaacatttaggcccagagatggtagatggcttgcttaagtctcccagcaagctacctcaagaactgagacttgggctgggcgtggtagctcacacctgtaatcccagcactttgggaggcccaaggcgggtggatcatttgaagccaggggttcgaaaccagcctggccaacatggtgaaaccccatttctactacaaatataaaaattagccaggcgtggtggtgggcacctgtaatcccagctactcagcaggctgaggaaggaattgcttgagcccatgaggcagaggttgcagtgagcagagatcatgccattgcactccagcctgggtgacagagagagactccgtctaaaaaaaaaaaaaagaaaaaaaaaaagaactgagactcagaagtgaattatttgactcttgaattgtacttcattcttagaatcaattattggcctctctgtaagactgtctttactgagtttttaaacggagtataataaactcttttgggaatgcggtagatgttcaaaggtttgacttcttaaaaagaggtgtaacaattatattccttaaaactgagaggggaccaattgagggtagagggattgatgtgggggcaggaggatacttttttgttgttattgtgatgaaaatgttccatagttttgtggttatatgactgtatacattgaactggatgcttacaaacggtgataaaaagggtgaaggaaaataaaaaaccaagtagcccaataacactgctcatccttgtttttttgttttgttttgttttttaaataacaagttctaggagtttttgtttgaataagaatatataaatcaggcagagtagtcccagtgaaatcatggttagattttactgtatttgtctgttgatccttcaccttctaagcacttaaaatacttttttattagacttgctttgatcacatatgcaatttaagtgtgaataagtaagtgtattatctttccctcctccactcagctttctttaaatagaaaagggacaaatatctctttattgcatattcagccatagttgctcaatctatggtgttaataagagactgtaattttatcttctaaaaatcattacagattataattataggctgtacctcattctcttaaagaaatattggcatgttagtccattgatattactgatagttgccaaatggtgagaatggtaactggtttggaggcaactgaaagggagggggaatcatcagtaaactggagaccaataaaaaattacacagaaacaaatctttttggataaactagatgaatgtctcttattgagactgatccaacagtattcactggcccatttcttgctgctagatgagcttctgtttaaggcatcacttgtggtggagttctttcttttatttggattggaaccatactgtgatctcttatggaaaacagacttcctccaagtctgttaaatataatttaaaattatatcgtttcttgttgatttgtttgtttttgttttgctttatttcatgttataggcatctgaaatgaatccttatatatataacatacaagtatatgtatgagaagacatgaatataagaagtataggaaacataagacatgaataaaagttttagctagacatttttagatgaaaagatgtgcatttaaatttgtaaaagttacaaatcgttctataaaaagttagcatatatttaaattttttggatacataataagagaattatatcacttctgatatccattgtgaagaccctaccacagtcatttttttgtgaagggtagatagggctcttgcttgtactcttccaggatgtgccacgggctccctaataacattcaggggagtgcatgtgcaggtttgttacatgggtatatcatatgatactgaagtttggttttgtaatgatccccatcgtctaagtagtgaacatagtaaccaataggtagtttttgagcccttgctttcctgtctccctccctgattttggaatctccagtgtcttttgtcccgacatctttgtgtctctgcgtacccagtgtttagcttccacttataagtgaaaacatgtgatatttggctttctgtttctatgttaattcacttaggataattcagctgcatccatattgctgtaaaggacatgatttcgttctttttttatggctgcatagtattccatggtgtatatgtattgaattttctttatccattctaccattgatgggcacctaagttgattccatgtctttgctattgtgaagagtgctgtaataaacatatccctttttggtagaatgattcattttttttcattttttttattttttaggcagagtctcgctctgtcgcccaggctggagcgcagtggcacgatctcgactcactgcaacctccacctcctgggttcaagtgattctcctgcatcagcctcctgagtagctgggactacaggtgctcgccactacacctggctaatttttgtattttttatacagatggggtttcaccttgttggtcaggatggtcttgatctgctgacctcatgatccacccacctcggcctcccaaagtgctgggattacaggtgtgaaccaccgtgcccagcctagaatgattcatttttctttgggtatatacccataatgagattgctgggtcggatggtaattatattttaagttttttgagagatctttaaacttcttttcacaggggctaacctaatttgcattcccatcagcagtttataagtattaccttttctctgcaaccttgacaccatctgtttttttttttttttttttttgactctttagtaatagttattctgggctgggcacagtggctcacacctgtaatcccagcattttgggaggctaaggcaggtggatgtgctgaggtcaggagttcgagaccagcctggccaacatggtgaaaccccatctctactaaaaatacaaaaattagccaggcatggtggcaggcacctttaatcccagctactcaggaggctgaggcaggagaatcacttgaacctgggaggtggaggttgcagtgagctgagattgcaccattgcactccggcctgggcgacaagagcgaaactccgtgtccaaaaaaaaaaaaaaaaaataggtattctcattggtgtgagatggtgtctcattgtagttttgatttgcatctttctctgataatcatctttttttctaaatgtctttatgctacctctaaaatgttctacgtataataggcaaatcaaatgtttaataaactggtgtgttaggtttattttcaggttgaaatgaagatagttatttttattttgtgtaccttttacatatcaacttacttttagaagtatttctaacttgtgttttgtgtttttttagagaaaatattctctttggaatgggaaatcctctgcttgacatctctgctgtagtggacaaagatttccttgataagtaagtattaaactcttcatatgcactatgtggaacttacatttgaagaagaatggatgaaaactttagaagtgaatttaccaccgaatgtcttcaattaaaggaaaactcaggaaatttaagtttggtgatagcaagtgtgctatcattaactattgaataactgagtacagttttccttgggaaaacttatatacattgctatttttacttaaaacttttttgcttattatttggaaggagaaaagtttatataatttacctaattatttaattccccaacttttaaactactgtcagtgagctacgtctataatggtatcataatctacagacattctaccccgaatgtgcccagtctggtttcctctcagaagctataatgggagaagaaagatgattagagaagacaagagaacgtgcaggatataattcagaggatatgaagctctgctgtttccgctttattagtaacttccaatgtttcaacttagctgagaaatcagtttgtttatttacctaagtatttgaggccatttcgtacaatagtccccacttgtgtccttgttttcagtttctgaggtctcagttacccataggacagtgtaataagacattttgagagagagacatgcaccacgtccacataacttttattacagtatattttaatagttgttctatttttagttagttgttgttaatctcttattgtgcctaatttataaatgaaactttatcatagtatgatgtgtaggtatgtatgtgtaggaaaaacagtgtgtgtgtgtttgtgtgtgtgtgtatatgtatgtatgtatgtatgtatgtatgtatgtatctatctatctatctatctatctatctatctatctatctatctatctatctatatatggttcagtactatccatggtttcagatacccactggtcatcttacaatgcatctacctcggataacgggggcactactatatggcaaatttaagtagtaaaaaagattaatgatgagaaagcaagatcccccctctcctcacacaccctgatttctgtacccaagagtaattactttttaaaaaattgaggcaaaatttatatcgcataaaattgatcgttttaaccattataaagtatacaattcagtgactgccagtatattcacaaagttgtacaaccatcaccactatctaattcaggacattttcatcaccccaaaatgaaatcccatacccagtaagtagtcattcgctattccctcctctaacccagtctcctgggaactactagtatacttagtttttctatgaatttgtctattctgagcattttatagaaatggaatcatataataatatatgatcttttgtgtttatatatatgaccttttgtgtttgggcttattttacttatgtaatgctttcaaggttcatccatgttgtagcatgtatcagtccttcattccttttaatagtggactattccattgtgtggatagaccacattttgtttatccattcattggttgatggacacttatgttgtttttattttttgtctattaggaacaatgcttcttatgaatattcatgtataagcttttgtgtaggaatgtgttttcatttctcttgggtatacacataggagtggaactgctgggtcacatggtaattctgtgtttaacttctagagaaaccaccaaactgttttccaaagcagctgcactgttttgcattcctaccggcagtgcataagtgttccagtttctctacgtctttgccaaagcttattttttattttttaaattatagccatatgagtgggtgtgaaatgatgtctcattgtgattttgatttgcatttttctattgaaaacttttgatgttagcatcttttcatatgcttattggatatttgtatatctttgggaaaatgttgaagctctttgcccattttttaattgggtcgttgtctttttgttaagttgtaaaagttctttttatattctggatactagaccctatcagctagcatatgatttgcaaacattttctcccattctggggatttactttaattttttgatagtatcctttgatgcacaaaagttttaaattttgatgatgtccattttatttttcttttgttgcttatgcttttgctgtcatatgtaagaatctattgttaaatccaggatcacaaagatttgtgcctgtgttttcttctaagagttttgtagtttaaggtcttagatttaggcatttgatcaattttgagttaatttttgtataaggtatgaaataagggttcaactttattcttttgtgtgtggaaatccaattgtctcaacatcatttgttgaagagactattcttttccccactgaatgatcttgatactcttgacaaaatcaggtgaccatagatatatgggtaaatttctggactccattctattccattgatacatatgtctgtccttatgccagtatgacattggtgtttttgtgtatgtgtgttttgttttttgttttttttttggagacagggtcttgctctgtcacccaggatggggtgcagtgatgcaatcatagctcactgaaaccttgaactcctgggttcaagtgatccttctatttcagcctcccaagtaactgagactatatgcaggtaccaccatccctagctattttaaatttttttttgtataaacagggtctccttatgatgcccaggctggtctcaaactcaagtctggcttgatcctaggcccaagttgtcttcccaccttggcctcccaaagtgctgggattataggcattagccaccatacctggcctgtacgacactgttttgattactgtagctttgtagtaaattttgaagtcaggaagtgtcagtcctccaactttgtttttcaagattattattattattattattaatttttaatttgagatccctcacaattccatatgaatttttggggatagctttttcatttctgtaaaaaaggcagttggaattttgattggaattacattgaatgtatagataaatacatgattaagtcttccgagttatgaagacagaatgtctttccatttatttaggtcttttttttttttttttttttttggagacagaatcttgctctgttgtccaggctggagtgcagtggcatgatctcagctcactgcaatctccatttcccgggttgaagcgattctactgcctcagcctcctgagtagctgggattacaggtgtgtgccatcatgcctggctaatttttgtatttttagtagagacagggtttcaccatgttggtcaggcttgtctcaaactcctgaccttgtgatccacccgtcttggcctcccaaagttatgggattataggtgtaagccactgtgcctagccttaggtctttttaaaataattttagcagtgtttagtaggttttcagtgcataagtcttatacttctttggttaaatttaattttattatttttgatgccattgtaaattgggattgttttattttcttattgttcattgatagtatgtagaaatataagtaattatgggggacaataatttttttgaaacttttttttatatcctggggattacccctgtaagtatatttggctaaactcaaatgtcaaagggtaaggcaagaatttataaatgtgtaaatttgacttacggtaatataataggaaatgtgctgggggtctaggataaactgggagatgtgttttatcctaagacattcagatagaaactttaaaacacactttcccagtcagaaaatactactatatacagttactttaatgattttagttcttttggttaccttgtacttttaaataatatactatacttacatttcttaaaatttctttttctgtcaaatttcaggctgggcgtggtggctcacgcctgtaattccagcacttttggaggctgaggcaggtgaatcacttgaggtcaggagttcaagtcatgccaacatggcaaaaccctgtgtctactaaaaataccaaaaattagccaggtgtgatggcacgcacctgtagtcccagttactcgggtggctgaggcaggagaattgcttgaacccgggaggcagaggttgcagtgagctgaaattgcaccattgcactccaacctgggtgacagagttgacactctgtctcaaaaaaaaaaaaaaaaaaaaaaaaaaaaattaaaccaagccaaaccacaccaaaacaaaaaaacccaaatttcaatggaatccattgacttctcattatggagaacgagattactggtgcccctattctttcctatgctacttcttctatctttctattctattaactgtgtttttaaggttgatgttttcattctgttatctatctataattgttttcccaactttgaatacaaattcataatgaaagttgaaaatgacttacccacattatcactctgtgtatcatttattgcagaattaagtagtgtaccaggaatgtagagcaggttaacatttgaaatgtaattagaagactgggcgtggtggctcacgcctgtaatcccagcactttgggaggctgaggtggatggatcacttgaggtcaggagtttgagaccagcctggccaatagggcaaaattccgtctctattaaaaatacaaaaattaactgggcatggtggtgtgtgcctgtaatcccagatactcgggaggctgaggcaggagaatcgggtgaacctgggaggcggaggttgcagtaagctgagattgcaccactgcactccagccagtgtgacagcctgagaatctgtctcaaaaaaaaaaaaaaaaaaaagaaatgtaattagagtaattcactatagtaagaaactaacataacagtctaagaaaactccatataattatctcaatagacaaagaaaaaccttttgacaaaatctaatatctattcctgatgaaaaaaaataacttaaagcaacctaggtaactatgtcgataactttcttaaccctataaaggttacgttaggggaaaactggtagtgtgatgcttatatgggtatataacgtatcaaattgtatactttaaatgtctacagtttattgtatgtcagttatatatcaaaggctgtaataaacagaaaataaaatcagttggacatgaattcatgggtttaaaattagatctcttttgtttgtgtagtgtgagatattttgttcaggaagtcaactaattcatggtcactattttaaaaaaatcatgatgtataaaagtaaagagcaacttaaaaatttgaaattttatcgtgtatttcaaaagtaaaataaagtatagagacaaacccataaatgtagaacattttatatgggaagcaagaattgaaatttgggatatacacacagaccaggtggtctttgctatgtctgaagaagaaagataagattggaagttttataaaaaggtgaaatgttttgtattgttttgaaagaaagctcattggcactagttttggggaggtggcaagctttgattggtgagtgactgcagtgagtagaactagtcttttagagtcacagctcattgtttcagtagctactggataaaactgttttcagatgacaacaggcagtttcagcagccaggcttgcagagaattaccttcttggagcaatgttatgtgtgctgagtgctcttccccccagcctgtcacctgttttagtcagatatgacaagaatgacccaatttatatgattagctttcacacatatataatcagtgttgttattttggtgaacatgcctccagatgtttgttaggcatatataacctgaagatgaatgtttatgggctaatactatgtgtagtctttgttagtatgctgtttttcactcaacattatgtttttggatcactgtttttaaaatttcaggcaaatgtgatcagagtgattatgacttggcagctgtgtgatgatgtcacaggatccttagggtgtcgcttttccagccagaagccactgtggttggtggagcctttgcctgaggtttgcttgtgcctgccaggcttgttctgcttgtttggcctggcaggctgcgttcggctcatgctaccagcctggatcccacacctgccaagggcgagccaggtgcagagtggcgtggcaaagagtgtgtgagcaagcgaatatgggatctggccactgtgtacagccactcatgctggctgctgtggtggggtgggcatctccaggcactggcacaggtgctggcttcatgcaagcttgcggctggatctgatgcatctcaagtggcttccactgtaggaacccacgtctggacgaggataatatggtggtgcccagaagcttggagacaccagaaaccacagagccccaaagagagtgtcacagccctggattgggaaccccctaggtctgggctctcagaagggctgcagctcttctttccttcttgttgcctgcaaggtgctgagtggggtgaggcatattttagctctgtttgtgttacagctgtttcagtcctgccacttggtgggtcttcttatcctgcatccatgaacagtgaggtatggggacaactggagggtgagcaaggtggagaggagcttcattgagcaacagaacagctctcaggagacccgaagtgggtagctcctttctgcaggcaggtcgtcctgacaagtgttcacctctcagtgagatgagaccccgagggggtaactcctttccacagttggtagtcccaggtctcttctgtaagtctggctgagtccagggtttttaatgggcttcacaagggagaagtgtgtgctgattggtccatgggcggctatgggtgggtctggaaaaagcaccatgagtctcactcccctcagtggaccccacctggaactgatagcctggcccccatgcttcaggctgtccctggcttgaaggcagggcttcacctgaacccaccccttttttcccaggagagtgtctgcctcctgctgccatcaatcatgttgtccacagtgtgcaggctgttggtgatgagggtacttgctggccccattgagctgccctcagtcccaccttggcctccttcccatgcttctctgcacctaaagtccagagggggctgagggggcagggggctggtatgtcagtgctgccccgagcacatgcacacctgctgggttgtgacagtgcctgggcttggccacgactttgctccaccctggagcaggtgctgggatcgaggagaggccaggcatgggaacaggcacttctgagtctgcaggggaaagggggacttcccgggccccagagagtgcagggatacctgggtccacagccatggctgggtggctgcagctgcactcaggagggtggggctccagccctgccaacttggaagtgggtgtggctcccacctgttcccagctcccatgggctctgtggagcatgcagccctggctgcatctccccaattgtagccagtgtctttgcagcagctgctctagacagcctgctgctgccatcaatgacgctgctgggagctcgagtaacttctttgttttacatgttttactagcagctggtcctaagtggctagctgaagttctattttatatttggaaggttttaatctttaactttgattttcaaataagtacttgaagataaaaaacaagtctttggaccctaacaataaaagagtcttctctattgttactcctggctatttcttccaaatatatttaaaaacttaccttatgatataaacgaatcgtgtttagcctacattttgagccaccattagataagtatttagataagtactatgtatatatatattttttatttttttatttttttattttttatttttgagttggagtcttgctctgtcacccaagctgcagtgcagtggcgcaatctcagctcactgcaacctctgcctcccaggttcaagcgatcctcttgcctcagcttcccgagtagctggaactacaggcatgtgccaccatgcccggctaatttttgcagttttagtagagacagggtttcaccatgttggccagggtggtctcgaactcctgacctctggtgatctgcccacctcggtctcccaaagtgctgggattacaggcatgagccaccgcacccagcatagataagtggtatattgctatggtttgaatgatggtatcctctccaaaaattcatgttgaaacttatccccagtgtagcagtataagaagtgtgactcttgggggttgaccaagttatgaaggctctgctcttatgaatggggttagcacacttgtgaaaggactcaaggttgaagggagagctctcctgcctttacattccttctgtcatgtgaggacacagtgttcctcccctctggaggatgcagcaacaaggttccatgttagaagcagagaaaagcctcgccagacaccaatcttgctggtgccttaaccgtggatttcccagcctccaggaatgtgagaaatatatttctattgtttacaaattaccccaaacaaaataagaaaaataaaacaacaacaaaacataagtaagtaaataaataaatagcctggtctgtggtatttttgttatagcagcacaaggggaccaagacatataccaaatgaatgagatatatactgattagtatcttacactgtgaaagtgagttctaattgtcaaaattcatttgataaaatatttttctgattctgatttttttttttttagagacaagtttttctgtttcccagactggagtgcagtagcacaatcatagcctagtcactcactgcagcctcaaactcctgtccctcccaccaaaaaaagaattgaaagttattaggaacacctgtggcagaaagtacattattgaaaagaatcttttctagtaaactgtagggacacagtgggcatgaggggataggaaatgtggaacatatgaatacctccagttgagccctggtctgtaattatggaggtatgtattaatagggatgaaaaaggcagggaaggaatgtgtaaggtaggtttgccttggtttttcctgacactagataaatatgaaagtaagaggaatgagagaatgaatgaaatggtaattgagaaaggaaaaccatcagtagaaatgaaaatactcagttttggctgggcgcggtggctcacacctgtaatcccagcactttgggaggccgaggtgaacggatcacctgaggtcaggagttagagaccagcctggctaacaaggtgaaaccccatctctattgaaaataaaaaattagctgggtgtggtggcacacgcctgcagtcccagctactcaggaggctgaggcaggagaatcgcttgaacccaggagcggaggttgcagtgaaccgagattgcgccactgcactccagcctgggcgacagagtgagactccatctcaggaaaaaaaaaaaaaaaaaaaaatagaaaatactcagttttatgacaggagtagttgaggagacgtgtttttcttacagatctaaacctttaataaacatacaaaccttacatgagtttttattaatctgagtatgcatgaaagatgttacttaatgttcaaacctaaaatgcccgaagtagctggctgtggtggtgcttgcctgtagtgccagctacttgggaggctttagctgtagtgcatcatgattatgcctgtgaatagccactgcactccatcctaggcaatatagtgagaccctgtctctaaaaattaaaaaaaggaaaatgctcaaagtaattggccataaattttagtgctgattattcagtgccaataatttacaactgaattatttctataaataaaaatttatttcttctacaaatgggtgtatgttagctttgaaagtgaaaaaaatatttagtgtcaagtgagactgcatgtgttaggttaaaagctagacatttaattgttttgctttaaaatgaattgtaaactgctctgacacttttgtagttaattttttttttctttgagatgaagtttcactgtcgctcaggctggagtgcagtggcatgatctcagctcactgcaacctctgcctcccgggttcaagctattcttatgcctcagtctcctgagtagctgagattacaggcatgtgccaccatgcctggctaatttttgtatttttaatacagacggggtttcaccatgttgaccaggctggtctttaactcctgacctcaagtgatccacccacctcagcctcccaaagtgctgggattacaggtgtgagctaccgtgcccggtcttttaattaattctttataaagctattgccatatttttttctacagctttcaacattatgttttgtatatttaggtctttaattgacctgaatattctgtctgggattttgtttagtatttatggattaatttggaaaaaagagatctttaccaacaaattttcttatccttacaaatatttctttctgtattttaggtattcttctattatcttttaataacatgtaaaatttaaatacatttaatatgggttacaaaatggttaggctgatttttttaaaaaacgtatacatcttatggtagtgatcatttgctaaatctgttagattcaaaaattctaaaagtaaatgctttttagaaaaaaattcagaccatgtagaagtcaataaagtacaaatgaaatctggggtcagtatctttgcagcagtgtgtgctgtccactagaatgtttcatgattatggaaatgttgtgtatctgtgctatccaacatggtaaccactagtcacatttggctttgatcatttgaagtgtggctagtgcaactgatgaatttcaacattttatttcatgttaattaaattttaatagatataattagcatatatgatattaaccagtacagcttaggtttattgtaaaattttacatttctttttatatgtttatattttttaaaggtatcttcaaaaaaagttgtatctattgtgtatatgatatatttttctacaacatattctagattattggtggtgtttggaaatgcttcttaagtttgaatattttctcttatttgactaccttgtgacctacattaacagatagtctttggttattctgcttctctccttcaaaattctaaattcttagaatttgaaataaactgctatttgaatctttatgtcatttcacatattgagtgattggtcctgagttgctctggggcttcctcaaaaaacaacctaaattatggatactaaatgaacacagactactttccttcattttgcccaaatagatgctgttctttgggttctttgatgttcaaacttaactttgaatattgaaggaaatggtacttctaaggataagtaaacatagattcttttttaacagttcatttcacagctcaacacacactttttggagcatatgttttatggttactcttttgccaaatactgggaatacaatattaaataactgttttgcctttaagcagcttgtaatctaattgaggagacagatgtggaaagaaatcacttacttcttcacagtggcattatagaatagaggttaagagtgtgctctggagctgtgtgaccttggttatctatggaagctcagtttccttgtgagtaaaataaggttattagggttcttgtgaggattgaatgagattatttgaatgtttggcatatgttagctaatattactggctactgagcttgaaatctctcgtgcctctattattggcaatggagagcacttgagagatttaagcaggcagatgacatggttggattcatattttaggattatgtgaattgctttgtctgtagtggatcaatagatttgaggaggctatagtgataaacctgttgcgagatgatgacttgatcactttagttatgatagaatggttgggaagagagtgcagtaatacttttcgtgttatcaaggtaagacttgattgatttaatgaagagggtaaaaggagttagagataacatttgaatttttggttttggtgactgatggtggtatttacaaatgagttagggagtataggaggaggatatggaagaggggcttgaaagattgaattgagttttgttcaagcttgagatgactatgatatccaggcaggcatattcaggagacagttggatttatgtttttggtgggtagaagagtcatggctggactccttttgtttctggagacagggtcttgctgtgttgcccagtctggagtgcagtgagtggtgctgtcatgcctccctgtagcctcccaggcttaagcgattctcttacctcagcctcccgagtagctgggactacaggcatgtgccctaccatgcccagctaattaaaaaaaaatttgttttttagagatgggtctcactatgttgcccaggctggtcttggaatcctctgacctcattctctcaaagtgctgggattacacatgtgagctacagtgccttgcctggactctttaattgtatttaattttacatagtttgacgcaatattattcaataaatggtagctattactagcactatttttattattatgtggctggtatttaaagcaaccagtagatgaaactttctaaaaaaaaagaaagagtaaaaagtaaaaggagtgggctggaagctagaacatttaatagatggatagataaagaatgagtatagaatgagattaagaaaaagcagaactaagacaagctctgatgaagtatgatgagtttatataagaatagtcaataatacctgatgcaacagagatatctagtaaagtaatgcctaaaagggtcccctgtatttgaatgggatgtcagtggcgccctctgccaggcaaatcacagtgcaaatatggagacagaagccagaaataaaatgtattagcaaataaatgggaggttgatataacatgggccggttttgctgatgtgacccaagagctaagcagtgatatcaatatcttccaattccaaattttaaaatgtcctttaataaaatatgtggctagtcattttgaacaattatcagtaaaatttttaaaataaaaagcataagaaaaattaagaatacaaagagtatagttctattttaggtatttaggtttaaatctagtttaattctttcagctttctctaattgagttttaatcctcgtttactttgctaatgagatttaaaaatattattttcataaaccttgtaactttttgcttttttattctaaccctgtgatttactcttaatctatttctttataagcttcttaaatttcagtccagctttagtctcaaacattgttgtagtgattaatggttttgcccccccattttcttcctttgtaatatattttaatcaacttttttttaaattggaagagccaattaaatatgttgtttaaaatcttgccatatccacactgtctacctgattggttttgccaattctgtaaaactttacttgatactgttgggattctttggactatgtggcaatatttgtagatttatagaaattttactgatttaattcttggaaggcaattttagttccaagtatttatagaatattttattgtcatctgctatgtaccaagtcttaacttgacattaactgtgcaacattaggcatggcacctctcttatgactgtcctatttcagaacttcacagtctgttcctgcgcctttcaaggcactaagctctgtgctatgctgatcttcagaggaggagcacatttgaataaaaagtgtttgtttcagtctcattaaaaggctcttataaaagttatgaacatttaaaagtgccctttcctccctttttgagctaattgaattcttcattttataggggtagaagattccaggaagagggggcagggatgagtatttatcataattgttaaataatgcgctggacactttttgtgtaatgttatttgatctggatagcaaccctgtgacataggcaggtttatcctcattagagaaattaagtggcttgcccagttcagaaaacaagttaatgtcagaatcaggatgatattgcaggttttttgatttgtatctagtgatttttttcactcagttgttctctttgtaggggctagaggcagaataaagaggccccttccctgtgctccctcttgcttccccgtcttctattctttggagtgtatgtcatttttctccagtaatttagggcagaaaaaaatgttgaggactaccactgtaccattttgttgtctctgatttttaggaactatgttcatggtaagaattgattataaaagaatacctatctatgccattagaaaacaaaacatccaaaatataggctgtgctttgcatcattctatgaaagccatggtgggaagttgggttatagctttctactaagttgaaagtaggctctgtcgcctaggttggagtgcagtggcacaatcttggctcacttacaacctccatctcccaggttcaagtgattctcctgcctcagcctccccagtagctgggaccacaggcgcctgccaccacgcctggctaatttttgtatttttagtagagatggggttttgctgatggggtttcgctgtgttggccaggctggtctcaaactcctgacctcaagtgatctgcctgccttggcctcccaaagtgctgggattataagcatgagccactgcgcccagctaatgatttttaataactttatataatactgataaatcactcttttttttttttttttttaagacagagtcttgctctgtcacccaggctagagtgcagtggctcgatctcggctcactgcaagctctgcctcctgggttcaccccattctcctgcctcagcctcccaagcagctgggactacaatgcctggctaatttttttgtattttttttagtagagacggggtttcaccatgttaaccaggatggtctcgatctcctgaccttgtgatccgcccgtctcggcctcccaaagtgctgggattacaggcgtgagccaccgcgcctggcctaaatcactctttttagtggactctaaataccactgtgatttgataccccttttattcatttataaaaatacataaacagcttccttttttgatgtttaaaaattttatagtcctttctgtcttgaatttgcatttctgttatacttttcacaccagattctattcttatatgatgtattttatgcataagttatattttgcctgtaacatgcatacattatgaaggtagtatatttttatgcattacagtctttcatgcatattgattaccctattatatgtctttgcagccagccaaaatgtgtaaattttaaaatatctcttagtcattaaattgtaattagcacacggtaaaataacaaatgtattaaaatgttgctaaattattttttatttattaaaaaaattttttttctccttctctgccttcaaaatgttgcttctctgccttcaaaatgttggtacattattaaacagaagaaaataggccaggtgcagtggctcgcacctgtaatcctagtactttgggaggacaaggtgggcggatcacttgaggtgaggagttggtgaccagcctggccaacgtggtgaaacttcgtttctacttaaaatacgaaaattagccgggcgtgggggtgcatgcctgtagtcccagctattttggggactgaggcacgagaattgcttgaacccagcaggcagaggttgcggtgagccacaatcatgccactgtacttcagcctgggtgacagagtgaaactctgtctcaaaaaaaaaaataaaaaaaaaaaagtttcacagacaaaatatgaatcattccttgtttaacacttaaaaggtttttatactcaggcaatagaatagtgtatagtttcattcacaataggtgaggagtatgtcatcctttttatattaataaaaagtgagaggagcccagatggccgaataggaacagctccggtctacagctcccagcgtgagcgatgcagaagacgggtgatttctgcatttccatctgaggtactgggttcatctcactagagagtgccagacagtgggcgcaggtcagtgcgtgcagcgcaccgtgcatgagccgaagcagggcgaggcattgcctcactcgggaagcacaaggggtcagggagttccctttcctagtcaaagaaaggggtgacagatggcacctggaaaatcgggtcattcccacccgaatactgcacttttccgacgggcttaaaaaacggcacaccaggagattatatcctgcacctggctcggagggtcctacgcccacggagtcttgctgattgctagcacagcagtctcagatcaaactgcaaggcggcagcgaggctgggagaggggcgcccgccattgcccaggcttgcttagctaaacaaagcagccgggaagctccaactgggtggagcccaccacagctcaaggaggccttcctgcctctgtaggttgcacctctgggggcagggcacagacaaacaaaaagacagcagtaacctctgcagacttatatgtccctgtctgacagctttgaagagagcagtggttctcccagcacgcagctggagatctgagaacgggcagactgcctcctcaagtgggtccctgacccctgacccctgagcagcctaactgggaggcaccccccagtaggagcagactgacaactcacatggccgggtactcctctgagacaaaacttccagaggaacgatcagacagcagcattcgcggttcacgaaaaaccactgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacggagaatgactttgacgagttgaaagaagaaggcttcagacgatcaaactacgagctacgggaggaaattcaaaccaaaggcaaagaagttaaaaactttgaaaaaaatttaaacgaatgtataactagaataaccaatacagagaagtgcttaaaggagctgatggagctgaaagccaaggcccgagaactacgtgaagaatgcagaagcctcaggagccgatgtgatcaactggaagaaagggtatcagcaatggaagatgaaatgagtgaaatgaagcgagaagggaagtttagagaaaaaagaataaaaagaaacaatcaaagcttccaagaaatatgggactatgtgaaaagaccaaatctacgtctgattggtgtacctgaaagtgacggggagaatggaaccaagttggaaaacactctgcaggatattatccaggagaacttctgcaatctagcaaggcagccaacattcagattcaggaaatacagagaacgccacaaagatactccttgagaagaccaacaccaagacacataattgtcagattcaccaaagttgaaatgaaggaaaaaatgttaagggcagccagagagaaaggtcgggttacccacaaagggaagcccatcagactaacagcggatctctcggcaaaaactctacaagccagaagagagtgggggccaatattcaacattcttaaagaaaagaattttcaacacagaatttcatatccagccgaactaagcttcataagtgaaggagaaataaaatactttacagacaagcaaatgctaagagattttgtcaccaccaggcctgccctaaaagagctcctgaaggaagcactaaacaaggaaaggaacaaccggtaccagctgctgcaaaatcatgccaaaatgtaaagaccatcaagactaggaagaaactgcatcaactaacgagcaaaataaccagctaacatcataatgacaggttcaaattcacacataacaatattaactttaaatgtaaatggactaaatgctccaattaaaagacacagactggcaaattggataaagagtcaagacccatcagtgtgttgtattcaggaaactcatctcacatgcagagacacacataggctcaaaataaaaggatggaggaagatctaccaagcgaatggaaaacaaaaaaaggcagggcttgcaatcctagtctctgataaaacagactttaaaccaacaaagatcaaaagagacaaagaaggccattacataatggtaaagggatcaattcaacaagaagagctaactatcctaaatatatatgcacccaatacagaagcacccagattcataaagcaagtcctgagtgacctacaaagagacttagactcccacacattaataatgggagactttaacaccccactatcaacattagacagatcaatgagacagaaagtcaacaaggatacccaggaattgaactcagctctgcaccaagcagacctaatagacatctacagaactctccaccgcaaatcaatagaatatacatttttttcagcaccacaccacacctattccaaaattgaacacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaaatagtgtgtagagggaaatttatagcactaaatgcccacaagagaaagcaggaaagatccaaaatttacaccctaacatcacaattaaaagaactagaaaagcaagagcaaacacattcaaaagctagcagaaggcaagaaataactaaaatcagagcagaactgaaggaaatagagacacaaaaaaccgttcaaaaaattaatgaatccaggagctggttttttgaaaggatcaacaaaattgatagaccactagcaagactaataaagaaaaaaagaaagaagaatcaaatagacgcaataaaaaatgataaaggggatatcaccactgatcccacagaaatacaaactaccatcagagaatactacaaatacctctacgcaaataaagtagaaaatctagaagaaatggataaattccttgatacatacaccctcccaagactaaaccaggaagaagttgaatctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatacccttgatgaacattaatgcaaaaatcctcaataaaatactggcaaaccgaatccagcagcacatcaaaaagcttatccaccatgatcaagtgggcttcatccctggatgcaaggctggttcaacatacgcaaatcaataaatgtaatccagcatataaacagaaccaaaaacaaaaaccacatgattatctcagtagatgcagaaaaggcctttaacaaaatttaacaacccttcatgctaaaaattctcaataaattaggtattgatgggacatatctcaaaataataagagctatctatgacaaacccatagccagtatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcatttttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttagagatttaatgccatccccatcaagctaccaatgagtttcttcacagaattggaaaaaactactttaaagttcatatggaaccaaaaaagagctcacatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatggagaaagctgaaactggatcccttccttacaccttatacaaaaatcaattcaagatggattaaagacttaaacgttagacctaaaaccataaaaaccctagaggaaaacctaggcattactattcaggacataggcatgggcaaggacttcatgactaaaacaccaaaagcaatggcaacaaaagccaaaattgacgaattaaactaaagagcttctgcacagcaaaagaaactaccatcagagtgaacaggcaacccacaaaatgggagaaaatttttgcaacctactcatctgacaaagggctaatatccagaatctacaatgaactcaaacaaatttacaagaaaaaacaaacaaccccatcaaaaagtgggtgaaggacatgaacagacacttctcaaaagaagacatttatgcagccaagaaacacatgaaaaaatgctcaccatcactggccatcagagaaatgcaaatcaaaaccacagtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactataaatcatgctgctataaagacacatgcacacgtttgtttattgcggcgctattaacaatagcaaagacttggaaccaacccaaatgtccaacaatgatagactggattaagaaaatgtggcacatatacactatggaatactatgcagccataaaaaatgatgagtttatgtcctttttagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagcgatagcattgggagatatacctaatgctagatgacgagttagtgggtgcagcacaccagcatgtcacatgcatacatatgcaactaacctgcacaatgtgcacatgtaccctaaaacttaaagtataataataaaaaaataaaaataaataaaaagtgaattttaggccattttctgttacttagaatacctgaaactgggtattttataagaaaaggaatttatttcttacagttatggaggttgagaagtccaaggtcaaagggctgcacttggtgagaaccttcttgctgatagtgactctacagattcctgaggtggtgcagggtatcacatggcaaggggcctgaacctgctaatggtagctcaggtctcttctcttcttttaaagccaccagctcccctcccatgataacccattaatccatgaatggattaatccatttatgaaggtggagctctcatgatccaattacttcttaaaggccccagctctcaatattgccccgttggggattaaatttcaacatgagatttgaggggggtcaaatattcaaaccatagcagtgggtttaaaggtacttgtgaaagaggagaccagagaggaaaatcaacatgacctttcaaatggacctatgatccattttcaggcagattaattttaaattttatgaaagggttgagtatgaatgagaattgaagacctgggaattgttgtccattgttgtttatctatttctgtgtacccttcagaaagtctgtttaccttcagcagtacaaatatatggtactgtgaaagatccctgatctagtatttatagcaacctgtattttatgaccagagaaactgagacttaaagatgtagagtacttgcctatggtcacttagctagtaaatggtcaatcaaaaactccaaaacttgaggccgggtacggtgactcatgccagtaatcccagcaatttgggaggctgaggtggttggatcacttgtggtcaggagttccagagcagcctggccaacatgttaaaaccccttctctactaaaaatacaaaaattagccaggcatggtggtgcgtgcctgtaatcccagcttctggggaggctgagacaggagaatcgcttgaacaggttgcactgagtcaagatcgtgccactgcactccagccttggtgacagagtgagactctatctcaacaaataaacaaacaaacaaaaaacacacaaaccctccaaagcttttctttccctcctgtgtcatgctacttagtacatagcctggttcacagtatatgattactatatatttaatgaatgatttacatattatttgtgaagtccaaaatacttaacgttgtagttgttccatcagttttgaactgctgaataagtgtgacattacagatgattcactacagaagaatattgaagatcttcaaagcattgttaaggtgatctcctttcagttcctggagtggtgttcctggaaatgactaatagaacagcaaaaaaccgtctacttgggcattcttggtgttttatcaattaagtcagagacctataacagtgttggagtgcttgttttgaagaggtcagctaacttacgttgacactgtgtgtgtatgaagagtgtaattttcgtttctgttatacaggtattctctgaaaccaaatgaccaaatcttggctgaagacaaacacaaggaactgtaagtgcattaaaccattggttgtaaatagtttactctgtctatgaacttgatatatgtatatgtaaattatctgattttcaaaattatataatgacaaagtataattaacactatgaccttaatcctaacaattatgataacctacactatataatttacactacataaagtttacacaggacataatttctcctgtattcacattaaaagatgtagtgttgtattccatcatctagactaaagtcttactgggaaatatgtcatgctattttctctttccagataaaatattaaattgttcctattttctttctgactgctctaccagaaaaaagtaaaaaataaaaataaattgtcactcttaatttttgggtcttactccggtggatcacccaccttcatggtaatgatagacaaatataattttgtttctgtcactggtttatgcaaaagtaaatgtcaattgtttggtacaaggtaaaacactttattttatttttatttttttgaaacagagtcttgttctgctgcccaggctggaggcgcaatctcggctcattgcaacctctcattcctgggttcaagcaattcccctgccttagcctcccaggtagctgggattacaggtgcccgccaccatgcctggctaaattttgtattttaagtagagatggggttttgccatgttggccaggctggtctcagactcctgacctcaggtgatctgcctgccttggcctcccaaagtgctgggattacaggtgtgagccactatgcctggctgaagacattttattttcacatctaactcaggtcgctcttggtttagtttaatgtaaccttcacttgtactcatttatagggacagtaattttttttcgtagaggacttcaagactattattttcttcttgagattaagtaataatttttttccaagtacttttaaactgctttttaaaaactgtcttgaaccttttgtaaattattttcttctctcctatttaaggtaacataaattgttaattataaaatggcaggaccaatgttcagggaaaggattttcttatgcgttcttaccgtttacacattccactattatgctaacctttcatcagtatttttatatttggcctatccttatttgagtataatctccatagtgggttctcaaatatatatattgtcaagaaatttttttgctctttctttatttcctagtatagtcagtgagggccggtgattgttactgtagcattggttggttattatttataggtctggtaacagagcttcttttgctttgggaattaagtagttggtgagccttaaaagttcctttagtccttagactatgaccaatattaaaaataccagaaatctgcttttaaagaatatgttatttaatatgtaacccattttaatgttttaattcatttgaaagtttttttaactgtccaagatataattcatctctatgggtataacttggcgaactgatacttttttcttacctttttttttgtttttttgagacagactcttgctccgtcacctaggctggagtgtggtggcatgatcttggctcactgcaacctctgcttcctgggttcaagcgattctcctgcctcagcgtcctgagtagcagggattacaggcacccgccaccatgcccagctaatttttatattttagtagagatggggtttcgccatgttggccaggctggtcttgaattcctgacctcaagcgatccacccacctcagcctcccaaagtgctgggattatcacaggcttgagccaccgtgcccagcccctacattttattacgaaaagttttaaacatatgttatgtgttcacccatatatttaccaccaaggttttatcattaacatattactgcacttgttttatctatttattcttctgttcgtgcattacttcatctgttttttggatgcatttcgaagtaaattgtagacatcaatatgcttctctctaaatatttcaacacatataccattaactagagttttatatttcaaagttttttttttttagtttcacctgttctaaaatttcttataaactgagtcatatatatgtcctattttgtataaggcttctgtcactccctgtgtttttgaaattcatcagtgttgttgcatatatcagttaattccttttcatttttgcagattaacattctgttgtttatttgttctattattgctaagtattgccacttgtttgatttgtcattattgatggtcttgatatttttggctgctggctctcttccttgtagtttttgacctacataccaaagaaaactttcagttgaatatggcaccataaaagcagagtattaattttaaaaaattaaaacagttattgaattaatgaatttcatgaattatgaaagctgtttataaataatctcatttgtgtctttgcaactcaaatagccaaaatcttggtagggtggtggtcatggaagtcagagtctgctaaggagtgtataacaactcacctgctgtattaaaaacaaaaaaatctttttgtgttcaagactaagctttaaacaatataagagatatggatataaaacaaaattttatctaatcagtaattccatgctttattctcataaaacattattacaacttcttaatttcagtctgttaaagcttgattaattataaaattgtaaaaatgtgttggcaccatcacattgacctgctctttgaaaattaaccctaattctataagagtaccaataagagagtacagtgatagctctaattatcttgatattaataaataaagagtggcctggcatggtggttcacatgtgtaatcccaacactttgagaggctgaggtggaaggattgcttgaggccagcagtacaagaccagcctgggaaacatagtgagaccccatctctacgaaaaacttaaaaaaggccgggcacggtggctcacgcctgtaatcccagcactttgggaggccgaggtgggtggatcacctgaggtcaggagttcaagaccagcctggccaagatggtgaaaccctgtctctactaaaaatacaaaaattagccaggcatggttgtgggtgcctgtaatcccagctactcaggaggctgaggcaggagaattgcttgaatctgggaggaaaagttgcagtgagccaagatcacgctactgcactccagcctgggtgacagggcgagactctgtctcaaaaaaaagaaaaaaaaattagcctgatgaggtggtgtgtgcctgcagtcccagctgctcaggaagctgaggcaggtagatctcttgggcctaggagatcaaggctgcagtgaaccatgatcattccactgagctctggactggacagcagagtgagaccttgcctttaaaaaaataaaaaaagaataccaataagagagtacaatgatagttctaattatcttgatattaatgaatattaagtatgttttcattaaaacatttttagttcctgaaattttgtgattcagatttcatatacacttagtcactgatgcttcacgagtatacttgtttctctgtctgaggaagattggcatgggaaaacagggaaatattggtcagcagtgacacttgtttttctaagcaaagtggtttttctcaacttcctgtttttcattattctacatactgaagaccttgggggatgattttaagtagagaaagctgagcaattcaagttgtgatgtgatttatctaaaactataggatttatagtttgttctatacatgatccagtaatcaactggtttcattagctttctagtttttttcagttttagttttgtaaatggaataatttaaaataaattaggaaaacatcactattttactaagtattttttcacctactttccattgtgctaggcattaaagaaaagatagtgtgcagctttttatatgtcaattatacttcaataaagcggtttaagaaaaagtaaaagatactgattttatttataaatggaatcttactctccaatagtggcttttcaaaatctttggacacatctgcagttattgaaaatagaaccattttgtttccatgaatatctattttatgaatatataaattttgtattaccttggattatgagatctgatcatatagatttaggtaaggaaagttaaaagttgtctggagttaggggtgaattccaaatgcaaatataaataaattcagaagtatccatactacttaacacagagtaacctggtatctgaagattttttttttgtttgctataaggcaaggggaaaatctctttaaaagggattcacatttatttacttggctttttaagatagctaccaaggtaaacagtgaacttttgtaagcagtgtatactgttctaaatatgaagtgtattttcccttctgatagtgaatgaattccattatgattttttaatgtcaaaaattaaattattttgtcagaataaccccttaaatttttaaatgttgtcttataaaagttaattatattgtgatatttaaatgcttgccaatttacgattatgatgagatggaagaaaataaataaattatgcaataggcatgaaccttcaagggtattaggacgtgctcaggatatgatctttggtgcagtgtaaaaatgtaatttcttagtgaataggtcaatttccaaaccagcaggaaagttataagtatttaaatggaatgtgtagggatatgtcagggaagttagagacaataacatctggtatgctttttttttttttttttttttggtgagatggagtctcgctctgtcgcccaggctggagtgcagtggcgtgatctcggctcactgcaagctccgcctcctgggttcacgccattctcctgcctcagcctccagagtagctgggactacaggcgcccaccaccacgcccggctaattttttgtattcctagtagagaaagggttttgccgtgttagccaggatggtcttgatctcctgacctcgtgatctgcccgtcttggcctcccaaagtgctgggattacgggcgtgagccaccgcgcccggtctggtatgctcttaaattaattgttaatgctgtgacttagcagttctttgaaatcatcaagatcatagactgggcttgtgcctataatcccagcactttgggaggctgaggcaggaggattgcttgagtctacgagttggagaccagcctggacaatatagtgagactcttgtctctacaaaaagttaacaaaagtagccggatgtggtggtgcctgcctgtagtcccagctacttgggagactgaggtgggaggattgcttgagaccaggaggtccaggctgcagtgagctatgatccgtgccactgtgctccagcctgggtgacagaatgagaccctgttaaaagaatcttttttttttttttttttggtaagaatgagctaagaactggatatctgtaaagctaatagaaaaaaatcctgtgaagcaaaaagtcaaaattgaaataagctaggaccgacagcaaggttaaatgcttatttttttttagtgttcataaataaggtacagttttaaaaatatcataaacatttttatgatcctattctcagggcccggttttttttgtatctttaaaattatagtattttgattctagaaatgaacccttgaaccaatatccgtattttatcatgaataaggtgagagtaacattgataaaatgacttgctatagtttacattgctacttaaggacagtactagaccagaaaccaagtctcctgagtcccatttaagtgctgtttttgtcacaccaagcagttctctaagtatatagtcttttttttttttttgaaacagggtctcgctttgtcacccaggctagaaaacagttgcatgatcatggctcactacagtcttgtttttagagatgaggtctccttatgttgctcaggttggtctcaaactcctgacctcaagcagtcctcctgcctctgctcccaaagtgttatgattacaggcatgatctactgcacccagccagtaacttttttttttttttttgagacggagtctcactctgttgccaggctggagtacagtggcgcgatcttggctcactgcaatctccgcctcccaggttcaagtgattcccctgcctcagcctcctgagtagctgggactacaggtgcctgccaccacgtctggctaatttttatatttttagtagagacagggtttcaccatattggtcaggctggtctcaaactcctgacctcaggtgatccgcctgcctcagcctcccaaagtgctgggattataggcgtgagccaccgcgcctggccgccagtaatttttttttttaaagggattaatatccattgcaagacttggtaacggatcacagagaactcattagttaattaaatcagtttcacagtattgtgttttggttttggaaatcacttcagacctataaccaatattgagtgagttgaaaagaattaattacttccaaatacaaggcactttacattcttctaaggagaggatgcaacacaaagctatttggtcagcttgatacaaaagctcttaggtgtgctcatgaagtaagtcaaatgtatacattttacaaccacatattaaatagaattagttttttctttttccttcccatttctttgaacagtcttattcagaatcttcatcattagcaactttgtcatcattggagcccttttctctagaacacatcagcctctttctatgtatgatattttcgctggaaattttatcctgagctataaatgcctctcatgtaagaaaagttttttttttgttttttttttgagacaagatctaactctgttgcccaggttggagtgcagtggcgtgatcatgactcactgcagccttgaccttgtgggcttaagcaatcctcccatcagcctcctgagtatctgggactaccactgtgcaccaccacacctggctaatttttgtattttttgttgagatggggtcttgccatgttgtccaggctggtcttgagctcctgggctcaagtgatatgtctgccttggcctcccaaagggctgggattacaggtgtgagccaccatgcctggccaagaaaagttttttttaaagtttatttttgtatgtagtcataatacttgtaaggtaaccttttcactgtattgctttttaaactaaggtttaaatagttcattgtaataagagttaccgtttgtgcttataaggctgcatctccaggagtaagtactaaatctgtgttagatttctttgctgcttttttttgtttgtctttttttttttcttttactgatatggtcaggtggtcaggttacttccgtaaggatccaaaactagagttgattgagatcatttcaggcttatacataatctacaaatgattctcaaccaattgagatctgagttcacctcttttgctgaacttttaattgtgatcttactgtaaaattctaggatctcataacttctatgaaatttttatacctggattataaaacttcggaaagatttgcttaaatattttgttgcttaaaagaaaataattggccgagtgtggtagctcacgcctgtagtcccagcattttgggaggctgaggcaggtagatcagttgagctcaggagtttgaaaccagccttggcaacgtggcgaaaccctgtctctactaaaagtataaaaaaaattagctgggcatggtggcactcacctgcagtcccagctactcaggaggctgaggtgagaggattgcttgagcccaggaagttgaggctgcagtgagcaaagattgcacaactgcactccagcctgggcaatagagtgagaacccgtctcaaaaaacaaacaaacaacccccccgcaccccccccccccaaaaaaaaacaaacagaaaataattaacactgtcatcaaggaaggtaactcattataaggatttaaaaaaaaaatttttttttgagacggagtcttgctctgtcacccaggctgaagtgcagtggcacaatcttagctcactgcaagctccacctcccgggttcacgccattctcctgcctcagcttcccaagtagctgggactataggcgcacgccgccacacccggctgatttttctatttttagtagaggcagggtttcactgtgttggtgaggctagtctcgaactcctgacctcgtgatccacccgccttgccctcccaaagtgctgagattacaggcgtaagccaccgcgtctggcctataaggaataattttgtgattaaacatggtcttatattcatgaacgataggtgaatgaaaaatgtgtgttattggtggtaaaatcttaaaatccttaaagaattaatttaaattgctaccttctacttatgaagcactatatggtgccctggacttagcattagaagaaacttagtttatgtatgagttttgccataggctgtagtcttggggtattagttagaattcaatgccactatgatattaagaaatttattacaggaattaaatcttattcaatcatgagaaaaactggggatattaaggtccctaaaatgtgagagaaaaatcgctaaactgccttttgatgtaggttaatgaattgcgtgttctgttaatagggaaactgtgaaggaggttcgtgtgttgtgggctctttgcaactaccacctttatgggcctttagtgaaaaatctggtgataggcttggtcctggtagttgtggacgtaaggtagagtggggatgagtaaggacagattacagttctgcccatacctttgtgtctgtccttcctgcctctaaccaatgactgcctttggaatgtaatggctactgcttcaattgcatcccctaaattttttgcaaatttctcttgtgacatatcttaagctgaaaccatataggagaggaaattaggggaagtgtactccttcttgacatagtttaataccttaactttgtttaatcacttagtcttccaaacttaagttcctccgatatcattttgggtttagattagtgcttttctgtcattgtccattaaacaaatgatttctttcattacctacttctcttttagtctgttcagtgatccctctgggtatagcttctgaatttctagcataaaactcttcaacaataacaaaaaaggataatgatctttcctgtcaatttttagggggaaggataaggtgtttcctagaaactttattcagagcactttagtcaaagtgtagttcattgatccttaactgcaatttacttgacaagatatatttatgggatgaaatttattgagggtaacagaatggagagagaaactgctggtgtgatgaattctctttcttcttggtctacaacaaacagaaatattttgagaatgtagctatggcagattttaatgtaagagttatgccaacactatttccccttaagggttgagtcagaccttttgggaatgatatagacttgggggtcttgagtgaacttttagtatttattagcagccaatctaaccttgaaaactctatgttgatttctttttggaaagtgttgaacaattaaataatacatgttaaagaacaaggaagaagggcattgttttaattattttgtgatctaatttaatccccacagcaactctgtgaagcagatattgtaatcattcccattttacagatgaggaagagacttcgtaacttggtttatataagaaaaggatagaactgtttagatctttttgattgctttccattttgtataagttcagtgacttaggaaccttttttaaaaaacttctttggaggagtgatattgttcattatgaacatacctacttgaaaagtatttaaaggtatttttcatggaaattatattttataagttttagtatggttcactagaaatacgtcacaatttgtaggtaatactgtgttttattttgagttggctaattgttaaggtaaaactttagaggataaagtgagctcatattgatgaatggtaatctgatatttccaacagactaggtctttttttgaagttcatgtattataactttattctttgtgatactagctccctctgtagaacttcaataagattgcaactggactttttcaataatttagaaaagtgatctaaacattatctataacatttccctgtaaaattttactttgtattctaatcagttgcaagtgggtttttaaaagtataaatgtaacatttataaaaatgtttcactttgtacacacaaagttttaataacatatacaaaataaaactttcttcaaacattcctataactttaatgcttttttatttaggaaggctagagagaggtgtgatttctaggtctgtaggtctgtgttgagtaaagcctgatggaagccctaggggaaaaataaattttgacgtttagctggatacttgaaattatcccttttttttttttttttctgaaactttccggtttgacttgggtgggaaaatgttcataagggattttttttttttatcttgtagagaaggggaaagcaaacttctacaacaggtagaaagagcaaagagaaaatcttagcaagatccagaaatttagtggagaattgcaggaaaacattcttgacatttacggtttaaaaaaattttcctttttctttttttcttaagaggtggtctcactctgtcgcctagactggagttgagtggcatgatcatagtgatcgttccacctcagcctcctaagtagctgggactacaggtatgtgccaccacgcctggctcctttttgtatttttagtagagatggggttttgccatgttgcccaggctggtcttgagctcctggactcaagtggtctgcctacctcagcctcccaaagtgttaggattacgggcgtgagccactgcaccctgctcacatatatgagttctatgagtttatgctgttgttggaaaatcctttgttatcaaagtctaccaattttcctgtgtgggagtgagcttacttattttaccaccactttttctcctttctttctgctatggtttgaatgtttgtcccctccaaaactaatgttgaaatttaattgccattgtaacagtaataagaggtggaggcctttaagaggtgattagatcatggggctctaccttcatgagtgcattaatgcaggagtgggttagttatctcttagagggttgttataaagtgagtctggcccctcaagcacttgcttgctgtttgccttctgccatgggataatgcagcaagaagttgctgagcagaagctggcaccatactctaggacttcccagccttcagaactgagaaacatattaatgtttctttcctttataaattacccaatctcaggtttctgttaaaagccgtagcaatcaaactaagacactcccctaaaccattttatattaaattgtaagttgtataattagctcttcaaagatgttttctcagacataatgtaagctcaatgaaggcagaggaaatatgattgacttgcaacatggaatttagaaaaatgagcgaactgatttcaaccataaagctagggactaaaacatacaaatgaggataagaaagaactgaagtacatatgctctttcagtttctaaaaatttaactgtattttcttctaagtagattgaaggatgttcttaggattatgcttgagtaggcttttaaacaattttgtgtggataattatctttgaagcctttgttagtactaaacatctttattctgttataatacagtttattcaaacagacgtacagtgtgtattgtggcacaaagaaattcaagaatgattcttattctttttgtttgttggccttgactaaatttgataccagataattgctttaaaggataggccaattttattggtataacaaatctacccttcattatccataaaccacttatatagtaatctggttttcctatacaggcacaccttggagatattgggggtttggttctagactatcacaataaagtgaatatcacaataaagagaaatacatgaagattatattccccagtgcatataaaagttgtggtgatatcacactgtaatctattgtatacaataacattgtgtataaaaaatgtatatgccttaatttaatgtaatctattgtatacaataacattgtatataaaaatgtatattccttaatccataaaaatactttatggatgaaaatgctaacaatcatctgagcctttagcaagttacaatcattttgctggtggagggtcttgcctcagtgttgatggctactgactgatcaggatgttggttgctgaaggttggagtgtctgtggcaatttcttaaaataagacaataatgaagtttgctgtgtcagagccttcctttcatgaaaaatttctctgtaatatgcaatgctgtctgatagcatgttacccacagtagaatttggaaaattggagtcagtcctctcaaaccatgctgttactttatcaacttaagtttatggaatattcaaaattctttgttgtcatttcagcagtgttcacagcatcttcaccaggagtacattccatcttaggaaaccactttttttgctcatctataagaagcaactccctgtccattcaagttttatcatgagattgcaacatttcagtatccatcttcaggctccacttccaattctagttctcttgctatttctaccacatctgcagtgacttcttccctgaagtcttgaagcgctcaaagtcatccacaagggctggaattcacttcttccaaactcctgttaatgttgatgttttgacctcctcccatgaatcacgaatgttcttaatggcatctagaatgatgaatacgttgcaggaggttttcattttagtttgtctgatccatcagaggaatcacggtctatggcagctatagtcttgcaaaatatatttcttaaataataagacttgaaagtcaaaattacttcttgatttgggggttgcagaatgaatgttgtattagcagccatgaaaacagcattcatctccttatacatctccatcagagcacttgggtgactgggtgcatcatcaatgagcagaaatattttaaaaggggccaggcatggtggctcatgtctgtaattccaggactttgggagactgaggcaggcagatcacctgaggtcgggagttcgagaccagcctgaccaacagggagaaaccccgtctctactaagaatagaaaattaggtgtggcagtgcatgcctgtaatcccagctactcgggaggctgaggtaggagaatcgcttgaacccaggaggcggaggtcatggtgagccaagattgcaccattgcactccagcctgggcaacaagagtgaaactccatctcaaaaaaataaaagcctagcctcccaaagtgccaggattacaggcatgagccaccgcgcctgtctgtccgcccgtcttcttttttaagagcaagaaaaggtttcccagaagtactctggtagattcttatcacacacacattcctaaaccagttactggcaaagaaaatagaattatcatgattaattagcatattctgaagtacatgcttccttataactgaacaaaaattagagctccactggcaacgcggaaatggctgttgacttggcaactaatagtgaattgctcacaatgtttaagtgaaatggcctgtcagatttcctgggaacacaggaaccagggccagacttagaaacggcctcagtaagaggttttctaaaactattttctggtatcgtaattattcctaattaccttgtgcactaaaaaaatttaaaaattttaaatttagaattttaaacacatttcctgacagtaaccaagatataaaaatgtgtaaaattgagtgaatatattttaaagcatggaagatttgtgttaccctcagacttgaaagggaacctgcaaagttatggtctcatgggaaatattgtttctttttgccttgacataattttcaggctctttggttttattctaagcaacccagcagggcacctttaaaaagaaacaaacaaaattactgtctctaaaccaaagaagatagaaaaatacattcaggagaatagtatacattgaaaactgccactttagctagtgcttttttttttttttttttttttttaagacggagtctcgctctgttccaggctggagtgtagtggtgcgatctcagctcactgcaacctccaccttccagtttcaaatgatacttatgcctcagcctcctgagtagctgggattacaggggccagccaccatgcccagctaattttttcatatttttagtagagagtactttttaactgagaagagatgctgtaaagttttaggaaatcacagtggggacagtagtcatacttctactttcttctgaatataatattgtttcttttttctcctgcagttacttattttttttttctttttgctttaaggcttggtagttctgagaattttagattcagttataatcgaatgtaactatcaacacatgttatggagtagtataaattgttacttgatgtttggagttgttttactcagtcactcagcaaaggtaagattagatctccgttagatgaaaagtattatctcttatgcaaagagacattggttagctctggatgaagacaatggctatggggtcagtcaaccttgtagaaagaataggctaggcacagtggctcatgcctgtaatcccaccactttggggtggtcgaagccagtggatcacttgagcccagcagttcgagaccaaactcggcaacatagtgagagccccctctctacaaaaaatttgaaaattagccagggcatggtggtgtgtacctctggtactagctatcaggaggctgaggtgggaggatctcttgacctggggaggttgagtctgcatgcagtgagccatgattgcgccactggactccagcctgggtgagaaagtgagaccttgtctcaaaaaaaaaaaaaaaaaaaaaaaaaagacacaataaaagtaaaattgtataatctctggaaaaaacaaaataggctgtcatgttctaatactcaatatgtaaggatgtttagtatattagtgggtataattattaataaaatattctatttagttatctttgaaccagtttgtaataaccaaaccacaaaaattcaatttgctttgtatgtaaaaatcttttaaaatagaaagtcctgccttaactttcataaatctgaatgtgagcatatatttatgcttttcatttctttgcacagctttttttttttttcctctaagacagagtctcactctgtcactcaggctggagtatagtggcacgatctgagctcactgcaacctctacctcccaggttcaagtgattcttgtccatcagcctcccaagtagctgggattacaggtgtgcaacaccatacctggttaatttttgtatttttagcagagacagggtttcgccatgttgtccaggctggtgcacagcattttgttgttgatgtgtgagacttgtaatataacagtaataatgctgtcatttcttaaagatgatatataatcctatcaaaatattcctgggaagtaggtatttgtcagcctgtcagtgttttccttttattttgtgtgtgtgtgtgtgtgtgtgtgtgtgtctgtgtgtgtgtgtgttttagtacattctcccagatgctgaaattttccctttaaactgttactatgatgtatgtcttatttctttctcttttttggtcctaattatgctctcaggagttaagacagtataaaattatgttttttaaaggaaacttcatcaaatacttggaaattagcaaatattttttagaggtagaaactgtcatttatattcctaagacttgtaggccattgtatttgttgactgactgatttgactgagaacctagtgtgtgataacgtgtcactgtttctgtcaacttatataattgagggtctttttaattgttcttaccttagaccactatatacttgtggtcttataaagtatatttgaaaattatatgcattttcatgttttgtctgggcctgggaaaaatatttattttaaaactgtaacatcttaacctttaaaacccattgtcagttatttggaaaaattagtattatatgatatgaagcacttctttttattgctgatttcaggtttcactatctgggaaactccggtgtggagacataggtctgttaactgtcttctttgttttatctggaatgttttattgatactataaaacaaaacttatcagtaagactgatttggaattcatattgtttgacagcattatcactgtcaataattatccattgtcagtatttgtaaagcagaataaaagaagccattatttaagtttaattcctgagatgattcagcatacggtgtaatatcaatctgtgggaattttattttaaactttttcttagtaaagtttactttttagagctgttttaggttcattcacagcaaaattgagcaaagatacagagatttcccataatcctcctgccctcacacatgaatagcctcccccattttcagcatcccccaccagagtggtacatttgatacaattgatgaaccaatattgacacatccaaataaaactattttttggggaggggagacggagtctctctctgttgcccaggctggagtgcagtggcgagatctcagctcactgcaacctctatctcccgggttcaagcaattctcttgtctcagcctcctgagtagctgggactacaggcacacgctaccatgaccggcaaatttttgtatttttagtagagacggggtttcaccatattggtcaggctggtttcaaactcctgacctcaagtgatccacccgcctcggcctcccaaagtgctgggattacaggcatgagacactgcgcccagccgataaaactcttagaacaagattaattgattgattgagacaaggccttgctctgtctcccaggctggagtgcagtgatgcaatcatagttcacagcagcctgcagctcctggcctcaagtgatcctcctgcctgagcctcttgagtagttgggactatagcttgtgctactgctcccagaagtctcttatttaatctgtctcttctaaagtatagatgtatagttcatacctttagaaatttctgagtttttatggtggttctgcaaataaacctgtttgcttcttatttctgccttcccttccttctgagcctttggtttttgattttctcttatatgctggttcagctatccttgtttctgttgctttaaagccttcaacatattatgaacattttccaccaaacatattgttcttatgagtacatcgtaattttagggcaagaagcagagatgaactttgctttaactcttttgtgttgaagtatgctaatggcaagcatgttttttaaatataaaagttgtacaagttgagatgtttaattcctttactttaagaaaaagcatcataattagaagggagaattgctgttatctggaaggtgttcagacagtttggggagaaaaaaacaaccaaaacagctgcagtgtaatttccataagggaatgggcttatatctttgtttatttgtgtttgttttccattgtacactcagtgcctagcacggggtaacacagtatgtgattaaccaacagttattggaaaaatatattttagtgtgttattttagataattaaaagtacatttaggaaatatgcaacctttttgtttggctttattaatcagctttaaaatgctgatgatagaagcaggaggcagagaaattataggcaaataggggtgggtccctggtgaaaccccacctccaaggtgaaaagcttgaaaccagcagcccaaagtgagaacttctattcctgtttgcctgcactgtcctgattggttctttctgaataatgtctttttaccaattgaatgttgccttttccaaagctacctatggcctgccccacccgcatcctgtgcctgtaaagccccggactcagtaggtagagaggagagattctgccagactttcgggaaaagagatggcttgacttcggggaagagactactgctgtacttcagggaagaccacctactcttcccgtcccctctccagctcccctctccactgagagccatttccaccgctcagtaaaattctccaccttcaccatccttcaagtgtctgcatcacttccttcttcttggatactggacaagaactcagaacccacggagtgcaggtacccaaaaaggctgtcatactggccctttgccctcgctggcggagggcagccaccccacgcaatgtggtaagggaccaactgagctgttaacatgcacacagacagacggcagagctaaaagaccactgtaacactttctctggggttttggggtcgtgggcaccctcacctgggtgctgctgtgggacctgcatggagctttctctcgctggctcctggagcagccggccaggtcctgcactctcttgctaacatgctccctcctgcagggggttgagcgctgtggcgtgagtaaactgtcgcccttgttgcaagtccaatgaagggaccaagaaaaatcctgcatcactgatatgaaatgtaccaaattaagtaacatcatcttatttcttctgattttgttttcagtttgtttatattcctttccataggtattatgtgtctgttttagttcataaaattgtggcctaatttatattttgaccattattcagcacactgttagtactcaggactaatttcagttgcttatttagacacatcgaaataaatcacattttaaggctgggcgcagtggctcctgcctgtaatcccagcactttgggaggttgaggccaggagttcgagaccagcctgggcaatatggtgaaatcccgtctctactaacaatacaaaagttagctgggcatggtggtgcacacttgtggtcccagctacttgggactctgaggcacggaaatcgcttgaacccaggagtcagaggttgcagtgagccatcacgccacactgcattccagcctgagtgagattacgtctcaaaaaaaattttttttaaacataaataaagaccacactatcttttttgaagattatgttcacatttcattctctccattgaactgtatagatgtattacctgtatataaagaatgtaaatttttttgtattaaaaatcgacaccttaaaaaaaaactaataccaccacaaggttaagctctgaggagatttcagctttacaataattacattgttacaataatgtttaacttctcaataattaaaaaccaaagcaatgttgcaaccttggttcaatattcaaatatatttttcttggtaaccaagctacttcactatttatagtactttataaatgatttagaattgttatgcagttttttcaaagaagtattcataaggtaaatttagaaaattattttaaaacgaaagtgatgcccaccagatggtgctatttcgcctgttttatctgcgacaataagtaggaaaaatgaatatagaacttcaaaaaagtgtatggaagatctagaatatttgggcattgtattttgggtgtagatgagctcagtggaaggaagcattcaaatattctaaacttgtgtttagtactgtatgtttatcttgataaaggtaaagatgaattcccagagttaatatgccagataaccttttatttagtctaaatgttaagtagattttttgaaaagttgacctatatgcaaattttattaacttcatagctgtatatgcatgaaaaatgaaattatttattagatatgtgttaccaaaatttgtttcaagatttctttatattgttaagtaaacaatattactatctcatttgagttacattgtgatttacaaattaagggaaacattttgatttttttatgtgtttgtaattattacccagaaacttaggcttgaattcactatttttacaaaggaaagagatgactcttctaaattaatttttgtattaggaagagggcaaactatgtggtacagtgttcacttagatgcagccattgaatgacgatccattagagtcaaaatggttagttagctaatgaaatacacttttcagtaaagctggaaagatttagccagctcttaaaagtgtttctaggattttaatgtagtctttttcccgctgattttattatcactctgtattcttctctggtcatgagattgaaccataaaagtcatgtagatgcttgttataagtatttgccaaagtcatcattgtcagtgattttattggcatgtgtgaaattagagattaaacttgcttttaaatcttgcatttgaatttttcttctggaagggtacatgtataactttcaatttaatgttcaattattggtaacagaatgaagcatctctctataggccagtaaatatatatagtagattttattgtattcctgtactgtttttgaatgaatattttactaattatattaacataatcctcatacatacccttaagattaggacctactataatgctttatttgaacttgtttcatagcatttgtcttttttaactttggattatagttttggaatataaatcagatccctcctacaaaaacataaagttcttcatgctttctctcattccacttatcacaatactttacatgtagtagatgaccctatatattttttatataaatgaatagttttgtcatgccaagtattgatattagtattagtgacaacaagtattcctcattccatagtttttgtttttgttttttttttttttgagacagagtcttactctgtcacccagggtggagtgcagtggcagaatttcagctcactgcaatgtctgcctcccaggttcaagcaattctcctgtgtcagccttcttagtagctgggattacaggcatgcaccatcacgcctggctaatttttgtaattttagtagagatggggtttcaccatattggtcaggctggtcttgaactcctgacctcaggtgatccactcacctcagcctcccaaagtgggattacaggcataagctactgcacctggtctctgttctacagttttttatcttatgcttttctgaaatgactttttatagttgggtttaaaaggatcatctcattggaatctcatatcacagttatgatgcattctgtcatgatgaggataagtgtatattcaggttaaaaaaaatcaaaatattattgtcagcctgcatcagtattagagattgtctggtccaggagttctcagattgtgattcaagggcctcttgtgggaggggggggtcaggggtccttaagaccttgacagaagttctgtgagggcagaactatattcaaagtaatactaagactgtgtttacccttttcattctcattctctcatgagcataggtggagttttctagaggttgcataccatgccatactgattgaatgtacaagttatatgaaactctagcagttctgtcaaaagacaaagttacaacaaatttagtttaaagatctcagtcagctttattgtgattctagaatcaggcaatacttcattccataaagtagagtgtgtgttctaatgagttgagcagatggttggttttatagacagaaagggctgaagaaagcagattggtcatttcaaagtgaattctcttgtaaggtctggatggggagacaggacaatagaaagactggttaatatcaggttacttcagattagggattaaaacagaggaaacttcattatcatgcccattgaatacttcattatcatgtgcattgaatattgaaaattgtcctgtttgggatattaggctgttatctgtctctcctgattttttagaaagtcaagataacaactcagtttgggtttggtgagcatgggtgactccattttgatttttagtctggtcttcttttggagcctagtgtaggagttttgttcaaaacagtggcctataattttggcttcataagccagacattaaagagatttgcaaagattataaaacagtgcttctcttgtcactaagatgttttttagtttggaaatagttattttcataaaatgttacattaacatttaatgaatttattcttaaaataataaatatttaaaaaagttatattttaacttctaatatgataactagggctagatattaaagctccttgaattactcgatactctttttaaagtgtaaagtggtcctgagatgaaagtgtctgagaacttatgatcctaattctttatcctcatttcatagatgagaatactatgagcccagagaggttagtttagttaagtacactcatccagtttttggcttagctgattcttggatcactgacatctggctttttttgatttttttttttttaagttttttttttttttttttttttttgagacagagtcttgctgtgtcagctaggctcgggggctggagtgcagtggtgcagtcatggctcactgcagccttcactgcctgggctcaagtgatcctcccacctcagcctcctgagtacctgggactacaggcacgtgccaccatgcctggctaatttttgtgttttttgtagagaagggtattttttgttgcccaggctggtctcaaactcttgggcttaagtgatcagctagccttgacctcccaaaatgttgggatgagccaccttgcctggcctgatatattttattagcagttttgctgtttagatattcttcaacctaataccaaccatcagctcctttaacagtttcttcatttgatattttaactaactttattaagtacatgagtaaattaggaatattgacctactttttcaacaacaataaaatggtgtttttttaaactcaaaaaatgtctagaaaaagggaattgatatatgaaacagtgtaaccttagcgtcagaaagaataatgttgagggcaaagaaataggttcttgtgttttagagactcttttactgtcttttttcctttttttccccccttcttcaacaacaaaacattggttacaagcttccctgggcatttatggcagcccacctacagaagaacaagtgttctgttttaaaattttaaaaattttatcaagaggataataattacacatatgctgcttttttgatggatatgtattatttctcaggttgagcctcatggtgggggtggtagattctaaccccctccttttaattgttgaatgaatttaaaactatgtcataaagaaactgcgtaattttaattcaaagaaagataattaggatatacataatatccctcttcctttgaggggcttccttcgtgtagaagacatggactgagtgatttttgctcaataaaggaaaactttctagtagtaaagaaatacaaaaatagaatcagcttgtttggaagtagtgagttccctttcttatgaggcattaaagcatagaccagattattgactgttagtaggagtactagcaaatgaatcagtagatggagggttaattgggttacatgacctttcagattgcttttttttttgaggtggagtctcgcttgtcaccaggctagagtgcagtggtgcaatctcagctcactgccacctccgcctcctgggttcaagcgattctcatgcctttgcctcccgagtagctgggattacaggcacgtgccaccacacctaattttttgtatttttagtagagacggggtttcatcatgttggccagggtggtcttgatctactgacctcatgatttgcctgccttggcctcccaaagtgctgggactacaggcatgatccaccgtgcccagccttcaaattcttttattaagtgtttgagtatacttgttcaaaataactttttaaacaagtataaaaaggcagttggtttagcagatgtattctacttttatatcagctgctctgttaacctaaagattttatggatctgtggtctcaccatgatcactgacatcaattctccttgaaggaggatgagttttgtttgttcattttattgcaaaccatttgaagagatgatagattggtagcagaaatttggcagagaaaaggatgataaacattagaaaggaggataaagcccactggaagacataaatgaattgatgatattttggtgtatattttctcattgctttatgattataaatattttctgctgctttttgccactatctatttttcatgtcttccaataaagtattccatggccaaaatttgtgtgaaattctcttcggttgttgctggttttacaagttatagggttctttggaatataattactgaaatgatgactacactaaaacatatttcttcttaatttaacaaagtatttagtgggaggaaggctctagcttttcttattttctttaatgttttttaggcatgctagaggaaaatagtgttcttactattagttttgaacattttttatgactatagagttgaaagcccaaaacactagaagtaaatggatcattgcaaaatatttgttttgttttcatttgtgagtggggcattcgtgtgtcactgtgtctatgcttctatttttctctgtatatagtttatatccttaagactttcagaaagaaattgagatgttatgttgttttattgtatatgcatgtacatgcatacacacacacacacacacacacacacacacagttttatttgttcatcatatatttaaggcctgacataggtcttacaaagttcaattactatagggcttaagtaggaaatgaatggtaaaatgagccaatttgaagcaataaatactgattgatagattatcaccttcttccaaataagatatgtggcatcgtagaatcttgctcttagatacacagatatgtgtgatgtttaaatagttgagaaattcaaccagaaatgaatgaaagggttttcccgttatcctgtcatacgcaaattaccagatcattcagttcttcaatttatcaattcatgtatttattcatttaactaatatttgttagttttatactatgtgtaaagccctattttagacactgaatacagtgccagacagtaattttcctgcactcatagtttatactctaatagagaatgtagaattgagctttaaatttcctattcaataagtatttttagtaatatgtgaagtacaagagcttctgaagacttattgcgccactctctccctattcatccatttaccagttgttactgaatgcttactctatgtactagaaatgcagagatgagtaagatacaacctggccctgaaaaaaattcagtctatttggagttatagacaggcagtaactagctattatatagtgtgatgatggctatgatataattacaaataatattctgcaagaacagtaattttctctagctgtgaggtatgcaagaagctatcatagagaactaatatttgaggatgagtagaaatagtcgggtatagggagatcaaaggagaagttactcctattccccaaatagagggttcttcatgaacacacagaagtaggcaaggtctgtttggagaatggtgagatattgtgtagtttgggtaaaacactgggtatgtcatggagggagaggtaaaagaagaagctacaacgtaggttcaggccgaattgtgaaaagttttatatacaaggttaaagttggctttttattttacagttagttggggacctgtggaagatttttcagcaggcaaacatacttagtctgcagtttacaaagatagttgatagaatacaggatgaagtagtgagaagttgaggctatggaaaggcaggtataccagtttgaaaacttcataatagatatgaatgaaataatgagggtctcttatagggtagtagtagtagtgactttagaacacagggatggattaaaaatcaaattcagaggtatttttgttttgcttcatttttttgagacagggtcttgctctgtcacccatgctggagtgcagtgacatgatcacagctcactgcagctagggctacagatgtgtgccaccatggctggccaattttttatttttatttttatttttggtagagacaaggtctcattatgttgcccaggctggtcttaaaatcctgagctcaagcgattcttccatctcagtctcccaaattgctaggattacaagcatgagccaccatgcctggtccagagttagaactgacaggatttagtgagtgatccatatggagagagggcgttgaaaaagattttgaagttttgtgtttagtgtctgcataattaaatgctggtactattaacttcaaaaggaaaagcaatatggttgagggaagcaatgaatttggttttgtaatattgagggcaggagtaaacctaagggaatgttggaggcatttaaattctaagtggaggagatgcctattcaagagaaaggaggaggagtagggggaagagatagctgttcagtgtgtcattaaacctctcaaatcctcagtttgttatttatcatatattggaggtagaatcaataatttttctggttttgaaataacctgtgttttagttatcacaaattctaaattagtagtacaaaaattataataattatagtttatatgttatagactgatgataatatttattgattacttcctgtgaagtttaggtaaaatgctaagcattttgcattcatcatccatttaattctcctagcaatatgagttaaatattattactatctggattttcagaaaagggaagataacttgaccaagattgttacagcaaataagtggtggatgggtattcaaacccaggacaatctgacattaaaactcaagcttttaaccactatattatttgcctgtcttgtagaacataagagttgtaatgaatctaaaacatcatctagccctttcctgtaatcagatttatgtcatagctaaggtctgtaattaatgtcaaaattagctatccaatttacttaataagaagcttactccacagccattcattactgctgttttccttgtggcagatacttttttttttttttttttttttgtcgactcacctctttaccgtgtgatgtgagtaaattctgtatagtctaggccactcatgattatcccatttttcttgctagtcattaattaagacctgaacataggactgatatctgaccaataactcatttgtggccaatgagacatgaggggaggtttggtggaggggcttcttggaaaggtaacacctcctctcccctcatttttggatgtttctatctagatgggttcttggaattgtgagagctatcttggaattatttggggcctaggtcaggataaaaccaaaacactggatggcacagtgaaaagatggtgagaacttggatccttaatgatcttgttgaacttctaaattacccattcctaaagctattgtgcctcaggactaggtcttacatgaaattagagggaatttattaggctgtgtgaaacaaggactttttaaggctactaacagtttttttcttttaaacgatacttatcactgaaagaaacctaactgggatctgcagtgtttatctttgtctgaagtaaatagaaaggcactgtagggcttgcattactgttgagacacaattaaaacaggaatagaagacaatttttgtgtcactgcacctaatttaattggtgtagaagttggagatgatcatgctctagaaaacagatcttatatatgttaaaggtagcaaagtgtcattgaggaaatgagtctgattattctgacagtttctgtaggtaaaaggaatagaaagtaagtgttcagattaggttaggaaatagaaatggatttagtttgtagacagttaacctacgtttcagggtccttccaagactctggaagaatctcaagcaatgtgttaacataatattttgggtgaggcggggtaagatttgcaaaagttaggtatttaatccattaaaactgctattccttttcacttagactttccctgtatcataccctcatattgggtggcattagagtggcctgagctaagggaaaattgagtagaggatacatttagagatagtatatggttagcagttgtttatgtgtccagttattttgtaggcattacttccaggaatgttattactgtccactgtgtctacttccctggccttgtgatacatagatgtagttttgcagggcaggtgagccccaaagtggggctcagcccgtgagggttcttggctttgcccagaaaagaattcaagggcaagccagaggtagaagaaaatagatttattgaacaggcagtgttacagctctggtggtgttatagctcggtgactgctcctgcagagcagggctaccccgtaggcagagagtagcagttcagggcagttattaatacccttttttaataacatgcagattaaggagtggtttatgcagaaatttctagggaagggatagtaacttttgggtcattgggtcattgccatggaaagtggtggtaactcctgggtgttctcatagcagtgttgacatggcacactggtgggtgtgtctgatggaaagcttcttctgcctaatcatctttcagctagtcctcaatttaattgggtgtctgaacctgtctctagagtcaagtcctgcctcctaactcagtaggggcaagggtcttagagcattataaatatgttctttgtggtagaggtagaggaagagaaacatcgtttaagtgtttagagtgagaaactagtctggaaaatttttctaaatcttggaacttgattgtggttttcgtaaatttgataatattcctaagaatgtatatgacattatcagtaataagttataaagaagttataaagctgatataaactctctacactgcctttttttttttttttttttaagatggagtctcctctgtcacccaggctggagtgcaggggtgtgatctctgctcactgcaacctctgcctcccaggttcaggtgattcttttgcctcagcctcctgagcagctgagactacaggcacgcaccatcatgcctaacaaatttttgtatttttagtagagatggggtttcaccatgttggccgggctggtcacgaactgctgacctcaagtgatccgcccgcctcagcctcccaaagtgctgggattacaggtgtgagacaccgtgcctggcctacactgtcagtactaaaaattgatcaaacacagtagtaaaaagataaaattatctttctattctcttaatgttgcaaaattgttatatgaagaggaaatcaagaaatgcagccagaaatgtaagaaaataagagcattatagagatagattaggcaattaataaagatatgctcttctttttgaaattcatgtttttggcatttgttagccttttaaagttagtgtttagttgtaatttattttctcattccagatatttacttcacacctaattttgtattcctttccttaaatagagtcccacaaattgtaaaaaaggaattagctcaccaaaaacaccaaatgcagtatttttaatatttacctttcaggttcggttgctggatctagatatgcctcttttttttatttcctcattttttcttctaaaaagaaaattatgtattttaatgtcagattgcttttgattaaaatgtttcatattaaaattgtatacctgaaaaatattattcaataacacacttcaaaaagttgacagttaaaaaaaaaagaatagcccttgttacttttcttatctaatcacagagtttgtgtagtgaatgtaaaaagaaaaaaaaattgttacaagtttggagcaaagagctctgtgtttaaaaggaatctccttctttttttgtgtgtttttccttttgtaccaatggggaacctaaatctgttttagttgcacagacacaatggacaaatagtcattttgtatttgccaagtgtgataccttcctttgtttatttgctattaaactgttgagagttttatggctagtggataatcattgttcaaactttttaataactacagtgaattgtgttaatataaaattatgctgtacagtattttcttgttatgttgatggtcaaagtgaacatcagatattaaaaatttagatgagtaaaatattaaacagcctatttttgtcatgtaacaaaagaccatgagatccatggaggaaaaaaggacagctttatttttctatagaaaacaatagtaggttggggatatgcagcctgtggtgtaaaatgaaaatgaggtcctagttgggggttggagagttagaaattataaaggcaaaaattgtaggacaggggaggtggggtcaaggaagtaaggaataaagtcttgattagatgacctttaatccccaaatcaccagtgtgtcttagttggttgtttccaggtggttggtcagttggcaccaggtggtcttttggtgatcatttggggaatttccaaatgatcaccaaaaggaactgttctttgacttggtggcagaaaaacaggttttgcaacacttttaaggacacagggtataattgctcccttaccctgtcattgcctcttggttctgcttttacctttgagccacaaggagtctatcttgtcaattaactgggggcataatttgacagtccaatatgtataatgatgacaacagctccactaacatgaatgccattcttagaatttctcatagatcctggcatttggtacatctgagttgaataaataaaagtctggggaatgaatgaaagaaaaattagttcaatgtcctataactttaagttaatttattagaattgccaccaacaaaattagctctagcatttagatactaaaaggaatttgttaagcaaacttacttttgcagttatctctccatggacagtcagaacaggtattcttcatttctaaaacatactgctgttctttaagaccattctttggcactgtggaactttagtcattttctagacatttgttagccactaaatgtctcataccagggactcatatttgtaaataatagtgtctgcctttgagaagctcataactgggtagtcaacgaacagtcacagtgcagatctggaatcagtgttgagggagtacaaaatcctttgggtgttgtaatcagagtcaagaaaagcttcacagtggcgataggcttaagcttagttgaaggaagaggaagctttcaagtggaggtggcagagaaagcattctgacatgtgaaaaggcaggaaagcctgcgtgcagcatatttattagttttgtctcccttggagcattttgtaaattttattgagtattcagagttgacagaaaggcagtcagggatcatttcatggagcgccatgctgagaagattagaggattttaagcaagtgatgtggtcaaatttgcagttttgaaagagtacttaacattatcctggttatatgtttagcagatttggcaagaactgattgttatgatttgatagtcatttaatacaaaaaggaacctggaatgctcttcgtctttagtgaacattatgtaacctatcttcatggccttcttagtgaggtaaacattttttttttgaaattgtaaagatttaaactttttgaagggtaaactttctcagataattatgcttagttgtgagcagaagtaaaataatgtttttacaggccagagcatttaattaccagtgcaagactgtccagactactctttccatttaccatgataactggtaaaatgtgagatggtgattgctccatcatcttgggtactgagatgaaaagatgtggggtggagtcctcaaatgacttatgatgaacagctagtgtaagcaagaaaatgaccttattgttttaagccactgatattttgcagttcttacctgataaatggtacatgaacctaacgtgtttttattgatgcaaccatatatcaaaacagtatttttgaaggaatcattgtagaagtacagacatttatagaaaattttttacctctctgatttagagaaatttttgaaagcacaataacttaggtaacatagtaacataaaagttctcataatatgtgtaaaccaaaatgagttactgcaactaagagtcattttgaaagagactaaaattgacttatctttaatttgttaaataaaagtgtgatattaaatccattacaaaaatgggtaaaaattgaagacaactgcaattttataggttactgaactttatattttacatgatattacagtcatccttcagtatacatgggcgggtggttccaggacccaagtctacaaatatgttaagtcccacagtgggtgctgtgaaacctacataaaggaaaagttggctctctgtatgcgcaagtttcgtatcctgtgaattctgtattttcaatccacatttggttgaaaaatttcagcctgtaggtggacttgcgcagttcaaacccacttcattcaagggtcaactgtattttatagtcagtatttgcataataaggaaatctaaatggtactttgatattcaaagtttcataataatctatatgtatgttttaaagtgagtgtggtgatattaatacttaaatgaaaaatatgagttaataaagcaatttataattttatatcaattgagcatattgtttttgaaatttaatttagaataatcatctatacataatctatagatactttagtctttctatatgacattcttatggtggtttattgattatcataactatgaataatgagtaaaaattatacaactatacaagccaatatatgcttgaaattattatttattgatagtaaattagattttgacatgaaatgatttctgtttaggcaataaatttaaactatagaaaaaaatgcagtgtaacttgtactgtaaataaacgattagcaatgaacattacagtgagagctgatagtttatgaattattcactgcaaacttattgtctctgtgtcattaacatgtaagataatgagcctaattaccatggctttaaactcaggggagttagcaatttatgtgtaaaagtttctgggctgtagttaccacccacaagggtattgagagaactgcagacactacttctgtgttttgtttcagaaatgttctttttcctcacttgcttccttcttaataaattagtttttatttatttttatagtgagaattatgagcttttcctcttgcttgaatacctttttaaaggagttatgagaaatatttaagtatttttttagtgtagtttagtgttgtaagtagacaaaatattattagatgtattcttttatttgcttacataagttggcatcacttactatagtaaatgaccactaatagtgtaatttcttggaaaatctagcctaaaaggtcaatattaataattggttttctcctctaaaaggatttgtactaagatgatttactttcaaagtactcagtattagcctatagccttttttctaatctttaatattgtatctttgatcttaatttaaagttttgatgaacttgttgcttctattttctctcttatagtataaattatctgtaataagccaccttaattaaagttggtaaatctacaactgcttcaattatacactaatcaattatacactaatttaattctacttagcaggatacggtacatcattaatcagttttagacttaatacaacagatttagaagtaatcaaaattgaagcattttatttagctgggaaaaaaatgaagggtcataatctagtaattcacatatcaattctgataaaaatcaaagattctttgctaaaaatgaaggaatgtagctgttatgtttactgttgagtgccatgggctgaagctgtgattatataatatctttagatgttaatagcataatagttttgtgctctacctttttctttaaattgttattcatgttactaaatgggttgttttctgtaacatgattgtttaacgtatacataatataagaattccttgagtgaatatcttttttgttgttgttgtttgtttttgtgttttttttttttttttttttttgagacggagtctccctgtgtcgcccaggctggagtgcagtggcatgatctcggctcattgcaacctctccatcctgggttcaagcgattctcgtgccttagcctcccaagtagctgggattacaggcatgtggcctagctaatttttgtatttttagtagagaagaggtttcgccatgttggccaggctgatttcgaactcctggcctcaagtgatctgcctgcctcagcctcccaaagtgttgggattacaggtgtgagccactgtgcctggcatatagaatatttactagtagtttgttttgaacatgtaagcatgtgcacaaatgtatttttttcagaattatgttaaataagatgattagatataattaactcaaaaatctttagcaaaatgatctttgttttctgtgattgaggtggtgacaaatttgccttagaattcttggggatgtgttataaactcgatgtaatcatttttcttttccttttttttttttttttttgagacggagtcttgctctgtcacccaggctggagtgcagtggcgcgatctcggctcaccgcaagctccacctcctgggttcatgccattctcctgcctcagcctcccaagtagctgggactacaggcacccgccaccatgcctggctattttttttgtatttttagtagagacggggtttcaccatgttagccaggatggtctcgatctcctgacctcgtgatccgtctgccttcgcctcccaaagtgctaggattacaggcgtgagccaccctgcccggcccatttttctcaattatctgctcattgaattaaatgactcagattgaatttcattactcattctttctatacatgttcatattattggaaacacttcttgtcctgctcagctttctttccaataaattagtaattctttgctcactcgtcttgtattcctttataagaatgttctagatagggatattctaagttttgaagactatgtatgttaagtgcattttacccttttgagagagttttagtaacaagtttcagggaacccctaggactctgacccattatagctttggccatttaaaaaaaaaaaccttcaaaggtaatatgtgtacatggttaacaatcaaatagaacagatggtctgtctaataatgaaaaacaagaaaaatcttgccctatgtttctctgttcccactccccccaaaatcagccacttgtaactgattctgttttcagtgcttattgtggttgtctcaacctgtagtagaattatagattcttttgtttgtttgtttgttttgctttttaaattagagacaagttcttgccctctcaccaggttggagtacattggtgtgatcacagctcactgaagccttgaactcctgggctcaagccatcctcctgcctcagcttcctgtgcagctgggactacaggcatgcaccactccacccagctaattttttaatttttttgtagaaacagggttttgctgtgttgtcccttgaatgcctggcctcaagtgatcctcctgccttggcctgtgattataggcgtgagccactgtgcccagccttagaaattatttctcaatgcttttgctcttctgtgttctgtgattaggtgactctttatctcacaccacttctaccttttctccatccttccaagttgtgatcactgttttcgttcctaaattggttatttttaaacttcaaataattcaggtaaatttatattttatgttttgttaactgtgttccctgcttactgtttcttccattaatttaaatatcatcgaagttgataatgctaagaacttgtttgtgttaaggtaattctcacatgtggataaaaactgattagtgccaaaagtttacaataaaatataacagtctcctatcctaccctgggttctccagaagcggcaacttataatactgttagtttgttctttctgatactagcttattcctaaataatatgtgtattcagcttttctgattaaccaattttagatgttatctattgacctttttattggggcctgggatacagatcatattatatacctgtgcacccagttctgaaaagttatataataattttggttcaatctataagcagtctataatcgttatttatattatagtgactatgtaagtattgagtgctgtaatatagcacattacattcatttgcttaaacaaatatttggtccccctttcccaccacattatttatagccttgtttattcatttgcttggtttcctattggctaatttgctaatctcccccctcagtgtttcagcagatctctccagcacctcccattaatttttctttgtttatcataggttcgaaactcaataattttttttcctggaagtttctctccttcagccctctattctactttaccaaggagttgtcttactcttttcagctctgatcctgggacttccctttgttgctcttttgggggacaatttgctttttgattgtttttagtcttattagtttatgcccttgttttgctcaagcacattctccagagcttcctgagaaaagaatatgtgagaaataaaatttttccatacatgtaggtctaaaatgtctttattctacctttacataggttggtatttcaattaagtctggaaatgcagattgaaaataattattcctcagaaacttgaaggccttgctccattagcaaccagtgtttcctatgtgaagtttgatgccacactgattgctgattctttatatgtgacctatttttttctctttggacattcttagaatctcctctttcctcctggtattctggcatttctcaatgtgatttttcttattatggcttttttttttcattgttctgagcatgtaatgggcccttatagtccagagacttaaatgttcttcctgccattcatgcaggtttttgaaatttcttctctactattttctttagagctatgagttatttttattagccagttttctattaatagacactggatttttcaagttttccaccacaaaaaacactcatgggccgggtgtggtggctcacacctgtaatcccagtgctttgggaggccgaggtgtgtggatcacctgaggtcaggagttcaagaccagcctggccaacatggcgaaaccctgtgtctactaaaagtacaaaaattagctgggtatggtggcaggtgcctgtaaatcccagccacgtgggaggctcaggcaggagaatcgcttgaacctgggaggcagaggttgctgtgatcacgccattgcactccagcctggatgacaagagtgagacttcatctcaaaaaaaaaaaaaaaaacaaaaaaactcctcacatatattatcttttttgcatgtacttttatataattgtgccagttcttctgtaagatatacatggcttttatcttattactttctctgagaggtagagggtggggcagggaaggcaaggagaggaagaagctttgagattctcctacctgaacttcagattctggtgtgatacctcaatattgagttagaatggctttatcaagcatgtttatttctagtttttcatattatttttgtcttagtcatgaagcacaacaaaccaacatagaacccatttcatactgatgaataaacaggtagcttcattcatgtattcatttattcattcagtcatgttgtgatactctttgggaatacaaaggtgatactgtacttgctgtcatgggatttacaattctagggataagtaggagtgtaattgataaaacatgtatttgtgcttttcaatagtaatattgactaactcaagaaaacttttggagacaggctttctttgaatggactgtgatgcttgcttgtttatgttttcatgaatacatttactagcttttgattttttatattaggagagaacagagtgtcttgttgtggcagaaatacctaatatgtaatcctctgaattcttcaattgttgcaaaacataaacatttactaaagagttcagcagagtagattaaatgttatttaaaacatatgttatattgacctcatggctaaatggcctggtttaggaatccatgaattatcccacaggtaatagcaaagttttctccctgcctcgtctcccaccccaaatatttgatttccacatatactgcacaggggaattgaatttgatgtcgaaagccataagaaaaagagaaactttgctttttactgcttttactaggaaatagaaaacatttttagtgacaggctatgcttcatcatgaaaatacggttgggtgttttaggccttcacaaatttgatttcattgtacttagtgatggatgttagtaagctgtgtgagatggagagaaattaaagaataaacaggaacctctcaaacttgctagtgatgttctacagtttgtagcatgaattttcttacttttagtttttccttatgaaatactttatgtagaacaaactagcagtactaaaacaaacacccatgtacccaatctgtcaacacttagatttgttgaagatttgggtgggcagagtcttccacccaaatggtaaaaggggaatacattacaagtacatctggggttctctgtatacctgtcttcagcccattttctgtcttatttcaaagttcactggtgttccagttttgtttttagctgtaatgcttttcttagtgcttaaaatatatgtgtatatattcataagcaatatgaagtattgatttgcgtgttctaaaacatattttacagtgcctctccttcggctcgctttttcgtgtaacattgaatttttagatttttccctgttaatgcacgtaatttatatgtaatttattttcacctgtatagacttgtatgaatacatcacaatttattctttggttgaggaattacaggtttttcagtattagaaacactactgtgtttaaggttcttgtactgatctgtttatgcatatgtgaaagattcttgaggactgtattttaaatatgtggatgtttaaatttcaattaattaaaattaactcagttcctcagttacactagcaacatttaaagtgtttaatagccacatgtaactagtgagtaatgtattggatattgtggatatggaatcattccattatcataaaaagttttataggctagtgctccttggggtttatacctgtgtgtggaattgttgtgtcactgggcttgcacatgttgcacttcagtagatgttgctgagttgttctttccagtggtatctgagcattccctttctcaattgtcttgctaagaattggtataaacagaaattctaatttctgttttgtaggtgtgaactgtatctcattgtggttttaattgaattttgaaaatatatagtgaggctgagccttttttcttatacatgtgtttaccttttacagttctcatcttgtgattgcctcttaatgtcctttactcattttttcttttgagatattttaaattactgatttgcatgagttttttttgtattttatggatacaaattctttgattatatttgccatatatctgtgcctagtatgtgacttgtctttcattttgtggtgtcttttgcctcacacaagttttaaaatgaaatgtaatcacattatcaatttttaaaaatgctttatcttcttatgccttatttaagaaattacttcctactctaaggtcagagtttcccatatgtgctttgcagaggtagatctttcatctggtagtatgtaatttttgtgtatggtgtgaggtagagttggagacttgagtttttttgcatatggataaccaattatctttgtataattttctgaaaacttcattgccttaatagttttttgtttgcatgggggtcaatttctgggttctaattctgttccattggtctatttgtccctataccaatgtttcagttgaattttcctttttgtcaaagtacctatttttttctttattttttgtagagacagggtcttgctttgttgggtagactggtcttgaacatcaaatgattctcctgccttggctttccaaagtgctgggattacagttgtgagcaaccacacctggccaaattttcttaaaatgaaaataacagtgataatttaggtccaagccctcttcccaaaattgatttagctgatgataagctataatattggaatttataatataaaatactacaatttttttttttttttgagacggagtcttgctctgtcaccaggctggagtgcagtggtacaatctcagctcactgcaacctctgcttcctgggttcaagcgattcccctgcttcagcctcctgagtagctaggactacaggtgcgcaccaccacgcccagctaattgtttttattttagtagagacggggtttcaccatgttggccaagatggtctcaatctcctgacctcgtgatccacctgccttggcctccaaaagtgctggctgagattacaggcgtgagccaccgtgcctggcctagaaaatgatattataaccagcagatgtgaacaataacatttttttctgtgatgatatttgagaaaagcgcaacttaattacaaaagagtgaaaaacaatcactttatcaaagtcagaacttctatacactttcaagtggtgaattgagcctcacttaaaatctaattttcacttttaatgccatttgttttcttttgagatataactgattcatttaccaccaatttttataaattggatttgtagtttggccattgtatgaaaatatttttttaaaaaagtatatgggtcatatgggtagtaatcaggcaaattggttttagatttgcagtacctgttcaattatctgagatttaggggatctagggcatgtgagtagaggttctattaggtttataaagtgcttgtgatgataatataggttaaggaccaagtacctgggaaagatcaagggcatactaaatagttgttcctaaagtaatgggacaattgcagagagagggatgagagaaggagacttaaggatgatgtgttgatgtgtatgtatatataaatgagacataaatgacttttggaaggattactaaagaaaaacagcaatagaagaagactagcctatgtccagcagcaaaaggaagtagaagacagtgagtcagatagtgaccagtacaggacgctaggtggtgccattagtcttagactgcttatttgaagtctctggaggctcagtaacctcagaatagaaagatcgaaaggcggccgggcacagtggctcacgcctgtaatctcagcaccttgggaggccgaggtgggtggatcacgaggtcagcaattcaagaccagcccggccaacatgatgaaaccccgtctctactaaaaatacaaaaattagcctggcgtggtggcgggcacctgtaatcccagctactcaggaggctgaggcagagaattgcttgaaccggggaaggagaggttgctgtgatcggagatcgcgccactgcactccagcctgggtgacagagcaggactctgcttcaaaaaaaagaaaaaaagaagaaaaaaaaaggcactgcttgtatagtaaatgagcgaattgtcttattgagtataacccatagtatattatagttcttgatattttcttctccagtgatcattttgaaaaattttctggaatttgcattgtaaagaagtttgtccaccaaataaactgtgttttaaaagtaatagttcatttctttctaattttaaaggttgtatataaaaaggtattttcatttaaaattcatattaaaaaagataattgaaattttcatattgaaattatataatcagaaggaacttggtgttttaataagctttagtggccttttcctaggtcaatgtacaattccactgaatttttttgaaatacatatccatgggttccacattggtggattaaaccgtggaaagaaaatattagggaaaaagaaattgcctgtgtacagagcatgtacacatttttccttgtcaatattccctaaacaatatgacaaaagtttacatacatttccattgtattagatattgttagtaatctagagatgatttaaagtttggggaggatgtatgcaggttatatgcaaatacagttgaccctcaaacagcacaggtttgaactgcatgcacctacttatattagtttttttccagtaaatacagttggccctctatatgggttggtttggcatctacaagcaaaaatggatggaaaatacagtattcaaggaatgtgaaagttgtgtatatggagagaagggccaactttttggatctatgggttcaacagggccaactgtggtactttagtatgtgtgcattttggtatccaagttgggtcctggatccctcaaagatactgaggaatgactgtattgaagatgattccttgattcctgttacatttttttttaagattccagattgggaataattaagtgcattatttgatttctggagatgagttacaccattaaatttttgttgatatgtgtatcgtgcaggtgacagaaaccctaactcatactggcttaagtaaatggaaattattggatcacatatctaaaaagatgttggtatggctgattttaggtgaagcttgatgcagaggttcaaataattttatttggaccctcttcacctcatcttctagaggtagggtactgccatcagctattggcttatatccttatttgtgtgtgtgtgtgtgtgtgtgtgtgtgtgtgtgtgtgtctgtctgtctgttttagtggctctaaaaacaggtgtaggattatgtcatattaggcctctttggcttgtttgggttccatatctactctgcaactggagatagagttaacactgctggaaatttatggattaagagtgttgaagggatgattccccaaagaaaatttggatcttattagggaaataaagaatggttgtaaaattgcacttatttctttaaggaagtcatcttaaagctgtttttctttgccaggtatggtggctcacacctgtaatcccagcactttgggaggctgtggtgggaggttcacttgaagccaggagtttgagaccgctctgggcagcataatgagatcccatttctacaaaatatttaaaagttagccagagatagtggcatgaacctgtagttctagctacccaggagactgaggcaggaggattgcttgagcccaggagttcgaggctgcagctcgattgcgccactgcactccagcctaagcaacagagcaagtcaccatatctttaagaaacagcaacaccccccaacacatgaaaaacttttttttttttttggctaagctgttcttacactattgattttatttcactagaatttgtttttactttaatctcatttgtgctacttattagttgtgtgacttctcagagtccatttcctcactggcaaaattgttgatacaactattgatatagttatggtgatgataaaataagataatgtgtgtgaaatacctagcctagtgcctggcatatattagatattacagaaatgttagtccacttgtaagcatggttattacccagacatgtttggattttatcagtctttgctatatgttttaaattagcctataatctgtaagtatcacagatgttgtagaatgatcaattttcagattatcagtttgatttattgattaccgctttcagtgctgaaaatgacagttggtagatattgtccaattcatgacttgccagtatttttatcctagtacttaatgtgcagatttagcttctgtaagatttttacaattaatctatgtggggaaatataaattatctttaaggagtagcagtaagtgtagtgaaattatgataaatggttttattgtttggggaaataatatcaactgcttcatgtgtttgaagaataaaaggaagttggcagcaagggagaaagatgaatgattaagtatggcttaaacttgttttttaattaaagtgcttcattgttgtacacaatattcaaattatatttaaatgtaacattaatttttctattaacattcatctttattagaaaatattgcttgtatttatcataatttttttccccaccaactataacactcttataatctatttgggttaatgcgtgtgtagtctcaagaaaagagcctccttaattgtttttaaactgtttgaacactagagatttagtaacctacatttccaataactaacaatacatatgaaactcttgatagtgatggaatagaactaatcatttccttataatatagtgatacatcattatttgacttatggcatatttaactctggttagctacaagcagctttatactggtgtcttttattcagatttgagaagtatcagtgtaacatataaagaacttatttttactaattttcaccatattttatagacacaaaccacatgagaccaaaaatagtgtatactgacctggctggtcattttatggttggttattgtgtttattattctgtactatgtttgttgtatttgtgctttagttgctatttatttttaagaatattgtgttatataggtgtaaaagtgataagaatgtgccaggtatggtggctcactgtaatcccagcactttgggaggccaaggcaggcagatcacttgagctcaggagttcaagtatatcttttgtaatcccagcactttgggaggctaaggcaggtggatcacttgagctcaggagttcaagaccagcctggccaacatggggaaaccctgtgtctactaaaaatacaaaaaattagctgggcgtggtggcacgtgccagtagtcccagctactcgggaggctgaggcaggagaatcgcttgaacccaggaggtggaaattgcagtgagccaaggtcatgccactccactccagcctgggcaacacagccagacttcatttcaaaaaaataaataaataaataaaagtgataagaatgtgacatgttaatagggagagatattagtccgatggtaattaaaagcagagaaagttttaaataaactaaatggtgaagaattggtttgttcaacaataggagttattttgaagaataaagcaagtgattaaacatgtgaaaagtaatgtgcctatgccccaaagtgctattgcttagtgggttatatctattgataattacaatattagaaattaaaatggaaacggttgaaaatattcaatacatttaaagataactgtaataaacccagtatttgctagcataaacacatttttctggaaaataatgatattttctaaaccagaaaaaaatagttaaaagaatggtattgctttttgcaaatctctttaatgtctgacttagtagaagacagctggattttcatctgcttctgcctgccatctgttgtaatatattgaactgatccagaactcctggtctcaagccattgttccacctcggcctcccaaagagctaggattacaggtgtgagccactgcacccagcaaagcaaatagttttaaccttgttggttccctgaaaagattttgtgggacccttgtagtccttagactatgctttgagaactgctggccttagcaattgaacgtaagtacagtaggagacattggtagaaatgcttttgaatttacagtagagtctgggcatcaatattagatgtctattgatcttttattaaaagactaagagtttgagaatttaaaggctaaaacattataggtcctgctgatcagacttttcatagccagatagttctgtaggcttaaggccctttaaatccagataatgtccaagtaagtggcaaggcagcaatttggattccatagctgctaaaaagttttttacggcatttgtacatagatcattaagaagagaggaattatttctcacaaccaatttttagtgtagacaaaactggaatattttggagaaaaatgtcttaatagaatgcatatagcggtaatgtagtcttctatttggcaggaatatatatagggatggtcactttagattaaagaacaaataaaacttaacctacttataaacagaggcttctgtattgagaatttttcttagtataacatatattcaccttagtatcaagttgtgggggtttttgatacccccaaattgacagttattcagctgaaacttggagataggacagaccttgattaatatttggcaataattgtcagttctaatgttggaatttttgctctaaccttgttgattaagcatttaacttatttacatttttatgcttagggattaaaagtatgtctactttacatttatattcaggtatatatatatttttgttgttgttgttgttttttcttattattattatactttaagttttagggtacatgtgcacaatgtgcgggttagttacacatgtatacatgtgccatgctggtgtgctgcacccattaactcatcatttagcattagtatatctcctaatgactatccctcccccctccccccaccccacaacagtccccagagtgtgatgttccccttcctgtgtccatgtgttctcattgttcaattcccatctatgagtgagaacatgcggtgtttggttttttgtccttgtgatagtttactgagaatgatgatttccaatttcatccatgtccctataaaggacatgaactcatcattttttatggctgcatagtatatattcaggtatattttaaggcagtttttaagtatatcttttttctttaatagtacttacaaaaatgtaattatttgatatgacaaagctgcttcatattttcatattagcttgaactttccattgatatgtcaagcaaataaatacttagtttttttctgagtagaaaccaactgtactgcaaaccccattgatagtaaattaattgcagggatttaacatgtagggaaaccttaattattctgaatatacttatgttatgatgtgtagatgatttgtttactgtctttaatgtgactgagtcaaaatatgtgtagttatttgcataaaagggaagtgttgctaatatattttgcattacttaatgttatatataaaattaattttccttgtaagggatgtgagaaatttttttactcctcatttctgtttattctcatctatttctttgaaaatgtagatttaatttatttaaatactgtgtgatgaaaacattacagatatgttcttgctctctttttttttttgagacagggtctcactctgtcatctaggctgagtgcagtggcataatcatggctccctgcatgtcaacctcctgggctcaggcagtcctcccacctcagcttcctgagtgtttgggactacaggcgcgcactaccatgccgggttaacttttgactttttgtagagatggggtctcactatgttgcccaggctggtctcaaactcctggatgcaagcaatcctcctgcctcagcctcccaaagttctgggattacaggcatgagccaccacagccaatatgcttcattttctacctctgattataaattaaaggatagtattataaatgcttaattttataacctccaaatagtgatattgtattgctccttattgtgatggataaattataagacatatgtgtttaactggtttggtggcaagtctgtttacagaaatttgctgttaatttctcagttgttcacatgaacttatctgatttatagctttggccagcaatttacaaagaaagttcagtctgtagggcttcctgttgctctgagtgggggctccttctacccctgttcaacttcagtcagcccatggtctatagtatacctctcacaaggtccttatactgcagatcctctctgctgcagatgcttgggcttttgccttaagcacactggtgtaattagaagaagtagaaaagaagagaaagggtgaataataagagatgagaggatttaaaaatggttgaaacaggagttgtgaagtttgagtgtggtggatatggagatgtgcagccctgatcctccttcaaggaagaattgtggcccagttgtggggaggtcagtcatcagaaaaccttcagctgtctggcctacagaggacagccagaaaaaaaaaaaaaattgccttaagctgtcagctccttcaggctctacctcagttgcggagagcctccttgcttaaggtcacatcctttccagggcagcacttatcctgcaatcaagcaagacatgtttaaaggcccagccattttgttcaggcctgagacaactctgacaggtgatataccaccagagatctgccaggttgcttgaggctttgttgggcctgaattgcaatttgatttttccctctgcccaattcggctttcttccccaaatctcttcttcttctttttttttttctttgagatgaagtcttgctcttgttccccaggctggagtgtgatggcatgatcttggctcactgcaacctctgcctcccaagttcaagcaattctcctgccttggtcccctgagtagctgggattacaggtgggtgctaccacccctggctaatttttgtatttttagtagagatgaggtttcaccatgttggccaggctggtctcgaactcctgacctcaggtgatccacccgcctcggcctcccaaagtgctgggattacaggcgtgagccactgcgcccggcctctccccgaatttctttcacagggattgactgctaataaacatcatatacccaaaactacttcagtgtccattttcagagaatccagcttgcaacaggcaggcgtatcggcttcatgttgtcctaaaccttacgtaaagttctatgcaattttttttgtgaatttgcatttttcttaggaggtctgtggcttccattatcttctttaagatagacttgaaaattaaaggtttttctcatcaaggacttaagaaggaaaggcttaaacattttttttttgactcaagatcaaactaaatacacttggccattgaacaatatgggggttagtagtgctgaccctttgcacagttgaaaattgacatacgactttttactctcccaaaacttaactattaataatctactgtgtaccagaagtcctaccagtaacatagtctataaacacatattttgtatatgtattaaacactgtattcttacaataaagctagagaaaacaaagtgttattaagaaaatcatggccgggcgtggtagctcacacctgtaatcccagcactttgggaggccgaggtgggtggatcacctgaggtcaggagtttgaggccagcctggccaacatggtaaaaccctgtctctactaaaaatacaaaaattagctcgtggtggtggcaggcgcctgtaattccagctactcaggaggctgaggcgggagaatcgcttgaacctgggaggcagaggttgcagtgagcctgaaattgcgccattgcagctccagcctgggcgacaagagcaagactctgtcttaaaaaaaaagtcataagagaaaacctgtttattattcattgagtggaagtggatcatcataaagatctttatccttgtcatcttcatattgagtaggctaaggaggaggaggggttgctttttaagagggggcagaggtgattagtaggagaaaaattttaatgtgtgtatatatatatatatacacacacacattatatatatataattttttgtagagacagggtcttactttgttgcccaggctggtcttgaactcctgggctcaagtgatcagcctgcctcctaaagtgctgggattaccagcatgagacaccgtacctgactggaggaactacgtttttgatatggtactcagagaactgagtgcagtacagaagcttatacacccccttttttttatagggaagtggggaaatggagaatgtagacagttcttttgagggccagtaaatcatttaggtgggaggcagacattgtgggaaggtgagaggtgaagctgcaggttgtcttaccatgcagatgaaggccccctgggtaatctgttggagctgccctgggaagaatagatgaagtctttctgggcagtaatgatcatgacttccagcttcttctcatgtagtcgacctttcctgatcatttgatgagatccctaggaagggagtttaagacaattgcatttcttttggaaagaagcttttttgggctgataaggaaataccagagagagcccctctctgcgctggggtgggggacacgacaagttagagggatcttgattgtgaggcagcttctaaggcctttaagcatgtctaagtgccagtctttgggggtgtggtttgagagaccaaaatagatgcccctttattaactaggacagatcttaaggttaaggaaacaaagttacctatcggtagaaagttcagggccctgctggtgtggcaaatttctaaattcctatggctacaagaaaaatcactcttattaaactctctaacaataggagctttcagacaaattatcacaattctgatttacagcccagactactacaactctggacagaattcccaacttagaaacattcttttcttttcttttttttcttctttgagacagagtctcactctgtcacccaggctggagtgcagtggcacaatcttggcttactacaacctccacctcccatgttcaagaaattctccagcctcagcctccagtgcggaccactatgcctgggtaatttttgtatttttagtggagatggggtttcgctatgttggccaggctgttctttaactcctgacctcaggtgatctgcctgcctcagccttccaaagtactgggattacaggcatgaaccactgtacccagcccttagaaacattcttttctgataagctttatagaccttgagtttcaaccagctttagaggctgggcacaaattgtctttgcatcgtatagtttttatcttttgatgtaaagagccaaattccaccttattttaatgctaaagccccaccccaaagtgagcataggatgtatattacacatatgtttacccattgcacgtgcgctcagctcttctcgtaaatatgaatagctttcccctaaatctgctgaatatatatgattctgttgtgtaatatgggccctgtgaggcataaaacccaacctatccttcccctgtttgaagacagagcacctttggtttgcactggagactttttcttcgctggttgcaaacccatattcccagtaaagctctcctttctactacgtagcttctggttatcttttggatgacaggggtattgctttctgggccccaacactgggaagcagcacttaaccattgtaagcaaggagaagggtgtattaattttctgtttttcagataacaaattgacacaaatttagcagctttaaaacaatacccttttattatcttatagttctataggccagaaatctgatacagtgtgtctcactcagctggttctcagctccaggttttacaaggcagaaatcaagatgctgggaggatagtgtatgttcctttctggaggctctaggggtgaatgtttccaagctctttctggttgttagctgaattcagttacttgcagttgtaggactgaggttcccatttacttgctggctttttgggaagtggtgtttacctgtttaatctcagtggtgtttacctgtttaatctcagtggtatgtgtagttatatgggattgtgtgttttaaattgatctcttttgtacctttcctttctattcctttgatttttgttctttttcatctccttttactttctttgggtttatctattgttccttttcaaatatctttttttttttgagacggagtctcagtctgttgcacagactgcagtacagtggaacgatctcagctcactgcaaactccacttccccagttcaagcgattctcctgcctcagcctccggagtagctgggattacaggcgcctgccaccacacccagctaattttcctgtttttagttagagacagggtttcaccatttggccaggctgatctcgaactcttgacctcgggtgatccgccctcctcagcctcccaaaatgctgggattacaggcatgagccactacacccagcctttaaatatcttaataagaatacttagctcattcatttacagccttttttcatttctaagatgagcacttaagtctatacatttttctcagaataccttttttgtgtgacctggactgtgtgagatagttttttactttttcattttgaagtgttttaaatttcttttgttttgttttgttttgttttgtttttttgagatggagttctcactctgtcgcccaggctggagtgcagtggtgtgatctcggctcactgcaagctccccctcccgggttcacgccattctcctgcctcagcctcccaagtagctgggactacaggcacccgccaccatgcctgggtaatatttttttgtatttttagtagtgacggggtttcaccatgttagcccggatggtctcgatctcctgacctcgtgatccacctgcctcggcctcccaaagtgctgggattacaggtgtgagccaccgcgcccagctaaatttcttttatggtttctttttgacctgttgattgtttgggaattgtttagaaatacgggtttttaaaaagctattttttctttgattgtacattgtggtcagagaataagttccatgtgatatctatgcttagaaattttttagatttatattttgccagtacatgactacttttgtaatgttttatgtatatttgataaaaatatagattatctaattattggatgcagaaattcatatattccatatatcattatatgatccatacatattcaagcttgttaattattatttcctgaatataatctttgtttatttatatgcttgactggtcagtaatagaaaaatgttgtgtcaaaatctactgggaggggtggcgacgtagctcacccctgtaatcccagcactttgggaggctgaggtgggtggtctgcttgagctcaggagtttgagaccagcctgggcaatatggcaaaaccccatctctactaaaaatacaaaaattagccaggcttagtggcaggcacctgtaaacccagctactcgggaggctgagacaggagaactgcgtgatcctgagaggtggaagttgcagtgagctgagattgcaccactgcactccagtctgggtgacagagtgagaccccatctcaaaaaaaaaaattaaaaaaaaaaaaaaaaaaaacaaccctaaaacaaatctactgtgatgttaggtttgtccatttttttccagatttttttggcttgatatattttgagactattttattagatgcacatacttttaaaattactttgtcttactggtaatgtgaacttaaataattttgttatgatcctttctttcctagttgatcatcttttagtttaaagtttatctgataacaattacatgtagttaaacttctttcttttggtcaacatttgaccaatatgtcctttttccttctttcactttttttatttttatttttagagttggggtctggatatattgcccaggcagaagtacagtgactgtttataggcatgatgatagcacactacatcctctaacttgtggcctcaagcgatcttcccgtcttagcctcctgagtagctgggactacagatgttagccatcacactcagcttctttcacatttatacattaggagtccttttgctttttatatgtcttttataatagccattagttggattctttaatcttataatctttattttttaacataatgatttttgatttttgttcatccctcttgttcttggcttcataaaaaaaattgaggccagctgggcgcggtggctcacgcctgtaatcccagcactttgggaggctgaggcaggtggatcacgagatcaggaattcaagaccagcatggccaagatggtgaaacctcatctctcctaaaaatacaaaaattagccgggcgtagtggtgggcgcctgtaatcccagctactcgggaggctgaggcagggagatttgcttgaatctgggaggcggaggttgcagtgatccgagattgcgccactgcattccagcatgggtgacagagcgagactccatcttaaaaaaataaacaaaaaataaaaattgaggccaggtgcagtggctcacgcctgtaatcccagcactttgggaggctgaggtgggtggatcatggtcaggagtttgagaccagtctggccaatatagtgaaaccccgtctctactaaaaatacaaaaattagctgggcatggtggctcatgcctgtagtcccagctacttgggaggctaaggccagagaatcacttgaacccggaggttgcagtgagccgagatcgtaccactgcactccagcttgggtgacagagtgagacttcatctcaaaaaaaaaaaaaaaaattgagtgccttttacccagagcctcaccaacagaattgccaaacttttgattttttctttttttgccagtttgatcactaaatagtgatgtttcatcttacctcgaatttttttttttcatgagtgaagttgagcatcttgtttaaaaacatttgtggccaagtgaagtgctcaggtctgtaatcccagcaagttgggaggctgaggcagaggattgcttgaaaccaggaatttgagatcagcccaggcaatgtagggagaccccgtctctaaaaaagaaaaattaaactggtgtggtattatgtacttgtagtcccagctattcagaaggctcagggaggaggatcacttgagcccaggagtttaaggctgcaatgagttattattgcaccactgcacccaacctgggtgacagagttagactagatctcttaaaacaaacaaaaagtttacttttctcttttctgtaaaatgtctgttcatatcgtctctaccacacttatttttttggtgggattgtgtctttttagtgatatctgtgtttttttgttttttgttttttgttttggagccagggtcttgctcactgcaacctccaccttcctcaagcgattctcctgcctcagcctcccaagtagctgggactacaggcatgtgccaccatgcccggctaattttttgtatttttagtagagatggggtttcactgtgttagccaggatggtatggatctcctgaccttgtgatctacccgccttggcctcccaaagtgctgggattacaggtgtgagccaccgcgcccggccttaaacaagtttaaacacacacacacacacacacacacacacacacgttttttagagttggggcttgccttgtagcccaggctggtgtctaacttctggcctcaagtatttctcccaccttggccttccagatagtttggattatgggtgtttacccctatgcccagctctaaataagttttaatgccaaccatcacttctatttgtagagattcctaatgccacccagtgtaatgcttttggggctatggcagtgtaaatttggttttctcactgctgtttataattcagctttcttgggtctattgagttgatcactgcacctcactctgctttccactgtccaaaattttgtcaccattatttttttgtttttcttgtctttcagagttttagtgaggtttcaggaggaatcagaagttcatgcatgtattaagtcctttggttttactgaaagtttgacacatattttgaattgtagttattttgtctttcctaatttagatgcaaaattaagttgtctagtgagatactcagttaatcaagttgagatattaagggttacaaaaaggtttaccacactggtttatatacaggttaagtatccataatttgaaaatttgaaattcataatgctccaaaatctgaaacattttgtgagccgacaagagactcaaaagaaattttgaataaggtatactcaacttggataatattcatttgaagcatgtaaaggaaataatggctgttatgtgttatacacaaatgtgaagatagtgttgatttgatgctttacttttgataatgttgatctgatgccctggttttgatcacttaacagatacccatgtgctttatgggaagttgagttcttcttatgctcatgggctgagcccgaattaatccaaatcagtaatggtaattttatgccctctcccattgatttgatagtgagtggccttgagagccagttcattgggggaagttccccacttttttggtaaagaaacataagcaaggggaaggcagtctctcttatgatcctagacattaaattgttacttgcaactagtgtagctactttgaaaccgttaggggacaaaaagtcatcacactaaagatgacacaggaaaaacaaggaaagaacttaggtccatgatcttgatgaggcatcataaattacctatccctggagctgctgtagctctggactttttgttatatgagataataattcctcagattgacttagaataccaatcaaaataactattattttagctagctaagaaaaaaaatctgagtaaataccataaggttcagattacataaatatgaagatcaaaactgcaagttttctgagaagttagttattattgttttttactaatatgagctgcattggaaatttattttctttttaaaaaattattgctgtctttgtccataacttttatggacctgacattttagttgtttggaaaaattggtaattttaatcttttgttttggtatgattcaggttgacctgacattttaatacatctggctcctaggactgattaaagagacattttatttgttgaaatatgcacattttcttcatgaaattggttttcttttttatgtgtgacttttcttgcaaaagcttacaaggcacatgcttttgatagcagtgttacatttttaattaatattttagatgtaaaaggtgacagtttaaaagattgttttattagtgggttatccttaaaagcaagtggcatttggttttattttacaatagagtttaatcttacatgttttttgttaaagtaatgttaccaaaaaatctcttattgaactatttgtggtgaactttttaaggatgtttaagatttcacatgcagtttaactgatcacagatgaagttgtaaattaatacctcatgagcgtatttgactgcagggcattgttgtgaatcaaaaccgctttgttcctgtaaactgtgaaaggggtttaagcatatggattaaaattgcatggtgataccgaagtacttatgaaaagacactgtagttggatcatttaaaatgtactaaaatattacgaatagccataaaatataataattccctgaagcttttaagagtggtaagatttagttttatttctttgttggatttaactactttaataagaaattgttttgttgcttttggaactatgcatagtaatgagaataaccatgatgatgagaacactggaagcttcccagaaaacatgtatttcttcagaaatgttcttggttgtgacaaatatatatatgaagcttttccttgttcccatctgagtcattcccttaccagaacctttagaatgaaaggtttaatgatatcttctagtataagattatgaaatgagcattgtttagtgtaaaatcatatttttcttttgctgttaattttgtcttatagtatatgaaaatcacctggtgtagaatgtatttttcctgccataagaaactgtcaagaatctattgaaaaaataccatgagagtagttgttctggatgacaatggtaggttctgatttactgacgtagaagcaagcttcagttagccactttagtcataggtaaacactagattagcctaaggaaaaattgttgggaagcttttggagttctcatctgtgtcactgttttagatctcttcaagttctttgaaaattttggtacctccctgtttaacaaatattctgttttctgctatctaattagttctcatgtagatgacgtttctaatactaattaccacactttcttggactcctcttttataacgacctttatctccattccatttgatcaactgttttttaggactatgttctgaacctacttcctacccaggactgctttaaaaaaagtaatctatgttagcttcctgtttggcttcttcctagtttgactttactctctatatacagcctgagtggcatgctcggttatttcagctacatcttaccattactcagttctctctcccttttgaccttgctggtttctaaatctgggtcaatttgtgtgccttgcttcttgacttgatattacaattaacttattttgtcatactagatgttttcagccatctttgatccccaggttgctcaccaactcttattatcctttgaaatgactctcaaatcttacccctctttttgacttttatgtttgttgccctcatcttcatcttttttttttttttaatgagacggagtttcgctcttgttttctttctttcttttttttttttttttgagacagagtctcgctcttgcccaggctggagtgcagtggcgccatctctgctcactgcaagatccgcctcctgagttcacgccattctcctgcctcagcctcctgagtagctgggactacaggtgcccgccaccacgcctggctaattttttgtatttttagtagagatggggtttcaccgtgttagcctggatagtcttgatctcctgaccttgtgatccgcctgcctaggcctcccaaagtgctgggattacaggcatgagccactgcgcccagctcgctcttgttttcttgttgcccaggctggagtgcaatggtttgatcttggctcactgcaacctccgcctcctgcgttcaagagattctcctgcttcagccttctgagtagttggcattacaggcgtgtgccaccatgcccggctaattttttgtatttttagtagagacagggtttctccatgttggccaggctggtctcgaactcccgaactcaggtgatccgccagtcttggcctcccaaagtgctaggattacaggcatgagccaccacgcctggcaaattctattttttttttttttttttgagacggaattttgctcttgctgcctaggctgtgcaatggcacgatctcggctcaccgtggcctctccctcccaggttcaagtgagtctcctgcctcagcctcccaagtagctgggattacagacgtgtgtcaccatgcccggctaattttgtatttttagtagagacggggtttctccacgttggtcaggctggcctggaactcccaacctcagatgatctgtctgcttcggcctcgccaagtgctgggattacaggcgtgagccactgctcccagcccttcatctcttacattaggtgccatagcactcacctctgtggctctgtttcttctatcccaacagcacatgagggattgggtccccttccatctctccaactccctactcctactaccacataaattaacagaaactccctttagtagtaattctcaaatgaggtgccaaatcttggtctgtatggaatgtgtatttggttttaaaaaaattctaaaagtgattctcttctgaggtcctaaagggtcttttgcaggacttcctcaaattcgtcttttacaatgctataggagtcatctttgtcaaacatagatttactcattttacaactgtgtaacaacttattttttgccaagtattgggatagctactggagttagtaaagtgaatattagggtgcttacttttgagaaaaatgctaataatatagtatagccatcatttactggaacttttttaagtgctaggcacttcatgtatttatccttataatagtccttcagtgtagatattattagccactgtacagatgagcagccattctcagaattctgaggactcacatagtaattcattaggcaagtgataagctttatgataaatacttgaaagggacctctaagagcatagaggagggatatctagtttagagttggaagattaacagaataggcttcacagagaagatgatgtattaagctgagtatttaaagacaagtaggaacttagacaaaatgatagattggaaaatgagtgtgtggcatggttatatttgtgaatagtctttgtacagagatataagagaagcattttatgagaacacctggtgctcacttaggcaacacatatactaaagttggagaacagctcaatatgactgaagcatagtatgtgagatggggaatttagagtggtttagatataaagacattaaactaggttgtattttatatatttatacatctatatctatatatctatatctatatgcatctgtggtcccagctactaaggaggctgaggtgggaggatcgcctgagcctgggagatcaaggctccactgagccgagattgcaccattgcactccagcctgggtgacagagtgagaccctgtctcaaacaaaacaaaacaaaacaaaaacccagttagactgctggaatagtccaaataagaaatcaggaggccttgaaacgtgtcagtgggattaaagaggagagaggtggaattgaaggttatctggtaggtgcaatcaacagacttagtggtttaaaaagtgagtgagaggttatagtcaggttgggactatgtattaatcctttatttttttaatttactgtactgtactatgtattattgttaatatcctttatttcagattgacatatacccttaaatattcttaagatcatatccttaaggtcttaatagtctctgaataaatattggtataagctgcttcctaaatgatttcccatttatttactggtgtttttatatatctatttagagactgaatctcactatgttgcccaggctagagtgcaggagcatgatcatagcttactgtaacctcacactcttgggttcaagtgattctcctgcctcagcttcccaagcagctaggactacaagtgtgtgccaccacacctggctcattttttaatttttgcagaaacagactcttgctatgttgctcagactggtctcaaactcctggcctaaagcgatccttcagtccctgcctcccaaagcagtgggactgcaggtgcgagtcaccatggctggcttgaggagtgttttttaaaacatcctggccaactgtgagcattgagacatcaatttatcaaggctttactgagtgctcaagggcccaggcacattctaagtcctggaagagggagcacagtggaagttctaggacttagctatctagttaaatatcttcagtttaaacagatttactcattttacaactgtgtaacaatttattttttggcagtttctgaacttccagttttcacgttctctagtattgacaacaagctgataatcttgctagacacaacagactcttgaggaaggaattattcattgtggtttatagacaatgatatttgaagttaacttgccccagggcaggagtatggttcttatataatgtaggaaaaggccagtcaacaccagacctcagagctaccatttaatgcattgtggcaaatgattcgcatgtattatcacacttaatgctcacaagaatactaccatgaaatagttaatatttaaaacaaatttttttattttttaaggagactgggtctcactatgttgcccaggcttgtctcgaacccctgggctcaagtgatcctcccacctcagcctcttaaagttctgggattacaagcatgagccaccgcgagtggtctttatcattattatcgctgttttacagatgagaaaactgaggcacagagacctgcttatggtgacacaagtaggaattgaaaagatgagatttgaatctagctggtctaatttatcctgaagttcaagatagcaatacaagaattatgaacatataaatggagtgagtggatatgatcgctcaagataaatctcttggccgggcgcagtggctcacacctgtaatcccagcactttgggagactgaggcgggcagatcacgtggtcaggagatcaagaccatcctggctaacatggtgaaaccccctgtctactaaaaatacaaaaaattagtggggcgtggtggtgcacgcctgtaatcccagctactcaggaggctgaggcacgagaatcacttgaacccaggaggcggaggttgcagtgagccaagattgcgccactgcactccagcctgggtgatagagtgagactccgtctcaaaaaaaaaaaaaaatctcttggatgagaaaactagacttaggatttaaggaaatctacgttaatggactggccagaaaaacaagtcataaaggaaaattaggaagtaatcatgagagagggggatgttatgtcctattacctgaagcagaaatataaatggaaaacatatcagtgttattaactgaagggaaaagaaaatataaaaatatatctgttataaaatatattctgtataaaactcgaataccagattgttgtttgcattgacgttgcctgtaatcccagcattttgggagggtgaggtgggagagctcaggagttcaagaccagcctgggcaacatgatgaaactccatctctacaaaaaattagctgggcatggtggtacatgcttgtaatcccagctactcaggaagctatagtgggaggatcacttgagcccgggaggttgaggctgcagtgagccataatggtgccactacactcctgcctggggcgatgtactgagaccctgtctcaaaaaaaaaaaaaaaaaaagagaaaaaaaaatttttaagtacttttttacttagaacctttcaaatgccatgttatgtgtctttatatacagaaaccctgggcaaagacagtatggctctttttttaagaattaggagacatgagtgtaaagcatatttgtaaataacgggcaataaaattaatgcggaaggtttggcttacattatttggggagggaacatataaaattcaatattcaaattgttacatcaacttgaagtacagtgaatcatgactcagaaaatgtatgaagatgagacaaggtagttgcctattggaatcttaaatgatacttttagtagagatcatgtaaatctgtgttgatgttaaagaaaagtgaacataggctgagcgcagtggctcatgcctgtaatcccagcacttcgggaggctgaggcaggcggatcagctgagatcaggagttcgagaccagcctggccaacatagcgaaaccccatctctaccaaaaatacaaaaattagccaggcgtggtggcgggcacctataatcccagctactctggaggctgaggcaggagaatagcttgaacccgggaggtggagattgtagtgagccgagatcacaccactgcactccagcctgggtgacaagagcgagactccatctcaaaaagaaaagtgaacataaacttttaaaacttcattacagagtaaaaagtcttattacgtttttctggccaaaatttataaacttttaaaatatttcagtgaagttgagctatattagaggtatctctttatgtacctctggaatggaactttgataactgtttattacagtagaaaataggatctaaaatgggtaagttcattatttcactttgctttcttaatattcatggaaggtattttgccgaaattatttttggagagtatatgaaaagtaagtaatattttataaaactgtattgcagctgatttggagaatgagtggctactttgaaaattgtcagtagataggaaataaaaataacagaatgaagcagctcacacacttcagagtttattctcaatattgttgaattgggccataatgaagcataatgcctggttaaactttattgcaattcaaacatcccaccagaaagaaatttttaaaaactatatcaacaaataaattcactgaagtctgtctatagcttcttctaggaactacaatttatttatttgtttattttaatattgttttttgtagagacaaggtctcactttgttgcccaggctggtcttgaactcctgggctcaagtgatcagcccgcctctgaaagtgctgggattacaggcatgagccaccgtacctggctgaaggaactacatttttgatatggtactctgctttaaacgcagtaggtactctgctgaattgggctaaataaacatttcacctctcaaaactatgtgaatatttggcttaagcaaagatagcctgggaccatgaagaaagctaaaacacttaaaaaaaatgtacccttatttaaaaagtagcatgtttctttctgatttggagtgttatgtttttgttgaaaaattggaaattacataaaaccaaaatgaaaaatatagagatgatcagtaatttcaccatgaatataatactcctcttatcattttgtattcccttccaactaatttttctcttaaaagtggcactatgtttttgaaaaagctgactactttaagaaaatttctctcagtttactttcttaatcgtgtgcttttctgaagagttggctctgacgttgactactatagtaaatccaattttgatgagtttttcttttttagtgggccaaaaaaaaaaaaaggaaagaaaattctcctttgtagaaaaaggagggaggatggaatgtatattgtagtacacctgaaaatccataccttttcttagccatatacacaattagtttactctttctcaagataatatttttatagtaaattaggattctttgttacaagtgatgggaaaccaaactagtgctatgctaggttaaaaaaaggaatttagggactcaagtcactaaactactcacgcgcacacacacacacacacacacactcacacacactcacataggggttcaattgggccttaggaatggctaaatctaaggtctcaaaagctgtcagtttttttccttcggttcgttctttgtctctgagagttagcttcactttgtcagcctgcttctttatactcttcctgtttttcactctgacttactgtgtttataattatcttgggttagtttttcttattgctcatttggaaaaactatcagtacttctgattagtaatttcagatgtttttatattttaattttgtatgcaaaataagtatccgtgatattttaaaaatatttactaagtatttccctagtctttctctaaagggtaatctcaaatgaaacaactggaactggattctcatttgtttaatgactgaagaagtcttccaattactctacaaaccattgataacttttgttatttgtgaccagtattcatctagtaagatgttaaatgcttttatgaaagagacaagtgttttacctaaagaatgagaaaaaaaaaaccctaattttttgtgaagttttctccttttttgctgagtgcttaaagaaaaaaagtttatgttgttttaggtttttcttcttgcttatcaccctaggaactaattgtgttactttttaaatgtttaaatttaatttttcctgtcccttccccatgcttgctaattatgttttttaaaggtgaccctttaagatggctcttatagaataaagagagacactgaattttctaatcttgtggaagaggttatatttagccattggtattttaagttggagcacttcattctactgtgcctttagtttatgagtcatctggagaaaatgggctgcttcttgcttttaggaagagtctgtagcaaataataataataagtgctatgggagattttttgccaaataatttaaaatggaaaatgttttgtaatatattttattgcccatatgtaaaatacgtactaaagaatataggagtttttggctcattattatctttagctcataaaaataaacaaaagaggctgggtgcggtggctcacgcctgtaatccagcactttgggaggctgaggtgggcggatcacgaggtcaggaaatcaagaccatcctggctaacacggtgaaaccctgtctctaataaaaaatacaaaaaattagccgggtgtggtggcaggcacctgtagtcccagctactcgggaggctgaggcaggagaatggcgtgaacccaggaggtggagcttgcagtgagctgagaccgcaccattgcactccagcctgggtgacagagtgagactccgtctcaaaaacaacaacaacaacaacaacaataacaacaaaaccctaatgtcacatataacaaaaagaaagcattttctaccaaaacattatatagattgttatgagttataggtaagtggaaagcaagcataaaccatatgaaattattttatatgcaggatgtacagcagtggtcaaatcttaatgataattgtcagtaactggggagaatattgtgattattgaagtattgattttttttcaaatatttttatattacatgtggtaactttttataatcttgttttatatctactttagtatgatagctttaccatactagatattctatgaggggtagacagttggcaaaggatgtgatattgattctaattttggctacctttgtattatgtgtatcataatgatttcacgcttcagttttctcatctgtacagtattttgttcttcgtgacttttcttgcaggaatgaaaggaggtagcatggaacaaagaaaaaagtgtatcatattgtaaaacaggaaattttaaagtcctagagttcagattttaaatccaagatgtcatttttgaggtaaatttgtcaggtctccctgggacacagaatgactgcatcactagaatcatgagcccgtgggattgtttttttctttttctcaaatgtatttatttaacatctctctccctctctacttacctacctgcctacctacctacttacctctgttgtgaaacttttgggagctcagtattgtctactataccaagaataccagtcctttactcatttttttgcattacaaagatcatatggaatatactggaggggaatttaggtcttttggttctgtgttagaagagcccattttgtttttccctgcatgtggtagtcggtgtataggcctgtttctgtgatgggaagatgacaccttttgtcaaatctctatcctttttgtatgtcaaggaatcatttctttgcagtgaagtagagtgtgccctgtagtatagcactctgtgtccttagtcatagcaatattggaggattggagagttaatcatgtttgagaagttaggggacttgttctttcagcatctatttaatgaatctgcttgtatttttgatatcctaatgtgtcccaacactgaactcctaatctttcctctaaaacctgttccacctgcagccctctctatttcacttgatggcagttttatccttctcgttattcaggataaaaacctgagactcattcttgtttttcctctttctcttatatcccacatctaatccttaaggaaattatactggcaccacttgtgaaatatatcctgaaatctgatcacttataccatctaaatcgctaaagtcatctgtacccccacctctcttttgtgccaccatcatcctttgcctagatttttgcagtagcttcttagttactttctttccacctttgctgccttcaatatcttgtcagcacaacagattggcggacattttaaaaacgtaagtcagataatgacactctaataaaaatgagaaaggtttaaaaatagtaaagataggaagcctggacaacatggtgaaacaccatctctacaaaactagctgagtgtggtggtgcatgcttgtggtcagctactcaggaggctgaggcaggaagattgattgaacctggaaggttgaggctgcagtgagctgtgattgtatcacttcactccagcccccgtgactgattgaaaccctgtctcaaaaaaaaaaaaaaaaaaaaaaaaaaaaggaaatattatttgcaggtgaaatggttgtatttagaaacaagaacatttaagtggcaggtagttacagaattgatacacacaaatatattttttatacttttgtatgtttaaaaaagccacaaattacaaattatgttaacagcaatataaaaagaatgaaacatgagtggggtttattctaagctgagttgttcaaaattagggtatctattaacataatttacgatgcttctcagagggtttctgttgttcactcagtgactgcagacccactagtactaatgaactactctcttaacttgttattgaactacaccttctccaatgagtctgagtctttaacattgcatactcttttaatctgccttggggtactatatagagctttcttatatcttatagttactcttttattagagttaaaatacttctttatgttaaacttctgtttaccttactctgtgatttatatcttttgattagaaaagactaatgtaccatattagtaggtttttggataaatttttatattattttcatagatgctagaagagcatttgccaaaattcatcattgattcttttattaactttttgtgaattaaagtataacatacatagaaaggtataaaaatcataagtgtacagctgaaagaattactgcaaagtaaacatacttgcttaactaccatttagttctagaaatagaacttggccagcagcccagaagcacccctcacccccaccttcttccccaaaggtatcttctgtcctgacttctaacattggagattacctttgctgttttaaactttaaatatatggaatcatatagtgtgtactttttgtctctggcttctttggctcatcattataagctttatccacattgttgaacatagcagtgcttttgttcattttcttttccatgtcctattccatcatatgaatttatctcagtttatttttatattctactgttgatgatgaatatttgggttgttactagtttggccatattacaaataatgttggtatgtgaacattcttgggtgtgtcttttggtgctcatatgcacatatttcttttctttctttttttttttttttgagatgaagtcttgctcttgttgcccaggctggagtgcaatggcacagtctcggctcattgcaacctccacctcccgggttcaagtgattctcctatctcagcctcccaagtagctgggattacaggcacacgccaccatgcccagataatttttgtatttctggtagaaatggggtttcaccgtgttggccaggctagtcttgaactcctgacctcaggtgatctgcctgccttggcctcccaaagtactggaattataggtgtgagccaccacccctggcccaaagtgttatctttagaacagcagaaatgggagttccagtttttccactgttattttctatcttcagacaaacaactgtttagttatactggtaaactggcagtggtatatcattgtagttttaattgtatttccttgaccatgaccactaataaagttaagcttttaaaaatttatttatatgttgatcaattagatatacttctttgtgaattacttaagttttttacccagttttctattgggtgtttaagaatattttatatttatttatgtatttatttttgagacagggtcttgctccgttgctcaggctggagtgcagtgatgtgatctcggctcactgcagcctccgcctcctgggttcaagtgattctcccacctcagcctcctcagcagctaggactacaggcgtatgccatcatgcctggctgatttttgtattttttgatagagctggggtttcaccctgttggccatgctggtctcgaactcctgaactcaggtgatctgcgtgcctcagcctcccaaagttctggtattcatctgcaagccaccacgtccggcctgtttaagaatttttaatgaatttggctggatgtggtggctcacacccgtaatcccagcactttgggaggccaaagcgggcagatcacctgaggtcaggagttcgagaccagcctggccaacatggtgaaaccccgtttctactaaaaatacaaaaattagccgggcatggtggcacgtgcttgtaatcccagctgcttgggaggctgaggtgggagaatcacttgaacctgagaggcggaggtggcagtgagccaagatcactttattgcactccagactgggcgacaagagcaagactctgtctcaaaaaaaaaaaaaatttttttaaatgaaaaatctctgtactcagggctatgacactttttggttggcatatgtctttttggacttgttctttcattctttaaatggtgtctttgatgaaccgatgttcttcattttaatatggaccctctttttggtgttcctccctttttttagttttcagaagatattgtctatgattggttttacttctattggttttatttcttaaatgtttggtggaattcactggtgatacccttgaagcctggagttttctttgtaggaatgttccattaaaaaaaaaatacttaaagggctttttagattttttttcacttcttaaatcaactttggtaaaatttctttttctaagtatttgtacattttgtcttaagtgttaaaatgcgttagcataaccttttccctacagtatctttctgtgatttttaaatatgcatatgacctatcatttctgctaatgattatttgtgccttctttgtaagagttcatcaattttattagcgtttcaaagaactaactttggctttgttggttctctgtagatcatgatgtatgttttctatttccacgtatttagctccttttttttttttttttactttctttgggtttcatttgcagtttttttccttaccctaaccctacagttgtttttaaaaaaagattcttgagatggatacaggaccatataaaaaattttttttatgcatggcaagaagtttgcataaagtcagaagacaaattacaaacttgtaaaaaaattatttaataccaattacatcaaagtccaaggcctacttctttaatatgtagtgagtttctaaaagtcaataagaaggaaataattatgtattaaaaatgagcaatgtttgtgaagagttgatgtgtagaaaagttaatattaatggcagtaaaacatatgaaaggatgttcatcgtctcatgaggaattcaaaataaaccttctattattaaattggcaagtattttaaaaatcagtaataagtagtatgggcaaagttatagagaataggcgctttcataagctatcataaggatataaattgctacaacctctttgaaggagaagtttacattatttatcaaaattttaagtattcttttttttttttttctttttttttgagatggagtcttgctctgtcacccaggctggagtgcagtggcgccatcttggctcactgcaagccccgcctcccaggttcacaccattcgcctgcctcagcctccggagtagctgggactagaggctcccgtcaccacgctgggctaatttttttttgtatttttagtagagacggggtttctccgtgttagccaggatggtcttgatctcctgacctcattaaccgcccctctcggcctcccaaagtgctgggattacaggcgtgagtcatcgcgcccggcccttaagtattctttaattcacgaactatgtgtataaagatgtttatttccatattacctataaaagccaaaaaactagacataacctaaatgtttattctagagactaggttgtagctacccaatggaaaactatgtagccactaaaaggcaatagactgttggtactggttgttacagaacaagctccaggaaagtttttttgcagaaatacacattttattaaacgagtttgtgggtgaagtgtttgtattttgtgtgtgcatagtaagtttctgaagtgcataactttgtgtatctcactaggtaaatttgagtgttgtatttatggagttggatttacaacatctggtatttactattcagtatcactttaggttatgtttcgttttctcacttatattgtaagctcatagaaaatggaagatatggactgtgttttatgcttcataattttctccacattgcctagcatagtatattgagtgtgaaacagacttggtttttaaaaaacaatttaagaacaaatttaacactaaatatttgttttccagtttcagaacctgttcacattatctttggtgagctgtattgtagctctctgtagtagataggtataatactcattaatttattcatatgttaccatagggcgaactgagcccaagtgaataagtgagttatttaaagtaggggttggcaaactatgagctgtgggctaaatttgtcccacctcttgttctttatggcctagaagttaagaaaggtttttatatgttttaatgtttgggagaagaaagcatattttatgacacatgaatgttatatgaaatttaaattttagtgttcataattaaagtttattagaagacactgatgcatattcctttatgtattgtctatggctgccttcccaccactatggcagaattgagtcgttgcaacacagattggagttggcattttcattgcttcacactgctgcttggcatactacacatctcagtaatgcagttataattcaacagtgtttcaagtgccatatgtattgctgtgctataacactgtattttttttttattactagggcatacctatatgtcaaaacaagaaaaggagaaaatctcatggttttaaagcacagtggactggggattattttatccaattagatggtaaagcattaggtttattatgcccttctaaagaaatagaatatatattgccattaccaggctaagcacttacagtgttccaaattcataggaacataattctcataaaaattcaaaaatttgaaatgtaatatgttacaacagcagaatttttcatgcactcactttttctctcactcactctcacactgaaaaggaggctggacttaatataagattttgaatgacccatttgttagcaaagcaaggagagctatttactaatggtaagttagtaaattttcattgtagcagctaaagaatattttcagaaaaaaattacatttttaaaaatatcattagccatttggtgaccatagttgctttaagaattgaggacattaggctcgttgcagtggctcacacctgtaaccccagcattttgggagtctgaagcaagaggatcacatgagcccaggcgttcaagaccagcctgcgcaacatagtgagaccctatcttttcaaaaataaaaataaaaagagtattgaggattttaggccaggtgtggtggctcatgcctgtaatctcagcactttgagaggtgaaggtgggagaatccacttgagccctggagtttaaattcagcctggacaaatggcaagaccctatctctaccaaaaaaaccccccaaaaaaacaaaaacaaaaacaaaccagaattgaggacattagccaggcatggtggtgtgcacttgtagtcttagcttcttgggaggctgagatgggaggatccgtttgatcccaggagtttgagttcagcctggggagcatagcaagaccccatctctaaaataaaaacaaaaaagtgaattgaggacattgggtgtaacatcggtagtcagttaaagaagatagtggttttacttggctctgatgaaccaacagatgttactgacactgatcagttattcaaagagccaatgctgagtttgaagtgactgaaaaattagctttcatgaaaagtcgatgaaacatctgcagacgtgaatattttcaaaaaatttgagaaaacactaattcagcataatctgaagtagaatctgttaagatgtgttgctactgatagtagtaaaaatatatgtggaggccgggcacagtggctcaagcctgtaatcccagcactttgggaggctgaggtgggcagatcacttgaggtcaggagttcgagaccagcctggccaacatggtgaaaccccatctctacttaaaaaaaaaaaaaaaaattagcagcgtgtggtggcatatgcctgtaattccagctactttaggaggctgaggcaggagaactgctcgaacctgggaggtggaggatacagtgagctgagatgatgccattgcactccagcctgggtgacacagcaagactctgtctcaaaaaaaaaaaaagaaatatatatatatatataaaatatattaaaatacatatttatatcataaactttgtagatttctccacttaacctttttgctccatatatattttaaatatacattatacatatatatggatcagaaaaaagggttaattggagaaatctacaaagtttgtgaaactataaggttgtaaagcctatggctattcattgtattatttattagcagctattttgtagacaacatttgaatctatgatttattatttgaatatcatttattattgaaccagtattatcaacagtgaacttcatttgctgtatgaagagatagttctgtaagtttttatcagaaatttaagctgtatatttgacttgcctgaccacccatcagtttgattactgcagttgtttgagcttatggtcaagattcaaatttttctaaacaaggagaagctccttcaactactgttattgcatatgaaatggctttgaaaattagcttttactgaagactttatattgtttcttttctttcttcttcttcgtcttcttttttttttttttagaaacaggatcttgctatgttctccaggttggtcttgaactcctggactcatgtgatcctcctgcctcaagctcccaaagtgttgggattataggtgtgagccatcatgtccctggctaatacattatttcttaatgatactgatattgttgttgtttgtttctttctttctctctctctctctctccttgtttccttccttccttccttccttccttccttccttccttccttccttccttctttccttccttccttccttccttccttccttccttccttccttccttcctttctttctttcttctttgtctcttttctcttttctcaacagggtttcactctgtcacgcaggctggagtgcggtggtgctgtcttggctcactgcaacttccacctccctggttcaagcaattctcctacctcagcctcccaagtagctgggactacagcctcatgccaccatgcccagctaagctttttgtatttttagtagagacaggatttcaccatgttgaccagcctggtctcaaactcctaatgtcaagctatccactcactttggcttcccatagtgctgggattacaggtgtgagccactgtggcagcctttatatggtttcttaattttgaggcataccagtgcttatatgtaaaacttatactatggtaaagttatttgacagcagctaatgtagtttgaatcacaagtaatgtcaagctgctttatatacaatgtcccattctgtcaaaagttaaaacaagaagtgatacttctatttccacacacatttgtagcagatgtttgtgggctcaaactatagttttagcaatattgatgccagagcagagataacttctttatttcaaaatccatctaacactgcaatcacggagcttctaccttatgttacattagaagtgattaatctgcaatctacatgctaaaggggaaatatcaagaaaaagctctgatagaattctataaatgctttctaagtgataaatatgcttaatttaaatcatatgctattggatttatatcagtatttgggagtatctatttgtatatagagacattcaaagttgaaatatgtgaaattattatagatcaatgttaacagatgaatatttgcgatcaattttgattgataacagtaactttggccaggcacagtggctcacacctgtaatctcagcactttgggaggccgaggcaggtggatcatgaggtcaggagttcaagaccagtctggccaatatggttaatccccatctctactaaaaatacaaaaaattagctgggcgtggtggcgtgcgcctgtagtctcagcttctcgggaggctaagacaggagaaacgcttgaacccgggaggcggaggttgcggtgagcccagattgcaccactgcactccagcctgggtgacagaatgagactctgtctcaaaaaaaaaaaaaaaaaaaaagtaactttaaacaccaattaaatgaaatgttatttcccctaaaagaattacattcttctcattactaaacctgataaacaaaaaattttattgttattaatattcctaaatttgtcagtaaaagttttttgttttataagtacctagataatgtccttggtttttttctcattacccatagagcccaaactatttactacctggccttttacaaagaaagctttctgaccctcatcttcttctaaaagaataatagatgtctaattagaaaccagttatgcattgggttgagtatcctttattagcattttaaagttcttgcatttcgaaaatactaaaaatactcaaatttagaaaagttagttgtcttcataatgtaatttaaatgtttgaagtgttacaaaagagattcacctgcaattaaatatcagcagagtgtgtcctgtacccttatcctgcaacacttttctcctatagtaactgaatgactttggaattcagggctttgtatttttacctttttttaaagcttatttttgctttcttttcttttctgttttttttttgtttgtttgtttttttttttttttttttttttttttttttttttttgagatggagtcttgctctgtcgaccaggctggggtgcagtggcgtgatcttggctcgctgcaacccctacctcccgggttcaagcgattcttccacctcagcctcctgagtagttacaggtgggaccaccatgcctggctaattttttgtattttagtagagatggggtttcaccatgttccctgggctagtttcaaactcctgagctcaggcaatcagcccacctcagcctcccaaagtgctaggattataggcatgagccactgcccccagcctgtttttgctttcaaatggactgttgatggttttctcagagtgctttacttttgaagtccagtttgtactggaaagaatttatattccaggctgggcacagtggctcatgcctataatctcagcactttgggaggccaaggcagatggctcacttgagtccaggagttcaaaaccagccggagcaacttggcaaaacctcgtctcttaacaaaaatattttaaaatgagctggttatagtgctgcatgcctatggtcccagctacttgtggcactgaggtaggaggttggcttgagcctgggaggcggaagttgcagtgaacccaaatcgtgccactgcactccagcctccattacagagggagagcctgtctcaaaaaaaggaaacgaatttatattccacattttactgagtctagtgtgagtttttgtttaaaaaaaaacaacccaggaataatttcttcaaattcataagcatggcaggcagttttattttaaattctgtgggaaatatgaatttaaggatctcatgtaccatgccttgataatcatttctctgtaatgtatattttggcaaatgatattgttatgaaacatacttttgcattaatattaactttatgcataataaagatgcatcttcagttttttgtttgtcctatgagagtttacagctggggacatcttttacaaaagtatatttataacctgttcagaagatatgaaacacaataatgagataatcacctatgtatttttcagttagcagttacaaaaggattattgacacttatagttgttaatatctcagtaaaaacatactcttgtgcttattttaaaattgaacgctagtctatatttttaaagtttccttttatggaatattttgtcttttggcactttgcatctggattatagttcccccatttaagaaagaaacctgtttctattcaataggattaaaaacacactttcagttttagagcagatttatcatctacccttcaggctattctttaatatggagctcttaaaaatgagtatattaagatattccccagatgttttaaacttcagcaaacttgtggttttctttatttgtagtatttggaagatgaaagaaagtatctccagtatctaaacacttttcatattggttttaatgttgttttttttttttttttttttttttttgctagaaaggcatgcacaagataaagcttctacactgataaattttcaaagtccttgcttttaaaatatcaagctgggtgcagtggctaacgcctgtaatcccagcactttgggaggctgaggcgggtggatcacctgaagtcaggagttcgagaccagcctggccaacatagtgaaaacccgtctctactaaaaatataaaaaattagctgggtgtggtggctggtgcctgtaatctcagctattagggaggctgaggcaggagaatcgcttgaacccgggaggtggaggttgcagtgagctgagatcgcaccattgcactccagcctgggcaacaagagtgaaactcttgtctcaaaaaaaaaaaaaggtattgtcaaaatgagagttgtattagcagtaatgtaaaagtaatattgtatgtctgtatacttttgaatttacattgttatgtgattcatatttgttttgtatagctgtaacatttggttaattgtttagtgggttattgaatagattattttcttcattacttagtacagtggggattgagaatgctttgtatcaagtgtcttacaagtattgggaagttcgaattaaaaatattaaagatgtcagtcatttacttctttttttttttaaggtggtagcccaattgaaaattttctgcaaaatcagtaactaagttatttttccacaattataaacttagttgatggcatttattgagtgcttactacgttcaaggtaaatgaaatgaaagagtggaatagtgcattatacacgcacacactcaagggaagcaagtataaacaccttatttcatctcacttgtttagaaatttgattttgttttttcttgctgggtaacatatctgtgttaatcgaaaatttatgacttagagtggaatttctctaaaaagcagtaggtgacagggatacaagataaataatttcatcagagaatagaaattcttttttacaatggataaaattgtgcttgtaacagggatacaagcacaaaccaaatcaatgtttaattattttaaaaatattcaagggaaatctagttttgttaaaatttgtataggttggtagtgtgcatgttcttaaaaatccaagaacaatagcagcagcaattcttatttaatctttctttagtgtgtccattcaaccattcattcatcaatttttttttctgtgtacccattattcatcaggcactatgcttaaatatcgtggaacacaaaaagaaatagtctttaatgctgtgttttacaaatgaggaaacctaatctcggagaacttaaattacagttgtcctttggtattcatgggggattggttccgggaacttcctcagataccaaaatccaaggattctcaagtccctgatataaaattctgtggtatttgtatataacatatgcatatcctcccatgtactttaatttctagattacttataatacctaatataatgtaaatgctgtgtaagtagttgttatactctcttgtttagggaataatgtcaaggaaaaacactctttacatgttcagtacatatttttccaaatattttcaatctgtggttggttgaatccatggatgtggaacatacggatatggagggccagccgtacttgccccatgtcatataattagatgaatatagaattaaagccaggtccgtctgacagagcgtttgcttctaaccattgaggaatgttgcctaccctgatgactctactataggaaatcatatattgatatcaaattgatcttatatgtctgtagtgaggaacttggccatgttggacctatccccttccctccttgctcctctcctttcttcctcccttacccccacagcttcacccctcccttagctcttttttctgacaggtggctgtttccatccctgtttgctggcaccttctccacttaaattttggtatatcccttggttccactctctgtgttcttctcttgtgtatgagtgtggattttgtgtttgcttatcctgtgtggagtttctgagcttgaatctgttaagagtatgtcattaatcaaatttggaaatttttaagccatttttttttctttctttcctttccttttccttttttagaagcaggttcttgctttgtggttcaggctgcagtgcagtggcacaatctcagttcactacagcatcaaactcttggactgaagtgatcgtcctgcctcaacctcctgagtagctgggactacaggcatgcatcactatgcctggctatttttatttttttgtagaagtagggtctcactatgttgcccaggctggtttcaaactcgtgggttcaagcagtcctcctgctttggcctcccaaaatgctgagattatagttgtgagccaccatgcctggtcaagccattattttttcaatttttttttttctgcaccgcacttcttttcttctgttactcatgcacaaatttagatcttttagtattgtcctataggtctgagtcttttttcattttttaaaaaaatcctttttctgtcctgcagattggaaaatttttattgatttatttttaagtatactgattaacagtcttcttcattttactattaagcccatctagttagttttaaatttctagttattgaatttttaaattctaatatttttattttatcttctttatcttctgtttctttgctgagtcttttcactttttctagctgtctgaagagtcctagtagtttgtggttccctggagctctccgccttggtaatccagccagagaactggggctttattttctcagctctgcacatacttcctgtgactgtaaccatgtctgggtctaagtagtaggcagatactcttctcttgcttttttctttcttgtgttttagtcaaattattttacctcttattataactttgtttattattatttaccaacactttatatgcaaattgtagattattcagattgtatcttctaccagagtgttcactcttttctgtatgaggctgatacggagtgaggggagagcttattaccttaataaaaattaagggttaagctaggtcaaagttgatttttcagtgttgacagttcagttgagcctgtttgcttctgttcctagagcctgaacctctaggacttttaattgataccagtggtctccgctctgaaacagtccaccagaatgagggtaccaaactgacctcagaggtttccaggttaatgcagaggtttctagcttaatttctttctgccttcaaaatttggcaattatgtcaaaggggaaaatgatcttttgttttaggttttcagtttccaatgttactacttcagccttatgtaattgctaaaatccctactgttttccccctattgcccccttccttatcattatcttctgctaagcacaaagtgtgaattttcaggttccacatgtaaccagtataagtatatccttccccccaaaccccagtggaaatgtgccacggatccttatttttattctccactccttctagggctttcatttcttgcctattatgtttttagttgctcttttcttgttctgtctttgtaagcacagctagagtcagagaactttctgcttttggaactattttggttaacctctttaacttagcattcagtttcagaattcagcaaatgtgttttggggcaaactagctgtgtgttttaggtttgggaaatgtcaaattttgtttctctgtcttcatgcttctggctgcaaatgttggcaggtggaacaaaaagctgccagttctggcctgcccctgtgaacaggtctcacctctccggaaatttatccactttgtccttgttgcttcagagctctttggtaccattaacaatgtgacttatgatttatatggccttcctaggtgtcatcagtaggaatgttggctgtgatgcagtatatgctacccagaatcggaagttccatatattatgttttgataagagattttaggtgtttgagtatttctgatgagtgacattttttgaagtttgctagagagaaataattagctagttattgcttaactactctctctccatatctattacatatgtttctggaatatttctatggtcagagaaactcaggcccattataaaccatggactctggtagaaatagaagctgaaagcaaaccagtaagggaggtggagtgtataatttgtgttttggaagtacctgccggtggacttgggggtgatgctctaggtttaccatgagattactcatctaattttgagaaccactgtcctgcagtatttttcttttgcttacatatgactttttctttttatgatttaaaactaaatgtcaaccagttactatttaatgaaaatcataaattggtttagtgaaattttgttgtgttcttacaatgggtagaaacctaatgcacttatcatgcatctaaatttaggaataattcattttattttaatcatctatacttatatacaaaatgcttttcagcagtatatttgattatcttaggtacaatgatcttcatgttcagagttataaatgggaataattaaacctttaaacatattagagttgaataagggcttatctaagcaatacatgcttaaaattgctttcttatcaaaaaaataaaattggaggttcaagaagtgtctttaaattacaatccttatgaactaatagcttaaccttagttttgaataactgttactttttccgtcttttaaaaagatgcttaaaaataaacgcatgtcgaaaatgttattttggcttttagcaaactgacatttgagttttttaaaacctcactaaacatttgtggtaaaagatttcaaagctttgaattttacaatttgcctgtcgattccccccctgtgttattctattaacatttgatcttaataagtataacctgtttagaatgacttatgtttttaattatttgtttagatgagaagtttaaggaataacttcatcagaaattctacttggcagttatgaatgctttcttaaggaagttaaatttttggaatttcactgtaaagattttaatcacatgtcctattcttcatacatcaatctataaatgttcaaaaattgttaatgttgtttttatgctgtgctgatgttaacacaacgtgaggtcttctttcttctcctgataatatgctgagcgcacacacactctcatatgctcactcgctctctctctctctccttccctcccacccctgagtttgaaataagttagtggctttagtttctttgaaaatggaaagcaattgcccttaggtagaactggaaattgtaaagtgttggttttgtggacattttcctgttcataattcttgttatatcttatttataagtacttttattcatataggaataaatgattctatgttgaagggtataatcatgaagtcttttttattttttcgtgttagataaggagaaaaatgacacattaaaaattacagtgctatttgtgttttaaaatttcttctgtcgcttttgtattccttattgttctcttcactttttctattgtttttctagcttttcaggatacattttctaaatgcatcctaaatataacttacaatagttgccttttatttaaaagtaatacatttagtttccaaccacaaagtgtttaattctacatatttctatttttattttacatgatcttaatatatccttgattactgtgttgatcttctagtttttaggctgccacttataccatcaaaagccatttaaactggacttagaggataatgaatctaaattttcttatcttcctcaaaacaacagatacaattaaagtcacaaataagctgtaccttcagaattgctaggagacagaacatagtaagaattcaaatctcttataagcagagttataaacatcatattccaatattgattctgctgctttgtctgtacatttggagagcagaggtagcagggaggtttaagagactgaaaaaagggagaggggtgtatgaagtgtagatcagtaacaaacaccatcactcttgaaaagaaaaagtccaacagaggtcctagacctgtgttttagacaggtgggaggacagtaaattaatttttaaagacaaaataattatattgaatgaatttattgatcattttgttgaacagttagtataaggacatcccgtattatatttcagctttcataaactataagtgtttatgtcttatattttgtgttctttcaactttatcttaatttgcttctgttatttttaatgccatttttgtacatttgtttaatattactatattcatctttgttgtaattttttcctgtaataatgtaacataaataattataatattacaaagtttattaaatttcttccaatgataattaatatagtaggcttgtggtggaaaaatggatcaggtactgtccttccaattctgtcaggcttttgattgaggtgtttatatggccaccccgttcagacaaagaatgtcaaccaaaaggagaaagtaagaaggaatctataaattactaaaattcccatactttatttcctatggaaaaagtcatgtaaggaaaatatatagaagtttcccgtaaaatgtaataatatcataaactctttcatccttaaacacctgttagtcttgccacagcacaatcagttccctaaagataaatatttcttggtttgttagttggctacttaggagttccttttccttcttatgagttttcttctctcctgtatttcttttctaacaccatccaactggttatccaaactagcaacctcagaattttcatccctcttccacatcttacatttctttatcacatcctgtgtcttcaacttcggaatgattccttactttggtctcgtctctctatcctgtctttcgtatgagctattctaaaggcaggtggtctgcttctctttactctgtccagtgttatcatcatttttaaaaagtctgcttttcacactgttgctaaatagagtttaataatttctagtagccttcagaataatgtctacacttattagcctgatagttaccttttctttgtcagtttttactactttgattttgacctgcattttagtctgtgtttaactggtttttctgaatacgtcatgtttattgttttagcctcaaccctgaattttttttttctcccttaagtgtcaaatttcaattcagatgttaaactttccctgcctttttcattcagaatcacttctttctttgctcttgttttttattcagctttgttctatatatggttctttaaaaataattgtatggaaaattgctatgttcttttattataaaatgaagttgatttttcattacaaaacagtttatatgcttattgcacaatctaaacagatgtataaaagagccataattgttcctaatttggcgataactactgttaataccttggttgtattcttccaggttcttttcagtagacatgtatattgggtaattttgtttacacaaaaagattacattgtgcatcagttttcataaattagcacttctcatttgaaataacatggaaaatacctatcaatagatgtaaatctattttaaatctgtaacatttaaaaatgtttaacacttaagtagaagcaacacatacacatagtaaaactacatcaaggtggaaaattaaacgcttatttgaagacttctaattttgggaaattgactaattctgctattcttcaggatttctcaggccaaaattcagaacaaggctaaatttgcccatttccacctactattatttattctttctttatattatgctagagcttgtaggctctgtactaacacaagaaaggggaagaaaaaaattgtccttattcacaaatgataattatgtttaatttattaaaaacacataaatcattggagttaattaaatattagaaacttggctggaaaaaattgatataaagaatgtttctaaatatcagccacaaataaagattaaacaatatcataatagtattaaaacataggaagtatgaagtagtgatcagaataaaagatgtggaggctttgtggcaaacattatgaaactttgagagatactgtaatcatggattagatgatttaatattggaaatatatcacttttcccagcatagatatagataagtagtgcaatcactgttaaaatcctaacaagttgggctgggcatggtggctcacacctgtaataccagcactttgggagtccgaggcaggcagatcacgaggtcaagagatggagaccatcctggccaacatggtgaaaccccatctctactaaaaatagaaaaattagctgggcatggtgggatgcgcctgtagtcccagctacttgggaggctgaggcaggagaatcacttgaaccagggagtcagaggctgcagtgagccgagatcgcgccagtgcactccagcctggcaacagagcgagattctgtctcaaaaaaagaatcctaacaagttggtttttggagtttgacaactagttgtaaatttatatggagtgcaaaaaaccaagaacggccaaagcactcatgaagaacaacagggtaaggacacttgtagatagagtgtgtgtgtgtgtatgtatatatatgtgtgtatatatattatatatgagagatagttataagatactggggtttctaagtcagtccagtgtgttttttcttaacctgggtagtggttacacagacattcactttttttttttttttagaacagaaagtttctaagaatttatagcaccaagacattcattttttaaaaattgcacatttattttacttatcctagagaaatttataaaaaacaaaagtaaactataaacaccagttaaaaaaatccttttatattaactccatagagatgcaaatactgttaacagttaatgttttcaggggcctggctccatggcttgcacctgtaatcctagcactttgggaggctgaggtgggaggatcgcctgagctcaggagttcgagatctgctgggcaacatggtgaagcctgtctctaaaaaaaaaaaaaatacaaaaaaaattagccaagtgtggtggtgcatgcctgtattcccagctatttaggagactgaggcgggaggatcccttgagcccaggaggtggaggctgcattgagctatgtttgcaccactgcactccagcctggatgaaaaaggaagattctgtctccaaaaaaaaaaaaaaaaaaaaaaaaaagttaatgtttttagcttaccattataagtctaaataatgaatttgtgcttatttttaattaacaaacttatacaatgtctgtaaactctatactggaagatgaagaatgtagtgcacttacactgttttgcctttttattcttccttatatttgctttagtttgattttttattgattgactttatgacttcaacaatatatttaaaacctttttaaaaacttgatttttaacatttgagatatttatggagtcttctccatgaaagggagaattttgcatgcaatagtgtatgatgggcacttttaacttttttatggctttctttttcaaagtcatacaccactttacttttcttttaacctaattccatctttcttctgttttttttgggggggagaggttggaacatctccttagtaattttttccacataggaaaaaggattattaaatattactttgccttattaacctgataatttgagtacatattgaaaatttctagtttcaaaaatttcctcccttctcagcatagaatacattactccattatatttttagcatccggtattctttgagaagttaagtattagtctgatttttattccttttaaggtaattattatttttcacattatatgctttaaaggttttatcttaatatgagagattaaacaagatgtgtccaagtatggggtcctagtccctaatcccttgtaaaactgcttgatgtttggaaaaatctgaccatatttatgtttcaccttttttttttccaacatttctctcttactcttcataatctctattttccctttctgtatttcctgttaaacagatctcagaccacctaataaattctctacaccttttaatttttatttcatatttttaatttcttatattttctatctacttttttggtctttttaaaaatttcaacttttctatttttatcttagtttttacccatgcatattttgattgctcaggtaatccatccaactattgatttttcaaaaatttttcaataattgttagtgtacagaaactgtgtcattctctagctgcatcttttcatataattagataggtctgtttgtggcatctttctttccttgctttacaggcagtactgttatacttttgtttatttttatacataaaacatattttttgacgtttagtaagatgtggaagaggaaatgaacatatacttcatctcttttgaagtgtaaggtcttataattttcatacttcttgaactgattccaagggtaacattaagtgaaattttgtttagtttctatagaaaactctgttagttgtctggaatgaggagaaatacatgctgatttctgtatgtttgtagtaacaagtgattctgagactgggattctgattttgacttaaccagtttgccacgtgacctccatttggcaatctattaattattacttttactttctgtttagtttaatggccaattatggacagtctgttttaaattcttaaattcttatagttgtacacttatggaaaacatttcttaaatgtggaaatttagtatttttgttataagatatttcaattcatttattcaacatacttaaacaataaaaacattttactatttgtgttttaatactcttctgctcagaaaagtttactttgttgcaactcacagaaggtaacttacttttttctactgtgatttccttataggtttgatgaacttgtgaaaaaattcaaagtcgaatatcatgctggtggctctacccagaattcaattaaagtggctcaggttggttaattattttaaaagttaaaaggattcaaaatgattctagacccatgtctattttgcataattgtttccttttatattgtgttgctgtagaatagttttgttcatttgaattgggattttagtagtcattgcacatctaatcaaaagttattttaattggtatttctttggttattggtaagcttgaacttttaatgtttattgttcatttgtgtttcttcttaaattgtttcctttcactatcattttataatttttcatgttacagatttgtagaaacttcatattttatagatagtattcctttttattttataagttgaaagtatttattttttgttatgtgtacattaactcttacagtgtcttttactgtgccttagttcttaatgtaactttcaaagtttttaacgtaattaaactttatggcttcttcatttcctgcatgtcccccttacgaaggacgtttctgccacaagatagtagaaattgctctgtattatatatagatatctatatacataaatgtacattcatatattcatacctaaatatctatgtatagacatatatgttggtagatatgtatatgcatctatatatctataccggtgtatatcttttataaatctatatatctgtctctattcccatatcttccaatgagtaattgaataaacccattaggcatatactctttgagttaccagcttaacctaatcttgattgagagagttagtgatctgtttaatcttccagctttgaaagatatgaacaagttttacatacctctggttcttacctctgcagtttgaagttaactcaaaattctgctcattgcaatcatgtgtcagttctgcctacactagatttctttttcttttttattgattaatgctttccccttgaattctgattaacttcaagaactggggaagtggaaaattgacaaataaaatccagaatgatttcttttcaagtaactcttagttgattgagacatatagtatgattattccacatacttccaagctcagatttaatcatagttttcaaatattttgtaaaaatgaatctttaaggcggtcattaatatgaagtggcctgagtctttgtattggtcaattgatttgtattgtttttggtaaaacatcctggtggtcactttatgaacttccagagtaatagaaaaaggatgatttacggccaggcacggtggctcacgcctgtaatcccagcactttgggaagccgaggtggacggatcacttgaggtcaggagatccagatcagcctggccaacatggtgaaaccccgtctctcctaaaaaaatacaaaaattagccaggtgtggtggcatatgtctctaatcccagctacttgggaggctgaggccagagaatcggttgaacctgggcggtataggttgcagtgagctgagatcatgccactgcactccagcctgggcaacagagtgagactccatctcaaaaaaaaaaaagagagaaaaaaaggatgatttacttaagccttaatttatcaaggcacgttttgcattttgcagttttcagtcttttctcctgctagaactgggggtgatatggttaggctttgtgtccccacccaaatctaatcttgaattgtaatctgtataatccccacatgccaaggaagagaccaggtggaggtaattgagtcatgggtgcagtttccttcatgctattctcctgatagtgagtgagttctcacaagatctgatggctttataaggggctcttacccctttgctcggcatttcccattcttgctgccttgtaaagaagatgcctttcttctcctttgccttctgccatgattataagttttcagaggcctttccagacatgctgaactgtgagtcaactaaaacttttttctttataaattacccagtctcaggcagttctttacagtagtgtgaaaatgaactaataccgggaggctattagctgttcactaataaattgtctcctttcttggggatcttcatcagtttctgccttctaaaagtttattaattatataattaagttctccctcagctttctccctgatattagtctcataataaaacagtcattgcctacttttattcttttgcacttttttttttacaatatttcacattcattctaacaacgtattctagtagtggtttatttgttcctgtctttagcaaggtaataaaaggaatttgaagctttgggtaacttattctgtcagatcttactagtaatcatactttcatgtatcaagtgatatggcaaattatgtcaacaagaaaatgtccccaaagctcttaggtattttgatatgtcaaatcatgtttttgaagattttaatgaaaccataggcaacaaaaacaagtatggttgatatcttgtccaaacacaattctagatttatttgatacacagcacaaatgtaaattttggtaaatttcatttggtctgaacttcttcctaatgaaagtgaaaagttcttatctgctcaatatcctgcacagcatgtatataacactgctaaaaaggggtataacttgcttaagtttgataattgatgctttcttaatgaacacttttggttactttgtcagtttttaaaaaatttgtagaagcacttaatgtgagttttgacttgaaagaaatggaaaaacgttggcattgtgactcatgcctgtaatcccagcattttgagaggctaagttaggagaatcgcttgagtccagtagtttgagaccagcctggacaacatagtgagaccctgtctctaggaaaaaaaaaaaaaaaaagaaatggaagaaaatgacttccttggatatgtgcctaaaagatggctattattgttgctggacatagatgccctgcagtacaatattaacaaaatatgggaccaaaggaatgcccatctctgatttggcagtacattgagaatgagaatggaaaaagaagattatagtaaaacaaatatttttatgctgtttctggtttttttgtttgtttgtttgtttcaagacggagtctcactctgttgccaggctggagtgcagtggcgcgatctctgctcactgcaacctctgcctcccgggttcaagtgattcttttgcctcagcctcccaagtagctgggactataggtgtatgccacaaagcccagctaatttttgtatttttagtagagatggggtttcaccatgttggccaggatggtcttgatctcttgaccttgtgatccacccgcctcggcttcccaaagtgctgggattacaggcatgagccaccgtgcctggcctgtttctgtttttgaagaggccacaagtgggctagaaaaaacacataccaaaaaaatactcaaataattttatttgttcattatttattaatttttttgagacagaatctcttgctctgttgcctagactggaatgtagtggtgtgatcatagctcactccagccttgaactgctgcgctcacagggtcctccttcctccatctccacctccatctcctaggactacaggcacaccctaccatacctggctaatttatttgttgtagagacagggtctctgtgtgttgctcagattggtcttgaacttttggcctcaagtgattctcctgtgttggcctcccaaagtgcgaggattacaggtgcgaaccattttacctggctcaaatggctcatttttatatattaagagtgcttcagaactcaagtaaaaaagtcacagaaaagagcaatgaggttaaataaaactttttttcagtttctttactaaaactgtaacttacttggaatccagttttgacatcagaaattcaaattcaggtgttttaaaaccatttctgcaagaaagaaatttaagttaggatgatagccaatgtctttcagagtgttttaaagtgatggacattttgaacattgataagcctatataatgaatctgtaaacacaagggatatgattcataaagagctggaatgccaaaacctgcatttagctaaaagatagatggatatttttatagaactataaactaattcctatatctaaacacctattattgatagtaattaaaatcctaagtattctatgtttacatgcttttgttgagaggatatttagcttaatgtcattgcactggactgacatcaagaatgtgggcttgatgcatcagaggtataagtcacagtgaattttacctttgactgtattacgttttaccacacatacaagaaggattgacctaatggctctagtcaagtatagaaaggaaacataaaagtaaaaatattttattatttcttaggcaaaaagaagcatgcctttattctttttaattaaatattggtaaaatgtttaatccaactgtggttacgttatttttttaaaaagtgtgatagaaataaacaacagaataatatatgattttgaataagttcaatattagtttgctagggcagtcttagcaatttcagagactaggtggcttaaacaacaaagatttattttctcacagtgttggagtcccagatcaaagtgttgacaccttgattccttcagaggcctcgcttcttagcctgcagatggctaccctctttctgcctctttgcgtggtggtttctgtgtacatatgtacctctggagtgtctctgtgtgtcctaatgtcttcttataaggacaccagtcagattggattaaggcctaccttactgccctcattaatttaattaccttgttaaagaccctatcttcaaatgtagtcacattgtgagatactggggtttagggcttcaacatatgcatagtggcaggagggtctgtggaggggtgtttataattcagccgataacaactatgtgtttttaaatttttgtgtctaagtaataaaacatgaataagttaatttttggtagtgttcttttttgataccttcttccttttctttcctgtatatgttttagttacttttattatttaccatttgaattacaatgaacattctaaactcataacaacctaatttgaataataccaatgtagtttcaataatatacaaacactctgctcctttacatctccatcctcttcttatatattattacgctcattgattacgtctttatatattgcatgcccattaacatagatttgtaactattcttttattcatttgtcttttaaatcatataaaaataaaaggaattacaaaccaaaagttcagtgatagtggcatttatatttactatgtagctacttttaccagagttctttacttcttcatatggcttctggttactatcaaatgtcctttcatttcagcctgaaggactctctttagcattttgtgtagggcaggtctattgttaacaaactgtcttagcttgtgtttatctgggaatgtcttaaatagcccctttattataggatagttttgttggatatagaattcttggttaacggtgcttttcttttagtatgttaaatatgtcaactcactgctttttggcctacatggtttctgatgagaattagttcttattcttactgagaatcctgacttgtgaccagttgcttttctctcactgatttcaaaattctttccttgtctttgtctttcagcagtttgactataatgtgtcttggtgtgaatctttttgtgtttatcatgtttagagcttattaaattcatgcttcaagttcatgcttggatgtgtagattcattcattttatgaaagtcaggaagttttggaccattatatcttcaaaaatttttttcttttattttctctttgttttccttctggcattctcataattaatatgttggtctgtggtgattgtttagtgataaggattctgattaaataagatagaaaaaaacaccatggtgagtaagcaaagcagaaatagaaccccactgttttaactagtaacctcagcttgctttttttaccggagatttttctctcatcctgagaaaacttcaatttttacttctctaaatgttagagattttgagtagtgtttcacatgctttcttcacttcttactgtcttcttcaatttgggagtaattgtaggttgtcagagagagtgtcgaatatgcatcactttaaatacagttatcagtaaatggactctttcattcatgcttcccagagatgacagttttccttggtgcctagatacctttttgttccttggagattcatagtattatgtgactcattgaatttttcagaagcctgatggtgagcttcgtgaggtatttctatttaagttgtaagttcgcttgtttttaagcttcctgcaatttaacttacctatagtatttttaaatttattttaaaaatgccatcttggggtatattctaggcatctcaaaaattttaaataccatcttatcctttgttaactggaatataagcaggtaatcatttgaatcattttttttcctgtaattattataacattgaggctatatggatttttttttctttttttaatttgaggcagagtcttgctctgtcacccaggctggagtgcagtggtgcgatcacagctcactgcatccttgacctcctgggctcaaggaattctcctgcctcagcctcctgagtagttgggactataggtgcacaccaccacacccaccttatttttaacttttttgtagagattgggttttgccatattaaccgggctggtcttgaactcctgggctcaaatgatcctcaagacattagcttggtctcttctcaaattagcagatccttatttctgtcttataatttctaatctgcttttataattattgacttacattcaatcttccagtttttcatgtctcttccaattagataagcctccatatttgtatttaacttccagtaaaattttaaccatgttgtttcatttttaattaaaatttaagaggactgcctaaatgccagtgtgtttatgttgtatacatctcggggcatgcttttaagtgttttcttgatgtaaaacatcacataataaactagtgttcataattgtattttaaagctttccaaaattctatgtaaaatgagtttctaaaaacactaaacaaaagaagttttaggaattatgtttgaatgaaatagaaacattgaactcaaaattgtaaagctgatatttcaagaactaccaattagtgtaacattactaattgagttacagtatttagaagttaaaactgatgtaaatcaaaggactcatgttgtttatctattttgaatccttttttgaaaaaagttaatctttaaagtttttctgtattaaaaaaatctgattatctcttgtgacctattttacctagaaaagctagttagaggttaaaaggttttttatgagacatacttctgtgcatcggaacagtccagatgtaaatttaaaaagaagaaatgacaatgaagtgatcaaagagaattctgtgttcaaatgctttcacctggagcagttgtagaaatgtcagtagcacaactgtatttataattatagcaggatgtggcagatggtgatgcaacaccgtctcgtcaattctttgtgtcattgaagaaagtagtaagtattaattctgccaattttatgattaatgaataattttaagtaacacaggccctacgaataaggttgactgttcaaattgtgatacctcattatagtttttaaagtttaaatatgaattaatactcctctttgcctttctgttctctttccttttcaaattaggttgttaagttttcatagctaaaataagatgaaggaagcagtggcttgctgtcctcaattatatttttgatgtgtttgtgaaattattataacttagatcagattctttaaagaaaaatcagtatttcattttttcctttcctcccttttctccctctctcctttccttgtctctctcctttcctttctctctcttcttccctttacccctcctctccccttcccttctttctcctcctcctcccttcctcacatctctttcccttctcctcctacccttcctcttccctcccctcttcttcctttcttcctactttgttttatgcattatgttaagaaattgttttactgctattagtgataacatgcttttagttctgtcttagcagttatggttgtgctctccaggataaatctacacatatcacagttatccacttcataaaagaatgacatatctctactcttgtgggccttaatgtcatgcagtgtttctgggtatgacattaaacatgggtacaatttgaaattgtatttttctgtctaaaagcaaaacaaagcttcatcaagaaatactacaagcagtgggacctaatttcatcaaggggataaaactctattcctttttattctattttggaattggaattcagaaacatttttttttggtcctatggatggtatattcacttatttgaaatgaaaattgaactcagacttttctgaaagagtctcatttgttaattggttgacaaggatggtctttgccatttaaatgatacagtggtactgtcagctgtcattgttcttgaaagcaaagaaaatatttaattgtattgattttctgacttacgttcgaattaatacacatttccttcttctttaagcaactttattggaatatagttcacgtacaattcacctgtttaaaatgtataatcttgtggcttttagtgtgttcacagatctagctagctgtgcaaccatcaccacagtcagtttcacaatattttcttttcttttcttttttttttttttgagatggagtctcgcactgtcgtccaggctggagtgcagtggcgcgatcttggctcactgtaatctccacctcccggggtcacaccattctcctgcctcagcctcccgagtagctgggactacaggcacccgccactgcacccggctaattttttgcatttttagtagagacgaggtttcaccgtgttagccaggatggtctctatctcctgaccttgtgatccgcccgccttggcctcccaaagtgctgggattacaggtgtgagccaccgctcccggccccacaatattttcattatcaaatgaagaaactctataaccattagtagtcattccccatttctctctcaccccctcatcttctgtccattcaaccccttggccccagacagtcacttatccagttttgtttctataggtttgcctattctagacaattatttttatttttggagatggcatcttgctctgtcttcgaggctggagtgcagtggcacaatcatggctcactgcagcttccaactcctaggcacaagtgatcctcccacctctgcctcccgagtagctgggtctataggtatgtgccaccatgctcagctaatttttaacttttaaattttctgtggaaatggaatcttgctttgttgcacaggctgatgttgaattcctgacctcaagcaaccctcctgcctctgcctcccaaagtgctgggattacagttgtgagccactgtgcacagcctttcaccaattgtcaaaaacttattcatgtatgtgattgtagattctttgaccaacatctctccatccttctacccctctaattacccaagcctctgataaacaccattttactttctccttctatgagatcagctttgttatagttcacatatgagttgagattatgtagcatttgtctttttgtacctggattatttctgttaacaagttattctccaggttcctccatgttatcacaaatgagaagattttgttccttttttttgtggatgaatagtattccattgtgtatatatatcgcattttatttattcattcattcattgcctgataaactcttaggttgattacatatcttggctgttgtgaataatgaagcagtaaatatggacgtgcagatatatcttaatcatttccactgaatatgtacccagaagtgggattgctggatcacatgttgtaccgttaatttcttaaggaacctccatacctgttttccataatggctgtgctagtttacattcccatcagcagtgtacagggttcccttaatatttcgggtactatagccttttgtaatatattttgaagtcagatagcatgatgtgtctttgtcatttttgctcaagattgcttttgctatttgggatcttttgtggttctatatgaattttagaattttttttctatttctatgaagattatcattgtcatttgagagggtttactttgaatctgtagatcactttggatagtatgggcattttaatgatattctttaattacatgaatgcaggctgtcttttatttgtgtcttctttaatttctttcatcagcgttttatacttttcatcttagagatcttttatctccttggttgaatttatcactaggtattttagctatttttatagctattttaagaggaattgtttacttgatttttgtttttttcagatagtttgtggttgatatatagaaatgcttttgtatgtttattttgtgtcctacaactttactgaatgtgattattagttctgacagtattttggtacattctttagggttttctgtgtatgagatcttgttgtcttcaaacaagaacaatttaatttctacctttccaatttgtatgccttttatttctttctcttgcctaattgttctggctgggtcttctagactatgatgaatagaaatggtgaaagtatacatccttgtcttgttccagatttcagaggaaaagctttcaatttttccccattcagaataatagctttggatttttcatatatggcctttattgtgctgagctgcattccttctatacccaatttgttgataatttctaacatgaaagaatgttgaattttgtcaaatgcattttctgcatctattgaaatatggttttttcctgcatttaatgtgatatatcacagttattgatttgtgtatgttgaaccattcatatatccatgggatgaatccacttgatcctggtgaattatcttgttaatgtgctggcttttttttttcttttttaagacagagtctctctctgtcacccaggctgaggtgcagaggtgctctacctcctggattcaagtgattcttccgcctcagcctccctagtagctgggattacaggcaccaaccaccatgcctggctaatttttgtatttttagtagagaggggtttcaccatgttggccagggtggtcttgaactcctgacttcaagttatttacttggcctcccaaaattaatgtgctattgaatttggtttgctggtattttgttcaggatttttcttctatgttcatcggagacattggcctatagttttcttatttttgttgtgtccttgttaggttttggtatcagggtaatgctgattttgtagaatgagtttagaagaattctttcctctttattttttaaaaataatttgagaagaattcgtattagtttcgctttgaatatttggtagggtgtgttggcttacgccagtaccccagcactttgggaggctgaggcagaacttcaagaggccaggaatttgaggtcaacctggacaacatagtgagaccttgtttctacaaaaaaaaaaaaaaaaaattagcttggtgtggtggtacacacctgtagtctgagctacttgggaggcctcttgggaggctgaggcaggaggattgcttgagcttaggaggtggaggctgcagtgaactatgatcatgccactgtactccagcctgggcaacagagcaagaccctgtctctttaaaaaaacagaacaaaaattttggtaaaatacagcagtgaagccatcaggtcctaggcattttttcttttttctttgatgggagactttttatcactgatttaatctctttacttattggtctgttctaattttctatatcttcgtaattaaattttggtagattatatatattcagaaacttatttcttctaggttttctagtttgttggtgtataattgttaatgagagtctcttataattctttatatttctctgggatcaattgtagtgtctccttttttgtttctcactttattatttgtgtcttctcctttttttcttagtctagctaaaggtttgttgcttttggctatcttttcaaaaacctaattctttgttgtatttatcttttgtatgttttttaggtctctatttcatttatttcttctctttattatttatttttttctgctaatttggagtttggcttgttcttgtttttctagtcccttgaggcgcaacattaggtttatatctttcctctttggggatttatgtgttaattactataaacatcacttttagacctgcttttgctgtatctgataggttatgctttttttccattggcattgtttcaaaaaatctttttgtttctctttaattttttcattgaccatgttgtttaatttccatgtatttgtagagtttttgattttcctcttattattgacttctagtttatgccattgtgatcggaaaatataatctatgattttgaactgaaacttgttaagacttatgttgtggcttaatatgtactctatcctgaagcatgtttcatgttcaattgagaagaatgtgtaatcttcagccgctggatagaatgttctgtaaatgtctgttaggcctatttggtcaagagtgcagtttaaacctaatgtttcttttttggttttctgtctggataatgtttctgttgcttaagtggggtgctgaagtttcctactaggtagaggatcagaaaaaataaatattacatactcagcttagtatctgggtgatgaaataatctgtacaacaaacccccatgacacaacctgtacatgtaacaaacctgcacatgtaccgctgaacctaaaataaaagttaaaaaaaaaagttgtctactatgattgttttgtactctatctttccctttagatttattgatatttgcttatatcaggttattttaatctagtaacaacttaactttgattgctaaaaatgtttaataaacactgtgtactttaactcctctttttctctcacattttgaatttttttctgagatacagtctcactctgtcacccaggctggagtgcagtggtatgatctcagctcactgcaacctccacctcccgggttcaagcgattctcatgcctcagccacccaagtagctgggattacaggtgtgcaccaccttgctcaggcaatttttgtatttttagtagagacggggtttcaccatgttgcccaggctggtcttgaactcctgacctcaagtgatctgcctgcctcggcctcccgaagtgctgggattataagcatgagccaacttgtccagccacatattttgaatttttgatgttacaacttacaacttttaaaactgcatatcccactatcaattgttgtagttataattatttttaatagttttatctttaatcttcatattaaagatataagaggtttacatactatgcttacaataggccgaatagccacttcccactcattttttccaccatagaaaacttgcatccaggggacttctgcatatgtgggcttaggggaagggtgttgcagtcaaagcaccatttcccttactgtctgatatggtttggctctgtgtccccacccaaacctcatctctagttgtaatccccataatccccacatgttgagggagggatctggtgggaggtgattggatcatgggggtggtttcccccatgctgttctcatgatagtgagtaagttcttacaaatctgatggttttataagtgtttggcagttcctccttcactctctgtctttttctcctgccaccatgtgaagaaggtctttacttcccctttgcgttccagcgtgattgtaagttttccaaggcctccccagtcatacagaactgtgagtcagttaaacctcttttctttataaattactcagtcttggatatttctttatagcagcgtgaaaatggactaatacactgttctcagatttttctcagctctgtggtacaatgagacaccatcctgagttccaagagatccagggtagtcgtcttgccactgagaagatactaattgtgacaagttaatgggtgcagcacaccagcatggcacatgtatacatatgtaactaacctgcacattgtgtacatgtaccctagaacttaaagtataataataataaaataaaataaaaataaaataaaatctaatcttctgtgcaggcaaaaaaaaaaaaaaaaaaaaaaaagaaattctatagggtgtggagaaccagacaacaattcctacccttccattttgcaagcatcactctgccatattttttaaagaataatgtttttagagtatttgtgttctttggtacttttgctgctgagattcttgggataacaaagtaaaaaaccaaatagtctagattgtaacataccacagtgatttggggcaagaaggatgtgcagtagaattaagccaagctgggcaagtatgaacttgggactgtcaccaaactctgtctcattcttttctccttatttaattctttccatatcaagcatttacaacccactatgtagaggtccatacaccttggcttatagacttcacttggtagttactgttgcccacctatctattaaccagaattttcatttaaaaatctctacataaaaattagcagttatgcagtggagttttcaaataaggaagaagattggttggatggatggatgttaggtgaccactgggaaactatggttttagaacgagtagctggtaggttgcaggtggcatgtattttaatacatgtagcagaaaactgaaaatttatgagcattttagaaattagagctctgtcaaaataagagaaaaacttagatttaattttataaaagcagtactaatgactttatgaagatggcatatgatttatgtatgtatgaacaattatatgtatcattaaatagatcagataaattttttgttcttttaagaataataggccagatgtgatggctcacgcttataatcccagcactttgagaagccaaggccagaggatcagttgagctcaggagttcaagaccagcctgggcaacatgacaaaaccctgtctctacaaataataaaaaaaaaaaaattagccaggcacggtggtacatgcctgtcatcccagctagtcaggaagctgaggtgcaagaattgcttgagcctgggaggttgaagctgtagtgagccatgattctgccactgcattccagcctaggcaacagagctagaccctgtctcaaaaccaaataataattttttaaatatttattatctaatgtgggtttttgctttatgttacagttgtcacctactccaatatgaaaaatgagaagaaagccaggtgtggtggtgcatacctgtagtccctgctactcaggaggttgagatgggaagatcacttgaggccaggagtttgaggttgcagtatgctatgattgctcctgtgaatagccattttactctatcctgggaaacacagtggcatcctgtctcttaaaaaaaatttttttttaaagcatgttcacaagttctttaatacttctccattgaaaaggtagaacctaatttcccttctcttgaatatggcccagacttagcgacttgtttctaataagtagaatgtatgtaatgatggtgtgctatttctgaggctagatcattaaaggcatcattacttccatattattttttcttgggacacccataatggggaattcaactgctatgttcttgaggatacgcagtcagcctttgaagacacccacatgggcaggaacataagccttccagcggcaaccagcaccaatatgttggccttgtgagtgcagccagctccagtcaaatcaccagattactggagccctgccttacttaaccgactacaacctgatgagacaccccaagagagaactgttccactaagctgctcccaaattcctgacccaccaaaactatgtgagatagtatttcttatttatagccaccatgttttgaagcaacaatgactattaaaataataaaataactttcagacattgtttttaatccctcttttctgtagtccctgtactttcccaccccaatttatatttcctgtttctatttgaacttttttcttttttgttttcatttcttttatacataatcgttttgagctataagaataatttatgccaaaaattatgcagctaatattttacacccgtattgtaaccagtatactggtataaaactagataataaactactatggctgtgttttgcttcttacagatggaaggaaatgcctaaaatttaattttatataccacaatgtgttttgaaagttttgaataattttctggttttgaaaacctgttttgatttttttttctcacaaacacgatattcttaagtaaaatagagtgatttatgattaatagaaataatgaagattatgcaagttattttacttcaattgaaatagcaaggccagaataatttaatcatgttttccagaagaataataaaatagaatcagtggcaatactagtaaacattagtctacatttctatttatttatttatttttttagacggagttttgcctttttacccaggctggagtgcagtggcacgatctcagctcactgcaacttccgcctcctgggttcaagtgattctcctgcttcaggcctcccaagtagctggtattacaggcgcctgccaccacacccagctaattctttgtatttttaatagagacgggatttcatcatgttggcaaggttggtctcaaactcctgacttcaggtgatccacctgccttggcctcccaaagtgcagggattataggcgtgagccactgcacccagccaacatttatatttctttaacttcatatcatttgctgtagttagctggatcatatttcttaaattttactttatttatttatttttgagacaaagtcacgctttgtcacccaggctgaagctcagtgtttgcgatcttggctcactgcaaactctgccttctgggttcaaggaatcctcctgcttcagtctcctgagtagctgggattacaggcttctgccaccatgcccaacaaatttttttttgtattttttgtagagacagaatttcaccctgttgaccaggctggtattaaactcctgacctcaagtgatccacccacctaggcctcccaaagtgctgggattatggccatgggccactgtgcccagacaaattttactttcatagtaacattttgcaaatgtaaaaattttataatttgattagtaatgtcagactctatcaaggtgatgctctcttaaaagttgttgatgataatattagatgagagatgtatgtagttatgaaagaccctgaaatgattgtatttttttatttctgtacaaagtttactcacatttctatgtctagccatagctattctaagccatagcacaaagaactgtattgtgatggtgagactataaaaaggtaaatttagagaaagcttccagatctgctctagaatttattaccatctggtctctttggagactagtataattattcatgggaatgttttcaacacagaaaagcatggtttgtgtattggcagaaagtaaaaagtaccagtggtttaaaccatatgtagcttttttagagttaggcaagggaaatgaactgaagacctaattgagagtcatcagtagtgatgcaatttgtgtcaattttgtcagaatctgttcataatgaacaaaatattgcacaacaagaaaaactgaaggtattagaaatataactccatttgaagagtattactttatcttaatttaaccaatgaaatgtaagatggtgtcagctaagtatttgtgtaaatctctgaaataacataaggaatatatgtcaaattttgatgacttttaaaaatgaaaacactcatgttaaaataattttaagcttgaacactggaagaatgtcttattaaggttatttttcttaaattgaatatgaatgtattattttagatcattttagatgtggcatggacttactactgttcctcttaagaagcagaaatattttacagtctttcttaagcttaaattgattttatagaaaaaggaaaaaaaaactaaatatcttttcactttccattctaacagttacttggagtctataaaaaatgagatgacaaatcaaaaaattgaaatcgtctattttttcagctattttaaaagaaaaatgcctagtgggctgggaatacacaagaaatttaaatttgtgattgagaataagaaatgcatttgtggttttaaaaaagaaataccagcatgtcacattaaaaatatggcatctacagtattgtacaaaggaaaatgtattacattaggagggggtatgttgtactttatttagagaactagtgcagggatacgaatgagaagtataacgccatagaaggcatgagcattagtaatccagtcagagaggaagaattttgctgcctcccatgtaacataaaacagatgttccattctattagaaccttactaaaatgagagtttagatcattggtcaataggagaaacatgaacaatggcaatttaataattttgagggtttatcttatttgtgagttaatatccatggtggggagtatgaagggatgcctgccaaatgttattttatttttgatatcttgattgagagagctgaaaggcaacagtaagctatactaatttttaatttattgttttgcaaatttaatctatttttttctcaaaaactgttgtaagaaaaaaagatttcaaaattataagtcctgatttaatgcttgaataggtattgaagcatatctgaaagtataattaattaacctcaaatgaatactgtaaacattaagtagttggcaactgaaagtagacgtatgcagaaagggacaccagggatggtaccacagggtcctgggtatatttttgtttttttaagggaagatttacttttttctagaaaagaaattcttttcaaataaatttatttttcaaaaaatactttttttcaaaagtattttttccattttaaaattaagttataatttatatacaaaaaagtgatctttgtagtgtatgtttctgcaagttatgacacatgcacagtctagcaaccagtatcagaaataagatagagaatagtttcatcacctcaaaactttccctgtgtcccctttgtagtcttcctttcccctacttcagcccttggcaatccctgctctgtttttgttgacagagacagttctcctcacttgtttgtgaagactgtaaggttctgactgccctttttcctgggacatttctcagggttatatatgcagctgataaacttgagacatgagataacatctgttcccagacaaaaagcaagcttatttactgcttgctataaaattggtggattccctgagttcagtgcttctcatttgctgatgcaaactcactacaagcatagcatccatctgagcatccccaaaggacttgggatgaagggaactgatgcaaatgtgctgatgttcttctgttttgtcataagtaatgaagtgttttttctttgactgaggagtcttgtgtcttctgcctgcatccatgaattagttaagaggcttttgtgttagcttttattaaatagggtaaaatcaaatcccagtctccataattttctgtttgtatagttttgccttttccggtgacttgtattgagggttcctgcttctggccaacaacctatgagtgattttttaggtctgatcataaggcatttacagaggttttcctggcaggcttcatagggggagggctggtctccagagcagacttggtgcaaagcttttatagtctctgaggggaattgcagtcaaggacccagccatcctcttatacatatctgcgttcctagcctaggtgccttcattcagaggcctctttatgtggggcttttggggaggctttccttaagtgtctctgtcaagactttattggggaaaagaggggaagacacttaccaactctttctctactatgacttgtacttttctgtttctaacccttccctctctagccttcactcgactcctgggtctgtaaaactgccagaatcttttgttgggggttccctttggcaatgatgcaaccctcacatttgtgctggtctacctgccctgtgaccaatgtgccatgccacaggggaaaatggaatggggggtagctggcactttctccaatttagcctcttatactgtcacagtgattacagacctattctttattttattttattttatttatttatttttttggcttgttgccattggctgtgccaaaacgtggcagcccagctttctccagctctcctgaggtactgatacacacaaatggaatcatgttgtgcatagcctttgaatctgactttcttcagttgacgtaagttcatcttagattcatccatttgctttgtcaatagtttttaaattttaatggctgagtagttttctatcatcgtgatgtactgcaccttgtgtctctatccactctagagggatatttgaattgtttctggtgattatgaataaagctgctaaaaatatttatacgtttttgtgttaacataaattttcattttactagatgtattgccaaactcctttccaaagtggctgtgccatttcacattcccactagtaatatatgagaggtctagtggtttcacatcctttcagcacttgatattgtcagcttttattactacatcaattgtaagggggagaggagcatctcattgtttgtttctacttccctaattatgtgaagcacatttttatatgcttatttgctatctgtatatgttctttgaagaagtatctcttcaaactctttgccttttttttaaaaaaaattgtgtttatttttgttacagagttttgagaattctttatctgttctgcagacaagacttatcagatgtgtgatttgcaaatattttctcctagtgagtggcttgtgttttcattttcctaacaatgtctttcagtgagcagaagttcttacaaatttatgtacttttaaaatggattatgcttttgtgtcatataagaactctttgcctaatccagggtgagaaagatttactcctatattttctactagaaatttcatagttttactttttacatgtagatctgtgatccattttgagttaagttttgtgtatattgggtgaggtctgtaacagagtttttgattattgttttttgctattgttttttgctttggcatatggatatccaattgatccattactcttccctgaagtctatttaaatctctttaattgccattgtacttttttgaaaatcaattatgtggttgtatatctatgttccatattctgtttcattgatctatatgtctcttctttctccaatatcatacttctctgattactgtagcttaatgtgtttgttttttttgctgtctaatcatggaagttgaatttattgcattttacaggtcaatattttttgtagttgtagacgtctgtaattttgcactgttaattttaatgtaatggacatattagaaattaggttttcaatatgcaggggaaatgctgttaatttacaattgaagagagttatgaaataataataaatagaaaaagtaaatagagaaaggaaagtacagtcatcccttagtgcccataagggattggttctaggaccctctgtggataccaaatccatggatactcaagtcccttaaatggcataatatttgcacataacctatgcatatcctcccatatactttaaataatccccagattgcttataatacctaatacactataaatgctaagtaaatacttgttatactgtgttatttagggaataatgacaagaaaaaagtctgtacctgttcagtacagactcaacaactatccatttcccccacttccaagtatttttgatctgctgttggttggttggtctgcagatgcagatcccatggatatggtgggcctatatatatgtcttatttattgtcactaccttttgcttccaagtattttttatttttaatgagagttattttgttgtggtgggtggtttaacatacataagttttcccagcagcagaaccctgaagcaaggattttagaacaaagtctactttggagacgtatgtaacaggcaagaattgatgcaaggaaagcaaggcagctaatgaagacttactaactaaactaacacaataggttgctggagctttatcttgtgggataattctgggaaagtcagtgtcaaatttagtttcgggactaactcacctgaagtgtgagagagtgagtatatttcctgttactggttgtggactgccatacagaagacattgcacctgcctggtgctgtggtgggcagagtagcattcagccattcagaggaaagccctgagggatacagaggaagatactggctattggaagtaatttggaatggtgggaaagggttaggtccaaaggatactgtacagacactgacattatctgactcatgccttgtgaattttaagtgcctttcctgggttatcaaagtgaatagctttaatcaaatcatctctataaagacatttctaagtaaattttctatacttacactcctctactttttattactacagctggcttcattagctttttgtatattaatctgtgttgtcctactattagctagaagagcttactaactgtgagcttgaagatattgtatattccctcttcggatgatttttttttttttttttttgagtcagagtcttgctcttgtagcccaggctggagtgcagtgatgcaatctcggctcaccgcagcctccgcctcccgggttcaagtgattgtcatgcctcagcctcccgagtaactgggattacaggcacctgccaccacgctgggctacaaatgtatttaagaatcttaaatgagctgtgattgcaccactacactccagtctgggtgacagagcgagaccctggcttcaagcagtcctcctgcctcagcttcctaaagtgctgggattacaggcatgagccactacccctggcctaaattccttttctagcctctatacagaatttctaggataacaacaacaacaacaacaacaaaaacttaaatgataaaaatgaatatataaaatagcaagtaagccatgtaaaatattttcaatattcttagccattagagaagtgcaaattaaaactataagatactgctgcatacatatgtggatagcgaaagtaaaaactggtgagaatacagaatgaatggatttctcatctgttgctgataggaaaatgacacagccactctggaaaacagtttggcatttttaataaaattaaagataaatattccatatgactcagcaatcatattcctgagtatttaacatagaaaaatggaaatttatgtatatgtaaaaacttgctacacaaatatttacatcagcttaatttgtaattgcctcaaactggaaagaatccagataactttcaacaggtgaatagataaacaaactgtgatatatctatcgaatggaataccaagctttgtaaaagaataaattactggtacagtcaacagtttccgtagatcttaagttcatcacacgaagtaaaaaaaaagctaaactcaaagtgttacatactgtatgattccaattatatagtattacttaaatgaaaaaaaattagtgttggaaaattaacctgtcattccaggagttagagataatgtgggagaaggggataggtatgactataagggagttgcaggagagggcttctttgtggtgatggaatagttctgtgtcttaattgtgctggtgagtacatgaatctttacagctgataagattttatagaatagtacacacacactaagaacaatgcatgtaatgtctactttggggagctttttttaaaaaaatttcttttaagagacagtgtcttgttccatttcccaggctggagtgcagtggcacaatcatagctcactgtagcctcaaacacctgggctcaagggattctcctgcttccagcctcccaggtagctaggactataggtgcatgccaccatggctcgctaatttttttatttttattttttgtagagatgggggtctcaccatgttgcccaggctggtctcagtctcctggcttcaagcagtccttctgccttggccttctaaagtgctgggattacaggggtgagccactgccctggcctaaattccttttttagcctcttcacagaatttctaggataaccaatataagtaaagtagatgttatttttaaaatgatccactttatacactaaattaaaagacagtcttgatttcttcaaaattctttgctgtgaagtgaaacgtttggtaatcatatatcttgttgacataaacatacagattcctctgcatgtaacattcttttccttcactttaccaatttgtgcccatttcacgtatctcagcctatatccctttttcatgatcatcttacctctgacataactctttcacccaccaaatctgtgtttggtgtcatttctatgatggtcccatacaaagctggactcattttacagatgcaaaaagtgatgaaataatgaacaagttaatggcccaactgaaactgtggtgttggacataaactttagaataaatcctaaatcttaagtgtgcaaataaattattcaaaacatgagattacctaacctattctagtgatatttaacagagatatgtttgtaactggtggaagaagaatcactccctaggtacaagatcaattactgttcattttattcacctgaagataaatcactttcacagattttgcagactacttcttttcctgaaaaaatgatttattaaagtggaggtttctttactatatcaacactggcttactcttttctttataatacttctatactgaaagaagccagaggccaaaagtagtcttgtttgtgctgctctttatttcattgttatttttaaaccagatgatgaaattcccttccattttgaagggccatttttcatgtacataggagggaatttaaactgtttgagttaatattaacatattctattactataaattggttttagtttgattttaaaatagcatattaatttacatttaattttagtattcaactctgatcagaaaaatagtattttggatgtaggggtaaggaaaaggtgtgaaattccagttaaaaatctaaagtactgtgtttattgtttcattgtgtgtctgcatttagtattgtttgtatgagaaaaagtcagttgtttccttatattcccatataatttttgagtagtatgacaatcttcatttatatacctgatgacttttaatttttaaaatgttgtctaaaccaggtttcaggtgatatatcttgcttcctaatttgacaactctgaatattactattgaaacttgtaagcaagtagaaattaaaatgaagccatacatagcatttgctttgattaaaaagaatagaaacctagactgttttggaaaattcagtgtatatttcagtgtatatatattatgtgtttatatattgacagatctgggcatcagaatagagtcaagaaataacataaatagaaattcagtaagaacacatatgaaactggaaaccagtggaggaaaactgaggaattgctgtttgtgagagacttatttttcactcagtatacttttttttactgttttaattgtctatatagcatgctgcatattaccaattttaaatacttaattttgaaagattaaaatggctggcaaatttattgcccatttgcaaagtacatttatatcaggcatagtacaatatgtagaatgttattggaacattggaacattgtgtctgaaatacttttttaaaaacctcataaaatatgaaaatacttcttaatgatttcaatattaactctattcattagacatctatcattatcctttatgtcagaaacttagagtgaaatcttattagcttgattgaagaacacttgttctcatttcattgtgctatagttaacattcaaagttaaagttatttttcttctccttgatagtatactataataagtatattcaaagtgatgctctagatttgtttccttcacatttagacttgcatttttacaatgtttatactaaggtttcttacacttgccatagtatatctgtgcggtggcttactcctgttaatcccagcaattagggaggcccaggcaggtggattatgaggtcaggagtttgagaccagcctggccaacatggtgaaaccctgtctctactaaaaatacaaaaaaaaaaaattagctgggtgtgttggcgggtgcctgtaatcctagctactcgggaggctgaggcaggagaatcacttgaacctgggaaggtggaggttgcagtgagccgagatcctgccactgcactgcagcctggacaacaagagcgagactccgtctcaaaaaaaaaaaaaaaaaaggatttttgcaatcattaacttacttcttgctgtctgtttttattgtctttggctgtccttcttaacttcttcaaagatttctagtatatttacactccttaatcctaaatccagtgtatgttggctctcatggtagttttccatttcatgtacttgcttgtataatataaatccctgttcttggtgttttgtgtatttatttatttggctgccattgtattgaaaattgtcttgacaattcatttatgaacatcattagtacagcaatatgtaattcaaaaccagcatgctcaaatttgtactattctggttagttattgctatgtgtgtattttcaaatttttaaagacttagagaatagtaaaacatatacttagcacaaatgatatcacttcttggtacctttctgtgagtccttcttcccataaggaaattaaattgttctttgttttcatgctaagtagcatgaaaaaaaagctttattgagataaatcaaatttagagcatttttatcacctcaaaaagagcccatatacattagctctcacccactcaattatccctccttggctattttgggtccattgcaattccaagtgaattttagagtcagtttgtcaatttacacaatgagtatagcttggattctgatagggattgtgttgaatctctacatccataatgggtaatattgccaatcttaataaaattttccatgaatgtgggatgtttttccatttatttggatcatctttaatttgttgcaacaatgttttgtagttttcagagtataaattttacactgtaaagaaaacttattcccaaatattattttctttttgatgctattgtaagtggaattcttttcttaattttatgttcagattattcattgcagatggcttagagatacaattgtgtgtggtttttgttgttttgtttttgagacaggctcatgctctgttgcccaggctgaagtgcagtggcacaaacatggctcactgcagccacaatctcctaggcccacctgattctcctccctcagcctcccaagtagctgagaccactagacatgcaccaccatgcctggctaatttttaattttttttgtagagacagagtcttgccatgttgcccaggctggtctcgaactcttgggctcaagcaatcctctggccttagcctcccaaagttttgggattataggcatgagccgctgtgcctagctcagtttgtgtgtgtgtgtgtgtgtgtgtgtgtgtgtgtgtgttttaatattgatcttgtatcctacagcctttctgaacttacttagctctaatattttttagtgggttctttatgattttctataaacaaaaccatgtcatctgtgactatagttgtgtttccttctttctttctaatttggaagcctttaactattttcccccttccttaattgctgtgactagtagttgtaatgtaacagtgaacagaagtggcaagaagagatgtccctagtcttgtttctcatatagggggaaaatatctaatcattcaccattaagtttgatgtttctctgcagttttcttagatgccctttatcagattgaggaagttactttctatttctgtttttttttagcgtttttatcttgaaacagtacagttgacccttgcacaacatggcgattgtgggtgctgacccactgcatagtctaaaatccatgtataacttttgattctcccaaaacttgtcaattaatagcctactgttaaccagaagccttaccagtaacataaagtcaattaccacatattttatatatgtatcatataaagaatatattattaagaaaatcatgagagaaaatgtatgtactatttattaagtggaaatgtttcgtgagaaaagtcatcattgtcttcatgttgggttggctgaggaggcagaggaggaactggttttgctgtcttaagggtggcagaggtggaagaaaatactggtgtaagtggatttgtgaagttcaaaccagtgttgttctggagtcaattgtagtggattttgccaaatgctttttgtttgtttgttttttgagacggagtttcgctcttgttgcccaggttagcgtgcaatggcatgatcttggctcactgcaacttctgcctcccaggttcaagcaattctcctgcctcagcctcctgagtagctgggatttcaggtgcccagcaccacgcctaacttatttttgtatttttagtagagatggggtttcaccatgttggccaggctggtctctaattcctgacctcttgtgatccacccgccttggcctcccaaaatgcgagattacaggcgtgagcaaccatgcctggctgccagatgctttttctatgtgtgttgagatgatcatgtaattttgttttctattctattgatatgatgcattgaattaattgatttttggatcttaaaccaaccttgcattcctgagacaaactccacttggttatgttatatataatttttaaatgttgctggatttgttttgctagtattttgttgaggatttttgcatcattctcatatgagtatcagtctgtagttttattttcttgtgactttgtctgattttagagtatcatagtaatactggcctcataacatgaattgggagatgtcttccctcttctaatttttagaagagtttgtggagaattggtattaatttttttaaaagaagcagcaattgcttatttttctaatcaggtgtctatgctgctgaatcttaaggcctcaacaaatgttgcaccttattatttcattgaacaataagaccttctattctgattattcccggtaaataggaataatcactggtttctccagtggtttccacttgccaaaaactcatgacagatgacttaacaaggtggcacctgctttcaggggattgtatcagatgcatactcatttccagtgcagcagctgttggcaatctaggacttctctatcatggttggccaagtagtcctgctttggctgccagagcttcattctgctgaatattacattcctgaagtctcatggatattctttttgtcatttaaaaatatttccataaagtgttctgaacaggctggtctcttcaggttttacatctgttgtgcagtcttaacacagtccaaaaagcagatttctgcaagtttattgtcagtcccaagaaattccttcaactgtttaatctgatcagattctggtatttgtgcacccatattcttttggtacatttattagtcatcttctctgatgcatgagtttcctttctgttcttgtaaagtagtgttccaacctttgtttgaatgtcttcagtgagacgtgatttcttacctaagcacaggctctcacatctgacgtcagtacaaggctggaggcctacactgccagtcgagtctgaggatggaggatcaggatcagggcaagcattgcagccgctttatctaattcttctttaaacgttcattagaattcaatagtgaagccattcagggctaggcttttctttgtgggtagtttcttgattactaatttaatctcttgttatataggtctgttcaagttacctattttttcttgaaatttttttagtcatttgtgcctttctaagtatttgtccatttcatctaataaataatctaatttgtttaatggctattctttctgacattaatatagccactttgtctttcttgtgggtgttgtttgcatcacgtatcttttttttttttcccagacagggtcttgctttgttgcccaggctggagtgcactggcaagcagaggttgccactcactggaacctctgattcccaggtttaagtgatcctcccacctcagtctcctgagtagctgggattacaggtgcataccatcatgcttggctaatttttaaattttttgcagagacgaggtctcactgtattgtccaggctggtcttgaactcctggctcaaagtgaaacccctgccttggcatctcaaagtgctgggtttacagatgtgagccaccacatccagcctgcatgatatatttttccacccgtactttcaatctgttagtaactttctatctacagtgtgtctcctgttgacccacataactgtcttttatgtatagttattagaactattgataagaaaatgtgaaagtatagtcccattatcttatttgagtggaatcagtagactatttcataaaatgtattctagtttatagtttagaatagtttgtttttcatggcttttgagaaaaacatttgaatgagcttacattttgttgcatttaaaatttctgggtttttgttgttgttgttgttgttgttttgagatgcagtctctctctgttgcccaggctgaagtgcagtggtgtgatcttggctcactgcaacctctacctcccaggttcaaatgattcttgtgcctcagccccctgagtaactgggactgcaggtacatgccacgacctggctaattttgtatttttagtagagatggggtttcgccctgttgggcaagctggtctcaaactcctgacctcaggtgatctacctgactcagcctcccaaagtgctggaagtacaagtatgagccactgcgcctggccaaaatttctgttttttaatgaatccaaagttcatgtttttttttcttcccaatgccatggtacatatcatcaccaaaaaaagtagtgattttgcttcagtgaacactgaattttaatattattgatagaatggctatatcgatcagggttttacacttatagtacagtatacttgcaatgtaggtaggcctcatcctttgtaattaattaattagcttgtaattatgtaagctaatctaaattttcatattttcagttttaacatttgggcttttgagttacatttcttatattttgatttttttctataaattttaaaaccagaaagacaacactagaatcaattaaatgcaagattgaaagggtttcataatgtaaaagagcaatcttgtttttgaaatgttcagtttacagtaaggatcgagtagctctgcagctaccgatttgggaaatacctgaggttttttttccccttgcacttacaggctgttttagccctgaaggtggctagtaaggacacagactttagagtgccacgacagttccataacaggaatgaattgaagaagagaagcagtggagtcaggagcctcacaaattaaagacaactggtgaagagaaaaaccatttattttcgatacttaagatggctgagcctgtaattccagcagtgctttgggaggctgaggcaggtggatcacgaggtcaggagattgagaccatcctggctaacacggtgaaaccctgtctctactaaaaatacaaaaaattagccgggcatggtgggcacctgtagtcccagctactcaggaggctgaggcaggagaatggtgtgaacccgggaggtggagcttgcaatgagcagagatcgcaccactgcactccagcctgggcgacagagcgacactctgtctcaaaaaaaaaaaaaaaaaaaaaaaaaaaaaaaaaaaagatggccgaataggaagagctccagtctgcagctcccagcaagaccaacacagaaggtgggtgatttctgcatttccaactaaggtacccagttcatctcattgggactaattaggcagtggttgcagcccacagagggtgagcagaagcagggtggggtatcacctcacctgggaggtgcaaggagctgggggacctccttcccccagccaagggaagccatgagggactgtgctatctggcccagataccatgattttcctatggtttttgcaatccgcagatcaggagattccgtcgtgtgcctacaccaccagggccttgggtttcaaacacaaaactgggcggctgtttaggcagacacttagctagttgcaggagttttttttcgtaccccagtggcacccggaaccccagcgagacagaactgttaactcccctggaaagggggctgaagccagggagccacgtggtcttgcttagagggtcccactcccacggagcccagtaagctaagaaccactggcttaacattctcactgccagcacaacagtctgaaattgaccttggaccattgggcttggtagggggaggggcatctgcaattactgaggcttgagtaggtggtttttccctgacagtactaaggtggcggggaggtttgaaccaggtggaattcaccacagtgcagcaaagcagctgtggccagactccctgtctagattcctcctcactggacagggtatttgtgaaagaaaggtagcagacctagtcaggggcttatggataaaactcccatctccctgggacagagcacctgagggaaggggcggctgtgggcgcagcttcagaggacataaactttcctgcctggtggctctgaagagaacagctgatactgacaaggaggattctcccagaacagtgcttgagctctgcttagggacagactgcctcctcaagtgagttgaggagactccgtgccttctcactgggagagaactgccaacaggggccaacagacacctcaaacaggagagctctggctggcatcaggctggtgcccctctgggacgaagcttctagaggaaggaccaggcaacaatctttgctgttctgcagcctccattggtgatactcaggcaaacagggtctggagtggacttaaagcaaactgcagcagacctgcagaagaggtgcctgactgttaggagaaaaactagcaaacagaaagcaacaaactcaacatcaacaaaaaggacccccacacaaaaaccccatccaaaggtcatcagcctcaaagatcaaaggtagataaatccatgatgatgaggaaaaaccagcgcaaaaacggtgaaaattccaaaaaccagaatgcctctttgcctccaaataattgcagctcctctccagcaagggcacaaaactggacggagcaaccccaagacacctaatagtcagattctcctctgagctgaaggaccatgttctaacccagtgcaaggaagctaagaaccttgataaaaggttataggaactgctaactagaataaccagtttagagaggaacataaatgacctgatggggctgaaaaacacagcacgagcacttcatgaagcatacacaagtatcaatagccaaatcgatcaagcagaagaaaggctatcacagattgaatatcaacttattgaaataaagtgtgaagacaagattagagaaaaaaaaaataaaatggaatgaacaaaacctccaagacatatgagactatgtgaaaagaccaaacctatgattgattggtgtacctgaaagtgacagggagaatggaaccaagttggaaaacacacttcaggatattatccaggagaacttccccaacctagcaagacaggccaacactcaaatttgggaaatatggagaacactgcaaagatactccttgagaagagcaaccccaagacacctaatcatcagattctccaaggttgaaatgaaggaaaaaatgttaagggcagccatagagaaaggtcaggttacctacaaaaggaagcccatcagaccaatagcagatctctctgcagaaaccctacaagccagaagagagtgggggccattattcaacattcttaaagaaaagaattttcaacccagaatttcatatccagccaaactaagcttcataagctaaggagaaataaaatccttttcagagaaggaaatgctgagggattttgtcaccaccaggcctgccttacaagagctcctgaaggaagcactaaatgtggaaaggaaaaagtggtactagccactgcacaaacacaccaaaatataaagaccaatgacactatgaagaaactgcttcaattagtgtgtaaaataacctgctaacatcatgatgacaggatcaaattcatgtataataatattaaccttagctgtacatggcctaaatgccccaattaaaagacacggactggcaaattggatgaagagtcaagatccatcggtgtgctgtattcaggagacccatctcacttgcaaagacacacataggctcaaaataaagggatggaggaatgtttaccaagcaaatggaaagcaaaaaaaaaagcaggggttgcacttctagtctctgataaaacaggctttaaactaacaaagatcaaaaaagacaaagaagggcattacataatggtaaagggatcaatgcaacaagaagagctatcgtaaatatatatgcacccactacaggagcacccagattcataaaacaagttctcagagacctacaaagatacttagacttccacacaataatagtgggagactttaacaccccactgtcaatatgagatcaatgagacagaaaattaacaaggttattcaggacttgaactaagctctggaccaagcggacctaatagacatggggttgctacagaactgtctaccccaaatcaacagaatatacattcttctcagcagcacatggcacttattctcaaatcaaccacataattcaaagtaaaacactcctcagcaaatgcaaaagaatggaaatcataacaaacagtctctcagaccacagtgcaatcaaattagaactgaggattaagaaactcactcaaaaccacccaactacatggaaattcaacaacctgctcctgaatgaatattgggtaaataatgaaattaaggcagaaataaagaagttatttgaaaccaatgagaacaaagagaaaacgtaccaaaatctaggacacaccaaaagcagtgttaagagggatatttatagcactaagtgcccacttcagacagctggaaagatctgaaatcaacaccccaacatcacaattaaaagaactagagaagcaacagcaaacaaattcaaaagctagcagaagacaagaaataactaagatcacagcagaactgaaggaggtacagacatgaaaaacccttgaaaaaaatcagtgaatccaggaggtggttttttgaaaagattaaccaaatagatagactactagctagactattaaagaagaaaagagagaagaatcaaatggacacaataaaaaattataaagtggatatcaccactattctcagagaaatacaaactaccaacagagaatactataaacacctctatgcaaataaaccagaaaatctagaagaaatggatacattcctggatacattcctggacacatacaccctcccaagactaatccagggagaagttgaatccctgaatagaccaataacaagttctgaaattgaggcagtaattaatagtctaccaaccaaaaaaagcccaggaccatacagattcacatccgaattctaccagaggttcaaagaggagctggtaccattccttctgaaactattccaaacaattgaaaaagagggagtcctccctaactcattttatgaagccagcatcatcctgattccaaaacttgacagagacacaacaaaaaaagaaaatttcaggccaatatccctgatgaacatccatgtgaaaatcctcaataaaatgctggcaaacgaatccagcgacatgtcaaaaagcttatccaccacaatcaagtcggcttgacatgtaaggctggttcaacatacgcaaatcaataaacgtaatctatcacataaacagaaccaatgacaaaaaccatatgattatctcaatagatgcagagaagtcctttgataaaattaaacatccttcatgctaaaaactctcaaaaaactaggtattgatggaacatatctcaaaatataagggctatttatgacaaatccatagccaatatcatactgaacaggcaaaagctggaagcattccctttgaaaaccagcacagacaaggatgccctctctcaccactcctattcaacatagttttggaagttctgactagagcaatctggcaagagaaagaaataaagcgtatttaaataggaatagaggaagtcagattgtctctgtttgcagatgacatgattgtatatttagaaaaccccatcgtctcagcccaaaacctccttaagctgataagcagcttcagcagtctcaggatacaaaatcaatatgcagaaatcacaagcatttctatacatcaataatagacaagcagagagccaaatcatgagtgaactcccattcacaattgctacaagagaataaaatacctaggaatacaacttataagggatgtgaaggacctcttcaaggagaaccagaaaccactgcccaagaaaataagagaggatgcaaacaaatggaaaaaaaattcagtgttcatggataggaagaatcaatattgtgaaaatggccatattgcccaaaataatgtatagatccaatgctattcccatcaagcttccattgactttcttcgcagagttaaaaaaaaaaaagaaacaaaccttaaatttcatatggaaccaaaaaggagcctgtgtagctaagacaatcctaagcaaaaataacaaagctggaggcatcatgctacctgacttcaaactgtactacaaggcaacaataaccaaacagcatggtactggtaccaaaacagatatatagaccaatgaaacagaacagaggcctcagaaataataccacacatctacaaccatctgatctttgacaaatctgacaaaaacaagcaatggggaaaggattccctgtttaataaatggtgttgggaaaactggctagccatatgcagaaaattgaacctggatcactgccttacacattatacaaaaagtaaccaagatggattaaggacttaaatgtaaaaccgaaaaccataaaaaccctagaagaaaacctaggcaataccattcaggacataggcatgggcaaagacttcatgactaaaacacccaatgcaattgcagcaaaagccaaaattgacaaatgggatctaattaaactaaagagcttctacacagcgaaagaaactatcatcagagtgaacaggcagcatacagaatgggagaaaatttttgcaatctatccatctgacaaaggtctaatatccagaatctacaggaacttaaacaaatttgcaagaaaataacaaccctatcaaaaattgggcaaaggatatgaatggacacttctcaaaagaagacgtgcaaccaacaaacatgaaaaattgctcatcatcattggtcattagagaaatgcaaatcaaaaccacaatgagataccatctcatgccagttagaatggcgatcattaaaaagtcaggaaacaacagttgctgttgaggttgtggagcaataggaatgcttttacactgttggtgggagtgtaaattagttcaaccgctgtagaagacagtgtagcaattcctcaaggatctagaaccagacataccatttgaccgagcaatcccattactgggtatgtacccaagggattataaatcattctcctataaagacacatgcacacatgtgtttattgtagcgctatttacaatagcaaaggcttagaaccaacctgatgcccgtcaatgatagatagagaaaatgttgcacagagacaccatggaatactatgcagccataaaaaaggatgagttcatgtcctttgcagggacatgatgaagctggaaaccatcatttttagcaaagtaacacagaaacagaaaaccaaacaccacatgttctcattaataagtgggagttgaacaatgagaacacatggacacagggaatggagcataacatacctgggccagctggtgggtaggggtcaaggggagggagaggattaggacaaatacctattgcatgcagagcttaaaacttagatgatgggttgataggtgcaccaaaccaccatggcacatgtataccaacgtaacaaacctgcacgttctgcacatatatcccagaacttaaagttaaaaaaaaaaaaaaaaagccaggcgcagtggctcacgcctgtaatcccagcactttgggaggctgaggcaggtggatcacaaggtcaggagatcgagaccatcctggctaaaatggtgaaaccctgtttctactaaaaatacaaaaaattagccaggcgtggtggcgggcatctgtagtcccagctacttgggaggctgaggcaggagaatggcatgaacacaggaggtggagcttgcagtgagctgagattgcgccactgcactccagctctggcgacagagcgagactctgtttcaaagaaaaaaaaacttcagtttacttgattttgcttatagagttctttgagaatttaaatcatcctttctgaattacagaaagtcatagattagaagtgtagctttaaaatgctctagatcactctgaattaagaaaaagggtttcctttgtccagaataagcatcaatttaaaacagcatttaaaaacaagtattcaacaaattggtatacgaattataacacaagcaactaaatcactgactttgattagtctctctactgattactactgttgaacagaagttgtgtgtaagaataggagaaggtgaactcattgtcttgagcatgtggaattagttcttgtctgaggccagatagcaatttttatcttattttcagtatagcagatcctatgctgccctgataagaatcacctgcacagcctcattgactctcacggaagtattccagtaactctttgaattttttcctagaaaaattggcatctgttacccctacacaattccttcataaacagtagaaatttcccccatgaaacctttcctttaaccttaacattcttcgataattatttatgaagtccttaaataattattacaacaagtattggttttgaatacgtaccagctttggaatactgcttaaggaaaccatgataaactccaactcctttatgattatttagaggaatatatctatttgttatagtcttaaggaaaaccttgtcaacatattagatgatagaaacagtcataaccagcgaccaccaggtttggtgggaactcatgatgtgaagggtctactccatgttctgccaaccaagtaactaagtcattttgggcaaatgattcagctgacttgatctgttacatgattcctaaggtctgttatagctccaatatttcatggcatcactccactttaatgtattatctatcttaaaaaagttaaacagaaagatcaattagcacttatattaaatttgagttgctgaatattttattttttctcacttccactcactgcttccactatttgggtaatgattgttggagctgtatgcatttataatgcattaagtacagtgtggtatatcagtaaaacttcattacaaatattcattccatacatttgtctgtactggggtcagtttttttccccttcttcttctttttaaagacagggtcttgctctgtctcctcctgtcttggtctcccaatgtgctagaactacgggcatgagacactgcacctgctcttttctagttttatttgtctatctgaagagtttattatttggctaagctcacatggcaaggtaggtatcatgaagtgttaaaacccagcttttctgctaatgttcttgtgagataaaccaactattagtaaagatacttgcttcctaatcaagattacttggaattgttaagagagtatgtatgtatgtataagttaactttttaaaaacttctctgctgcctggaggaataatgaaatgacccaaagggatagaagcaaaatatttcagatagtacataacgtatatacttagccttgtgcaatcaagaattaatgatataatgtgtatggagtaatatttaactttatttcgttataagcccttttgggatagtggttgttccacataacttttatcttctttaatgcttagtatctgctagaaatgtagtctgtgggatcataagagttggggaagatttacagatagcattttcagagactgaacagaaaagcatattgtcatttggaaaaattttaaaagtgtctaacttttattcaggaccatttgcttttattttcctgttgttatttatttctattatcttgtttacagttgaaatttggacaattggtctgtatcttttctaattttcattatatataaagacttaggtttcctctttccttatgtgtttgttggtaaacattaggtgctatttttaagttttcaattctcaggcatagtgctacttatccatgttatttatataagcaaatgagcatatttgccaatcaatccacggtaagaaacacaatttaagttcctaccaaggatacctctgtgtgtgtgtatgtgtgtgtatgtatctgaaatatttcactaaataattcatttttttttttttttttttttttttttgagacggagtctcgctctgtcgcccaggccggactgcggactgcagtggcgcaatctcggctcactgcaagctccccttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaataattcatattgttaatacctcaaccatatcttgatattctgttagctttttaaatgatggttgtgaccaactacagttcacatttttcactagtggatcacactctgcagcattaaaatcaccgtgaaatagattaattagaataaatgaagtgttcttttttcattctgtttgtacagtagatattattggattattttataaaatacccattttataaattggatggtatgttataaatggatagtaggatttttcctttcttcattttgtaccaagagaataaaaaacactcctgttcagtacatctctagcaagcctatttcaacatccaatgtctcaaataattaatttttctatactttagtcacccttacacctaaacgttacagtgcttcagtataacttctatgtaaacattattaatcccatttacagatgggaaccagagtgttgggagacaggtcatggatttctcatgttcctgcacagtctaagtgttctaaggagaggcatttacagtgccaattgtataaggagaaatttcaggacagtaaaactactgacatgtccctccctggagacgtccaaggataataaaaataaaagaccttctcttccccttcccagaggagatttgcttatatttgagtgtaatgagcaatctttctgggcagagcagggtggcaaaccaatagaagatcagagttccttcatttgggggttactctcctgtgatgctctctactgtatgcactagtaacatccatcccttactgcattgcctcatggagattggagctcagggaactggtctaaatatattgttctaggtgctgcttttgctacgagtaataaattgtctttgtttctgatccacagttcttgtgtccttatgtcattgtgtgtgtgtgcatatgtgtatgcaggagaacgaatgcggcagattgaagagcagttgaatatcagacctttgtagtgtggtggtggtgattatggtgttgagacagaattttgctgtgttacccagtctggtgtgcagtggcgcaaggctcatttcagccttcgaactttcaaactccatgggctcaggtgaccctcccagctggtactgaaggcacaccccaccatacccagtgattttttttttttttttttttttaagagacagggttttgtcatgttgccgaggctggtctcaaactcttgggctcaagcaatccacccacctcagcctcccaaagtgctggggttacgggcataagccaccatgcctagccctttgtgatttttttaacttaactctggctcacacaatttaactgtaggtctgtttgtaaacctgaagcgctttctatgctttcttccttacatagaccgataaaataagtagaaaatatggtgctaatgactagtatttggtataagtagataaatgttttgtatcacatttgcatgcttataatctgtgatcaatgagcagtctgaatatttttccctccatcctcataagttaaactaaaaaaaagttatagattgaggctgggatatctggtggcgaaattatatttatttgaacagagtttgtgtatatacatacatatttcagaatatattgaaaaataaaagtgtaatgaccttgataaaaatgaaatattcacttaaaaactccatttaataatgcccacaggaaagaaatgcttctagaattttttaactaatcatttttctcagtacttttgattgtcatgcaaactaaagaaatggacttaatgaacaatttagttacaataataaagtttcaaaaattctaaatttacctcataattgcaacagatgcaaaattatttcatatctttatactcgttatgaaattacctcatatccaaaaatatttatgtcaagtgacaggctttttgcagcatttttgatattattacccttgtaatatataattaactttgtaagttaaccttgtggaacttttaagggaaatgcattaacttagcattaatatagacttctaaaatttactgtgatgtagaacatttgatttaatgttgtctgtgtctaatacaaaataactgtggtccacttacttatttcaaattttattctcaaaggtacctactagattatgtgtgaagaagtttgtgaccaaagtaatataactgattctgttttgaaaatctagaataaagtttatgcaaaagcatatggattatttctttatgaatgcagttttatactaaaaactcctccatacccacgtaagtagatatattctcatagtgatgtagaaaactgacaaaacttttcatcctcagagctaggaattcttgtgtttggccacaagggaaagacaaaggtattagaattttaaataagctatcatcaacaaatactacatctctccagctccattcataaatatagcaacattttggaagtgcagatgaatcgaacatagttaagtgagaaaaatttttagtaacatacataatttgtaaatattgaatcgttttttaaatgatactctgagtcataattatttcaaattgtacataatgctagaagaaactaggataatagcagaataagttacagtgactaaaatcataggtttttttaagagattggggagtctctgtggtgcccagtctggagtgcattggtgcaatcatagctcactgtaaccttgactcctggcttcaagcaatcctcctgtctctgccttccttttgtagtttcaggtcttaacatttaagtctttcatccattttgagttgatttttatacatggtataagatgaggatctagtttgattcttctccatatggatatctttggtctatatatttatttatatgacagtaccatgctgttttggttactgtagcttggtaatataatttgaatttgtgtagtgtgatgccgcagctttctctttttgctcaggattattttagctatttggggtcttctgtggttccatatgaattttaggatttgttttttctatttctgtgaagaatgcctttggtattttcatagagattgcatttaatctgtagctcactttggttagtaaagatattttaacaaggccgagcatggtggctcatgcctgtaatctagctctttgggaggctgaagtgggaggattgcttgaggccagggattcaagaccagcctaggcaacatggcgtgaccgtccctacaaaaaaatatttttttaattagctaggcatggtagcatacacttgtagtcctgtctacttgggaggctgaagcaggaggatcctttgggcccaggtggtcaaggctgcagtgagctataatcatgccactgcactctagcctgagcaacagagagagatcttatctctgtgtaaaagaaaaagaagtgtaattaaaggaaaaaaacattttaacaacagtctttcaattccaaaacatgggatgtctttttttccttttctcttcagtttctttcatcagtgttttataattttccttgtatagatctttcatctgcttggttaaatttatttcctggttattttatttttttgtagctattgtaaatggtttgctttcttgatttctttttcaggttggttgctcttagtgtatagaaattctactgacttttgtatgtcgattttgtatctgacaacttaataaattcacttaccagttctaatataatatggtctaattaatatattagactagaagtataagatctctcctggagaatgttccatgtaccgatgagaagaatgtgtattctgtggcagttggatgaaatgttctgtaaaggtctgttaggtttatttggtctagagtatagtttagcttcactgtttgaagttaaacactgatgttcttacatttcttataagaacattttatgtttcttatgtataagaacactgatgtttttatatttctagtctaataatgtattattaaactaaaaatataagatttgtcctggagaatgttccatgtcctgatgaaaagaatgtgtattctgtagcagttggatgaaatgttctgtaaatgtcttaggtttatttggtctagagtatagttttttacttcagtgtttgttgattttctgttgggatgatctgtccattgccgaaagtaggaaattgaaatcccctactattattgtatttatctcttgctcttgctcttatgtattcacacttgctctctctcatgctctctctctctctctttccctttgtatctaataatatttgctttatatatttgggtacaccaatgttgggtgcatatatatttactattgttatatccttttgctgaattgacccctttatcattatattatgatctcctttgtccctttttacagtttttgacttaaagtctattttgcctaatgtaattataggtattcctgcccttttctggtttttatttgaatagaatatctttctgcatcccttcactttcagcatctatgtgtctttataggtgaaatgagtttcttgtaggcagcatgtatctgggtcttgtttttaaaatccattcacccaccctgtgtctttatttgggttttatttgagatggagcctcactctgtcccccatgctggagtgcagtggtgtgatctcggctcactgcaacctccaactccctggttcaagcgattcttctgcctcagcctcccaagtagctgggactacaggcgtgcaccaccatgcctggctaatttttgtatttttagtagagacggtttcactatgttggccaggctggtctcaaactccggacctcatgatccacccgcctcggcctcccaaagtgttgggattacaggcgtgagccactgcgcccggcctatcctgtgtcttaattggagcatttagttcatttatattcagtattattgatagataaggttttactactcttattttgttacttgttttctagttgtttttaacttttcttctgcttcttttcttactgtctttctttgtggttaggtgattttctcttaagagtacattttaatttattgctttttatccatttttgctctgtggttaccaagaggcttataaataaacatcctgtagttatagcaagtatttaaaactgataatcaacttaactttgattggaaaaaaaacacacaaaagtgaacattaacttccttctcccccttcattttgaatttctgatgtcacagttcacatttttatattgcctatcttgtaacaaattgttgtagttattatttttaatagttttgtcttttagtcgtcttactacagatattagtgttttaaacactgcaaatacaatattaatataacactcattttagtgtttcttccagtttgaagaagtttttaaagcatttcttattggacaagtctgattatggtaaattccctcagcttttgtttgtctaagaaagtctttatttctccttcagttttgaaggataattgtgctgagcacagtaatcttggttgacagtttcttctccaccagcattccaaatatattcttccacattttcctggcttataaggtttctgctgataagtctgctaccaggcatattggatcttccttgcatgttatttacttctttcctttcagtgatttcagaagtttttctttgtgcctttgacctttgtgagtttgattataatgtgtcctagagtagtcttctttgtgtttaatctaattagtgatctttgaccttagtctacctgaatatttatatcttttttcaggtatggaaagttttctgttatcatttccttgtataagttttctacccctttgtctttctcagtccttctttgacttcagtaacctgaatatttgcccttttgatgttgtcccatagattttgtaagcttgcttgcttccttttctttttttttctcttctcaccatatttttaatcatttttctttgaactcactgattcttttatttggttaattctgcttctgttgctctctattgagattttcgcttcattaattttttttttttagttgcaggatttctggttttttaaaaaagttatttgagtctcttatatttctttcataattttctgaattgattcttcatgttttctttaagttctttgagctgtcttcaaacaggtattttgaatttttggagagatcacatatctcggtcactttcaggttagtctgtggtaccttattttgttcttttggtgtgatgtatttccctaaatgttctcaatgctttagaagtgtgatgatgtctgagcattgagggatttgtaatttattttagtcttcccagcctggctttgtttgtgcctgtccttcttcaagaggccttccagggattctaaagctgacttactattgcattctctgagcctctgaccaattacagccatctcagcactagagtatgctttaagcccaggttttctgagtcctgcaagggcaccaaggttgacacagctttctggcccagatggacctcgggaagacccaagggaggtagttgggctgcctgggaatgctgtccagacacctgaagccagaagactctcctagtggtcctgataggtatgcctcccaacaaatctctgcacagatgggataggtccctgactacaaagagagtggctggagttgagactgtgcgtctttggaatctactgtggaaaggaggctgattggctcacctcattggctcagattagcatgcatcacccaacaggtcccagtatctgggcagtttcttgactgcagcaagagggcttggagccaagactgggccccttcagtatctactatggatatgcctgtcacatggatccagttgggcgtgtgtctcccagcaagtccctccatagatggaatgattccctgactacagcaggagaggctggaggtgtgactgtgcccccttgggatttgctgtgggacagaggattgagagcctggtcttggctcagaggggtgtgcatcgccctgaatgttcctgcacatacaggatatttccccaactgcagtgagacgagccaaagctgaaactgcaccaccctgggatctgctgttggatggaggttgatgtgcttgtcatgttggctcagatgggcgtatgtctcccagcaggtctctgcatagacaggagggttccctaacagcaggaggagggtctggatctgagactggaccctctcaggatctgctgtgggatggtggctggagaacctggtctgagcatgcatctcaccagtagaccctgtagacaagatagtttcctggttgcagcaggaaaggctggagctgagactgggctccctcaggatctcctgtgttgcagaatctggagagcctgtcttgtttgcccggacagatacccctcttccagcagatctctgcacagaattattttcagaccacagcaagaagggtcagagctgagaatggaccacctgaggatctgctgtgggatggaggttggcgtgcctgtctcattagctcaaatgggcacccatctcccagcaggttcctgtttctgcacagataggatgcatcccctactgcagcaggaggagctgaggctgagtctggggcctcccttgggatctgtggcatggagtctggagccccttgtctcattgactcagagacacacccacaggagataacttttcaacttctagtaagcaatcatttgaatcattaagtatttttggtgtattatacataaccacacttaattacaattcatacctgtaccttcttattgctacccatatttgaggaataggtctttcccttctttccttctatatttaaaaccttttatctatattttcttctcatgccttgagtctaatctcaaaccttgttctcttcttgatctttgctaactttgttgtaaatgtgctcctatcccactattgaaacaaacaggcaaactctccaacattcgccttatctatcctcatttcagctgaatttcttgacagtgtagttcacacttctttatctctgatgcattcagctgctctcaccacgtttttaaaatccagtgggcacgagtcacccatgaccttttagttgccaaatccagtgaacacttttcagttcttgtctgacttatctctggcatttatcagtgttgaccttaccataactctgaaacttttcctgtcttgcttagcttatgtgataccttttccctcaggtttttcttcttttctggctcctcttcttccttttccacagctggcaattcctactcttacagctcttctaatgttttcctttcctttcctttatctttaggcaaaggctatggtgtgtgtgtgtgtgtgtgtgtgtgtgtgtgtgtgtgtgtgtgtgtgtgtgtgttctagcaacctctttcaaatgaattccaatggattctaacactaagctggagtgtcaggtactacttgtgatttcttctcttttatcttcctgggagttttacagaatctacagtagtgatcactacttcccacagtcttttcctgacactttctttctccctttctccagtttattcacttctcttttagattacaggacaattttcctctgttctccgtacatccagcctggctgtcctccagtctgtgttccatagagctactgaaaaccctactaagaaacaaattttgtaataccatttccttacaatgcttcagtaattaatgttaacatttaggttaaaaacagccttatcattaagaaaacttttaaactgatttaaaatttatataatgtgaaatcattttaaagtatacaattcagtggcatttactgcattcacaatgctgcacaaccacaaccataatttctaaataattctaagttttcatcaccccaaagggaaactccatacccatcaagcagtcatttgtcattctcccctccagctagccccgttcatccattaatcagctttctgtgtccgtgggtttacctattctggaggtttcatatacatgaaatcatcactatatgtgaccttttctgtctggtcttttacttagaataatgtcgtggaggtgcatcccattttgttgcatatattagcacttcatttttttgattgaataatgttccattgtatagctataccacatttgttattcattcatcaattgatggacattcgagttgtttctgccttttgaatgcctgattttgattcatttttgtagagtccttaggttttcctaagtataagatcatttcgtctgggaacaaggctaatttaatttcctctttttcaatttggatgccctttatttctttgtcttacctaaatgctttggctgattcattttgggcaaatacctgggaagagtgtttaattgctgggtcatatggtaattctatatttaactttttaaggaaatgccaaactgtctactacaacatctacaataagataaattttcaccagcaacttatgagggttccagtttgtgtacatcctcactaactcttgttattttattttccagttttaaatactattaatatctaactcagtgggtataaagttatatctcattgtatttatgatttgccttttcctaatgactaatgatattgtaaatgttttcatgtgcctgttgcccatgcatacatctttttgggagaaatgtatattcaacttactttcccgttttttatttgagttttatttttaaccaagaaataccttttaagtgatcagacctggaaccttgccaggtttaatgattatcaaagcagagccatattttgacttttgatgttatctattattatagtcttgttattcataattacttgaatattatcagcatctctagatcctttgtagttaaaacatagtaaagtattttaagtctttatactaaaatagtacgtcttgaaagttttaatatagaacactctgcttagcatttctttataacctaaaatgcaattaataaaagggtgtcatttcctctgccaattaagtagccttcattggttgatattgaacaaattgctgatacttatttctgtgatgtttactttttaaaaaaaatattttttgctttctttttaacacttccaaacaattgctaggttaatttgtcagttgcaaatctgaaataaaattgtttttagcagtctttcaaataaaattttcgttgagactaaagagatcctggattacaatcaacatttgtagatatgtcatacatagagaaccaaaaaaaaattataaatctgatataaatatcagtgtgccatacaggcatggtggctcatgcctgtaatctcagcattttgggaggctgaggcaggtggatcacttgagtctaggagttcgagattagcctgggcaacatggtgaaaccccatctctataaaaaatacaaaaattagccaagcatggtggtacacacctgtagtcccagctgtttgggaggctgaggtgggcggattgtttgagcttggtaggcagaggttacagtgagccaagattgtgcctctgcactccagcctaggtaacagagcgagaccctgtctcagaaagcaaaacaaaaacgcccaaatatcaatgtgctatgaaaccacacattgtatgtgttcattcccacaaattggagcattttaagaagcgctctaaattagtttatgtcttgcttttcttcttatgttctgtagattctttagtactccataagaaaaatttgctatagaaagcataaaaactgcaaatgcattatatcctccatgaaaccagctttaatttagttgctaaaccctgatcattgttgcactatacactcagaaaatgtatagcagtgactattttgtaaatatgaagagttcatattcagcacattcagcaatggtttatatctaaaatgatttttgaagaatgctttaaaaaacttctttgcctagagtctttaaagctggcactttaaaactatgtttcatggattgtcagttggaatggacttcaggaggtccataagtccatgaaattacagttttttaacatgaatttttctgaggatacatgatttttatcatactctcaaaagaatctaaaactcaaaaatggttaagagacacttaaataaaatgttgataaaggccatggtcattgattctcattcttcagaagctttgcatgtgtgagtttacctactcactaaaatgtacttgtaaatccaaaaccagtactcggtgcttttgcagtcatttgtaaacatatttggagaagcaaaaattttgagttaccttatgtgttcattcctctctgaggtcaaagaaggtgatggtttgccttgtttcagctgtcatactgtaaacaagtgtccttttcaatgcgtatttagtgccatattaatcacattttttgttgttgatttttctgtttaaaatggttcccaagcatagtgcagatatgctgtctagtgtttctaagcataagaaggctgtgatacacctgagagaataaaaatctgtaatagacaaacttggttcaggcatgagttacactgctgttgactgtgagtttattgttaataaatcaaatatgaagtatcaatatctgtataaatagttaaatataattatatatagatgtaaatataaattgttaaaatacggaatctttaaacagaaacatacattttagaaattatgtattggcattggttgaccaagatgatgtttggagaggttttcaggaaactaaccctgtctttttcccaggaacaataattctgcaggaggcagaacctgttgtctaggttggagtacagtggcatgaacatggctcactgcagttttgacctcctgtgcttcttctgccccagcttcccaagtagttcaggctacaggcacatgtcaccatgcctggtaatttttgtattttttgtagagacagggtttttcttgcccagactggtcttgaatttctgggctcaaacaatcctcccatcttggccccacaaagtactgagattagagatgtgagcctccatgcccagctatagttaaccttttgcagtgtttttttttttaacttaatgtttctaaatttcttctagggtaaacatttactacgtagaggctgtgtgtcatttacctcttcatggtatcacacatcagatacttctaacataatcatgataaatgttagtggtttcatggtcttatttacactccagctctaccagaattcactaatctacttcaagtttctgtctgaaatattctttttttttttttgatacagagtctcactttgttgcccaggctggagtgccgtggccccatttcagatcactgcaaactctgcctcctgtgttcaagtgattctcctgcctcagcttcccaagtagctgggacttacaggcacacgccaccacacccaactaattatatttttagtaaacatggagtttcaccatgttggccaggctggtctcaaactcctgacctcaagtgatctgcctgccttagcctcccaaagtgctaggattaacagacacgagccaccgcatcctgcctctgtctgaaatattcttattgttcatcatacagtatattgggctacagtactgtatttttctccagggtgttggtaaccatttatgctgagtttagccattttacttaagagtctactaattcactgtagataaagagttactactttggcatggtggagcatgcctgtaatcccagctctttgtgggaggccaaggcaggtggatcgctcgagtctaggagctcaagaccagccaagacaacatggcaaattttatttctacaaaaattacaaatattagccaggtgtggtggtgcatgcctgtagtcccagctactgaggaagctgaggtgggaggattatttgagaccgggaggtagaggctgcaatgagccatgattgtgccgctgtgctccagcctcagagacagagcagtaccacaaaaagagttagaagagttctttatctaacaaatatgagttgtatatttgcatagttgattgcattcatgaagtctaagtatttttttattcattaaatctaaaggaagttggggctctctgctttcgataagatgaagtaacaagtactgtacttatccttcacctaaaataatgattaaagaaaatttgtgtgtttatttcttaagacacagaacaagcatttgataaaatccaacatccattcctcataaaatcactcctgaaactggtgatagagaggaacttcctcaacctgataattagcatctataaggaaccaatggtaatattatatttactggtgaatgtctgaatgctttctcactaagatcaggaataagacaaggatgtctactttcactacttctgttcgatactgtactgcaggttctagccagtgcaattagttaagaaaaagaagtgcttctagattaaaaaacagaagtaaatcaatcattatacttcagtgatatgatcatctatgtatattattctatagaatctacaaaaaggtactagaatgaataattgagtttagcatgcttgcagaatataagatcagtatttaaaactcatgtagttttctgtactaggaacaaaaatttgaaattaaaatttaatagaagaaatattttctatcacataaataataggctatacttggggacaaatctgacaaaagatctggaagacctttactctgaaaactgtaaaaacattactgaatgaaaataagtgtgcagattctttacatatgatactaatagaatgatctgtttaaaattgattaattgtgcatcagctatatacataagccaaaacttaaacaattgtacaccttaaatatgtacagttaattttgttaattcaaatccctatactactgttaaaacaaattagaaaaacaaactaaaggaatttatgttcatatgacagtgaatgagttgtctgaactcacctcaatttttaatcctaagatgaatccatctctaaaaagtactgaacatctctgaaaagttatgaatatggtgtatgttttctcccataacctcatatatagcaattattgttattaggaaatcagaactagcttaaataatcataacattgaccatctgctttccttgttaaatacatttgactactaacttaatgttttcagttagccctctaaaatttgagaaagcaacatcttttttacctttttgccagatttctacaggctttctgatatatagttggccctctagatcattgctggcagtttgaaatatgtgtgattatgatagagtatttaaaatattttattataaatatttgatcaattttttattatataaattttcttcttttaaaaaaatacaatttagagatggggatcatactatgttgcccaggtcttgaactcctgggctcaagtgatccttctgccttggcctccaaaagtgctgggattatagatgtgagccactgcacccaggctagggtaaacttttgataaatatttttgattatgtagaataattttatggtgagttcaaagtagggttttgcaatttttattgtggagatgtatttatactgttagtttcaggatatctgtactgatcatctcctgtgtttttaatcatgatgtttccttttcaaacaacacattatgatgaaagatcaattttcaatgaaatcatttataagtatatactagctattgcaactttggggtttggaaaggaaaaattaaagtgtgttatgtttacatgttggaaacatgttagaaaaatcagtctaggattggaaggagatgggaagatttaggagtaactgctaatgggtacaaggtttcttcttagggtgagaaaatgttctacaatgatttgtggtaatggttacagaagtatgattatacctaaaatcattgaatcatatgctttaactggataaataaaaggcatttatattggaaaggaaatagtaaaactgtatctgtttgtagataacatgatcttatataccaaacaaaaatcttaagcagtcccctacagatctattagaagtaataaatggcttttcacactacccacatagacgtccatacggcgttctttctggattcccatcgtagcttaaagcgaaacttttcaccatgtctggagcccttgatgtcctgcaaatgaaggaggaggatgtccttaagttccttgcagcaggaacctgcttaggtggtaccaatcttgacttccagatggaacagtacatctctataaggaaaagtgatggcatccacatcgtaaatctgaagaggacctgggagaagcttctgctggcagcttgtgccattgttgccattgaaaaccctgctgatgtcagtgttatatcctccaggaatattggccaaagggctgtgctgaagtttgctgctgccactggagccactccaattgttggccacttcactcctggaaccttcactaaccacatccaggcagccttccaagagccacggcttcttgtggttactgaccccagggctgaccaccagcctctcacagaggcatcttacgttaacctatctaccgttgctttgtgtaacacagattctcctctgcactttgtggacattgccattctatgcaacaataagggagctcactcaatgggtttgatgtggtggatgccagcccgggaaggtttgcgcgcgtgtggcaccatttcccatgaacacccatgggaattcatgcctgatctctacagagatcctaaagagactgaaaaagcagagcagcctgctgctgaaaaggctgtgaccaaggaggaatttcagggtgaatggactgctccagctcctgagttaactgctactcagcctgaggttgcagactggtctgaaggtgtgcaggtgccctctgcgcctattcatcagttccctactgaagactggagtgctgagcctgccacggaaggctggtccacagctcccaatgctcaggccattgaatgggtaggagcaaacactgaaaggtcttaagctgttattgcacacgctcttaagcaacatggaaataaggttgacggaaaataaatgtcagtttaaaaaaaaaaaagtaatgcattcagcaaggttgacagataaaatatcaagatagaaaaatatattggatttttgagcaatattaatgggcaaattgaaaatgaagttatgaaacaatttcatttaaatatcttaaaaagaaataatgtacttaagtataaatataacaacagaagtgtggaacttatactctaaaaactacataacattgaaagacattaaaggaaactaaatggaaagacattaaatgttgatattttgaaaagatttaatatttttaggatggcagttctcccccaaattgatctaaaataaatttcctactaaaatcacagctaaattctttgcacaatttgacaagctgctcttaaaattaatatggaaattcaagggacccagtatagccaaaacaatcttgaaaaagaccaaaattgtgtttctcacttcccaattaaaaaacgtatgatgaagccataccaatatgtagttctggcataatgatagacatatctattaatggtatagaattgagaacagaaataagtcttcacatttatggtaacctgtctttctataagtgtgccatggcataaagaatagtcttttcaatgaagggtactagaacacctgcccatccatatgggaaaaaaaaaaagctggacccctatctcatatgcaaaaattaactcaaaatgaattaaagacttaaatgtaagaactaaaactgcaaccgttagaagacatagggatacatgtttatgactgggcatgggatatgagctggcaaatgattcttagataggtcaccaaaagcatgagcaataagagaaaagaataaataaattagatttcatcaagttttgaaagttttgtgctttaaaggacaccatcaagaaagtgaaaagacaacccacagaatgggagaaaattgcactcacatatctattttatcttgaatatataaagaattatttagactcaataatgatgaaaagacaaataactcactttaaaaaatgggcagaatatctgagtaggcagtttcccaaaagaagatatacaaatgactaaggagcacataaaaagatgctcaacataattagctatcaggtatattaaagtcaaaactacaatgagataccatttcactcctgctaggatgatgggtataatcagaaggacagagttttggcaaggatttggagaaccctaaggcattgctggtgggaatgttaaatagtgcagcctttttggaaaagagtcttgcaattccttaaatattttaacatagagttaccatatccagcaattctgctcctaggtatatacacaagacaaatgaaaatgtttgcacaaatgtttatagcagcattatgtataatagcctaaacatggaaacaacccaagtgtgttactgataaatgaataaacaaaatttggaatatccatgcaatagaatattatttgacaaaaaagaaatgaagtactgatacatgctacaacatgggcaaattttgaaaatatcgtgctaaatgaaggaagccagtcataaaagtacacatgttttatgattccatgtctgagaagtggcctgaacatgcatatttttagagacagaaaataaattagtgtttgcctgggacttgtgaagatgaggttttcggaagtgatgactcaagagtgaactggtttttttggggggtgttgaaaaatgttctaaaattgatgtggtgatgcctatacaactccaaatatactaaacaccattgaactgtacacttcaaagggatgaattgcatagtatgtgaattatatcttaaggagctgataaagaatatatatttattggtctgttttaccctttgaatggattttacccatatgtgatgtttttaccatgatacattaatcatttgccagagtttttgttccttaaattatgcatatcttacaaatgtaaaatgtcttatttgtcaatatcactactaaacaagaaaatagtctttaagcattgggaacctcactggtggatatgagttttacacgatcataattttcagagacccagggagaattatctcccattttttgattagttttctgtacactgttgcctaattatctttctgaaatacagattgatcaggtaactctctgatcccagcctgcttgtcattgtcatgcatggttagtccttcataaaatatgctattatggaccccatcttttactaaattcagagaaagcatgcccatgtctctctgtgttttttgtgtgtatgagtttctctatgtataattcactttagtttatttttcttcttttcgcctggtaaaatcttcaaacttcaagaaacagcatatctgttatttactctttgaccttttcattataccccatattccttggtgctttccaagttttttgttcgtacctttattataacactcctcgtatgttgttttcatgcttactcctccagtagagctatgaacttctcatgactttatttgtgcttctattccctcacagagtactttagatataataagagtctcttggattaatgagttcctaattttattgtgggtgctcagtaacatttttattttgatgatgttataattgaggtatgaatcagactccccttacactttctgcatataaatcttttttgtaaaagaattctatacattttaattatcctataaaaacttaattaccaatattgtttgtagatgtctgttgccagatttttaaaaaatgatgcattaccatccccataaatgataattgccttttgctttttttaatataaaaatgacaactttgcctgtcaaattataaaaaatgttttctcattattttcatttgccattctttggttactgtgctagagaatatatatgtctattgtttgttagtgtttatatcattgccctttaaaaaaattgtagttgtgcaagaatggatgtaggcaggctaaaatatggactctccagagatgtggatatgcctgggaaattgtcatttgatttacctgtcttcacaatcagcattttggaccgtgatacagttgttactacctatttacacttggctgataggcaggctcaaagctgtagcctcttattagagtcagtcaaggggggccagaatggcaagagccatttttttttttaaactgctggtcctacctcagcagcaccaggagagtggcaaagggggcttcttcaaagattttatggtatcttcactttatgtcaaagtctaagctatcagtatttttctttgtagtagttggtgtatgtgccaaagttagaaaatctttctctgtcttggttattaaaataagtggctgaattttctaatacctttatgggttctgttttgttttggtttgttttttcatttgtgtggggtttttgttgttgctgctgttgttgtttttacacttttggttaaagtgtgacaggaaaaacttttctttttttccctgaaaatggttctgtttttatgccagcttaatgtactaattccctcatttccgtctaaaaaaaaaatcacctttattttaatactatattgccataggtacttggatccgtgtttgaactctgtatttttctgttgatctgtatattagtaccaaattgtttctaaagcaattaacaaataatacattttaatacctggtagtaaactgctcccttaatcccatcattattactcatctatttcagaaggtactttcttattattcttccacatgaatttaaaaatcatattgatattttcaaaatatcacattggaatttgtaggttctttaggaagaaataacattttagggtacatttttgttttcttatcatatatcaagtttttcattttaattatttatttcatagctttttattatcgaaagtttcaaacatacacagagaaagaatagtaggtataatgagctccacgtttctattctctatctagcttcagtaattatttacatttgccaaacctgatttaagtacctctcctatgaagcaagtcccagatgtcttatcatttcatcctcaaatgctctagattgcctgagaatggtctcaaaaaacccaccatcatattattcacaatggtaatttcttactgctatttaatatccaatttagatttgcatttcataattgtttcaaaaatagccttttacagtaagtttatttgaatcagcatctaaagaattcaaacactatatttgtaccttgtgtcttttattattactgcttttctctctctcgtcttttttttttttttttaatactgtcattgacctttttttaaaagagaaactgtgttatttttccaggagaatatctcactttctgaatttggttagttgcttcatatttagtatttgctgagaatttgagctagagatttggttaaactcaggttttatttctttaggcaagaatcttcttaaagtgatgctccatcatttccattttatctcatctgtgagccatcatatctggtggttccacttttaatgatgctgagattaatcaatatgttcaggtgtaggttttttgtttgtctggttttctttctgctattgtatatagaacattttccttactgtttttctagtaggttattattggtatctgagaagatttttaaagcatgtgttttagtaactggacatctgaccaaactctcattactgtgtcaacttaaaaatcatgagatctgtaaatctggaaaagagaactttatttctgagaagggttacaacctgtaggctgggaagcacagcctctggattagatcaaaagtagccatttcaaagacgatgggtgagagaggagttttacactaaatgggttagctgaacatacatatttaacaggttataggaggagctatgagtattcatgaaaggggttacatgtatgtatgataagcaaacataacatgttacatatgtcccatgttcgctttggaatggagacttaacattaaaaatgtggtaaaatcagactctatacatcaaaggtgaaacttaggactcaaaggtgctttgtgcacattctctgtaaactgaccagtccatggtcaattgtcgtttatcaggaaggattgctttgtaagttggtcagcagtcatgtcaaaaccatgaaaagggaggggaatctggccacaacatcaggcagttggtcagtggaagaattttccattctttcttttccagggctggtgtttgtttaactcttaggaaaaatagtctaatgacaggtagtgaggaagagtgtatactgagacgtgaccaacctcctatctcatcaaggccgggaaacttcgtttttaaagtttttctggggcctccttagcccacagacatctgttcagtaggttggggcacttaggattttactttatctcacaaatatctaataaaatttttgggtgatcctcttcagtgactagtatagaattgtcacacttgagctttggagatgaggtgtctcaaattaaaccctaggatggttatttagtctttctgtgcctcagttttttttttttttaatctatgaaatggagatcatgtgtctacctcataggtttataatgaagattgaatcacttcccataataatcagaaactacatatttgggctgggagcagaggctcacacctgtaatcccagccccttgagcccaggagtttgaggttatagtgagttatgagcatgccaaagcactcagagtgagattctgtttcaaaaaaagaaagcagatgtttgttttttaatttttccatatcttttgcagattgtgatattgtgctttccctttttttcatattttaggcctttaattttaggatgtaattatataggccataacagttaaaaaatagcagtgataacatgcatcctacaataacatgaatagctaatatttattttagtataattttcttcttgtataattatgttgttttagtagtatgttttgaatatcaccagaataaatttttggtatctattaaaataatactataatttctttacattgatcttttaagatacagtttatccaatacttatgatgccaggttccagaatgcattagaagagtgtttgtggcatagggaatgttggaacagaagcaacactttacaatgttaaatagttttattgagaaggtgagatttgggtaaagactttcaagatgagtgaggatccatatgggtttctgggggaaatccagttcagtggaggggttggcatttgctaaaggagggcatgtttggtgtgtttcaaaatccagtagggagccgggtgtggtggtgtgcttctggagtcctagctgctcaggaggctaaggtgggaggattgcttgagcccaggagttcagatctagcctggacaacatagcaagatcccatctctaaaataaaataaaaatttaaaaaattgtttaaaatcctgtagagagttcagagtggttggagcagagtaatggagaatagtagacaatggagttagagaggcaatgagaggtaaagggaagtggcttgaacctgtagggcctcatagactattgtaaagatttttgctttttagtgagtgttgttggaagcattacagggttttgaacaaaggaatgacatactttggcttgcatttaaaaaggacagctctatgtgcgtggagtcaaggatggaagcagagaggttaggaaatcatcgcaacagtctaggcaagcagttatggtaacttggatgggtggtagcgtggagttaatgaaaagtggttgaaatctggaaatagtttgagaacaggcttttcaaatggactggatgtggtgtgtgaataacactcttctcactggtcttgttgcctctccaatccagttatacacagtagcaaaaatgatcttactttacatttgataatttcaccttcttgattaaaatccttcagtgacatactattacactgaataaaatttatccttcttaatataaccaacaaggcccacataatctagaactgcatatttttctaaccgttttcatctccctgagctccagccatacaggtgttaaattgttttaatatgccaaagtttttcctgcctcagatgctttgcattgctcctccctctggaaacttcccctaaccgtaaggtcactctttacccaatcagctcatttgcatgtttcacgtctcagtttaaatgtccttttgtctatttaaaatatattttagctgagtgcctttaatcccagctacttgggaggctgaggcaggaggataacttgaggccaggagatagagaccagcctgggcaacatagagagacctggtctctgaaaaattgaagaattagctgggtttgatggcttgcacatgtagttctagctacacaggaggctgaggcagggaggatcacttgagcccaagagttcaaggttacagtgagctatgattgtaccactgcactccagtctgagtgacagagtgagactccatctctaaaaaaataaataattggttccttctttgcctgcctcccactctttgtctttctcaaacatttttttcttcatagcatttcttacaattatgcattttatttctgtgtaatgtttttgtttgctatgctttgcattttatattgtgtggaatctccatgaaaataaggaccagcctgacttgttcaagtttgtggtcaagtaacaggatggtacctggcccttagaactatctttataaatatcattagattggattgactgactcaattaatgaacaaatgaacaaacaaaataaatcattatatgctgaagtagcagtcctggacattgtatctaatttagattttaatttaaccttgttattttgatactcgcttcccttaatcagtcattgcatgttccttattgtaaggtggttgtttttctttatcatgagaagaatagttcttctccgggcgcagtggctcacatctgtaatcccagcactttggggaggctgagacgggcggatcacaaggtcaggagattgagaccatcctggttaacatggtaaaaccccatctctactaaaaatgcaaaaaattagctgggtgtggtggcatgcacctgtagtcccagctacttgggaggctgaggcaggacaatcgcttgaacctgggaggcagaggttgcagtgaatcgagatcgtgccactgcactccagcctgggcgacagagtgagaccctgtctcaaaaaaaaacacatttttttatttagctattagcttctaggcaaaatcttaaatttcagaaaataattatactcatatagtcatactacctgtcagggaaatgtgtcaaaggaaatatgaaacaatagctttaaagttgtcccgcaccctcaccctgtttttcttttgaaggtattatactaaaggaagaaagggaaaaagagaaatctatggtgtgagttcaagtttactactgtaagtgtttaagaaagggctctgttaccatgacaacaaatgcatgaatttcatgtggaaaattttcagtgtatgggactgataaaattgtaacattctgattttctctggtatagaattgttctttgtcaagttaaaaaaaatctgttaatatatgttaaaattaaatttttaaatgttttatgatattgttttctaattgtttattataacttaaaatcatagccaaaagagtgtactttcgtagatctgtcaagcagaaagttaagtatttgatttgacattaaaaattacttttctaatctgtattagatttttgctaaatggtaaataaaatggtaaatagtttcatgtattgggagttcttgacaatagaaaatgacctgccactttatagattcctttgccttaaatgcttactaactcaggtagaggaaagctgttaagctttaagtgctttgtcatatttgcaggcttttatagtggaagagaacagcagtcagcaatgatgatggaaaactgtggcaggtagacttaaaacaccataaagcacagacgattgtgtgtaatgccttgaattgaatcctttttgaatgaaatgatcagccatatgtgccacccttatggaccctgtaagaagagtagaagaaatgtgccctaatgctaactgtgcatgaaattgcagtgttaggagatattgaccagatgtttcaatctcagcaaatggcttgttatgtgactgagtgaaaatatctttgctgctttgatcacatacaccttgaaggaaggggtaatttaatagaggctgtcatagttcatcattgtcaataaactttgacttgacctttgccttacgtttttgatgttgctgctgttaagtgttgttgggcagatgtttactgccttgagggattttgctttttataaagtgtatactagaaaaagtaaaggagaaggattttctcaattcttttcttattctttggttattagttggcatgcttctctgtggattttgtagaatttctgggcagatgcatttgagtgacattcttatgtctaaagatcactgtggtgtttctctaaaggtttcttcctttcctcaccttcctttttcttttctcgagacatggtctcactctgtcactcaggctggagtgcaagtgatgtaatcttggctcactgcagcctctacctcccaggctcaggcgatcctctcacctcagcctcctgagtagctagaactacaggtgcacaccaccatgcctggctaatttttgtattttttctagagatggggttttaccacattgcctaggctggtctcgaacttctgagctcaagccatctgccggcctcagcctcccaaaatgctgggattgcaggtgtgagccaccgcacctggccctttctcaccgttttgtcctggttttaatttaccacaataaacttccttggtggtttttctttcttattttatatacagcctattcttttgttctgatgaaagtcacattgaattaaaacttgacacctattgtaacaccataccaggtgctgtgttatttttttatccctagttttggagacctttggagataaatccatgctattttgtaatccatttttgttaatcttaagaaattgagtgaaagtttcagtaacacaatttttttaaaattataagatacagtattttaaaattttggtaaatagctttggattaaatgagtttcttgtttaatttgatgaatttgactcagttctgtaacctttttgctctttttcttgaaaagaaaaaggcttcctcactggctatatctgggttctgcctacactcttccctcacttccccttggtgtaggtggcctagaccgtgttagtcacctaatgaaatctgtgaatcctctcttgaaaaacacagcaaagtttccttacaatttcaggatgtttattggattttccccccctcctctcacacataccctgcaatgataggggcccctggacttcaagcagactaacaaagcttagaaaataagattcatactccttcttagtattctagatatataacaatttgacttagaagtaacaataacaatagtattagtgatactgctacaataattacaacagtaataataataataataattaaaatttactttctgccaaccttatgccagattctatgctgaacctttaacctgtattactggttatattgttaatgatacctctagatagagtatatgcagcatacttttattctgtactttaggaaatactatatctttagaatacagatttgagtaagagattataagcattttgattctaagactttttggaatactgaacttttagttttctgattccagtagtcagtctgtctgtctctgtctctgtctctgtctctctctctctctctctttctcggcctctctgccattcatcttcttctgaaaattagctatcccacgtaagcctcatatatcccctaattcctatttgtagttgtgagggaggaaaaatattttccttctaagttctctgctgtaagattcttgtaacaaaagacagattaacaaaagttaagtacactaatttatattctaagttttatgtaacatagagggaaatgaagacttgaagaaacaattaaacctggtgtttttacattaggttttatgaagagtggaagggaaaggcaataggacaaaaaggggtatgaactaagagtagtaaactgaggggaccttagcaagacctgtttgtttagattcatctcatgtccttacatcttctgagataaggatgttctttttttctgcatatagtaaacatcctctcacatggatggtcttatgatttgcttcagaggaaatcagaaagtccttcctgcacctgctgttctcaaattccttcagcttaaaattttcagtatgtcaagtgccatattttgggggtagtgtgtcctgatctccatcatagttaagtgtcagcttggacacagtttctcatatttatcttaggaaatcttctttggccactctgcaaagactaaggtgctacttgcatgttctgcaacaactcctattatatatatatcatctcttaaaataaatagtaacatatcttgtatgtaagctttatgtacccttaaattgtaagttttaagaagatacaatcctggctttcctgttcacttatttgacaattatttaattgcatagaatgtagcaggcactcttctagatttggaaacacaccctacaactcttttaaaaaagccaagaaaacagtcttgaacagcaaattacaattaagtggaattaattctatgataggaatgatacagtttgttgcggcaacataaaatgcaggcatataggctgggcacggttgctcacacctgtaatcccagcactttgggaggccgaggtggatggatcacttgaggtcaggagttcaagaccagcctggccaacatggtggaaccccacctctattaaaaatgcaaatattagctgggcatggtggcgtgcacctgtaatcccagctactcaggaggctggggtaggagaattgctcgaacctggaaggcagaggtttgcggtgagtcaagatcgcaccactgctctccagcctgggtgacagagcaagactccgtctcaaaaaaataaaaaataaataacaatgggtatatagaacagaatttaggacaacattgtctcagtaagtgaaacctgaaacctaagtaggaagctagaaagaacaaacagaaacagaatgaagtattcagtgtactggaacattgcattcaagagtgttaatgcttaggattaacttggagaggaagttaatggttcaatcataaagttgtttatgttgaacttgcttaagatacttgggtaacgattgaaggacattttaggaagagcactcaaaatgcagtggattggagaaaaacagaactaaaggcagggagatgatctaagaagcttttgcaaatggttgcatggttgggaggatggagtgacagagagaatgggaaatgacatccaatgggtagaggtttctttttgagataatgaaaatgtgatggttgcacagctatgtgaataaacaggaaacaactgaattgtatattttaaagtggcaaattgtatggttatatgaatatatctcaataaatttttttaaaagagacttttatagtagtctaattgagagtagatggtggcctgtactaaagtggtgttaatagaggcaggagtaaaagtgtgtcaatttaataggcaaaatagggttgagtaggtatttggatattcagagcagtcatttgaaaacaagtataagctaaaaatgagggggtctcagcatatagatgataattgaaaccatgagagtagattagatcatatccagagaaagtatatacggtaagaattgtaggtaacctgggaatccaggcctgagaaatgctaaggaatggggagaaggaaagaagcctacaaaagagatagagaagacttctttatccattattaattacaataatgtccaacaaataataggtgatcaacaaatattggtggaatgaattgaatgaatatacactaaaaattctgcattttatcacagtctcagggcactgttgtcatcgtcagctgtactctgtaataggcactgccttgaacactttgcttacattatcctattcaatcatcacaataattccacaagaaacatagtctctgaaatagtagcttgtttaccatcacatggctggatgaacttatatatctgagtctaaagtttattttttctactaggcctaatattccccgaatctgttctgagaatgttaacagatatttactaacaaaaataacaatagaactatttcagggaaagaacaggattattagaaattgatttttattaataggatgcttgctggcaggggcaatggagcagttttttaaggaaagaagcataacatactagttattcagttagaatagattcttaatatttatgaaaatcttgtgttttgccctgtctcacttggtggtattgtaatcatctgagaatctatcctataagttatgtgatatatgctattttccttatcaatctatttcagttttgatttcctcatcatcctttgcagtctgcttgttgctgtttctcagttttgacatttaatttcttttagttgtgctttacagtttttctgagatgcctcattgagttttctgtataaaatttcatatctttggcttatcttgcaactcttttagtacctaggtgtcattcttcatcattctattatgaattgaattaaagcatatggcattatttcagaagtgactgcctcttgggcatcattgtcagttatattgtcctaaatattgcatttaggtaataaaaaggaaatcttccttgaaggtaaagttaatattaatagaaatctttccatatgttgttaaagactcttgttatgaagtttaatatgccatttatttaggccttatttaaattcagttgtaaattttttccttctggctccttaccttagtgaactgtcatctcttatcatcatactctttgctcgaaaaccttcatgtgttgctttctaccctcaggatgttgcctaaatttcttgaagtggtatttactgatctggcctacatctacctttcccattagtctcttccttcccacatagttgctttgtcggtatactcctaatagtcttttatttctgtttttcattgtttttgttaatattatattcttgtttcccaatctgtgcactaagtccccttggggtgctgtagcaaacccacagagagtcttcagggtatttcaaaatttcaaggtaaacacagtgacgtctatcagacacagcatgaaccactagctccagatatttcagtttttttttttttgagatggagacttgctgtgtcacccaggctgtagcgcagtggcgggatcttggctcactgcagcctccacctcctgagttcaagcgattctcctgcctcagcctcctgagtagctgggattacaggcatgtgccaccacgcctgggtaattattgcatttttagtagagacggtgtttcaccatgttggtcaggctgttcttgaactcctgacctcgtgatccgcctgcctcagccttccaaagtgctgggattacaggcgtgagccactgcgcctggcctggtatttcagttttaacattagattactacattccttttggtggcattatactgtgcgaaactgaatctttgacggtttctgtgataaaaagcaaatcagtgtgaaacaaatgagggtgatggttaccagtctgattccaagatttgagaattttgcagtgcctaacaggtagaaaatcattaggaaataaacacttttggctgaaacgaattatttaataaatggaatttctttcatcctaggggcaccatgataaaatttctaacataggaaaggaggcatgtgctatatgctgtatgactcttttttctttctagtttgtaaccattttggaagatcatacccatccttcaaagaccaattgatactgctacctgtctttggaggcctttcctgatcccctccactgcagttgatctctctcatgggtattttccagtaatatgctgcttttttactattgctgtttaagttaaactaattgaagtatttatttgaagttaccaatagtggccgtggttttcctattcctccagttaggtataattacttaaagtataacaagagccctttccttctttgtataaaggtgatacaaatataataatagaaaccctatactgtactaaactgcgtaggttgttagtcaatttctttttatttcttttttttcttttttctttttttttgagaggagttccactcttattgcccaggctggaatgcaatggcgcaatctcggcccactgcaacctccacctcctgggttcaagcgattctccttacctcagcctcctgagtagctgggattacaggcatgcgccactatgcctggttaattttttgtatttttagagatggagtttttccatgttggtttggctggtcttgaactcccaacctcaggtgatctgcctgcctcggcttcccaaagtgtcgggattacaggcgtgagccactgcacacggccttgtttgtcaatttctaattcttacaacatccttaaaagatcataggttatgttatccacattttatatttgaagaaattgacgtttagcagtgttagtttttctcacacccacatacctcctgacctttagctattctagttccttttcctttaatattgattatagaatcaactttttgatatcctcaaaaatccattgagagtttggttgggattgcattgaacttatgaatcaatttggggagaattaatgtcttaagaatattgagttttcaaatccatgtacataatatagctcttcgtttatataagttgtttttttttcctcagcagtcttttgtagtgttctacatatatgtcttgcacatatttggttaaatgtgttcctacatgtttcaattttggtggtattgtaaatattgttttcttaattttaattttcaactcttctttgaaaatttatagaaatacattagatttttatatattgatcttaaagtctgagaccttgattgacttacttttaattctagagcatttatgtggattccttatgattttacatatattccttaaacatgcacaggttggtatctagccatagcctcaagggttactctgtagatttcaactcattcttctctgaaaatctttttcacaatttctagtctcctggctctccttgaacacatctctttctcctcattttagtgaaaatgccaggctctatttgccttctttctccctctccatggtgtggaacttgcctcctggcagagtacctgcatgatgtcagggcacaccttgtttctttcctatcagagatcacagtcctaccatgcctgttattcaatgtctgaaaattctgtaggtgtttccttttggttttctggtttacagcacaacagtaattctagagcctgctactcactcatggccagagcagaagttaaagtttttaaggtatactgtacatatgtgaaccaagggaaggtaggcagtttattttagctaaaagaaggagcataatcaaaggttataaacaaggttgaatctccatcctggagaatcaaaatctagtagttgtgactttgtattaggaacatcatcatttttatctttttattccctggcagacatgcattaaatgtttgttgattgagtatcaaaatgataggaaatagattagttggatgttggtgaaacattgtgttttagatgcttacagatgtactaaaattttaacagaaatctttgcaaattacttgttaaattttcctaaactgatttttaaaaatctatttcattctcaattataacatctttactgagattattaagtgctttgaagcagttaacgtggcttttttttttaatggctgtaaaaaaactgaatttttaggcttgttaaactctggttttagaatgacttttgagtggaaatcactgatcaaaagcaaagttctcacattttgtcaatatctgaatgtcagaaatagaatgtcaggcagtttcccatgttgaaatattcgatagtaaaaggatagcaaagttgctgaatatttctactgtttatcaatttttgccttgcaggttcaaataatatttatttgtagtggaaatatttcaattcatttaaatcctgattatggagtagttagtaaatcaggtttaagcctgacagtgagttgatatagctcttatttcagactgtagtttgaacatgtagactctctgattataactaggctaaattatataataatgactttattttcactgaacaaagtttgctattattttgatgacaaattatttaagtaatcatagtaaaagttgctattggctctgggttttatttattttgctatatatagtagacatggttgatcatttaatcatgccttatagataaataaaagtaagttatagaataacacagaaattttctgctaaatttatactttcactaaatttaataacaatagaaattctctgttaaatttatactttcactaattgtagaataaagtattttaagttaggcatttatactgagacattttatgatattaactgcttcatgttatttactcattttgataaatggagtgataatatccaaaatggaataaattaagtttaaattattgttattctttaaaggaatgatttagctacagtatgtttgtcccaccttttaattttgaacattttctaacttacagaatagtaaaatgaacttttctatacctttcacattgatccaccaattgttaacatttcaacacatttgtgttctctctttaaataaatgtatgtgtgtgtattttcctcagaaccattctgaagtatttattccttattcaagaaattaagcattgatactgttttctgatgtgtgatcaagattccagatgtcacagttattctggtagtgtccttgatagctgtttaattttattctcagtccaggatccaataagaatcacacattacatgtattagtactatttctttaatatactttcctcccacctttttggttaaggcattttcttcaagagtccaacccagttgattgtaatatgtgccaccttgtggacttaatctcatgattttaggcaataatagtacgtaagtgacactgtgtatttcccattgcatcacatcgtaaggtttatggctttattgataatgctaattgataatggttaagatagcatccctcagattttttgcttagaaccttcttccctttccccattccatgtttgtgttttccttatcctgttcagcaaacctagttcccaacagcatcaactttatattcatttgctctatcctacaatacgcacaaaatagtttcaccaataacataaccaacaataaacctactaaataaagtttgatttatttgttgtttttgttccttataattattccattaagactgtattgtcataagagcatactgaaaaattatttgcattattttttctatgtgcttatgttacaatttgataccttctttgatttttcattcttgttatactcaacttcataatttgtttttcttctaatggaatttgaaattaaaattaaattttattatttgaaaatgcaaaattttaacatgtttcagaagtcaaatttgtatggaatgctatattcagagaactcttctattcctattcctctactcctttcccactcactctcatagaaaagcatttttcatttctagtttattctttctgtgtttctttttataaaattagcaaacacaaaattatatatacattctaatatatgtatatagtatagtatctatactaaaagaatatatatggttgagtgaggtggcttgcacctatagtcccaactactcagaagactgagctgggaggatctgttgaattcaggagttcgaggcaagaatatacacacacacacacacacacacacacacacacacacacacacacattctcttttatgtaataaaaaccataacattaactctaccatcttaaccatttttaaatgtaccaattagtatacgcatgttgttacatagtcaacctctagaaatttttcatcttgcaacactgaaactctgtacccattaaactcttaattctctgacttccctccctgacgtccttggcaaccaacattctacttatgtttctatgattttgactacttcagatacttcctatgaatggaatcatacaatatgtgtcttttttgtgacagaccttatataacttagcaagttcttgatgttcatctatgttgtagcatgtgacaggatttccttcttttgtttctttatcctttaattgttgatagatgtctgggttgcttgtacttcttggctatcatgaatattgctgcagtgaacatggacatgcaaatatatctttgagatcctgctttgaattcttttgactgtatacccagaagtgaggttgcttgattatatgttaatttaatttttaatatttctttcaggaacttccataccattttagtagtggctgtaccatgttacatttccaccaacactgcacaagggttcattcacttctccacattttgccagcattttttgttttctgtgttttcggtagtaaccatcctgatcagtgtgaagtgatatctcattgtggttttgatttccctgatgattactgatgttgaacatcttttcttgtgcttattggccatttatatatcatttttggagaaatgtctattcaagtcctttgcccattttaagatcatgttatttgtatttttattgttcatttagaagtttgttatatattctggatattaacctttcattggatatatggtttggaaataagttgccttttcactctgttgattgcctcctttgccatgcagaagttaagcttgatataatcacatttatctatttttgcttttgttgcctgtgcttttgttccatatttatgaaatcattgctaaatccaatgtcctgaagctgtcccccatatttgaaaataatatatattattaagttttattttttaaacaaagctttttacctttgagacttgatttttttttgaagttaacaaaatatcctggaaattactttgtatagaaggagtgttccacagagcttttcctttttttgtgttgttttgctgggatttttgaatggctgtgtggtattccattgtgtggatatatcataatttaatcgactgatcttctacaggtggacttctagtttatttccaacattttgccattacaaataacatctcaatacttatatatgtgttgttttatattgtggatgagtctgtagaagtgggattgctggtcattaagctgttactatgtctcattcttacagttctgtctttgttactttttcctctcctcatccttttacctctcaaatatgcatgtatttcttttctattccaaatatttgagaacagattttatcaaaatctattttgatatcttttgactttgtatgtagattatttgtaggttattttgctacctgtaagtctttgaaactaaacaggtgttacctatagaatcactatagaatattagaaccctcagggatttgagctaattataaaaggtaaaaagttcaaatctgtgaaacatatgcatcttacaagaaatccattaaagcttataataattacttcaatgaaaaaatgagatatttgtaactagaactgtaacactatttctgaatttttaaaagaatttttttagatatgagcatgttttagcttaatttatatatgaattactacaataagtatgacaatcatagtaacagccacagctaatatatgttgttgactatgtgctgggtaccatgctcagcaatgcaagtacattaatttacatcatttcaattagtcctcaacgaccttatgagatgtatttgtaattatatctccactttaaacatgagtgaaatgagaaatgttaagagatatgctctaacatgctctaactcatgcagctagtaagtggcagaagcaagatttgaacccagagagtcttcaatcaagatggattctgctctttttatgacaatgctagacttcttatattgggacccactattattttcctatatcaggccagcatttgtcttaaggtctgtatgattttagctgctgagtccttaacaactttatgtactttatttctctccccaaagcagtataagatattacatggttgttatattaagtttttttaatcgtaagtgatagcacagaattgaaatcccattcataacagctacagtttctcacaaagcattcttgtcacatcactatctgtggcagaatattaaactatgtgtaccatttttttgccccattaaattatttatgttcctgttttacagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtcagtgtaattccaagggaaccactatactaattggctattttaacactggtaaaatatgaattccaatgtgaatttggaattttgactttataattccttttaatgtttgataaatgcttattccttatatcagttttcctgtattgtttttaaatttacttttgttaaacatgcagttgaattcatgaggcataatggaataaaagtttgaggttatttagtccagtctctactttttataattagaatcagaaaaggctgatagcttgctcaatgccttgtagcttgctcaacaccttgtagctaatttgttgcaaaacttgaattagaaacaatgttcttttcaccatatcctgaggttggaatacgagagagagagacagagagacagagagagagtgtgtgtgtgtattttatgtatataaaatacaacattacattcaggctcgtaagacttagtcatctaaatggtcatctaaaccatttctggcaaatagtaattcattcatattgaataaactcagtcgtgggtagtataccactaacaaaacaaccaagtatatttctatacacccttacttattagaaaagtattcttaatatgaacttgaaatatctctctcaggcccctccatatattggttggttgttcttttgtacccacatggagatactccttcagtgtattcatgcactgctaacgttattaccatatcagcacaggcttttttcccctttgcaagggaaaaacaaaataactgccctagctattatattgttgggataatcaaagatgacctctttttaaatagtgattcactagaaattttgcattacttatagttggaaatatgtagtctgtcctcctccattccctatctcctttcttttcccatcttctcttcctttctttttttcccttttcatcctcctttattttcttccccctctccaccacgaccttgctccatttcttctatttacccactttattgctcactacttgaccttcagcagaggtatattaaggaatggactattctagagactggggatcaataagcacagtatttactaaataaccaaaatacaatattcaaaaattattagggtatgaaaggcattttcagatctttcctttaattttgttttttatatacaggagaactttatggttttaagattacagtaaacattgaaatatgggattcagggattttaaaaaaaaacaactaaaaatgttgaaatatgtttgtttagacctttgcccttagttttcccaagaccagccttaatctgtaggtgcaaagttttcccattagtgagaagtaggtcagattttcttctgatatcacttaggctacagtaaaattactaaattgttttagtatgctaaattgctgtcctaaagaacagttatggttgggtgcagtggctcacgcctgtaatcccagcactttgggaggccgagtcaggtggatcacctgaggtcaggagttcgagaccagcctggccaacatggtgaaactccgtctctactaaaaatgtaaaaattagccaggtgtgcacctgtaatcccagctactcgggagacgaaagtaggagaattgcttgaacctaggaggtggaggttgcagtgagccgagattgtgctattgcgctccagcctgggcaacagagcaagattctgtctcaaaaccaaagagagagagagaacagttatgataatattagatcttctggatgtcaaaaacttaacttttatactaattttatggttatagtgatattgttgagatgatatgggactcaaaaattggggagaaatcttcagtatctaaatcattatctaaattctggaagctaatacagttggatcaattgttttggataggtccagtaacctttgctgccactatcaaaaactcagaaattggccgggtgtggtggtcacaccttgtaatcctaacactttaggagaccgaagtaggctgatcactcgagctcaggagtttaaggccagcctggccaacatggcgaaactccatctctacaaaaaatacaaaaattagctggggatggtggcatgtacctgtggtccccgctgcttgggaggctgaggtggaaggattgcttgagcccaggaggttgaggctgcagtggactggggtcgtgctgcccactgcacttcagtctgggcaaaagagtgagcccctgtctaaaaaacaaaaaacaaaacaaaaaatttcagaaattgaagtgtttgggtaatgcagtatctttcttgatccaggttcttcctcttcaaagtcagaatcaaatacgttgggataataagaatactcatatttttctggtcgggcatggcagctcatgcctgtaatcccagcactttgggaggccgaggcgggtggatcatttgaggccaggagtttgagaccagcctggccaacatggtgaaactccacctctactaaaaatacaaaaaaattagccgagcatcatggcgggcacttgtaatcccagctacttgggagactgaggcaaggaaattgcttgaacccggaggcggaggttgcagtgagccaagacggagccattgctcttctctagcctgggcaacaagaacgaaacttcatctggaaaaaaaaaaaaaagaatacttttatttttcttttggagaaactgtagtttcccatcaaaaagtagttttattatcagaatagagtttagtatctggtaccagaaatgtttgcttttatttggtagccattttgtcaaaattttcctaaagtcataattactaaaatatttttataaattaggtctaaattttcttaagtttgtaatatagttattttgtatatgaatatgttgatgcatattactctttctttccttcatttacttgaacataaacagatgtatcctttagtagtaaattggcagatggatgagtggaaatacgttttggaagagaattgaggtttttttttttaacagtgtaatcgaacatattaccaaagtctgaaatgataagattttttttgtaagctataactgttacaatttaattagaaaaagagaaaaattggcaagtaattttttaaattctggagcagtatgaggaaggaaagtatttttatttataatgtaaataattattgtatttatttttaattaaacaagccaagtgacacttgtagcaggattttatttatttatttatttattttttagagatgtggttttgccttgttgcctaggctggagtgcagtggcatgatcatagctcattgcagcctcaaactcctgggctcaagcaatcctcccacctcagcttcctgagtccctaggactataagtgtgcaccactacccccagctaatttttaaaattattttgtagagatgggatctggctgtgttgcccaggctgacctcaaactcctggcatcaagcaatcctcccaccttggcctctgaaagagctgggatttcagctttgagctactgcacccaacctgcagcaagattttaaatgcagtatcctgcttagatattccatttctaaaattggaccagtcaggggacttttcaactatagaaaacaattctaattgatttcagcccttagaatgtaatggtttacaaattaattcctcttagcgaatatggtctacatttataagtgtcttttacgaaattaattccatatttggcttttaaaggcttcgattaaatagacaattatagtatgttgatatttatttttataaagatatttttctacttaaaaaatgtttttagttgcatagatttctttttatataatgagttagccttatttcttaactgcattttgaactattaaggtgtaaaaagtaggtcctattttactatcaaaaggcaacttaaatgccaatttctttctcaaaataccaggtgttgtttagaacaaaaattatcatagatgcctcagaaagttctcaaaacaaaattattatttatatttatttaaaaatcaataacattagttttgaagaattaattaaaatgtaaattttaaactttgcaaaaaatattggtaattatctattgaaacatatgctaagtttgactataatattacttgcttattctttggttgttttaggtccctcatagctaatcttgctgctgccaattgttataaaaaggaaaaacatcttgatctggagaaaaactggatgttggtagaaaaagcaagagtttgttatatagcagtaagtacttacctaattcaaatctctagtacatatttacatgatggattatagttgttgtctgatatatattttaaaataattatcttttatttaccctgcaaattatttatctctctcaaagcatatgttagattcactattgtgaaaatagaacagaaatcattatctttctatgggtaacataatttgtattatttatcttcaggtctacctatttttggatacattatgcataggtgcttgccaaccaagcgcagaattctatattaaatcagtttccaaatatattttaaaataattctacaaacttacatcttacatttgtaggcaacttgcattgtgcagaaaaatattagtagtataaatattcactgcaaatagtttgagctgaattgcttaaaaaacttaattgctatttattccatagtaattaccatgacacctcttaatttaatatttcagaaacattgatcgtgacaaatctcttaaatctgggaacaagggcagggtgtaatttgaattattaagtcttctgacacaaaaataattggttaagaatttatttctaaaataggatggtactaaaaattctgaattaatcaccccatgattaccttgtttttatttaatatgtgttaaatgtggctttacacaaataagtagatacctatgaaaaaagcatctcgtatgcatgtaatatatggttttggtataacagctgctgccatttcattacctgagctctgtgaaatagctggtaagatgtgtaaaaaattgattaccctactaggaggaacatgtttattgaaaatataattatttctttcagtctaatgttaatgtctcctacagcatgtttgtgtgcactgttctaggctttacaacattgttattgattcctctgtataccaaatcctatccctttataactgtcaaataaatgcttacattgagaagattatataatggaaagttatgctatcttttctgccagtatgtgagaaaaacatttcaagaattaaatattttacccctttattatttccatttcattttatttctcaaattggtctcatgttctttccatttttcaaatcttgatactgtatttcttgtagtgtgattctttagaggggatttatgtactatttcaaaccatcttacacttgaaagtctgattttcaaaaagcaccatgtttagaatttggcataatttatatatacttgttgactatgaaataagacagtgtattctgatgaaaaagtatatttaacttgacaattacagtcttctatgtttcaatatatagttgttcaatcctgaattgtgagccaacttgcaaacaactcatagttgtaatgattatacagtataacatgtctagccaactttgggtgaatggaacttttatgaaagtgtagattcaacttgcagacaactcatagttttagcatttatgcactatattgtatctagccatatttgggtgaatggagttttacagtagtattaaatatttatacttacgtgcaattttgtacagcataaagtgatcagcttttggtgaaattaataaggcaaatgatattatttttgagatttgggtggtgtattcagccagaagaaataacaaaatggatttcagttgttatctgtgatacaagtgttagcttgtagcttctgtttcagcagtttcataaaaagaatgatctcttacattgccaggtaaatctgtactcttctcctagcttggcttattccaaaatagttctgaaaatagtagactcatattggatacctgggacgctgtatattcttagtgaacattcaacaaatatttacttggtgaataactaagagcataattcgtatttattgaaatctgtaaacttccttttgaaatacaatgttatttccacaaagacactgcaggttttgcaaatctgtaattccctttgatttcagagcattccgaaatgatgtgtagtctagtctagttttttcttagcatatggtcaaaccataaattaagtgggctgccccatactttctggttctatgaggtcaacagtctcattacattatcatcataaactaatgaggtttaagaaattaaagttctgggggctctttaattctaaaatgtttttgatctaaggaagcaacgcagtttatctattcaacaaatatccgtaactaaaacatctgtctgcatcacataagctaaaccagatctacatactcagctctgcttcttcacactattctccaaactagcagtgtttcatgaatattaagaaaattccaaaccttcttcttcattttcttcaccatataatttactgagtaagttcacactggaaaccttcctgactgaaaagctaaaattgaatatggatacaccagcatcctcttttggtttaaatacagtgccaagatcttttaaaatttattttttacctttcataataaatgtctcattttatgccacgtaaactcagtttttccatgtttaaaccagcttctcagattctttgttagcaggtaattagggactactggctatggtgactaggtaattatgtttttgaaaacataagtctcaggttctcttcaccttagaatcagattgggatatatctgttttttctcacttaagaaataatatttcctggcatagtggtttatgcctgtagtcccagtgctttgggaggccaaagccagtggattgcttttggtcaggagatcgagtccagcttgggcaacaagtaggtctctaaggacttgctttatgaatctgggtgctcctgtattgggtgctttatgaatctgggtgctcctgtattgggtgcatatatatttaggatagttagctcttcttgttgcattgatccctttaccattatgtaatggccttctttatctcttttgatctttgttggtttaaagtctgttttatcagagactaggattgcaacccctgctttttttttttgttttccatttgcttggtagatcttcctccatccctttattttgagcctatgtgtgtctctgcatgtgagatgggtctcctgaatacagtacactgatggatcttgactctatccaatttgccagtctgtgtcttttaattggggcgtttagcccatttacatttaaggttaatattgttatgtgtgaagttgatcctgtcattatgatgttagctggttattttgctcgttagttgatgcagtttcttcctagccttgatggtctttacaatgtagcatgtttttgcagtggctggtacccgttgttctttccatgtttagtgcttccttcaggagctcttgtaaggcaggcctggtggtgacaaaatctctcagcatttgcttgtctgtaaaggattttatttctccttcacttatgaagcttagtttggctcgatatgaatttctgggttgaaaattctattctttaagaatgttgaatattggcccccactctcttttggcttgtagagtgtctgcagagagatctgctgttattctgatgggcttccctttgtgagtaacccaacctttctctctggctgcccttaacattttttccttcatttcaactttggtgaatctgacaattatgtgtcttggtgttgctcttctcgaggagtatctttgtggtgttctctgtatttcccaaatttgaatgttggcctgccttgctaggttggggacattctcctgaataatatcctgcagagtgttttccaacttggttccattctccctgtcactttcagatataccaatcagatgtagatttggtcttttcacatagtcccatatttcttggaggctttgtgcgtttctttttactctttttttttctctaaactactcttcttgcttcatttcattcatttgatcttcaatcactgataccctttcttccacttgatcgaatcagctactgaagcttgtgcatgtgtcacgtagttctcgtgccatggttttcagctccatcaggtcatttaaggtcttatccatgctgtttattctagttagcctgtcgtctaatcttttttgaaggtttttagcttcttttagatgggttcgaacatcctcctttagctcggagaagtttgttattacctatcttttgaagccttcttctctcaactcgtcaaagtcattctccatccagctgtgttctattgctggcgaggagctgtgttcctttggaggagaagagacgctctgatttttagaattgtcagcttttctcctctggtttctccccatctttgtggttttatctactttggtctttgatgatggtgacctacagatagggttttggtgtggatgtcctttctgtttgttacttttccttctaatagtcaggatcctcagctgcaggtctgttggagtttgctggaggtccactccagaccctgtttgcctggctatcaccagcagaggctgccaaatattgcagaacagcaaatgttgctgcctgatccgtcctctggaagctttgtctcagaggggcgcccagttgtatgaggtgtctgttggcccctactgggaggtatctcccagttaggttactcagggatcagggacccacttgaggaggcagtctgtccattctcagatctcaaactttgtgctgggagaaccactactctctccaaagctgtcagacagggacatttaaatctatagaagtttctattgccttttattcagctatgccctgcccccagagatggagtctacagaggcaggcaggcctccttgagctgctgtgggctctacctagttcgagcttcctggccgctttgtttacctactcaagcctcagcaatggcgggcacccctcccccagcctcactgcttccctgcagttgatctgatagcggactgctgtgctagcagtgagcaaggttccatgggcatgggaccctccgagccatgcgtgggatataatctcctggtgtgccgtttgctaaggccattggaaaagcgcagtattagggtgagagtgtcctgattttccaggtaccgtctgtcatggcttcccttggctaggaaatggaattccccaaccccttgcgcttcccaggtgaagcgatgccccgccctgctttggctcacactctgtgggctgcatccactgtccgacaagccccagtgagatgaacctggtacctcagttggaaatgcagaaatcacccgtcttctgcatcactcacgctgggagctgtagaatggagctgttcctattcctttttttgttttgttttgttttgttttgagatggagtcttgctgtgtcatccaggctggagtgcagtggcacaatctctgcccactgcaacctccgcctcctgggttcacaccattctccttgccttagcctcccaagtagctgggactgcacgtgcctgccaccatgcccggctaattttttgtatttttagtagagacggggtttcaccatgttagccaggatggtctcgatctcctgacctcatgatccacacgctttggcctcccaaagttctgggattacaggcatgagccaccacacccagcctaattgttttttttttttttaatcagctttgttaatatatgtctcacaacttacaatacatacattttacttctacatatatattataaacatcgtaaccttgctgctatttttgtttaaattgtcaaatatatattttaaaagacttaataagaaaaaattcatatttttactcaggtatttatcatttctagttctctttattccttttggttagaattagatttccatctggtatcattttccttctgcctagagggcattctttaacatctcttgtatttggatctgtcagtaataaattctttcagcttttgtatgtttgaaaacatctttatttcaccttcatttttgaaagacatttgtgccagatatatagttctagtttgacagtttttcagtacatgaaaaatgttaccccattgccatcttacttgcatagttcttgataagaaatctgacattcttttgttcttcaatgtttcacaacccccattccccaaattttgctgcttttaagatttttcatatgagaccaggtgcggtggctcacacctgtaatcccagtgctttgggaggtcaagatgggaggatggcttttgaggcatggagatcaagattagcctaggcaacatagtgagaccccatccttacaaaaaatacacacagagaaaattactcattttgatcagtttagttatgatgggccttagtgtattcttcttcatgtttcttgtgcttgggttttgtttaacttcttagagctatcggtttttagtttttattatgtttggaatatttgcagccattatacatcttcaaattggttttctgacccttttatgccacttgaagttgtctcatagctcactgacactctttttttattttgtttctttctctatgttttattttggatacctcctttgctgtgccttccatttcactaatattttcttctgtaatacctgaactgttattaatctcatcaaataaataaagctaaatatttcttactactgggggaagacttttcttagtactccatggcacagagcactaaggggtccctaatctctggtactgcaactatatcagttcctgttaggaaccaggccacacagcaggaggtgagtagcaggccaccaagcattaccacctgagctccacctcctgtcacatcagcggaggattctttttttttttttttcaaatgtgaaaaatctaattttattcagtttagattaatgtatagctatacactctggactcttaatgaaacctttcccattctttttttttagattttattattatactttaagttttagggtacacgtgcacaacatgcaggtttgttacatatgtatacatgtgccatgttggtgtgctgcacccagcagaggattcttataggggtgcaaatcctattttgaactgcacaagcgagggatctaggttgtatacgtcttatgagaatctaactaatgcctgatgatctgaggtgcaacagtttcatcctgaaaccacgcctcctacccgtccgtggaaaaattgtcttccacaaaactagtccctggtgccaaaaacgttggagactttgatgaaaaaaatgatgagtttttctgctctaggtctttgaaacagccactatttccaaatgtgtatgtgcctcaggtactgttccttctatttttttttcctcttaatacttttggatgtttctttcccaggtactgaccttaagaaaagaccctctacagaattccaggtttctctgtaaatctttctgttctctgatattgtggtctttcaactcttaactgctctgaaattcccagactctcagttgtatttcctcaactcactggcatctactacagttctccttataccatattctggaaactcttgcaataaactgctgtagtcatatggctgacctccattgtttcccatctctcagagatacgtattttttattcttgatgtccagtgtattaaaaaccattgtttctagttttgctattgttgtttcatgatagggagtaaatctagtttctgttcctctactgtcttctgctttgcattgtttttgaaaggaagcctgctgccattcctatcattgttccctcttacctaatatgtcttttaacctcctttatctgcttttaagatgtttatcactgattttaaacaattttattatgatgtaccttggcatagttttatattttgtgtggttggggttttttatagtttcattcactttggaaattatttaacaataagttttctctttccacctccatctacctttgggactccgattaaaataataataataataataataagaagaagaagaagaagaagaagaagaagaagaagaagaagccacttgtagttgacccatgtctcagtgattctgttttcaatatttttgtttttctatctgttcttcattttgaataattactctctcccctattttgtcttttcttttttatttttatttttattttttgagatggagtcttgctctgtcacccaggctggagtgcagtggtgcaatcttggctcactgcaacccccgcctcctgggttcaagtgattctcctgcctcagcctcctgagtagctgggactacaggcacgcctcaccacacccggctaatttttgtatttttagtagaggtgggttttcaccatattgtttcggctggtcctgaactcctgacctcatgatctgcttgcctcggcctcccaaagtgctgggattacaggcgtgggccactgtgcctggcctctttcttttttttttttttttcagacaagttctcgttccgtcgcccaagctggagtgcagtggcacaatattgggtcaatgcaacccccacctcagcctcccaagtaactggaactgcaggagtgcaccaccatgcctggctagtttttgtattttctctagagacaggttttgctgtgttgctcaggctggtctcaaactcctgaactcaacttatctgcctgtctcgacctcccaaattgctgggattgcaggcatgagccgccatgtccagcattgaataatttctattactctgaagtttactaattatttcatctacaatgtttaatctgccattaatctcatccagttgacattttatctctgacattatagttttcatctcttgaactttgatttggacctcttttactcatgccatatctctacatagtatgcttatgttgtcatgtgctttcggaatgttgttataacaattgttttaatattcatgtctactaattctgtcacttttttttaatctgattaccttggtattggtttttcctgattacctgggtattcattgtttcctcatacatgtgtactgaagactccaaaggaatcccttgcatatctcgagttctcactttccacctctttcttctccaagcagctctgtcctctccagtactctgccccagcatgtggtagccagcttggcctccctgaatggaaactacttgactctatttaggttcttccttcccgctctgcagcctgggaactctattcaaggtgtaagtttgagtaattgtagcgcttaccttattctgccccttctttgattattatccaatgcctgaaaattgtgttttcatgtattttgttcattgttagttgtttaagatgggaatataaatctgctccctggtccttcatagtggctggaagtgcaaatctctaggttgattttggtttttccctttttcaggtaactcgctttttttttcaagaatgcctaatttttttatttgaatttgagtctcagtctgttgcccaggctggagtgcagtgacacaatctcggctcactgcaacctccatctcctgggtttgaacgattctcctgcgtcagtctacccagtagctgggattataggcacctaccaccatgcctggctgagttttgtattttttttttttttttttagttgagatgaggtttcaccattttggctaggctggtcttgaactcctgacctcaagtgatccacccgccttggactcccaatgtgctggtattacaggcatgagccactgcccccagcctgaatttgaatttgataataactatgatttatctctatgcgaattctgtattgagttttcctcgaacaatgtattcattttaaactgtagatttcattcccagttaactttcttgtccccaaatattgtttctcctttacttgacctattggagtgtcagaaaatgatcataaccatcactgataaatgtgttatggggaatattagagtaaaagcagaaattccaagttgtggtgagaaagtacagtagaaccttgaacaatgtgagggttctgggcactgaccccttcgaaaatccacatacaatgtttacctcctcaaaaacttaactactaatagtagttaattggaagccttactgataacgtaaatagttgattaacacgtattttgtatatgtattatattctgtattcttacaataaattaagctaaagaaaaaatgctataatatcatatggaatgaaaatatattattattcattaagtggaaatggatcatcataaaggtctttatcttagtcatcttcatgttgagtgggctgaggaggggaagaagaggaggagtggttggccttcatgtctcagaggttggcagaggcagaagaaaatctatgtataggttgacctgcacagttcaaattcatattgttatagtatcagttgtaatcttaaattcatcttcaggttgatttagtgtcaaaattccctcaaatattattctagattctataaaatgttctagataccattttatcgcttaaaaataaatgtgaaagctctcagctaagatatagttgttcatctatgtgtaattactagttttgtaattttttgtaatttcttagtcacctctgcatagtgtttggattacattgtgagtacagtaggattttgtttagaaatctatgcgttatttcaaataacatctctttatgataggaaaaaaggttccaagtttgaaataacactgtgaagaactaatcaccatgcaagtttaggcttattatggggaaatttttaaactttaggtattaaaaagatttttaagaaatagattttaacaaactttcagtaccttgtgacttaccctgcgtaaacaaggtcagccaaatttgtaccctgtttcatggattagaaattaaacactataagtgaaagaataataagtcatatcttgtcaataattttgtgagagtatgagacttgtggtgagttttcctttagcactcatgcctattttcttttttaaattattttttcagttcctatgtcttattacaggtcttctcttttcctctcttcatttatttataactctgtcttgaccacttatatctgttttcggtctagaattttactactttggagaatgtggtttttgtgagggtagagttttcaaatgtcactaatgtttgcttctggaataagggaagtatgattataggtcagtagaagaaacatggtatgaagaaatgtacagccttggtggtaagcaatagaattcatacttacaaagaaacagaagtatatgtatattaaaggcaagtaagaatcactaccaaatgtttacattttacatctcctgctttgtttgccctataggtttttcatacctatgccatgagtaacaatttttcttagtaaaactttcatttatactcagttacaattaaatatctttatcagtaatctaaaagcaataaagcccttaaaatgaggtagtgtgataaattataagaaatctcatctaagaaatcatatgtttgaaattttacgtgtcagtaatgtggtttgtgtccattgaattaacaagttagaatgaatttataattaaataaataatttctatttttttaggatttggttatcttttggcagtatttaccaaaagacatggttacactaaaacgtgactagaaatttaaaaagattgctcaaaatttcatgctcagaatttagaacgtgccatctagtattctttgctctgtcatgaaaagatttgagaaagtttcagtgaaagtgaattaagttgttttgtaatggtaacctaatggaaattgaagtaatttttttttaaaaaaggtaagtattatttaggccaggcacagtggctcaagcctgaaattccagcccttcgggaggctgaagtgggtggatcacctaagatcaagagtttgagaccagcctggccaaaatttttggtagagaccagaccatctctactaaaaatacaaaaattagccaatcatggtggtgcattccttagtcccagctgctggggaggctgaggtaggagaatcgctcaaacccaggaggcagaggttgcggtgagccaagatcgcgccactacactccagcctggctgacagagtgagactctgtctgaaaacaaacaaacaaacaaacaaaaacttacttaaagtgatagctttaaaccttattcgaccatggaacaagcctttgtaacataatctatactgttacaataagtacactttggcagagtaagtgaactaatgatttttttttataatttaagctagtctgtgaatgacagttgattaaataatgtcacagctctttatatatagcattaaatagagttcaaagtatttttggaatttattaatttataatattcttctgtgattattaaagaggtgggatagctaaactttttctcaccttttatcattgttccaagtgcagttttgaactcgtatgtgttagaactcccattatattggtcaaatcgatgatcaccatatgactttattcctgcatttttgcctcaaatttttaactatcctattctggactgcttcattaacttcattagggattaactatgaatgtttaagcctttattttacaatgtccttgcaggtgtccttaactgtttcatttataaacacagagaataaaatgaaaaaaaaatctgtagagttgtttgttctatttggagcttttcatgttggtgtaaaattcctgacacttaacacatatgaatctttttcattcatgtttaataattttatttgagagtcacttcaagtaaagcccaaactgtgttaacatttgagttaagcaaagacatctttgcttaacaataaagcaaatatcacaataaagcaagtcacatgaatattttggtttctgaattcatataaaagttatgtttacactatatggtactctcaagtgtgtggtagcattacatctttaaaaataaacatactttaattaaaaatactttgttgctaaaaaatgctagtgatcatctgagcctttagcgagtaataatctttttgctgttggagggtcttgcaccagtgttgatggctgctgactgctcagagtggtggcttctgaaggttggggtagctgtgacgatttcttaaaataagacagcaatgaagtttgccacatcaattgactcttctttcataaaagatttctctgtagcatacaatgttgtttgatagcatttacctacagtagaacttctttgaaattggagtcagccctctctaactctgttgttgctttaacagttatgtttatgcagtattctgaatttttcgttgtcatttcaacagcattcatagcgtgttcaccaggagtagattccatgtcaagaaaccactctctgtgttcatctataagaagcaatttctcatccattcaagttttatcatgtgattgcagcaattcagtcctatcttcaggcttcacttctaatactagttctcttgctatttccatcacatgtgcattgacttcttccactgaagtcttgaagccctcaaagtcatccatgagggttggaatccacttattccaaactcctattaatgttaatattttgaccacctcacatgaatcgtgaatgttcttttttttttaaacagggttttactcctgtcactcaggcagggaagtgcagtaacaatcactgcacattgcagtctcaatctcccaggcaagctcaagcaatcctcccacctcatcatttattttatttttgtagagacgaggtctcaccatattggccaggctggtctcgaactgctgggcttaagtgatcctcccactgcggcctcccaaagcgctgggattgcaggtgtgagccaccatgcccagcccatgaatgttcttaatgacaactggaatgatgaattattttcaggaggttttcaatttactctgcccaaacccatcagatgagtcactatggcagctatagccttatgaaatatattacttaaataagatttgaaagtcaaaattactcattgatccatgggctgcagaatgaatgttgttttagcagccgtgaaaacaacattcatcttcttatacgtctccatcagagcccttgggttaccagatgcattgttaatgagcagtaatattttaaagggaatctttttttctgagcagtagatctcaacagtgggcttaaaatattcagtataccagctgggcacagtggcttatgcctgtaatcccagcactttaggaggccaaggcgggaggatcacctgaggtcaggaattcgagaccagcctggtcgacatggtgaaaccacatctctactaataatacaaaaatgagctgggcatggtggtgcacacctgtaatcccagctactcaggaggctgaagcaggagaattgcttgaaccctggaggcggaggttgcggtgagccaagattgcgccattgcactccagcctgggtgacaagagtgaaactgtccccaaaaaaaaaaaaattcagcataccatactcaaacaggtatgtgttcatccaggctttgttatttcatttatagaacacaggcagagcagatttaacataactcttaagggctctaggatttttagaatggtaaatgagcattgacttcaactgaaagtcaccagctgcattagcccctaaaaaaaaaagagtcgtcctatcctttgaagcttcgaagccaagcatttacttctttttagctgtaaaagtcttcaatagcatcttctgccagtagaagactcttttgtctatgttgaaaacctgttgttcagtgcagccaccttcatcaatgatgttggcaagatctgggtaactcttcagcacctgctattttaccttgcacttttatgatatggagattgcttctttctttcaacctcacaaattagcctctcttagcttcagacttttcttgcacagcatcctcacctctcagctttaacagaattgaaaagagttaaggttgtgctcgggattaagctttgacctaagagaatgctatgctggtttgatgttctatacagaccagtaaaactttctccatgtcagcaataagcttatttcactctcttattcatgcgttcactggagtagcacttttaattttcttcaagaactttttctttgcattgagaacttgcctgtttgttgtgagaggtcaaactttcagcctgtctcacctttcgatatgccttcctcactaaactcaatcatttctagcttttgacttaaagtgagagacatgcaactcctcctttcacttgaacacttagagaccactgtaggattattaattggcctaatgtcactattgttgtgtctcaagaaatagggaggccttaggagaggtagagagatggggtaatggccagctggtagagcagtgaaaacacagcatttatcagttaagttcaccatcttctatgggtgtggtttgtggcatcccaaaacaattacaataataatatcatagatcagtgatcactataaaagatataaaagtttgaaatattgaaagaattaccaaaatatgacagagatccaagcgagcacattctgttggaaaataatgacaccatactcaaggcaggcttgccataaaccttcgatttgtaaaaaaaaataataaaaaggtatctgtgaagtgcaataaaataaggtatgcttataccaaaacagacttaattatgctatttcttaccattagtgttagagttcagtttctaatgtttttcattttccatatgttattgatgttcagtgagttacacaaattatttactgttgttacttccaccttagtagggagaatctttgatttttgctggataaattttcaaacaagagtgtgattataggctggacgtggtggctcacgcctgtaatcccagcattttgggaggccgaggtgggcagatcacttgaggtcaggagttggagaccagcctggccaacatggtgaaaccccctctctactaaaaatacaaaaattagccgggcgtggtggcgcatgcctgtaatcccagcacttgagaagctgaggcaggagaatggcttgaacctgggaggcagaggttgcactcctgcctaggtgacagagtgagactccatctcaaaaaaaaagaaaagaaagaaaagtgtgattacagagatcctatttgtgtttatttttaatttctctagaatttgttttcttcaataaataaaattctaataccagttttttttgagtaacactgtgatttttatacagaaagactttctccaaattggagaatgtactcttttattcctgtaatttttcttaactcttatttttggcagctaccaaaagtaaaactctctaccaagacagagaagaaatctttgggaatattaagtaatgttatttttcattacacggactaacctttttactaagaagaattgggatagtattggttatgggagcttaggagccctaaagataaagattggaagattttgtgttgtggacttgtggcactgtaacaaagtctgggaattttatgtgagattggaaaccacactatgtgctaattgcctcagaatggtaagaaaataagcatatgtatagcatttagttgttaagacagtaggcacttatgcagagccccaaatgaattaacaaatcatctactgaaatattttcacttctgtttactttatgtattttagaccaatcagcagttgcttgagaaaatgaaatgtttactaaatctctttaataaacatgtttaagagaggaaaaacttataaacattcagatggcagtgtacatttttaagtgctagttgtcatatctttgaaattgtatgtaaactggacataaacaatcaagtgtctacagaatggtatctgtcttccaatatatttactgaagatattatagaatctttatagtttaatatgatttaccccacatgttctgttgttgctatcttttcagataaagttgaatttaatctttcttatcagcttttattgaggtatttatgaaccattgagttcacccacttaaaaaatatcattcagtggctgttagtgtatttacagagttctgctaccatcactgtaatctaatgttagaacattcacatcaccacagaaggaaatgttatacccatcagtagtaatgctccataccccctggatttaatcttatatccacatctctcataatagtttcagtggtatctagttattatgactacaaatgatgcaattgttcctgattacacaaataatgtatttatgtctttattgttggcatgtaatggaagacataataagtctgctttgatctcttgctcttacctatttctctattgcaagtgttataaagagtcttttaagcttttgctcatatatataaatatatatatacatacatttatatatacacacacatacatatatacacacacacacacacacacacacacacacacatatatgtaatgctaccgtgtttgagggtcatgagggtcagttttttgaaataccagtttttttctgatttaggtggatgacatggtacgtgaagcttaaaaaaaaatttggtaaattggtatgaaaaaatgagaggacaacgtttttcctttctggtacttagcaggaaggcaagttcttgtatgaacccatatttcctgttacccattttcagaccaatattggtttctcatctatataatagggatcttttgactctaacctcttaaatctatcatgtgttttctttcttcaccttggaaatagcttcttgaagccccagacttctagagcacattcatattaactaacattgtcctggtttactagttagggatattagtaaatcctaaatagttgaagacgttctgaaagatatattgctgctttttaaaaatttatttatcttgttctctatacggatttctggcacaaggttggtttttgtttttgtttttgtttctgttttttttttgtcaattgtggtaagtccatggatgcttttctctataactttcccattttcccttatcacaccgtcactgcaaacatctaatttctgtccagtctctcaactcttttcagctctgctgtcctaactaatcattttttgtattcatctttcaaagtatttgtttctgtcttcattctataagtaacaagattatttaaggttattttgtattacagaaatagtaaaaatcaaataaaatatcaaatgtagaatagtccaccaaaaatattttatttcatcttttccagagaggtacacatataataaagtaaatgagcattatatattttattattaatcctcaataatatatttttcacaggtatgttgcttcttgtaagtttaccttttttaatgtgaaaactacaataaactaaattaaattttaaaaatattttacttactaaagtcaactgatgttttcctggtagattgataggcttcttgtggtagcttttaatcatttgcaagttttgagcccatttctaaaacttttctcattgtaaatatgtatttcctttcttatattaactgagaatttgtttttataaaaataaagtggggaatcagactcaaggtgaaatgttgtagacttagtgccagcaataagcagaattatttaaaatcattcaaatatctttaattcccttgttgtctttttcaaaaactgtacattttaactacattaatataacggaagactttttaaggcttagttttcctttatagatattccctaatttcatttttatttcagtctgtcagggttgtgaatgtgatgttttaaggtacactgtagtgttttcacatcctcagatgaactgaattgggacaatactttgtaggaagttttttaatatagtatgtagacacattggtaaaaatcagtatgtccactggcttattagtttcacagatgcttccataattcttagtgtactcttgggtattttaaattatcatttcctgacagcaatcctgaaacatgccagtcttttaaagccttatttctgagaactaaagcaaggcatcagcgaaccatatctgacatgccatgttaatttccataactatcatttctgggaggtggtaggatttctaaggcatggagaatctcagtaaatctactttaaaaaaaaaaaaagcaaaatatctgttttattactgggtttccattcacgagccctgactgcttcattcccacttaaataatttcaaaaatagtgataagcatattttttctcttatagattattaaatatttactcacgtgcacaatatatcaaaacatattttgaattctatattcttagtgttgggtgttcatgttgtgaatgaaaacctcattctgttatctcatagcatatttatatatacaaataatttttgccttaagtaggaaagaaacagctaaaagatacataggttattttgctttttaaaattttagcaaactattctgtgaatcttttgtgtgtttggggctgtttgtagaggaaaatttcatcaagcaacattttgggaacattggccttttgtactctttcctaaataaacagaaacttgtactccccaaaataaaatgtttctttgtatattgttacctgcaagttattgataatggaaggaacaccttttcaatccttagtcccctttcccccaacacagcttttagattgtcgataaacttcccagctcagtaattaactgagctcagtcattgcaccctgtatcatgtgatttttttttccagtggaatacattattagagcacttacacagccagtctagctgcagcagcccaggcggcaacagcagtgccatttttcacaaagaaaatgttgaacaggagccaaatgtttggtggcagtctgttgctaggaaatcaaggtcctgaggcgattaatgacaaagcaagcaataacaagaaggcagaattacagatttaaaagagaaaaaagtggttggtgttataattacccaaagaaatccgcactcattaaattggctgtttttatgattgactttaattggaggttagctcagatatttagctcctttcccacccctttaaacacacacaggcacataatctgtagaactgcagacttgtttttctaagcattgagaggagcttgccctgtaatttgatccccactgacagatgcattttctatgctgccattttgaattaacctattgtagaacaattttcttcagccctgttgaataaaacatccagtctgattacctccgatggatttgatagagtaaaagaatgtacttctcattgaagtagattgtttgcatggactctactgattgtgaactctgccagtaagcacaatcatttgtaataaattttcaaagaaatttgtgaggaaaaggtaatgagagtcacccttttatagtttaatgtttggcacctccatcaaaataatataattcttataagacagtgttatttttccagtaagcttttcacgtggttttagaaaaaatttctgaatcttcatttggactattcatatatttaggaatagagtcttgtatttacactctaaaatgaccattcttcctccccaacaacagtattttagtgcaagactcaatatgcaaagcactctattgcaaaaatatttttggtatgtacaatatttaaagtgattttaagattggcctatttcagtctttgaagtatttcccccccccaaaaatcccttatttaaattttttagggtgtgataaagcatattactagaaaagcatcaatcggtctttcaggtacaataccagaggaaccatcacagtttatttacctttcagaagctttaaaaataaagttacatgatgcctctgctctccagatttctaatcaaaccctggaacaaaagagccaagcacattctatctgacaatgcacacactgctaatcagatgccaatgccaagctgtctgctttgttaaatacttagcttcctagaggcaggaagacagctgctataagtatgatgaaattttgtagttcaatctatttttgctacccttgggctaccaagatactgttaatttagaccaccccaattggtacattttagggagttttttaaagagtttgtaattaaaatgataaaacatcgttattacattgaagaccttctgtaagttttacatttggcagatacctactgagataaccccagcatgtaatttacaatgatgtaatggttgtaattgcattttagaaaaaaagaactataggaggcaagtgcttccattagaagagtttttaaatctgcttctgtttcatttaaatctacttctatccccaaattacttacttataattgactagagcagctataaaccttaagatgctatctgaatatttttaaaaagttatcaccccagacactgccaccagggggaggaagctaaaatcttaaagttcttaactgatgatgatactgccagtaggtagattatattgcttagccctacatagttaactacttcctccagataataccgccttttgggacatgattctcacaacctgtaatatgtgatacctgtagacttagcacactattaattgtaaataaaatggaaactttcgtactctggtggttggggtcaggaaggggaaagaggaagtacaaataagcaacctggacatttttattgtttttctcttatctgttagtctacttgaagagctatccttgaaagtgagtgctttagatctatgaaactgggcagctatcatagcacatctattaagatctaataatcacataattaatgtagcaaaatgaatagactgtaaggtagttttctattttttgttactacactgtggttttgtttttaataaatagttttggctttattttaaacaattaaaaattcaaaatatttttatgaccaaagcttgtaggttctatccctggaaaatattttataaatgcagaaaatagttgcttaggattggaatccaactctgtttaccatgaacaacttaaaagttgatctcataatcttgcatgttgtggaataataccacgaaaaagttaattaaagaatttagatgtttgttctcctgtctagaactcaataacttttaagtagtaactctccctacagtttaactgttaaacagtaactcttctgacagttttaggttttattctgtgaagactcatgatttttaatttttgcatcttaatttttcagttatttcaggtattgaaattacaaacgacgggaaagaaaagtggttgactaaaaaggggatacaaaaggcaatttttagggcgatgtactgttctgtatggtactgtggtggtggatacatgatactatgcatttgttaaagcccaaagaactgtacatcacaaagggttaattttaatgtatgcaggttttttaaatgttagggatttcaggatagaatgcaagctgtaacaaatgaatctaattgtattacaaatgtatggcataacttcactgaatgggtgggggaaaaggagctgacctaagtaactttggaaaatggtgttttgattggacaatgtaaagctaaagactaaggaacactatagaaacactctattctagttggtaaatttgtttctcataacggtatgggtgaacagttctgaacctctttacatgtatcctggggttgaacaaataagtaaatggatgatgaatggtggaagctaggtttctcactgtcaggaagggatgttacagataaataaacaagaggggagagccagaatgaaacctgtggtactggattagagttggagatataagtatttactcatgtttagcttaatatatgcagatggatagatgcagaaataattatagatgcatgtgtatatgtggattagtatacatgcatatgtttcctagctgtgtttactgagaaggcctagaagcagtgatatcccagtagccacaaacacatctaacgctcacatcctggtttgtaaatcctattctccaataaaaggatccaggactccttttaaatatgactgattctggggctggtgatgggaaaatacaacataagcatggaatatcttgtagtgccagaaggcaagagatttcttaaaaataataaagattaagcatgccaaaagggacacatgagccaatgtgaaagaactccgagtggccgtagctggaataattagagcaacaaaataaaacatgtagcattggattaaggataaattattgagtaaatatacatgagttcacagtgttatgtataaattgtataaataagtaaatggaggagaagagataaatctccctgacagaagaattccaaataacatattgccccctccagaagggggatcctacttcccttctccttgagagtatgagctggattgagtgagtcatatccaaaaattgagtttggaagacagcgaaatactgacttgactatttccattggagaaagctggtaaacaactatgttaactaagtgatcaaggttaacatcacaaatgggaagtcatgctgatgtgaagaggtggaaacttcatctctctgatattctttccctaaacctgtagcctcaatctaatcattaggaaaacatcagacaaatcccaactgatggacattctaccacataagttgagcattcctgaaaactgtcaaggttgtgaacaatgaagaaagactatgaacatctcactgacaagaagagactacagagtcatgacaactaaatgttacatagtttcctggatcaggtccagaatagaaataggatattagtgtaaaaactggtgaaatctaaataaagtcttgactttagtcaataatccaccaacattggtttcttggtttggccaaatgtaccacagtaatgtaagatgctaagatagtgacattagaacaaattggatgaggggtacataggaagtctgtatattaaacttgcaatttttctgtatatctaagttcccaaatataaaataaatttatttgaggttgatcaatgggctgactatattgacaagatactgataggttacatgttgaagaaaacatacaatataaaatagagaaaaagtcagttccatcccttcccactccccctttacctacctgctccccagtactcatcattgtgatttagtcagaacagggtttagtgccagaggtcagggtgactgagggtggaggagttgtgagcaatgggttcatggctgtcacaataatgctgtggcaattctatggtttcccagctgggagttaggagtggggagggggctgcagcctgatgacagccagctgaaggaagagctacctctcccttccctagctgctcatcacctgaacccaagaccacgccaaacaagatatggatgtagatgctcttgctgagtctgttccgcaagagggaaagaaagggtagctgctccaaacacgccgtcctcatatacaagggtgaggggaacagaagcatgtggctgctaccagcaaaggaaaagtaggagagcaatagaaaggggaggaaatgggaagagcagaaaatcaatattatttaaaaagtgacctaagacttaaaattgaattagtatttgtacagaaagatgcaggtggaataactcactctggcctgtgatcaaaattatatggagaaatcatggtgggccccttcctctgtccccagtggtggcaccagttgctgagtgtgattagttagaatggattccagtctagtcgttcaggcagaggaagtagttgcagtgggcaggcaagaggggctcagttgctgcagcactggctcttgctggctgggtggttcttctggaggtccgtacctcagttttggcctggagcaccaggtgcactctggggcttattaggaatcttcttagctctcgccgtgtaaacttcattcacgttcattgcagtctttactgatgtctccatagtcaactgtcgtcgtctgcatagtcctgtgcttcgtggaattctggggctttcttgctggccaggtctgccttgttacccacaagtacagtgacaatgttggggctggcctgcctctctagctccttcacccatttcttggctggtgcaaatgtatcttttttggtgatttcatagtacatgggggctgggctatgataccgctcctgtccagcgctgccccagatctcaaacttgactattgtgtcgtctaagcagacagtctgtgtaaggaaggctgctctgattatgctctcctggtactcttgaaattgtcccttgacaaagtggaggacaaggctggatttggccaccatagactcattgttcccagtggctggtccaccaggtcgtgtgctgtgccttgccgacccgccactacccgtccagctgttgtgataccagagagcatggggacgggagccattgctatgcaaagaggcacttagttgggaagggggtctccaaaatgacgcaagggcagtagtattacttggggctggggctcacacaggctccgcttctctccccccacccctggtggtatctccatataaaaattttacttaaacgcagagaccatatatgtacttaaacacttgtctaaagaaataaaatatggccgggcatggtggctcatgcctgtaatcccagcacagaggccgaggcaggaggatcacctgaggtcaggagttcatgaccagcctgaccaacatggagaaaccctgcctctactaaaaatacaaaattagccgggcatggcagcacatgcctgtaatcccagctactcaggaggctgaggcaggagaattgcttgaacctgggaggtggaggttgcggtgagccaagatccccgccactgcactccagcctgggcaacaagagcaaaactccgtctcaaaaaaaaaaaaaaaaaaaaaaaaaaaaaaaaattcccctgcctctctccaccccagagggtaaccattatcctaaattttattattattattcacatgcttttctttataggatagccatacatgtatcactaactgttctaccatatctcataacctcttatatagtttcccttttttgtcatatttgctgtgttctggataatttcttcagatctatcttccgatattggtaattgtatcttcagcagtgtctcatattctgttttacctgacattgaattttatgtaataatcattacttccattttcatttcttcccctgaaatcagtttactttatcattttgataaactcatttcattctcatatatacaatcctcttgtttatttaaatatattaaacttattttctattttgtgcctagcctaatatttaaagcttatgcagttctgattttgctgtctgttgtttctgctggctgttactcaaactgccttattttcctgtgtgttagcttgtattcattatttgtggtgatttctgagactgagatgaagatacgtttccaaagagagtatttacatttgaatctgccaaaagcctggggatactgtcaacctgggaacacattcaaataaatgttgggcttaaagttttgtgggctgcataggtaacatgagttccagatccataaaccttcatgagggtgggcttgtggttaaattttcagggaagatgtatttacctgcacccagcatcaagtttgaaagaggttaatttccttgtttattccttctgtagggtagacatcattctattcaactcttacactaaacatgtatgtagctctttaggatcccaactttatgtggagagtctaattagacttcgtatcgttaatgtaccctagaatttatcccctaaaccttgggttcagtagtgtcctggtaaatattttaaagctggctgtccagggcaaaaaaaaaaaaatcctaatttctcacatttttctatttcacactatggctgatttcacgataccagcctgaagtcattgaacgtggagttgggaaaagatatgtacagttagctttctcaactccagtgtatcactgccagttctgtacatggctgtgaaaactgaagctcaatgcacagggcttggcatatccctcagaatgaaagaatctgagtgtttgcctacccctctggatttccatttttactttgttttaaccttttgagtattctgtgtcaactcagcaatatacttcaaaaaaagattcttttgttttctttttattttaacccagcatttgttgttgtttttagcaaaagtcctgtgttagggtacctatttagtcagaaatagaagtctctgtgcttgtttgtaagtataatgtattatttttctttttggggaaatatagaaagaaatagaagtctctgttcttgtttgtaaatttaatgtatttttcttttttgagaaatagagaaaagtacagagaatattaaaacacccataatcctatcatatatgttcattttatgtgcatgtatgtctctatacatttttatataatttgcattatatctactatttcagtatatgatttttgttaatatataatgaatgtttgctcatgccgttaactattcctttaaaacagcccccattatatatgagactaaacataaaatgctgcacacataggagttagtataattcagaaatttagtctgtattgcatttggaaataattttgtgaaggttattcatgcagcattattaataattgcaaaatattggaaaccatataaatgaccagttctagaagattggttgaatatactctggaacatacaatagactactatgtttataaaagctatctgtttttataaatatatggagtaatttccaggaaatattacatgaaacaaaaagcagaaacaaatacccatagtgctacttgtcatacaagaaaaagggagaattaaagaatgtgtatgttcaggaaggataaagcagaaaacagtaaaattagttacaagaggtagaagggagagtgaggtggaagggatgtgggagggagtgagacttggatattggggtatactttcttggcatagtttcaacttttgaaagcatgttaatgtccaacatattcaaacagttaaataaaaatgatatcactgggacagggacctaaaattgtaaacaaacaagtgaacttaattcatttttttttcttatttttttattattatactttaagttctgggatacatgtgcagaatgtacaggtttgttacataggtatacatgtgccatggtggtttgctgcacccatcaactatcacctacattaggtatttcacctaatgctatccctcccctaaccccccaagcctcaacaggcccctgtgtgttatgttcccttccgtgtgtccatgtgttctcattgataaagttaattttaaagtaaaatgaatactatatccataccgaaaggggataaagaagaaagaaatgaaggaagaagggaggacagatttatgaacaccagattcaactatatgtccttagcttggggtgggtgggagagaaatgaagaattgcaaacaaatcctgaactcacttttgtaggtttattttattttattttatttttttgaggtggagtctggctctgtcgcccaggttggagtgcagtggcgtgatctccgctcactgcaagctcgacctcctgggttcacgccattctcctgcctcagcttcccgagtagctgggactataggtgcccaccaccacgcctggctaattttttgtatttttagtagagacggggtttcaccgtgttagccaggatggtctcgatctcttgaccttgtgatccacctgccttggcttcccaaagtgctgggattacaggtgtgagccaccgtgcccggcctataggtttattttaatggtatgggcaaactaaatcagagactattttgagcaaatgagtgagcctggtttctcactatggaagaagggacaaacatatagacaggaggaagacaggtaagaattctgtgtagaggaattggattggaggtgtctgtgtacatatggacatttctgtgtgtgtatgtatctgttgatgtgtgtgcatgtatttttgtatatgtatatgtatgtgtgtgtgtgtgtgtgtgtgtgtgtgtgaagagacattcatatatttcttagctctattgctgaaagagcaaaggagcgaagtcacaatagtagtgacacacctagcgttatttcccactgttagtttcctaaggctgctgtaataaattaccgtaaacttaacagaaatttattctttcatagttcaggcggccagagctccaaaccgaaggtgtttgtggggttggttccttcttggggaggcagagggagaacctatccatacctctctcctagcttctggtggttgtgcataatccttggagcttgatggtttgtgacattataacttcaattcctgccttcattgtcatatgacattcaccctatgtttacctgtccaaattttactctttttatcagagtaatccactcattagggccgactctaattcactgtgactttatcttaacttccaaagaccccgtttctaaataagctcacattcacagggttagtacctgattatgactttttgaggagcacagttcagtccctaatgcctactaaaactaaagctcttcactcaaatgactggcttcagtctggggcagggtaggtacaagatgaacctagaacatgttgtaatgccaaaaagtaaggaaatgctaaaaagtaagataagttgtttgttaagtatacagaatctagcttgaagagttccccactggtcaaatctagggcaatttgagcatcaaataattaaatacagtaatgaattataagctgttggaaataaagaactttataagaccattccaatcactaatgggtggatggatagaaaatgaagatattttacttacagtggcatgctgaaagttgaccagcaaatgtggaggttgtgctagagttgggaaaaaacaaaacaaggaaacctcattttgcagtcatcatgttaaagattagatcaggcaaaaatcatcaatggttgtaacatctaagaggacagacatgttgatgaagaacagaatatttacatggtcttgaaatgttgtatgggagaagagaaaaacagcaacaatgcagtggagaaatcagacaacacattgacagggtgatcacaagtatcacctccagtgagagtcaaatgaacattgtttgcctccttatgtgtttatctgtccctgagaagtacacaacatcatctatgcagtttctggcccagaatgcatctcaactcaatcacaagagaatattatgcatacatacagaaaaagaaagaatacaactgaacatagatgataaagaaaatgaggtaaaaatgtgacaacagatgaaaatggataaaggtattttctgtgtttttatttttggaactttttgtacattgaaatgattgccaatggaaaagtttagataaattgtcctaaagttacagagaacttgcagggaaaaacatcttaaagtagactaatagtggagagtcataaaagacacttggcaaatcttcttagttgaatattattcaaactattcagtcagggaactgattttgtgctaattatgaaatgcattattgcattgactttatgtctcttacaacattaaattatgttacctaggatcaatttgagattcaacacatgatagtagtttaatacagtgaagtcataacttgcaacaaactatcccaattttaagaattaattctgagcaatttttatatgcatgaaaaagatggttagaattatttgcagacacttgcatattctttagtcaagtggtcttattaccataattcatatctgttgtgggagtagggaagaaagagatttaaaaaatatctatcagttctttcaatcaagttaggtataatattaatagactttgagctaagaaagttttcatgaccagaagaggagcaggaactgtctaacatagaaaatgtttatggtataccataatcagttatacaaatataaaaggaaaaaatgtttgactagtgatactctcaaacttggatatccagaagagtgattctgtcagtacactaaaagcaaattcatctatcaggagctttcatgttttcattcaacaaatatttatccagtgcctattatgtaccagatagtgttatactgtgaatcgggagcatatgttaaaatagacaatatagtagacattattctctaaaattattaacaatagtagctaatactcatatgatacttactctgggccacataccattctaagatctttacatatagtaattcctttacctcaaacaaccttattagattggtactattattacctctattttattgatgaagaaacagaggcacggaggtgttaactttctccaggtttcacagctaaaagtagcagacccaggattttgaatccatcagactggcttgtgtccaagctttttttaattaattttttttattttgacataatttgtagattcacatgcagttgtaatataatacagagagatctcatgtactttttactcagtttctcgaggtaacttcttacaaaactatagaaccatatcataaccatcatattgacactgatatagtcaaggctccaaatatatctgtcaccacaatgatccttcatgttgcccacccacttccctctgttcacctattgaaagacatcttggttgtttccagtttggagctattacagataaagctgctgtgaatatttgcacataagtttttgtatgaacaccaatttttggctgggcgtaatggctcacacctgtaatcccagcattttaggaggccgagatgagagaattgcttgaggccagaagttcatgaccagcctggtcaacgtagcaagaccccatctcattttataaaaataaaaaattattttttaaaaggaacatcaattttcattactttagactgcctctaagcttttaattcttacattctaccacctctcaatatatagtagggaataaatagtagagaatgacttgatggttaagttgacattcagaagaggcctgaaggaagtgaagaaaaaagccatacagctgtttggggaaagcacatttcaagcagagggaacaagcacagaggccttgagaaggaaatatgcctagagtgtttgagacagagcaaggcggctggaaggagatgagttctacaaggcagctatgagccaggtctataagatgtggctgctatatagaaaatagatggtggttgggcaagtgttgaagcatggggaactattaagaggctgcccatcggagcttgcagtgagccgagatcccgccactgcactccagcctgggcgacagagcgagactccgtctcaaaaaaaaaaaaaaaaaaaaaaaaagaggctgcccatgtgagagatgatggtagcttagacttatggtggaagtgttaaagatggttcagattctagatatgttttgaagaagagctcacaaaaatttttctgatgggctgacagttggatatgagaaaaggaaaggaggcaagaatgattccatttaccaggttccaagagaatgattacagaaaccaatagattgccttatttatttatagtaggaaatgtagttatcacatcggcccaaatgtttgtgtctgcttaatccgcatatctgtttctttaggcaaacttgcattggaatgtaatggcgactgcagaatcaggataaggggacttgaataaatcagtctttaaatgcatctgaggccgggcatggtggctcatgcctgtaatcccaacactttgggaggccgaggtgggcagatcacttgaggtcaggagtttgagaccagcatgcccaacatggtgaaatcttatctccactaaaactacgaaaattagccaggtgtggtagctggcacctgtaatctcagttgctcgggaggctgaggcacgataattgcttgaacctgggaggcggaggttgcagtgagcctagattgtgccactgtgctccagcctgggcaacagagcaagactctgtctccaatcaatcaatcaatcaatcagtaagatacatttcactccagcctggacaacagagcaagactctatctcagtcaatcaataagatacatttatctctttagtagggacctgaaaaaattaaattccatagacaaaaggctttctgagctcttctttaataagtagtgttggcagatgcagtggctcatgcttataattccagcactttaggaggccaaggcgggaggatccctgaggccaagaatttaagacgagcctggtcaacataacaagtccctgtctctaccaaaataataataataatatttagacatggtggcttgtgcctgaggtcccagctactcgagacgctgaggtgggaggatcccttgagcccaggaggtcaagcctgcagtgatccatggttgcaccactgcactccagcctgagcaacagaatttttatttttatttaaaataaaagtagcacaaacatttgcttttgtttctctttcataatgcaccaacactaccctaacccccaacataatccttttgtagatttgttaatatattcagacaggccatattccatatctgatcctacttagtggtttgatggttggctaaaaggcagtattaatatctgttatttccatgctattgagggatatctcacattgatcatccttgtattggcaatagaaataaatggtgatagtatttttttcatttagataaatttagcactgctcttagtattattgaaacttagtttaggaatgtatcatttatctataatcatttattgctgaagtgaacccttctttaaattttcctcttccaaatattgatgtagttctttctttcttcatcagttccatgcatacaattcaattttcttcatgacacgggatcatcatctataacgtctgttacttataggactattctatgagtctcttcaagtgtatacatgtatttgcttttattttaagttactcaaattgttatatattttgagtacttatatatacattttaataattttactagccctggagctggtggtgtgtcatcttcaacttcctttttaaattccttctaatttcttagggtgggaaaaatctaattcagtagattgaatttttagaaaagagtagataaactgatgtctaaatatttaggtatttgtctattctggaacctttttgcttcatgatttttcttttttactttgcattcctgagatttcctttcatgaactggaaggctttactttactaagtgactcagcagtagctctatgtatcttttagttggaaatgcctttggctctatgcatgcacacactgcccattaattagcaaaccaacatagaatcatctgttgatgacaaaattaccaaaatggatcatccataagtgtttatactgcaaacagtgtatcagaaatgtcataatctcattcattaagaaatttacatacacaccagattttagagtgctcattcatgatgaatgtctacttccacactgtttgtttggaaacattcaatagccagtcttgaatttaaaaaatttaattgaatgcttaaagaattacaagtgttcctttccttggctctaatgctaaccaaagtgcttttctaaactgctaagaatggactgaagattctgctgagggctgtagatacttatctgcctaattgagccatcatttgttgacatgaagaaaaccacgtgacctactttaatgcatttctcagtagcagcaggaggctagaatgtagttcatccaacagtaaaactagcagcagtattattagacatgtgaaaatagcattggttatgggattagttttgtaaagtaaggatagtaatataaaggtatatagtcataatataaacagtatagagtgatttttttattttcaaaattatttgaatccaataatcatttaagtcagtcattcagtaactatttaccaatgtttacagttgccagctatattaaaggaattgttgacttgtcaaagttgattcatatgagagtaacagtgttaaaatctgaaactggtatggattgctaaaacgaaatactttgagtacacagggaattactatgatcaaaactatgctggatacattaatttgaccatgtgtctttaaattggaggtgaggaagattagttacagatacattaattagaaaggtgttatattagtctaggttgaggctgatataagtaagaaagtaggaaaggatgcaaaagcccttggaaatgaatatttgtgtgtggtgaagtaaaatgaggtagaggttacccttttacatgacttgagagaatcatggctcatttagtaaatccagagggagaaatgattttctatatatataatgagtttggaatacaggaagaatgccaaaaataacatcttaaggaattcttcctaaatagtgaagaaagaaattagtatcaacagaagagacagaaaaggatggttatgaaagataggaggtcatcgctgtctaaaatgactgatggattttgattacaccactggtgatagaaaaaaaattattagagaaaagtgtagtctgagaactatttgatcttagtctgtaatgaatgaaatataaaatttgagactatttggaaactgtttaacaagtttacacccccttccagcaaatacaaaattacaacaaatttaaagatgttaattggtttttatttgcaattctaaaatcggacaacaacctcattctattaaatagaatgaatattccagtaagctgagcagaggaagttgactttatagacagaaaagggctgaggaaagcaaaaacagaaaacaaaatgtggattggtatttccaaaattacttttcttataaaggttaaagcagaggggacttccttataccagctaaaactggtctgtttggggatctggctattatctgtttctcctgatttcttggaaagtaagataaacaactatgttttagcttagtgatgtggaacttcagcttgagtgactccattttggtttggtctggtgggcctagtgcaggagcttagtccaaactaatgggatcctatacattttgtttaacactgccaacatcctggtgcacgatcatcagatttctcattgaacagggaatggatgactttgaatgttggagagcacctgtggtgagttgtttatatataatctgtaaactagttatgcacagtagcactatatatgggtctatgttggactagaggataaaaaataacttggccttcacctcagagagtttaagaatcactatgccaccagaaagatggtagtagtaggcacattacatcgagtgaagactgttgggtgagagggaaggtttgcttaaagatataagagatttgagtttgtatattgtctaaggaagatatgatagaacagaagactgataatgcagtgtggaagagtgataactgctagatggaattgagatcaaaggtttatagatgaagactttatccttggaaaaatacatttacatttatttaatgtttagtttttaaattagatattatgtaacttgagcctcacagtaatccaatgaattaggtgacatatggttggtataattcatccgcctttacatttaagaaaattgagacacaaaaaatgttgtgtgttatccacagtcatgtggttagtaaatggggagatattttcatgcccagttctatgctataactactattatgtctgaaaataaaggcagaaaaaaatacttgaagaaaaaatggcaaaaaaccgcccaaatttattgaaaaacatttgtttatacatctaggaagctctttgaacaccaagtacaataaatgcaaagagatgcacacctggcctcataatagcaaaatcttgactatttgacaaggacaaaaggaaaatcttaaactcagcaaatcacaacaggggaacacaaaattaacagcttacttctcaccggtaccaatgaagccagaaggtaatgagataacatatttaaagtgctgaaagaaaaaaatcatcagcaaataaccttatgtccagcaaaaatatgtcaaaaataaaatgaaatattttcctagataagcaagtctaagagtgttcattgctggaacatctgccttaccaagaaatactaaagaaaattctttaagctgaaattaaatgacaacagatagcaatttaaatctatacacaaaaaacaaagagcatcaataaaggtaattatgtaagtaattacaaaagacagtataatgacatatttcttcactattctctcaactcatttaaaagcaaatgcatacagcaatttgtgtataattgtatttaggccctatgacttattagaatgtaatgtatatgatgataacagcagaaaggaggtgcatggcaacaaagctctattggagtgagtaagaaaaggacaccagatggtaaactaaattcacaagatgaaatgaagaaaaccagaatggtaaataagaagattaatataataaactctttaaatgcttgtagtcctagctacttgggaggctgaggcaggagaatcgcttgaacctgggaggcggaggttgcagtgagccaagatcatgccactacgctccagcctggaaatcataaggaatagaaaatatatttactattcattaagtggaattgaatcatcataaaggtcttcatcctcttagtcttcatttactgtctccaaaaaaaaaaaaaagtttccatgactcttcagtagattatcataaattaagatgtatattgtaacccttagggcaactgatgagaaaataacaaaaaattctagttaaaaattattaaaatgcccctataatatgcttaactgatttttgacaaaggtataaagccaactaattggtgaaaagatagccttttcaaaatgttgctgtggcaacatgacgtcaaaagtgaaaagtggccaaaagaccaaaaagtgaaccttgacctgatacaaaaatcgagtaaatggatcacagccttaaatgtaaaacgatgaaacttttatgaaaaacataggagacaatctcagaatctaggggtaatcaaatttctactgaaaattttagtagccacagcaaataagcaataaatagaaagaaatgtcattaaggttggaaagaagtgaaactactcttatttgtagatgacattttgcatatagaaaatcttaaggaatccactaagaaaaataaaggaggacaggtagtgataaatgcaaaaacagaaagtaatgaaatagaaaacaagaaaatagaattaaatctaaagcctttttaaataaaattaacaaaataatcaaagtggtcataacactaagcaagtgaaaaaagaaaagatagaagcaatattataagtgaaaaacaatgtttaatcataaacaattctaagaaatttggaccaataaaagtttgacaaaaatctgaagttctctaatttgtttatatatttttggtatttatgtatttattgtcataggtttcttagttagattcatggccaaaagtaccatccaaaaaactatttccaaatgtatatttttagcacatacctcttttctgatctccaaacttaatgaccaactggttatttagattattatatgcaaatagacttcttaatatacagtgtcaatcctgtttctcttatgtttaatacatctctgtatatggtaccactgcagggtttgactcatgtgccctagccaaaccctaggagtcatccttgattttttcttttccttcaataagtccctatctttatatctggaacccatttactcttcttttatcagcaattaccattctattacagaccattagtatttttctcctgccctactgctatagtctcctgactgatctccttctactttttaaccctttcaaaccattctccacagaatagctggagtggccttttaaaaatgcaaaccagcataaaacattttgatgtttaaatccctctcatggctgccaatgattgctcatagaataaactccaaactttctgccatggtgtataaagccctacatgtcttacatggctttcctcctacctgtctaatatcatcttattctagttctttctcattgattattcctttaacaaccaagcccttttccttcaaaagtccttcactcttactcctccttcctggaatgctcttcactgttttctaagggctgactcatgtataaccttcaacattcaactcaaatgccatcctcttagagagtcattttctggttagctatctaaagtagctttccctgttcctccatgagctgttgtcataatatccctccaacccccaacccccaccttatataaccatgcttgtctcctttgttgcagttatctccatttgtaattaacttgtttaaatcctcctagaatgccagctaataagaaggtaaggtccttgcctctctctctctttttttttttttgagacagtctcccctgtcacccaggctggagtgcaatgacgccatctcggctcactgcaacctccacctcccgagttcaagcaattctcctgcctcagcctcccaagtagctgggattacaggtgcctgtcaccacatccggctaattttttttttttttatctttagtagagatggggttttaccgtgttagccagagtggtctcgaactcctgacctcgtgatccctccgcctcagcctcccaaagtactgggattacaggcatgagccactgcccccggccttgcctctcttaataaccatattacctctggcaaccagcatagtgcctggtatttattgtgctcagtatgcatctgttgaatattattattttgtatactctatagtgatgagcatgttgtaagcaacccgatatgtataaattcattgatggtgttctctctctaaattttctttattgttttcatggtgggttcatttcctcctttaccccctctttttaggttgtataatcattagttttattttcatctctgattttatatggacatgtttcaatgcatacagacagttaatattcttttcctcctaattatctattatatatatcatcttcagtatcatcaccattcaaaaaactcttttatatgttctagataatgtggcctattttttacgttagactacctgataaggtgtcaactgaattggctgcctttatctacattctgaaccaaaatttaattctagagtttgtagtcagcgtttttccaaatgtgtaaaactgtaatccttcataaaatgtcatatgtaaaagagtaagcaattctgtgtgtactaaaaggtgagaaagttattactttagctttcactgggaagacttaaagtttatcaaaaaggattatagaaagaacagatttatagcaactgtctgatatatgaccagaacccttatgttccactgaaagagacttgccctaggctttctagagcataatgcccttagcaagtagctttcaacatctttttcaggaagcaatattttccttcagtaaaagggtcactgtactgtttttctttttccttccctgtcttatcttttgagttcaggaagtactttaaatttacaggcagctttgaagacatgaagcaagttcagccccagaagtatttcctgttatggcattaatctaattccatgaaagtagaactgatttttcatctgtaaagtagataaagtgcctagagcagccgaccattattctgggttatcatgataaagaggcttagttttgacacaaaagagtttatcagcctacccagtggaagatttcatcctttttgttgaaagatatattaatggattataatctgtcttggcttccaaaagaaagttcacctttatattgaaaatgattagttaaatcagcaaatattttcctgaatatacattttataatatacgataaatcaagcaaacattctagggatatcacatataattaaatatctaatgttaaatcattttatgttattttaatgtttaaattattgtctcaatttgaaataatcacagattttccttataaaccaacttggtttaattttaacatatagactaacataatttctagtaggcatatatgcttcattttagaagcccctgttattaggttatataatttctccttacaacttataatgtagaaatagttttcttataataaggtatttctcttaatagttaataattaaacttagttgattattttaagtatatagtacatacaaataatatataattcaaaagctataatatatttttcctatccctatttcctggttcctctctaagctaaggcatttagactaatcctagtggcttagtattgtttaaataattttttatttgaaaattgattccatattggacatatttacaatatttccttgaataataatagcttaccacatagtaatacattacatatttagttctctcagtagccttctgagttaaattctgttatccatttgaaaaatgcaggaactcaaggttagagaggttaaataattggctaaaattcacctggctgataagtgacagatttgggctggaactcaggtcctctaataccagagcctatattcatagcccatactgtaggattatagaaataaggttattcccagttgtgccttttatacttgaaaagaacaaaagattccactgaatgcttattttacaattaataaattaagttaggctttatcataccctaatgagatatcttattatttgtttaaaataaatgatctaccattatgttcataaataaaaataaagatattgttttattatagatgttaatgttttaaaacttagatcatctaaacatgaaaaatctctggcctagtcaaaggcacactgagaactaaacttgggattggaaaatttggagttttcaaatggccctaccaattcagcgcataattgtatatgcttatcatttttccaaagagggttgaatagtattcttccattgtatatcttagggaggcattataaaggtaatatgacatcagatgttaaacttacttatttaaccagcattcattgaggctgcctactatacgtatcctgtgaagcaatgtgaccaatacaaagatgaagaaaacatgggtgctgtctttagtgaactacccatcttctaggaagaataagatctattgtaatataaacaagagtgatgagtccttagtatatgtgaaggtctcctcagctaagttccaaaaagtaacaagctaactgtaatttcaccaccttagtattttatgaacaccaccttagtttttatgaactcaggaccttacctccactttatgaaaacacatatacacaaagcaaggagttttaataagcacttgaaaagatgctaatcttagccatcagacagtggcataaccatgtgagctttatcttaacacccactaggatgtctataatcaagaagacataataccaagtgttgacaaggatgtggagaacttggaaccctcatgcaccactggtggaaatattggcagttcctcaaaaggctaaacacagagttaccatatgacccagcaattccacttttagatatataccaaagaaaaatgaaaacctgtgtttacacaaaaatgtgtatatgaatgtttatggcagcattaattataatagtcaaaaggtagaaatgactgaaatgttcatcaactgctgaatggataaataaaattagattgttattttacatgagacacaaaaatgaactcaaaacagattaaagatttaaacataaaacctgagaccttaaaactcagaagaaaacatattagaaaagctccgtgacactggtcttgcaatgactttttatgtatgacactaaaagcacaggcagcaaaagcaaaattaaacaaaattgtatctatatcaaaccaaaaagtttctgcacagcaaaggagacaacaaaagaaaaggcaactcacagaatgggagaaaatatttgtaaaccccatatatgataaaaggttaattatccaaaatatgtaaggaactcatacaactcaatagcagaaaacccgattaaaaaatgagcccaggacctgaatagacattttccatagaagacatacaaatgacccaggtatatgaaaacatgtgcagtgtccctaatcatcaaagaaatacaaatcaaaagaccacagtgaagctgggttcagtggtggtggtgcgtacctatagtgccagctacttaggagactgagataggaggatcagttgagcccaggggttcaaggccagcctaggcaacataggaagaccctatctctttaaaaaaagaaaaaaaaaattactcccccacccccactttcctctccctcacaatgagatactaccttaaatttgtgactgttatcaaaaagtcaaaatcatgtggaaaaaagggatcccttgttagcgggaatgtaaattggcacagagattatgaaaaacaatacgaaagttcctttaaaaacagaactactatataatccaacaatctcatttttggatataaatctaaaggagatcggccgggcatggtggctcatgcccgtaatcccagcactgtggaaggccgaagtgggcggatcacttgaggacaggagttggagactggcctggccaacatgatgaaaccccatctgtactaaaaatataaaaattagctgggcgtggtagcacatgcctgtaatcccagctacttgggaagctgcggcaggagaatcgctcaaacccaggaggtggaggttgcagcgagctgagaacatgccactgcactccagcctgggcgacagagtgagactctatctctaaagaaataaataaataattaaataaacggaaatgaaatcagtatgttgaagagatatttgtactcccgtgttcagctgcattattcacaatagtcaaaatagggaaataccctaggagtctgtcaacagatgaatggataaagaaagtatatgtatatataaacagtggagtactgttcaaccttaaaaaagaaggaaatcctgccatttgcaacaacataggtgaacctgcaggacattatgctaagtgaaataggccagacacaaaaatatagatactgtgtgatctcatttatatatgaaatcttaaaaagtcaacctcatagaaacagggtagaaagtgtggttgggggagggaagaagggtagtggaatgatggggagattttggtcgtggggtgtaaacttttagttataggatgaatacgttctggagacctaatgtaaaacatggtaactatagtttataattatgtattgtatacttgaaatttgttaagaaagtagctcttaagtcttctaccacacacaaaaaaagataaatttgtaagttcatggatatgttaattggcttgatagtggtgtcatttcacaacatacacatatatcaaaacatcatattttatactgtgaataaatgtaatttttgtcagttataactcaagaaaattgaaagaaaaatgtattatatccacacagtgaaatattatttagtaataagcaggatgaagtactttcatccatgctgcaacatagataaacctttaaaacattgtgctaagtgaaagaagccatttataaaaggctgtctattgtatgatctcattcatgaaaagtcttaaataggtaaatcaataaagacagaaggtatattggtggttgtcttaggctgaaagtgttgtgggacaatgctacactcctaatagatacaggatttctttgggagttagacaactaatctaaaattgactgtggtgatggttacacatctccgtcaatatactaaaaatcacgaattgtatgctttaaatgcaatttatatgtgaattagatctcaataaagcttttattttaaaaaatagatggtattaacaaaacttttagactactgtgaccacttggcacacctaacaacaaagcatccaaggagattaatatttaaacgtacattataatatgaaaggcatgaatttagatgggggcatgtaacctcttgaagaaatatataatgtaaaagtgttattattgctattttatttcttattttaatcaaacactgtgatagtattattcattccactgtaacccctattggataaatacattatagtatttagaataaaactcatgtgttagtaagccagtgagaaagaatcataccagagctttatagatcaccagttctatctcctgtccctccatttcaggtatatgcaactggcctacctgttcagagtattaactctatggtgcttcatcagtcagaccatccactatgcccaaatgagtaatatgtccaaactgtatttgcaaaatgcatttcttcacagaaattaatatcctgtgcaaatgctggctaattgattattactctttcataaaggcttaattaggtaggaaacccagtacctgcagcgagagaggaagaaaagtctttcctagggctagatcctgacccaaggttttggattttaatggggcagagttgtctgttttctattaaacacatacttgggagtaagtagacttgcccatctcctgttttatactgatcttttcacgaatgtgaacctttttcttgaaagagtaaatatctttaaatttttctgtagccttccctgttacaagttaaatgttcctacttctctagagtatttcgaagtgtttatttaaataagtaaacatggatagacactattttgtagcaaggggttgggggagtatactctaaggcagcttctctctgacagcttatctttcttataagtatagtgtaaacatataatttataatgtgggaaaagagggtttgatcttttaataaagccatttctttttatttcagagttaaggagtttaaattctttttctttagcatctagcagtgagttcaggggtgatggtcattaatatcttgatccattacttttcctaaaagataagattttttttcccataatggttcatttgtctgactgctttatttcccaccagaaatcacaaaatccatttttcctgtgacagtataataattttcacaacatctgattttagtggcacatacatgcagaagattaaaggtgtaggttagaaaagaagcagtaagaaggcattgagaataaaaacatggtagaatttatttctttaatgtcataataactaatttagaaaaacaaatataaacaatgggttgtaaatagtttattcaatattttaataaagaattaattcattacatgcacacttatttttacatacttgcccagatttcttaccaaaaaaaattttctcgccctattctcaaacaaaatttatagacattatatacagcctctgttgaaaagaccttctgttaaaatcagctgcccttagcttgacatatcttgagttcttagtgattaacatgttaataacaagtgtgaatgtcattaatgttcctataattaatttcagtattaacaccttatgtttcttattattcattcctcaaatgaaggatttttccatttataactaagtggcaattattatatcatttttatataatggagcaataaattgtatctgatgttattaatagtaattcctacattccttataacatacttttatactcattcctttatatattcctttactgttatataatactttttaagtgcctttaagtgaagagaagtggttgaaatgtaaaagaagctacttggaatgtctgtaataacaaatgtgttagtatatttacacctgcttgaaggaaagagtaaagtatttcctgaaaaccccacaattatataggtagttcaacctctgatctgcactgaggcatttaacctctcttaaccttggcttccttatttaaaggaagtggctgttgagccttacctaaatcataaagtgagtgcaagtaattgtttactgagaaatctaagaaaggctaatggaaaacatcaagtatgaatgaaacagttataactgttttcccctttgaaaagaattgctgttccacattgaatttctgtcatgaatctaactctttttaaatgagctatttaaatttaaatacataaatggatgttatattttgattttaattacttcagtagtaattcagaattaattgaagctacagcttaaacatattttattacatttaaatagttgggaaaaaataaacagttggttagctaaaacccaataaataaattgggaatagattctgctagttgaatgctgaaatgaatagtatatactttaaagggctttaattttttctttcatactgatttaagactgataatttatctctttacttattctaattatttgaccctttttgttggaggagagggggcaatcttgtcactaattgtgtaacccttgtttaatttactctttcaggaacccttccaaccttccccctctccaccttaatacactgatgttcattttggatttccaagagggagatatgatatgcaactttaaaaaacctattttccagtcaagccatttttcaaagagagcttattaacctctcctatggatcaaattgtgaaatactaaactaggttgcctgtggaagtatagtgagagacgacgataggaaagaagataggatggggtcagaagaaccttacattccatgcttaggagtataaactgtatacgataagcagctgggaaccataaaatccttttaagaagtattgtgatataagactaatttgaaagaatagtgagaaggtggataattgtacatttgattttattcctttatgctaataattcccatgtacatacagtgaatgaaatataggagacaaacatcttcaactattctcatttcttattggttttagagcttggaaatatgttaaaaagacatgtaaactagttccatcaattgtatttcctcctatttagatagtacagtgattttgagcaaactgttaacattgattttaaaatccaaaatatattattagtctataaatcactgcatggttctcattcattgattttcacttaggaggctttggggggttgttttgtttttataatgctttacccaaagcattttaaatcttctactctccagtaatagtttttgtcaaatatattttgatatctgctgtactatttgctatatttacttaaacatctctccactacgtagagcaggtactataggaggaaaaacttttcctctaccctcttatgttcagtagttggtgcttgcaaattaaactgacaaaaaattaggaggataaaaggattattttgtatgcacgtgagaagcctcacagaaaagaattgaaaaccccaaaaaaccaatgagaccaaggggcttacatatcattttaagaaagagtgataaagtatggagaagagactagacaaaatgggggtttagacttctggtggggtgagggtgggcattaatgataggtgactaaggaatgagtggtaaataagggttgtttagtaaggtttattaggcagagtcaagtgagaagagtctgcttcttctcttcctggtactggagaggaggacgccattacaaatatgaatttcctttacaaaagggaaatttatgccctatttttaggaagtaaaggggagggcagagagctcctcctatgtttgctgttttaattgcctgtagttcaaaataatccttatgctgaagtggcatatttgagggtgtcatactctgatccccttcactatagactactctctaataccagggtactgagttaagataattctgaaggcttcgctaataatctactactctttgtcaatttcctatcttagttttctcatctgtaaaatggagatcatgatagcacttacctcaaaaaatgataagaagtcaattaaaaaagcaccaaaaaatgcttaataaagtggtctgacacatagtaaattctcaatgaataatgtatatactgttaaggagtcatttccctctaagagtacaaagtacaaaagaaaaagttggagcttaagatttaggtttggctgggtgtggtgtatcacgcctgtaatcccagcattttgggaggctgaggggggtggatcacctgaggtcaggagttcgagaccagtctggccaatgtggtgaaaccgcatctctactaaaaatacaaaaaatggcagacgtggtgatgcatgcctgtaatctcagctatttggaaggttgaggcaggagaattgcttgaaccctggaggcagaggctgcagtgagtcgagatcacgccactgcactccagcctaggcaacagagtgagactctgtctcaaaaaaataaataagagttaggtttaatcccagctacttgggagggtgaagtgggagggtctcttgagcccaggagttcaagtccagccggggcaacctagtgaacacttccctccactccatctcttaaaaaggatgggagtgttcccagtgctgattatgccacctattagccgtatgaccttggacaactgtaagcctcaactttcccatctatgcaataagaatcatttttacctcattagattgttatgaggattaaatgaagcagcatgtatatatgtgtatatatatacgcatatatacatatagtatcttgtatataataagtatttattacatgcaatttcatcttttatgtagactttctagactctaaccttgccccaggaagataagtgacttttacattaagccatgttctctttttcctttatgacactcctcaatgcttaatgaagaactctggctacacaaaaaactaaagtaaaatgttgacagactgcttttttctacatctgggcttctttaattgaaagctgacatttaggccaagaattgttaggaattcctatttaggtttataccagttctcgcttatatacaagatgtatacttgtgtatacatgttatttacacacatacaataatatatactggctttctttttttccctctcatcccataacagatagtatactgccttttttaaaaaaaaaaatgcccacttttcaaattaaaaagcagaggcacacattctttccaaatgtattagtataatttgaaataatgagattgtattaataggattcagccacagaaacagacccattagggaagatagagtgagaataagatttatttgttggttgatcgattttgaggaattggcctatgtcattgtggagactggctaagtagtccaaaaccatagggcaggcaaccaggaaggggagaaagccttgaacttcttaggcatgggcagaagctgtcattcataggtggaatttattctctctgtcaaggaaacttaagccatgcttttctttttaaattttattattattatactttaagttttagggtacatgtgcacaacgtgcaggcttttactttcaactgattgaatcaggcccctccagattatccaggatactccagtaatagaagtcaactgactgggagttttaattacatctgaaaaatacctgtatagcaacacctagattggaatttgattgaataactagagtctgtagcctagtcaagttgtcacctcaaaaaaaccatcttgggataaagttttttgaaaaaagaaatagaaagttcagggcattttggtcattatttttgtgtattgtgcctattatatctttttattttaaatttttgagaatctgtttagtgcctagtattttgccaagattataaaggaaacaaaggtatcttaatgtttttttcaaatcttaacatcttaaagttgtttcaagcattttccctgaattcattgattaagtattgttagaagaagtggaacatggatgatgcatatgctttagattgaggcaggagtatgtgtggtgactaagagagtaagaaatgatgatctcgagaatactagactgtgagctttctaaaagctggtatcgtgtgttatttatccttgtattgccatggcctggcacagtaattgaaaaagttcaacaatggtttgttgtttaggttgattaaggaatgagcaaaaacgtaacttaaaagctatctgtattgaagtgtgatctgttatatgtattcagatctgattatacttggagtcgaaatcactgtatctaaattaatattaagactcagggccaggcacattgtctcacatctgtaatcccagcacttcaggaggctgaggtgggaggtcagttgaggccaggagtttgagaccagcctgggcaacatagcgaaaaactctgtctccacaaaaaattaaaaaaataaaaattagccggacatggtggcatgtgcctgtagtcctagctacttgggaagctcaggtggaggatcacttgaatctagaggtggaagctgcagtgatctgtgatcgtatctctgcacttcagcctgtgtgacagagtgagactttttctcaaataaaagaatcaatacagcaatacagccccaatttctaaattggagaaagtcattttctatttcgtctctctctgttcctccactagattgtaaactctttgagagtaagaattatgcagttttgtctgctcttcaatgttttattgccttgcattaaaaagataataaatactgcttgatgaattaattaaaaacagcatacagaagagatccaaatttaattttgtaataaatcacctctgagaataataagaaaaccagaatatttgaaatacatcatttaattgaataaggaacagtaaactgatttttaatgttcctgtttttatgtatttgaagttaatgtttagttattttgttttaaaatctttataaaaattctctgctttatcttccagtgaacaagacatattaatagcttttctgtagagcaaggcatattaatagcttttctgttgaatatgaaagaaagcagctgtagttttatcctactgagtacaaatatttgttggggaattaaagatttattagataaatggcttaaagattaattaattaactatactatctttttactttcctatcttatctgtaggccattggtctgttaatatatataaattgctctgtttcctgctatctttccatttcttaattaaatattagaaaaatgcccaaggaaaaacaatacaactgagcttcctttctggttttcatgcttttaaaatttataaaaattgtggctctgctgcctttttttttttttttttttttttttgtagttagatgaatttggcctgagattctatgaaaaaaataaaacaatagtttttatttcatgatttttttttcaagttgttctgattttataatatctagtcaagtgatgacatgcagagattttgctgtgaggagagggagagagcaaaaagtattctgccctgattgctttttagtgattttattactagaaagataaacattgccttgttattttagccagtaaaattgtctgcaaagtaggtaacaaaatgcaaagcagtgtatttacttttccactttttcccaaaggtatgataaaagcagggttccagtggaacaatttgctgagttctttcctagggagcactggtagcccgtattaaatgattatattttggaaaatgctaatgatgaaagatgagaataatttatattctttgaaatgtgactaaaaagttggaaatgaaacctatctttctgaagtgacatccacatttgtggttcattttcatcacacctgattcacttctgccagcaattcagaaagaaaggtggaggtgggaaagcatatatgtagctaagctactaaagtgactatttgagtatttcattccatctgtcaaaagattcagtgggataaagaatttggcataaatggatgtaattcattctctttttacaaagaagtaaatgatagaacaaaatcatcctaaaatgaaggaacaaaataccagaaagtgaaagaaaacaaaatttgtattttttgatagaatagtagcagaactcaatgtaaaaataatgattacattaataattatttgctcactttttcctgtatttggtattttgggaaagtgggcttgaaaaacagtggatacattgatgaaacatttcaattttcacttgcctgttgtgtttgctcatgttagacaaactataacttctcggtgtatagatatgatgtacacaaaattacacagaaattaagccatgtataataatgcatgactagaagaaagatatatctcccttgaacaaataacagttattttagtaaatttgtaacagagaaaataggcttgattaacaaaaatatgaaagatcttttaaataaatgaattttgaattttcagagtagcccagaattttatctaaactcggattatttcattagctagaacatgaaaataggcatttattctactcacctacagcttctgtagtactaaatttatggaatgaggctttgtggtgctgccttcagagctcaatgatttgctttttctgaattttggaagtctgtctctaattgattgacacatatgaatgtagtgggaagaaatgagattaagcatacaagctttctttttcatttaaacatcattgaagccatgaatttgtaaattgatataaaaacacaatcctttggatctgtattaggaaatttataaatgggagctttattttgctccagaaatgtgataattagaaatatattcaggtgattttttccctttggtttttgttgttttttaatttatttttctttcttatttttaccaaaggttcaagtcatctgtaatattcaggtgtttttaagaatttctcatggcaagttaattgtgggtgaacatttccctattggactaccagatgtactttgtggttataacttgcatagctccaggatttttcgtgaacaagtaataaaacacatttctggtttgctttctgccatagagtattaagagtttaacactttttaaatgttactttaatctctgaaattttcaacaatgattagtggcagtatactcaaaaaaggaaatgtgtaggctttactataataaaaataagaacaacttatataagctccacactttatagatttgtatggatatacaatcaaatgtactaatttttaaattatcctcattttgcagtaattttacattttgctcatttgtgcaaaccgtggtgatagtaaaatatttaacagaaattcaagcacattcttttaactctttctgaaaaatctcacaaatgagatttttttaaaacagttaagaatttactaaatttaaaatgtatatatacctgatgccatccagatgttttattgaatttctaaaataaaagtccacctaatgaatggctaatttactcaacacgtaagacaaagatgtatttctgtgttactaagaacatgcatcctatctccttgacaatggctctaattacctcagcttggactgatcaatatttgatctttttcccaccatgcaaacatgttactttgactttgtctcttcctcttcttttcagataatttgcagccatgtgagaatggttcattttgtttgttctccctggcttgaggccaggggtctcttattagtataatgcagttcattgatgtgaatttgttgatctcctgggtaggttttcacaaatttaaggcaattaaaagcttttatatggcatttcacttgaagttattagtggcctttcagtgattttgcttttaaaaattacttcatcattttatgattatttcctttccttctcttttctctactctccccatgctataaaattctatagtaaaggattgaaacaactatttcattgatttcattaaaagtaataatttataaacttataattcaatagcttaatattttaattaccacaatttttaaaggactaatgaaatttttggttttgtgttttcaaaagctgctttgttttaagcatataaatattcatgatagaagccataatttggagaataataagaattgaatctaaaaattattagtaattgctaaaaaattcaaaaagcacatagtgtaaactttgtgtatatgagacagaactttttctaaattgcagtttcattaacatcttaaagttttctcgtagctaacagatgtccatgatatttttgcttccttaacttttacagtcaatggaccattctccagcaggtcataagtaagaatgttaaataacggccactaaatcttaaggaatgtgacaacattgattagattaaaatcctttgacttcattgacatatcttttttctttccccatttaaaaaattgtttcagttgttttcctactgtttgttggtggcatactttgttacagtacttgatccagtttgtttcattggtgtgcttggtaaatttgaagaaatgatcactggagaggatttgaaataactagcaaaagttttgaagtattgcagtgagtatatggaatgtgttactcatttatgcaaaaaatattggtgtttttatactttttattttaaaaaatatataacaataatagcaaatatttagtaagaatgtaactttatgccatactaaggcaagaatagtatattgaataagaggatataccctgaaggcagggtataaatccaagttgcgctgcttactagttcacttcttaagcagttaacttctgaatctctctttatgtgcaaaatggtataggagaggaaaaaaaatatctttccctcctgatatgtacatgactggggcctctataacaaaaacagattaacaagagaaaagtatactataatttaagtgtaagttttacatgacatgggagccttcataaggaaatgaagacccaaagaaacagctaaatctgagtgttttttatattaggttcaatggtgaaatgatagggtatgaagtaaatgtagtaaactgggtgaaacttggcaaggcctttttgtttggattcccctctgtctctttgtctttggagaaaagatgctcctttatagagagggtaccattcacataagggtcttgtgacctacttaagggaaaggtcaaaaaacagttaccaggttttatgatctgtttctagagaaaagggcaggggacagtcagagagaccttcctgcttctgccattttctcacattccttcaccttaaaattttcaatatatcaaggtgctatattttggggtagtatatcctgaaccgtgcctataggaatgatgataataatatctactttataaggataaaatgagacaatatgtataaattgtatggaacagtgcatgaaccacaataaacactcacaaaatgtttgctataaagatattttcgaccttccatggtggttcatgcctataatcccaacactttacgaggctgaggtgggaggatcacttggagccaggagttcaagaccagcttgggcaacatagcaagaccccatctcttaaaaaaaataaaaaataaaaattacccatgcctatagtcctaattacttgggaggccaaggcaggaggatcacaattgatcctcaggaagatcatgcttgtctgtaaaggattttatatccccttgacttatgaagcttagtttggctggatatgaaattctgggttgaaaattcttttctttttttttgagacagagtctcactccgtcaccaggctgaagtgcagtggcatgatctcggctcagtgcaacctctgcttccctggttcaagcaattctcctgcctcagctgccctagtagctgggactacaggtgtgcgccaccacgcccagctaatttttgtatttttattagagacagggtttcaccatgttggccaggatggtcttgatctcttgacctcgtgatcctcccgccctcggcctcccaaagtgctaggattacaggcgtgaaaattcttttctttaagaatattgaatattggctcccactctcttctggcttatagggtttctgcagagagatctgctgttagtcccatgggcttcactttgtgggtaacccaacctttctctttggctgcgcttaacattttttccttcatttcaacctttgtgaatctgacgattacattgtgtctgggggttgttcttctcgatatgtatgcacccaatacaggagcacccagattcataaagcaagttcttagagacctacaaagagtcttagcctcccacacaataatagtgggagactttaacaccccactgttaatattagacagatcaacgagacagaaaattaacaaggatattcaggacttgaactcagctctggaccaagcagatctaatagacatctacagaactctccaccccaaatcaacagaatatacattcttctccgcaccacatcgcccttactctaaaattgaccacataattggaagtaaaacactcctcagcacaagcaaaataatagaaatcataaaaaacactttctcagaccacagtgcgatcaaattagaactcaggattaagaaagtcactcaaggctgggcgcggtggttcacgcctgtaatcccagcactttgagaggccgaggcgggcggatcacaaggtcaggagatcgagaccatcctggctaacatggtgaaactctactaaaaatagaaaaattagccgggcgtgatggcgggtgcctgtagtcccagctactcgggaggctgaggcaggagaatggcgtgaacccgggaggcggagcttgcagtgagccgagatcgcgccactgcactccagcttgggcgacagagcgagactccatctcaaaaaaaaaaaaaaaaaaaaaaaacctcactgaaaaccacccaaccactgctcctgaatgaatattaggtaaataatgaaattaagacagaaataaagcagttctttggaaccattgagaacaaagacacaatataccagaatctcttggacacagctaaagcagtgtttagaaggaaatttatagcactaaatgccctcaggagaaaactggaaagatctaaaatggacacactaacatcacgatgaaaagatctagagaagcaagagcaaacaaattcaaaagctagcagaagacaagaaataactaagatcagagcagaagtgaaggagatagagacacgaaaaacccttccaaaaatcagtgaatccaggagctggttttttgaaaagattaacaaaatagatagactgctagacagactacttaagaagaaaagagaaaagaatcaaatagacacaataaaaaatgataaaggggatatcactactgatcccacagaagtacaaactaccatcagagaatactatagacacctctacgcaaataaactagaaaatctagaagaaatggatacattgctggtcagataccccctcccaagactaaaccaggaggaagtgaatccctgaatagaccaataacaagttctgaaattgaggcagtaattaatagcctaccaaccaaaaaaagcccaggaccagatggattcacaactgaattctatcagaggtacaaagaggagctgttggtgggagtgtaaattagttcaatcattgtggaagacagtgtggcgattcctcaaggaactagaaccagaaataccatttggcccagcaatcccattactgggtatatacccaaaggattataaatcatggtgctatgaagacacatgcacacatgtttattacagcactgttcacaatagcaaagacttggaaccaacccaaatgcccatcagtgatagacgggataaagaaaatgtggcacataaccaccatggaatactatgcagccataaaaaaggatgagttcatgtcctttgcagggacatggataaatctggaaaccatcattctcagtaaactaacacaagaacagaaaaccaaacactgcatgttctcactcataagtgggggttgaacaatgagaacacatgaacacagggaggggagcatcacatactggggcctgtcagggggtaggggactaggtgagagatagcattaggagaaatacctaatgtagatgacgggttgatgggtacagcaaaccaccatggcatgtgtatacctatgtaacaaacctgcgtgttctgcacatgtatcccagaacttaaagtacaattaaaaaataataataaaattttaaaaagaaaaagattgggtatttcacatcttcttgaatgtaaaactgggggaaaataatcttttttaatgtgcattaaaactttttttttttttttttttttttttttggggggagaaggtctcactctgttgccctggctggagtgcagcggtatgatcaccgctcactgtggcctcagcctcacaggcccaagtgatcctctcacttcaggctccaagtatctggactcaaaggcgtgcaccaccactcccaggttttgtttttttttttttttttttgcagagacagggggttttctatgttactcaggctgttttctaactcccagcctcaagcaatcctcttgcctcaggttgccaacgtgttgggattacaggcatgagccactgtgcctgacccagtgaaacattttagtgcagaatagttgtgaatttttgaaatagataaccaagaaaatttaacttcagatatcacctagttgtaagttatctctccgttttgtcattcaggaatgggttttctgagactttctaaagaaatatatattatcgttcagtttggctttggaaattttattattgccctatatttctagtaaagtaatgtagatctagtttgatacaaaccattctatacactacaccggtactatcagctttcacttttcacagctcccaaaacaaataaataaaagaaaatagctttcttttctatgccgtttctttctgaaatagtactaatctgccttacctttaatactatcccatagacccacctagtagctcttcccttacgagagagttcttttgatcagataaggtttaatatggaaaataaaaagaaataatcatttaaaacttgaccaaaatattttaaaaacatacacatatatactctaccttaacatatggtgaaaagcaatttttcctaaaatatattctatgaaaaaaaaattttggccaggcacggtgacttatgcctataatcccagcactttggaggctgaggcgggtggatcacctgatgtcaggagcttgagaccagcctggccaacatggcaaaaccccgtctctactaaaaatacaaaaaattagctgggcacggtggtgggtgcctgtaatcctagctacttgggaggctgaggcagggagaatcgcttgaacccaggaggcagaggttgcagtgagctgagatcacaccattgcactccagcctgggcaacagaacgagacctcatctcaaaaaaaaaaaaaatttatttccaatcagttggaaaatgtaagaatatgcaaaaatttaacagatttctttaatgtgggtttttcctagaacacctttttacatttcagaggacattagagttcagcaggacacagtttggtaaatattagtataaaaagttaggctcagccgggtgcggtggctcatgtctgtaatcccagcactttgggaggctgaggtgggcagatcacgaggtcaagagatcgagaccatcctggccaacatggtgaaacctcgtctctactaaaaatacaaaaattacctgggcgtggtagcacacgcctgtagtcccacctgctcgggaggctgaggcaggaaaatcgcttgaaccagggaggcagagattgcagtaagcctagatggtgccactgcactccagcctggcaatagagcaagactccatctcaaaaaaaaaaaaaaagaaaaaaaagaaaggagaaaaaagaaaaaaatcaggctctctgtagtcaaaagtcaaacatttttactgctaaaataaggcattattttttttccttgcttaattgccatgccaacttttattggttctttcctgtctcccaatgagttaaaaaagaaaaaagtatccaaatgtgttcccaccccaacccaagcctgtgatcacttctttgtttttttgcttccctgtaagggtatttctccctataattatactcacactttaagaagtaggagccattatactttattttcaaatttcaaattagaaagtgatttgggtttggaagcttgtttctgtctctggctatccaactgtttctcggctccaagatgtgaaactgtttcttcaccctaacggcaaaagggcacctgctattgagcgtgctttgagcgttattctcccaatagtaccctagataggtaagacatttttgaaatcaaaaataaacaaaaacttcttgttgtgatttctctgtataccaaaacatcctcttgacataaactgtgttatcctaatgacacagacaaacacaaattatcttcatttgggttgcagagttgggggtcatttcttgtgcttatgagcctgctattctgcaactgtgagatttcagacatgttcaatttgtggattttattttttattacacacacatgtgtagtattattgcttgtaataccttgtatgaatataaaaagattgtcatttttcaggtgtatattaacttcattaattttttacaattcaaatgatggagagattcctattgaaggatacttagctttttctaataattcagttatgattttatattcaatgtaaatgattttgtctctctggggccagattatcctatttaccttgaccccctaccatgacaatttaaatactgcatttaactgtagtatatgtaagattgtccttaacaaatatgagacttgaaaggttgtttttgtttgtgtcctctcctctgaagttttccttttaggatgacagcatacgatagatgtgttctagtaaagtgcttcttttattcatgaattacaaatagcttaagaaaatgtttaaagtaaagctataatgattagtcctggtagtctccattttattcagaatgtctctgtcagaaattatgtcatcactatggactgttagccaggaagttctgtctagcagatgaatgaatagggagtactgagttttctaataaaagacactgttgtaatattgaaatactgctaatggaggttgccagttttctgttcttaaatttacaggacatcttctgtgattaaagtaaggaatacttagagcaagtccttagagtaaaccaactataaacttaagaaaccggaaatagaattttttttttttaaacaatgccatttaagtccctaacttgtcttggttcagctgctagacatttgttcctttgtctcaaaaacgttagcagaaagcaataaatatagttcttgctttactcagctaacatctgattttatctgcacattgcttccatcttaaaactttcttaccttactagtctgaatggcttgtgtagcctaatactgttataattgtcagaacaaagggtttgattattttggcaaggaaaaaagcctggtaatagtatttgcatttcaattaattgtttcattctgatttgaaatgtgacttatgttagatacatctctgatccttccctatctcagtactaatactaatatgttgtatttccactacaatagcattacatcttacaaacatttatttcctttataactgacgtagagctttccacatagtagatatttaatataattgatggtttggaattcatacattttgtaggctaagtataactctcctactgtttcacctacttcctaagctagatttatctttacaggtactagactttatagaactaatggtaaattcagtatgcatatcttctgtagtaaacatagaaaaacatttttgtaatagtgctccccaaattttagtttcttgactagtaatgaaatatcttatctgtactagagttttgttatacaataatgacagcattttcatgtgctatgttatggccagttaactaaaaataagtggatatttaaaatggaaaatgaaattatcctgttgcctgaaatatcttgactcaggttctattacaggttgcatatggtatctgttagagctttgaatctatgttggttgttgagttattatgtgcattaactattgcattcaaaagttctttaaaagcatatgtctgttttaaatcttatacaaattccttgcaggttttgagagcagtctttttgtatgtctttcttgtttgttgttttgtttttataccagagcaccatgtcctaagcagcagtaaatttaaaacattgcttaggatagttttataatatcattaatagatttttatattagatagtttctctgaattattgacctattatagggaacatggaaaaatttagaaaaattagaagttatacggagtattaagaaaaaaactttatattttggtactcccaggaaaactaaaacctctttctaagagtatattttaggaaattttctaaaattttgtaaatcaacctacagagaaaaaaagtatagaaagtattttgaaatatttgtgtgtatatgtgtgtgtgtgtacacaagccacattttctcctagaactcactactgaaatttctgaaagtgattcaataagatatatatttcatatctggtttttaaaatccatagaatttttgtgttttgaccatcaggtagagtcttacagtttagtcacagtggaatcatcagcttcaaaatgaaagaacaagatagtctcttggcattcaaaaatttagcatactttaactcatatttgctgtgatgttaggtagtgaattattcttgttaactatctagcgtccaatgtgacatgtgtttgttgttacctacaacttatcaaataaacagttaccctctggaatgataagaacttgggctttttatgaaaaataccctctaaatgaggacagaaatctatattaaggataggctattgattaaatttagagatacacataaagatgactctcatataaaatttagaataaacatgaaagttttagcatgtccagactttagggatttaggctttatgaaggtctcaagcctgtctcctggaattccaacattgtgatgactcaaattttatcagtaaatatggaaaaataagctaaagttcttgagaaattgctatctaataagtgattattttattttttttctagttttaaaataaaaaatctttactatttattagattcaccagtgttttatactgggggtccccaacctttttggcaccaaggactgtttcgtggaagatcattttccacagggcagggtgggggaggggtggtttcaggattattcaagtgcattgcatttgtcgtgcactttatttctgttattattacagtataatatataatgaaataattatacaactcaccataatgtagaatcagtgggagctctgaacttgttttcctgcaactagacagtcccatctgggggtgatgggagtcagtgacagatcatcaggcactagattctcataaggagcacataagctagatccctcacatgcacaattcacaatagggttcgcactctaatgagaatctaatgccgccagttatctgacaggaggtggaggtcagacagtaatttgagcaatgaggagtggctgtaaatacagatgaagcttcacttgcacatctggcactcacctcctgctgtgtggcccagttcctaacaggccatggatttgtatccgtccatgtctgaggggttggggacccttgttttatacaattctaattgtgtcattgaatttcttttttcttttttctcattgttaggaggctaaaaacaaacttgtcttgtgcagattcgtcgtctttaccaccaaatttttgtcatggtatcttgtcttttttttacgtctttctaaactgccttaatccttgtaagggaataggtaaggtgtaaatataattaataaggtgcaaggaaatgttattagaaagaaattagattgttatttgaaaacatacagagcctaaatgtaagagaaatgtcctaagcaaaacttattaacaggaaatttactgaattggaaagtactcttgattttatgactaatatgaattgaggtattcttatagacactcagagattcctgtacacatgttacttgtgtttttccaaaactatatacgtatagtctttttacaaataaacagtggccaccaagaaaaattacagcagtacacataagacataccgtatacatgatactcaactttgtctatatcctttgtgttcaagtttctagaaattttcatctttgtaaggatatcatgtgagtgtgctcaaggtttgttctaagaatctagctgagcacagtggctcatgcctgtaatcacaataccttgagagtctgaggcaaaaggaacatttgagcccaggagttcaagaccagcctgggcaacatagggagacccccatctctattaatttaaaaaaaaaaattacctggacatggtggcatgcatctttggtcccagctacttgggaggctgaagcaagaggatcaagaggatcacttgagcctggaaggtcgaggttgcagggagccacagtcatgactctgcactccagccttggtgatacagcgagaccatgtctttaaaaaaataaaataagaatctatacacaattcatggaatgatgttgttttatagttttactgtatatttgtttctgtcataacttccaatatcccaaaaactttttaattatttttattcaagacatacatacagaagcaggccaggcacagtggctgatgcctgtaatcccaacatttttggaagccacgatgggtgggttacttgagctcaacagtttgatgctacagtgagctatgatcatgccactgcactgcagcctgggcaactatttaagaaaaaaagagagagagagagaagcagaaattcaaaggacactttttgaaatgcacttaatgtaaaggctgctttgcatggttaatttattcctattaaaggaatactacattcctgccacttttctaggtggtgaatttatagcagcgaccaggtaaatattgctgtcctcagggtgcttacctttcagtgggtaatgctttaaacaaaatatctagtatattagatggtaataagaaccttggagaaaaataaaacagaaaagagtgttcaggtctagcatgaaaggttacactttcaaatctgatcattagggaaagtctcacccaagacagtgatgtttaaaaatatttcaagaagcaagttgtgcacatattagggagaaaaacaatcagtgaataaatagcaagtataaagtctctatgccaggagcatagcatgtttaaggaatagccaggagattaatatggctagagtaaaatgagcaatgggaaaagtaagtaggagatataattacactgggaaagagtctaggggcatattaaataagactttataggtcattataaagactttgttgtttttgttttgttttgactctgaatgagatcaaaagcctttagagggttttgtgcagacgagaaacataacatgacttatattttagtagggttattctcactgttatatggacaaaactgaatggggcaaagatagaaatagggagatcactttggaggtcattgcaataatccagtgggagatatgatgacttggactagagaattagcaatggaggtgttaagatacaatcaggctctggatatagtgtgtaggtagatttaatagaaattgctgttgaattgaagaatagtttacgagagaaatgagtcaagggtggaagcttcattaactaagagagggtaaatggggataatttggtctagttttgtataaattatggggaaagtcttggtctcatagtttagcattccatagtacgttctccatagtgtataagtgataggttttactaatttaataatttttttgtctcaaacttgtgacttagactttgataaacttctgtttatgatagatggatttttaattgattttattgtttgtattttataatggattttaaggcatattagtgaaaacacaacttaaaatttattttcttaccttactaacattccaaaaaaggaacatatactgtataatgtttttttgtctcactaatatattcgtatccctcttcccccttcttggcaaacttgtctgaaagtatactgttgcatgttatgtcatggatgtaccggagcatgtgtgtaaaatacatgtcataaatggaagcagctggtttcctatgcagttaagagaagaaatgcatacagctgagctcttcaaacttcagaactcattggattcagtttctatcctgtgtaagcatgctatgatttcaaatagtacaaatgtataacaagttaccttaatagcttaaaaaattattttgtttcgatagttgaactactaaatctgttttattctctttccctctgccttcagtccctacttacctatcctacctcttgaaaagaacattacacctatagtcttagttttaaattcgaatctgaaaaggccttggcaagagttgggaaaaagttatcatctcaaagggaaaagctgaattcatacacaggaactgcaggattactctggcgttttactagtcccttgcagcactcgcaagtcccataaatacctaatggaaaaacagcagaaaatgagatctgcagcagccttttgagatcaaatttatgttgctgaacatttttttgaggttgagtgtaaaggtcaaaagaaagtgggtagattaaagttgctgatttttgcaaacttaaggccatttttaaaggtttctctttctgtagcaagaaaatttcaagataaatggctttgcttcattagctgaaatgtcatgtcttcctttaatatctgttacctgagacatttagtgatttagtggtatttatatacaacaaataaaaatctcaatccactttaacaaatctagataaatttatgaaattgcagatctttccaagaacagcatgatgataaattaatgtatatatacatgtttgtattgccatgtatatatgtatcttaaatgacatattttagatgtttttgtatgatacagaaggaaaagataataatcaaagttttgtatttttaaagtataggttattgatccagcagtgtaattataaccatctttttttaaaattatttcttatattaaactattacaatgaagataaatgacctcaaagaaaagatcgtgcatgtaatagcattaaaacaaaattcatggatgcttttaatggtctcttaccttttgaacaacattttaacacgttgttactggtgcaagcctatatctaagaaactgtgagttactagggtactgcagacttgatgcaatgaagaacaataaactgccatttctggacatctctatcctgagttgatagtacagaaagccaccacatatgttaacgtgaagttatagattatttatatctccagggcttgcttcgtgtctttgatttcgtagttcagattgcccagttattagtacttagaattcaaaagaataagataaaaaatttttacttaatacattcatttctgcatcacaataaagagttttcatggaaattatccagataatttcatagtagaataatatatgaaatgaaatcttttcttttttatggtagttgataattaatagtaaatctattcagtttatctctaagaagtcagattatgggagacttgtctctatttttctctatttaattttcccaaaaaaattcataaggaaaatattaattttcatttaaatctctatattaaacattaagtgatctttttatgccttggaatcacaatgaatataaatgttatttttattgtagttgattttgcagtttcaattcatttctattaaatattttaataaacatttttatgaaactaggtagaggtcacaaatctcattagtcactgacagccaattctcaaacccaggtcttttcctgtataccacatttcctcattagttctcactacactgtatggctatttccgcctcttaactttttatattttattacactcttaaagtacaactgtacttctcttctcaagtgcccttttctattcagtaagggtcccaggtgagcaatgattctgactggggaagagggagaagatggtgttgtagcaagtagtattaaaaggcccttaggaaggtagatagatgtataattttgtctctttcttctcactgttttcgtaaagacaaaggctatgccttaacttttttgccattcttatttttgagactacccattagggattgtttttgatgttgttgagatgaagtatttggtgaagccaaaacctccttgacttttatagttttaataagtttgtgctctccaaaccttcataaagtaatgtctagtgatcctttcagatatggcatgctgtcatgtcagctttaaataattgttaatggcatgatttttaacattttacctagttagaatcagtaaaatttattatatatactctttgctgatcagtagagcctcttatgaaggagtcagtatgatgtgctggatagagcattagatggcaaattgggcctcagatattattaggcatagttttgccactaatttgtataatgtgcaagtttaataacctttctgggcctacagttctcctcttctgaaatggaaagatgaataggttatctctaaagtctatccagatctaaagatctattttattatagaaaacttttaatcatacacacaaagatagaataaaaataaatggcattatgaatccctgtgtattcattacctgtcctcatatgttatcaatagtaaccccttagtatcttctaatacctagttcatattaaaatttcaattaaagtatctagtccatattaaaatatcatctcagtaataatagtttctagttgctttgttttgttcaaattataatctagacaaggggtgtgtgtgtatgtgcatgtgtgggtgtgtgtgtgtgagagagagagatctagttgtgtttttaagacttatggtcaaaaatacatatcataaaatttcccactttaggctgtacatggtggctcacacctgtaatcccagcactctgggagaccaaggcaggaggattgcttgagcccaggaatttgagaacagcctgagcaatgttgcaaaaccccatccctacaaaaaattatgaaaattagccgggcatgatagtgcgcacttgtagtctgagctactcgggaggctaaggtgagaaaatcacctgagcccaggagtttgatgctgcggtgaactgtgattgcaccactgcactccagcctgggtgatagagtgagcccttgtctcaaaagaaaaatattttttaaccttttaatttattttttagagatagggtctcactgtgtcacccagaactggagtgtagtagtgcatagcatagctcactgtaaccttgaactcctggggctcgagtgatcctcctacttcagcctccagagtagctaggactacaggcacacaccacctcacccagctcattttaaaaattttttgtagagctggggttttgccatgttgcccaggctgttctcaaactcctggcctcaagtgatcctcctatcttggcctcccaaaatgctgggattataggcataagccaccgtgcccagtctatcttaaccatttttaagtgtaaagtacagtaatgttaattgtatgcacattgtgtgcaatagatttcttgtacaaacaccttgcaaaacggaaactctgtagccattgaacagtaattcccctttgcccccttcatacagccccaggcaaccaccattccactctgattccgtgaatttgactattttagatatttcatgtaagtaggatcatggtttatggctggctttttatggctggcttatttcacttcccttaccatgatgtcctcaaggttcatccatcttgtagcatatgacaggatttccttctctcttttttttaggccaagtaatattccattttgtatatataccaccttttttttttttttttttgagatggagtcttgctgtgtcacccaggctggaatgcaatggcgcaatctgagctcactgcaacctctgcctcctggatttgagcaattctcctgcctcagcctccggagtagctgggactacaggtgcgcgcaaccacacctgactaatttttatatctttagtggagacagggtttcaccacattggccaggctggtctcgaactcctgacctcaggtgatccgccttccttggcctcccaaagttctaggattacaggtgtgagccaccgcgcccagccacattttctttatacattcatctgctgatggacatttagattgcttccacttctttgctattttgaataattctgcgatgaatatgggtgtgcaaatatctcatcaacatcttgttttcagatcttttggatatatttccagaagtgagattgctggcatttttaattttttgaggatacttcatagtgttttcatagtggctttgtcatctaacattgtcagcaatagtgcacaagcgtttcaatttctccacattctgtatcttctttgaaaaatatctattcaagccctttgacaatttttcatttggattctttcgggggtgaggtgttgtggagttccttatatattctgaatattgatcccttattggatatatggtttgtaactattttctctcacttcataagttgcctttttactctgttgtttcctttgctgtgcaatagtttgtaagtttggtagtcccatttgtcttatttttccttttgttgcccatgcttttggtgtcttatctaagaaattattaccaaattcattgctgtgaaacttttttctccagtgttttcttcttggagttgtgtagttttaggttttaaatttaattgtttaattcattttgagtttatttttatatacacaataaggtaagggtctaactttattcttttgcatgtggatatcctgtttttcccaccaccatttctcaaagaaactatcctgtatgcattatcagtactatactttttctttttttttttttttttgagatagattctcactctgttgcccaggctggagtgcagtggtatgatctctgctcactgcaagctccgcctcccaggttcacgccattctcctgcctcagcctcccaagtagctgggactacaagcacctgccaccacgcctggctaattttttcagtttttagtagagactgggtttcaccatgttagccaggatggtctcgatctcctgacctcgtgatccacctgcctcagcctcccaaagttctgggattacaggcttgagccaccatgcctggcctatcagtactatactgttttgattgctgttgctttgtgtaatatgttttgaaatcaggaactctgaggcctctatctttgtttttctttcttgagattgttatggtatttgggggcctttgcagttttatatgaattttagaatttttttctatatctgcaaaaaaatgtcattgggatttgtataggaattgcatgtgcaaaggaatctgtacattcctttcagtagtatggatattttaacagtattaagttccaatccatgaacacaggacgtcttttcatttattggtgtcttctttaatttctttcatcaatgttttgtggttttcaatgtaaaaatcttgtgcctccttggttactcataagtattttattcatttttaatgctattattaatatatttgttttcttaattttctttttgggttgttcattgttagtattttcaaacacaattaattgttttatgtttattttgtgtcctgcaactttgctgaatttatttattcctcctaataggtttttttgtatgtgcagtctctaggctttttatacatacaagattgtgttatctaaagaaataattctacttctctgtttccaacttgtatgcctcctatttcctctttcctttctttctttctttagctgactgctctggatacaacttccagcactactgtgttgggcctggtggtatgctcctgtagtcctacatacttggaaggctaaggcaggagaatcacgagttcaggagttcaaggttacagtgagctgtggtcataccactgcactccagtctgggtgatagagcaagatcccgtcggtaaaaaaaagtggcaaggggggcatccttgctttattcattgtctttgagggaaagctttctgttttttaccatcgagtattatattacccatcggcttttcatatacagtctttattgggttgaggtgatttcctctgtgccttttttttatttaattataaaaagatgttgaattttgccaaatagtttttctgcatcaatagagatgtcatctagttgtgatgtctgataagattcttctttctgtaagtcattttcctcccctccactccattttttagctttcctttggtttgtcagagaagccaggtcttacatttgtctcatataatgttctacaaggttcagtgcttccttttgtagtgttgttcctctatcacctaatttcctaataagacctagaaatgcattgtcgtctggtagctactagctacatgtggctctttacctgtacatttttaaaaattaaagtttaaaattttcagccattgtagccacttatcaagtgctcatatagccaaataggggtagtggctaccatattggatagtgaaaaggaacatttccatcatcgcagaaagtggtctcatataaagaactgatatgacagtgttttttccatactctattttgtctttttccacatgccagctatctcaacaccatttggggctatttttagatgtcataattttagccaatactaatgggtatttattgatatctcattgtggctattttttcatcaatagttttttgtttgttttggggggcagattttgtttgtttgttttcatttttttgagatagggtctcactctgccacccaggctggaagacagtgatgtgatcatggctcaccgcaaccttgaactactgggctcaggtgattctcccacttcaacctcctgagtagctgggactgcaggtgtgcaccaccatgcctaatataaatatatatatatacacacacatacatatacacacagacacacacacacacacacacacacatatagagagagagccactgtgcctggcctaaatagttttattttgaaataattttagatttatagaaatgttctaagatagtaaaaataagttccatgtactcttcacctagcttctcctaatattaacaccttaaataactgtaggatcttcatcaaagctaaattaacattggtacaataccattaactaaactacaggtttattttcccagtttcttaagtaatgtcctttttctgttccaggatctgttggaggatactacttgacatttcattgtcatgttgctctgtcttgccttctcttttgtggccttgacacttatgaagagtagaggtcagatagtttgtaggatatctttcaatttgagtttatctgttgtttccttgtaattagactgaaattatggggttttgagaataccaccactgaggtgattttgctttcccaatgtatcacatcaaggtgtacgtagtatcaatctgttactgttagtgtgaaccttgaacatcaagttaaggtggtgtccattgggtttctccattgtctatttgttcctttccatatacagttcattagaaatgaatcactaaatccaccccacacttgggggtgggggggtaaatacaaaatgaatagtgtttagaaacctcatagaggaaggatatagccaccacagtaattaataaatattagtggagagatattatgaaattatgcaaatattctagttttttaaagttttacccactgatttatagcatttattagtggatattgcctataccaattacaactatggtgttctaatggtgattttctatttccctcatttattctatatttaataattcaaattctttaaggaagatttgtctctttgcttccatttttaatattctttaatttttttttcgagatgggttctcactctatatctcaggttggagtgcagtggtgtgatcgtgactcactgctgcctcaaccttctgggctcaagtgatctacctgagtagctaggactataggcatgtgccaccacgcccaattaactaattctttttttaagaggcagggcctcactgtgttaccgagcctagtctcaaatgcctgaactcaagtgatcttccctcctcagcctcccaaagtgctgagatcacatgtgtgacccaccacacctactctgtattcgttttttacaaattcagtagtcttttcttttctttctttcttttcttttcctttattttctttctttctttttctctccccctttcctctcctttccttcccttcccttccctttctttcctttctttcctttctctcctttctccctcccctcccctcattctctctgtgtcatccaggctggagtgcagtggcgagatcatggctcgctgaaacctcagcatcctgggcttaattgatctcccaccttaggctcccatgtgtgtgggggtgtgtgtgtgtgtttgcatgtgtatgtagatggaatttcactgtgttgcccaggctggtcttgaaccttctaggctcaagcaatcctcacaactcgcccttccaaagtgctggaattacaggcctgagccactacacctggtttgtttccatttttcataaattctgcctggtgcggaggctcacgcctgtaatcccagcactttgggaggctgaggtaggcagatcatgaggtcaggagatcgagaccattctgaccaacatggtgaaaccccgtctctactaaaaatacaaaattaactgggcgtggtggcacgcacctgtaatcccagctacttgggaggctgaagcaggagaatcgcttgaacccgggaggcagaggtttcagtgagccgagttcacgccactgcactccagcttgacaacagagcaagactccatctcaaaaaaacaaaaaacaaagcaaacaaaaaaaaacaaaacaaaaaacccttaattgtcatttatatcaatagggctcatggatatttatttagttctttgggttataatctaaaactgtgtcacttttactactcaaattcgagatttaactattgagagctttgtcacattggcttctgtatcattgtgacagacctgtcatctttttattactttcttactttctggcactacaagatcatctagactttctgtaccccagcttgtttctccaaggatcactggttcactttatcaaagagaaggaccaggcatggtgactcaattctctaatcctaacactttgggatgctgagacagaaggatcacatgaggccaggagtttgagaccagcctggacaatgtagtaagacccccatctcttaaaaaaaaaaattagccaggcatagtgacatgtgcctgagacctagctacttgggaggtttaggcaggagaattgcatgagcccaggaggttgagcctgtgtgagccatgatcatgacactgcactccagcctaggtgacagagcaaggccctgtctctaaacagagaaagagagagaaagagagagcgaagagagaaagagagaaataaaagaagaaaagagagagagggagaaagagaaagaaaagaaagaagagaagagagaaaaaggagggagagggagggagggagggaaggtaggtgggaaggtgtttcaaaaccagcatctgagcactgttttctcgtaagctactggcagtaattgcttctaggttctctcagcagatagaattaggaaatatgcttatgtctgctaactcatgtatacatagacacacattgtatttaatcctgttacctatgtgtgtttataatatatataaaatcgtgagtttataatggtatctcttactctaattcagtaccacagagttcatgctagcatttccctttgacttattttaacttccttctctgatagtgagaaagctggctctgattatttgacatgtatttacttatttatgcaaacctagtatacatataaagtcgtttaaaaattgctggctgggtacagtggctcatgcctgtaatctcagcactttgggaggctgaggcgggcagatcacctgaagtcgggagttcgagagcagccttaccaacatggagaaactgcgtctctaacaaaaatacaaaattagccgggcgtagtgacacatgctgtaatcccagctactcgggaggctgaggcaagagaattgcttgaacctgggaggcagaggttgcagtgagtcaagatcgtgccactgcactccagcctgcgtaacaagagcaaaactccatctcaaaaaaaaaaaaaattgctgaatcatacctctgtgataaaccaatttaccagaatacaatgcttatatatagttctttttgtctttagcactatagtatgtaaaggaaatactgttggctacagttatttagggtcttttcattcccaccactttcagtaagtttatttcatacatatttaatacatttagactaatttatcacagtttgcattccatcttgggttcccttaacatcctaattgatatttttaaattagtatttgctgaaagaaacctaaaatattgctcctttacggtagttggtcccttccacctgccaaccatgggaaaagttaatctgtttttcatctctgtagtttggcattttctagaatgtcacatacatgaaattataaaatatgtagactagtggttctggcttttttttacttagcaaaattcatttaagattcattcttattgtgtgaatcaagtttgtgtttagtatgtaaaatatatagtttaaaccagatattttggggctgatttctgttattgtatggtatgctttctgtactatgaggattttttaatttgtttctatcttttgccatatcctcccactttggtttgtgtgtatgtttcttccaataatttgtgagacttgtatttttattcaagtgaccacatttagatctgtaacttcatgtaacatgattaagatttttttatttaaaaaaaggtcttttgagacatggtctcactttgttgcctaggctggagtacagtggcatgatctcagcttactgcagctgcaacttcccaggcacaagcgatcctcccacctcagcctcccgagtagctgggtttacgggtgcatgccaccaggactggctgttgttttacaatatgtttttagagatagggtttttccatgttgcccaggctggtctcaaactcctaggctcacgtgatctacctgccttagcctcccaaagtactgagattacagtagtgcaccactgcacctagccaagattttttaaaagataataagtattctttttcggggaattcttcattctcttttcctagaagatttttctttcccttagtgtttttaagaatacttagacctcaattacatgatttatcagcttttcaggatctccttgacccctggctataaaagatgaggaaatctttcttaccctcatagtctcacaccttccctctcccaattactctattttgtatatttgttcccgagatttataacatttatattgttctgtaaccaaacatattctcctccctcctgcaaatttttgatcttattcataacagttaaaaggcaataaacagaatcaatgtttatagctaagcctttcataatagtcattttatctcttggtttgctgaggtttgttctggtggtttcttcagaaagtcacatagaaactatatttcccaaattattttatgttctaaattttgtctcttcatttatacttacatggtagtttgaccagatacaaaattaactaggctatctttccttgaggaggtaatagacattgctcttttattatagggttttttggtttgtttgctttaatgagatagggtctcactttgttgtctatgctgatctccaactcctggcttcaaccaattctactgcctcagcctcccaaagcactgggattataggcattagccactatacccagcctatcttagaactgtatttatttatttctagagacagtgtttcattatcactcccaggctagagtgcagtggagccatcacagctcattgcagcctcaacctcctaggattaaatgatcctcctgcctcagcctcctgagtgtcagggactccaggcatgtgccaccacacctagctaatttttaaaaaaaattttcatagagatgagtgtcagtctgttgcccaggcttgtcttgaagtcctggccccaagcagtcctcccaccttggcctcccataatgctgggattaaagacatgagtgaccacacccagcaattctttaaatgatactttgaagaacctgagcacgcacatatatttcttccctctttgttagtaactctcagttccttatctagctttatttttctgtcacctggtgtatatattccttggattatttgtttgctgtcatctccatctatagaatgcaactatcaatagtaaagggatttggtctgatttgttctctgttgaattccaaatagcttgttagtgtttaatacttagcatatagctaatacacatttattgaattaataaggtcagaattcatgattctgccccattctccatccttataagtactttgatgggtttgattgcttacaaaaggattcgtttcacattttgaattcccgtgcctttactcagatatgtcttggtcttcactactgtgtgtcagtgttgtgctctttccaactatatttttctgtgctatttctagaaagttcttccacatgtatctttttttaaaaaatatttttttgagacagggtcttactctgtctcccaggctggagtgcagtggcatgatctctgcccactgcgacctctgcctcctggtctcaagtgatcctcccacctcaacttcccaagtagctggaaccacaggcacgtaccaccacacctatctagtttttgtattttttgtaaagacgtggtttcaccagttgcccaggctggtctcaacacccgggactaagcagagctcacctcggcctccaaaagtgctaggattacaggcatgacccatcgtgcccagcctcacatatctttatattaggattgcagcttctgttttctactattcccactggcctggtttatcattctctatctcttttagccactttgttttttgttggtttttttttttttttcattttttttctccctacccctctcttttagccactttgaattggtttgttttagtgtctctttgccatacagcagagaattttcttttgcttcctgaggcaatctgaatatactttcatgtcaataagctgctgatatatttggcctcaaacctgtcatgttattctataattactaaatatatatgtatactgtttttctgtgtgatttattatctctgctgtttttaaattttttattctggcattttggaaaggtttatatttcttttctagccattagcttttcttttaagtgtgctttttatggtggccttaatccccatttttcttataacattctactctccaatcagttttaaatgatatcctttgattctcacctattatctatacaacagtgattttattctgcatttttctctcacttctttgttttaaaattgtattacttctactttgtcagaatatgcagtgcttacaaactatgttctttccatcctttttaatttataattataattatcttattaaatgtaatgaggtttaccaacaacagtcctgtgtttgagttttcccccaatcatgcttggatgaagcttatcttctaatacatttctcaggaaaggcgtatgtgtacagtatcctctgtgttcttttttttctattactttatactttttcctacacaaagacagcttggctgcatataaaatccttgactttatttcttggaaataatgttctagttttgtcttgctttgtgttttgctcttgaagtctaaggcagcctaattttctttctttctttctttctttttttttttttttaaagagacagagtctcactctgtcacccaggctggagtgcagtgtggtatgatcatactttactacagccttgatctcctcagctcaaacaatcatccaaccacagcctcctgagtagctgggactacaggcatgtgccaccatacctggctaatttgttgttttttgttgtttatttgtttggttggttggttggttttgtttttgtttgttttttgtagagacagggatcctgctatgttgcccaggctgttctcaaactccaagcctcaaatgatcctcccacctcagcctcccaaagttttaggattataggcatgagccaccacacccagtccctagcctaattttcttattcttatttttctaatttcttactcttaattttatctttttgcctgtaggcctgaaaatactgtttcatcattaaggtctaataattttaccaggatgtgtcttagacctttcttgtttggggtcagtttttccaggtatgcaataataagctggaaatatagtttctagcttatagagtaatatggtagctcatgccttgcacatgcttttacaccagcagcacatcttttaaatgtgtagatttaaattttcatctatttctggaaagttttcttagactatattttaaatatactattccattgcgttattttttcctcaaggattctgtgtttatgttggatcttcttttcctgtcttccatttcatctactttctctctttgttatgtctttcttctctcattttcattcttttggttgtttgccttcattttttcagtgtacctttttagattttcactttattaatgtattcagcatggtgcactttgtaatttatttctgggattgttttttccttttattgcatttcttccctgattactttgtcctagtaatgttgaagacatggtcatatattgttttatttgtacttcttgtggcttattgagagaatacgaagataaatttggtttcagattattgccattatcctgaaatagattttgaactgtttttctgtgctactactttgttactctaatttaggaatgccatttatattatcttagattcacttttcctcttgttctgtccttttctcaccaatttattttattacctttgttagttcctatttcattttgcttgctttacacagtcctgacctccattttatttactatatttttatcagtgtttttttctccatttctttgatggttgcatttttctttcacactctcttgagcccagccagtttgtgtttcaccatctgttaatatgtttaattataacttctctatactttagtgtctctgcttaatagggataattgcttcatgaattttgtccatgcatttgcttataattgatgtgtgttccattactatatatttctgttaaatgtcttgtatgtgtcatttactttgctactttttttttcttctgtcctcatacaaattctgttctggttcctttttcatttctcatcttcgaatatggtattttcctacattagctattttacatgaggtttaattaaggaaggggttacacatgtatttcatactatgaagaattgtccatatgatgcacatatgccagttcaattaatggtcttaactcaggacaatacaaatagtacctattgtttcctaccactattcctaagcaccttatatcagattttcttttccttaacccttggagacatctagggaagattcatcgtagtttttagtcactttcagctgttaaggaaattgccctgcttttggttatttaaacaaattttaagtctgttgttaaaaatgtcagtcttaaactgtgtttgtattagtcctttcttgcactactatgaagaaatacctgagactgggtaatttataaagaaaagaagtttagttggtttatggttctgcaggctctacaggaaatgtggctggggaggcctcaggaaactttcaatcatggcagaaggggaagcaggcacatcttacatggctggagcagaaggaagtgagacaagggggagacgctacacactgttaaacaactatagctcattgaaaactcatgcactatcacaagaacagcaaggggaaaaatccaccctcatgatccaatcatctcccaccaggcctctcttgcaacattggggattacaatttgacatgcagcttgggtggggacacagaactaaaccatatcattctgcccctggcttctcccaaatctcatgtctttcctacagtgcaaaatagaatcatcccttcccaacagtcccccaagacttaactcatctcagcattaactcaaaagtccacaatctgaagtctaatcagagacaaggcaatctcttccacctctgagcctgtaaaatacagttagttacttccatgatacaatggagatacaggcattgggtaaatccctgttccaaaagggataaatcagccaaaagagaggggctacaggccccatgcaagtccgaaacccagcagggcagtcattaaatctttaaactccagaataatctttgactctatgtctcacattcaagccacactgatgcaacgagtaggctcccaagggcttgggcagttctgcgtctgttgctctgcagggctcagctcccatgtcagctctcaagggctggcgttgaatgcctgcagcttttccaggtgcatgatgcaagctgtcggtggacctaccattttgaggtctggaggacagtggccctcttctcaccattccaataggcagtttcccagtggggactctgtatgaggactccaaccccacatttctcctttgcattgccctagtagaggttctccatgagggttcacccctgcagcaaacttctgcctggacatcaggtgtttccatacgtcctccgaaatctaggcagaggctcccaagcctcatctcttgccctctgcatacccacaggctaaacactaggtagaagctgccaaggcttacagcttgcaccctctggagcagtggcctgagatgtatctggggctcttttttccatggctgggacgcagggagcagtatcaaggttgcacagggcagctggtccctgagcctggcctaggaaagcactcttcgcttttatgactctgggctggtgatgggaggggctgctgcaaatgtctctgaaataccttagcagcattttccccactgtctcggctattaacatttggctcatttttacttatgcaaatttctacagccaacttaaattcctgcccagaaaatttctcttttctaccacacggtcaggctgtacattttccaaactttccaaattctgtttcccttttaaatataagttccagtttcagatcatctctttgctcacatatatgagcatatgctgttagaagcagacaggatacatcttgaatgttttgctgcttagatatttcttctcccagataccataaatcatctctctcaagttcaaagttccacatttccctaaagaaggagcacaatgctgctagtctctttgctaaagcatagcaagagtgaccttcactccatttgccaagaagttcctcatctccatctgagacctcctcagtctggacttgactgtccatagcactatcagcatttaggttacaaccatttaacaagtctctaggaagttccaaacttacccgtatcttactatattcttatgagccctccaaactgtttcaacctctgtgtgttacactgttccaacgttgcttccacattttcagtcatctttatagccatgccccagtcgtaggtaccatttttccgtattagtttgttctcgtactgctataaagaactacctgagactgggtaccttagaaagaaaagaggtttaattggctcatagttccgcaggctctacaggacatatggcttgggaggcctcaggaaacttacaatcatggcagaaggggaagcaggcacatcttaaatggctggagcagaaggaagagagacaagagggaggtgctacacactgtttaacatccagatctcattgagaactcgctcattatcacaagaacagcaagagggatatctgccccactaggcccctcttctaacactggggattaaaataaacacgtgattcggatgggaacacaaatctaaacctatcagtgtttacattttttatttttattatttttattacaaagctcagctttccaatatactctgcttataaactgaaatttttaatattatttaaaatgtcaattctccctacagtgagccatagaatcaatgcctttccaaccaaaaaacaagatttttgtgaaactttaccatacatttctatggaaaagcaaaacggcaagaatattcaaactactcctgaagagggacaacaaagtgggatgtagcctaccatatatctgaacattctgtgatttttgtaatatagcagttcgctattaggacagtggtagaccagtgtaatgggacagagaggacagagacagatgccttcatttccataaggaaatggttgattattcaataaatggtgctgcgataattattttttcataacaaaaaagtgaaatcaaatttctgttttatactatacacaaaaatcaatttcaggtgaattatagatctaaatatgaaggtaaaatgacagagcttttggaaggtaacttttgagaatatctgtatgatctcggggtgtggaaaaatttcttaagcaggacacaaaagcataaaggcaaagactaataagttgtaccacattaaaattaagagcctttgtttatcaataggtacctttaaaagattaaaaggcaagccactgagtaggagaagacatgtgtgacacaaataacccagaaagaattaatatccataatatattttcaaaattttagtaatcaatatggaaaagacaacacagaagaaaaatagtcaaaagataccaacaggaaatttaccttagaagaaaatcacatgtgtattgaaggaatgaaaaattgttctacctcatcattaattagggaaatgcattagccgggcatggtggcacatgcctgtattcccagcaattcaggaggctgagacgggagtattgcttgagcccaggatgtcaaggttgcagtgtggtatgatcttaccactgcactccagcctgggtgacagagtgagaccctgtctcaaaataaataaataaataaataaataaataaataaataaataaataatcctttgaaaaataagggaaattcaaatgtaatccacaatgaggtatcattttataccagttgataaaaattttaaagtctaaaaatttcaaatgctgcataaaattagaattactgactcttacacacttgaagatacaaattccctactatccccagaaaatgttattgcttttagacactaattatatccaatatctagaacttagtctaataaactatgaacaaggcctctaccaagaacacttaaaacataattgtgagaacttaaaatgtaaatggaggtgtgttttaaagatgtttatttattagaagactcaatactgtaaagatgcaatatttgtccattttagtctgtaatttcaatgcaattctgattaaaatcctaacaagtaggggtgtatatgagtgtaaattgacaaactcatttttatatgtttttggaaagtcaaaggataataatagccaagaccatcttcaagacaaataagatgggagaatttactggtgatatggttaggctttttctcccatatccccaaatctcatcttgaattgtaatccctataatccccacgtgtcaaaggagagacctggtgggaggtgattggatcatgggggcggtatccttcaggctggtctcatgatagtaagtgagttctcatgagatctgatgatattataagtgtagttgtcttttccacacttgcacgctctctctctctctcgcctgccaccatgtaagacgtgtgtcttccccttctgccataattgtaagtttcctgaggtcactctagccatgtggaactgtgaatcaattaactcttttttctttagaaaatacccagtcttgggcagtactttataaccgtgtgagaacagactaatacaactggatattgagtcatcttataaagttaaaataataagacattgtgacattggtgcagtgataaataatggaacagaataggaaacccaaaaacacaccaacaggtatagttttccattttgattgttcctttcattagatgtttaaaactttataatgaatatgtacttttagtcaaaatttatttacttgagaagcaaagtgatgtatggattatggcctctgaggctataatgtgagtttgacccaaataatgatccaaatgtgagttccagtcccagttttgtcctatactactagctgtttgagcgtattcaactggtctgtggttcttagtttttttatctttaacacaagataataaaattacctctcagaattatggtgagaatttgacataacaagtataatcctgctggcacatgctgttcccttgatgaggggaatttgttattatgtttcttaggaacacaaaacttctgtttattcttggtaagaattcatgtttcccagatctatgtgtactatttgttatatttaaggttatcaaattgtatccttggtaatggttgccactggatcttttttggaatatgtacaactccttattcaaagtggctttctaatcatgattagttttttgtagttttggaagagccatattactgccctgcattcataaagcagtcttgtaaacactgattatgatagtgttttgaaaaattaaaagcctccaaaatcactaatttttaaaaaataatgcagttaaatatagaaaaggattagccatagatattttgtagttaaccctattatcattaacctaagtgaatagaacctaatttttgtacttgctaataattgctattaagaattttgttaatcgtgtgtggattggtgcttgagttcagaatgaatgattgataggggacaactctaagaaatacagcacttacattaatgttttattaaacagaaaaagctttaatgttttattaaacagattttaagagttacagtcttaaaatctttattatttattttatgaaatatttcattttgttttttttctgggcactttaaaattgagatgaggatggtagaatttgccagtttattttttggctattttttttttaacccatcttattttgagaacgaatttagtaatatttttctcaacatcctgaaattgtgtaacctgtagaaacttcccactgtctttttaaacttattcttaaataccacatttaatataggataaataagtcacaaagcttgcttatcaaaacagaatattgtattcagctttccatcggagcttttggggaagacatcacagtattgtactgtctcccaagatgcaaagtatcaggctttaaataatgaaaataagggaaatgccaatagaaaattagaaaaaatgttagaacagttaaaaacagcatactgaagcctgcattatttggcttatctaaaaatcatatgttttcaaccaatcagtacttatagtcattctatttaatcttttaagaaggagacataatccaccctcaccaagtgattcagtgtagcatcctaactaataatgacttaatgtgtgtccaaatggcatgtaatgagaagtatgaaacattgtctgtatactttcttgcctaagatacttaactgagtctaatcataaagttcagacatatcttcactgtggaacatttctacaagacaacggcctggactcttcaaaaatgccactgtcatgaaagacagtaaggagaatggaaggagactttcagattaagggagactaaagagacttaagcaaatgtagtattagatccttgactatatattagataatactacatcactgccacattttgtgcttatataggaaaatctccttggtcagtatgtatcataatagggtcataatgtctgcaacttattttccagtggtttgaggggaaaaaagacgtgtgtgtgtgtgtgtgtgtgtgtgtgtgtgtaaagaatatgttctaattgatacatatacgtaaatagcataggagtgttcatttgtactactctcaattttttctataggcttggtttcaagatgaaatttgaaaaaccttaagggaaaatatgtttaaagtatgataataacaaattagcacactagataaactttttatagcttttgtgagtttttttccttcagaaaatcatatttatgtagatagcaggattaaagaaaacttttctaaatttcagatgtcagaaatggagacatctaaattgtttttccatttcatctctaaatgctaatgaaaactggacttttacgacattaaagacatttaattgatctctgtgggatttcatgtttagcttttttcaacagctatatattgaacatttaggtgatgagattgagtagctaatcttagaggcgctctattgagattgtccagattccaaccctgatcccacaacttaccacctttgtgatcttggacaagtaatttgagatatctgtgcctcattctcctcaaatattcaacaggataataataatacataccagtttcttaggattgtagtaatgcttaaatgaattaatatatttggagcacttaggaaagagccaagtacatagtaattttctaaaaattatacctacttattatgtggatctttgctgaggaaatatgagtaagcatacaagactggacaggctttgagtagtgaagatgttttactcacaagcaaggtaattatgccttttatattaaaagaaagttcatatggaacactctgcttatatgcttcatcttcttttcaatcagataataagttctccaatgtagaagggaaatgtcagcctcacacataaaaatatacctgtcagagattatataagtgtcaaaataatactatctagagaaattcaggacatttggataaataaaggaatgtcatgtagtttggatagaacatagagaagtgaggaaaggagacattcccagatagaataacagctcaatgacttgaacaaggatacagatgcatgtagtatacacagtggactagaccatttatgtgtgtatgtacatatgtgaaaaaaagtctttgaaatgtttgcatttcaattaaattctgattttaagaacttattttccccctgtatcctgtgtgtgctagcattctgtttcctaaggcattctttcagacagacatacctagtcctgaaaatgctgctattattgttccagatacaaagcaggatgtcataattttttttttttactattccaactggaataatatggctcaacttaagttctgtacaaaactacttaatgataactcacaaaattaaaccaatttatattttctgcagttaaaatagaatgcacagatttttaaagacctaggacacattattatatctagttcctgaaatcattaaatgtccatggggaagaaaaaaacttgtgtaagtaggaataatataattggatttgcaatgctctcttaagagattctttaaaatcatgtgaaataagtagagtttctatgattttttaaaaatcacaaatagcatatatccgttttatctttaatagtgtttgagcccatcatttgaaagcattggagcatgtaaccaatatttctgaaaatgaaccatggttccagtcataatctatatgctttaaaattccttccctttattctttcttcccaaatccatgacatctgaatttcaataaggaagaaaataagcatgtttttaaaatgttttagaaaagattttcaaaattagattaaaatgtttgaggaaataaaaacttctttatgtattcattgtgatactgatttttatcaatgtctttttgtaaaaatacctatatactaactttgaataggtccaacatatggtaatgtgttatgcaattaatgataatgtagaacgatgttaaacccacagaatattgccaaggatttaccaacaaccaaaaatgtaattatatagaagaaaagtgtagttacaaatgcagtcttttgtctttttacattctctatatgtagagggtaacagaaatactgtatcactttttagtatatgttctcccagaataagttgccacaattagaacagagtttaggagcctatattaagctttactagttatggttatttccatagtgctagtaaataagagaaaaaaactttttgaacccatgtctcattgtaggtctcctaaaggaaagtggcccaaagtccaaatacttcaataccgttcgtctctgcctgataacaaagtgttttgtttttgtttttaccctcggacaagccagtcagctgatctttgtcctaatttgttcctggtagaattgaacaagatgtttgcagaagcttcctctagtttgaaaattgtattgattttttttccccatagtaactcacagatggcttctcaggttggaaataatggtgtccatgtttaggtaccacgtgttagatcagatttgtactcatggatctgtgattattttaactttttcttgttatttataaaaataattatgtacttctctctggggtttaatgtgtctttttattctcaaaaaatgtagtacattgatcagccacctaaaatactagccctatagaattctaatagttaggttttatatacagccatttgtcgattaaatattaaataccggatcagcttaaaatggacacacaaaaaaacactaccacataagctatacagtgccttttttcacagtgtcttataggtggaagatactcagtgagtgtttgttgagtgaataaaggatcttcacttggtgcatcccatttccttacaatttattattttttattttactttactttgagtcaggatctcactaggttgcccaagctggacttgaacttttagatccaagcaatcctcctgcgtcagcctctcaagcagctgggactacagggatatgtcactatgttcggctttaatttttattttattatgaaagttttcaagtagcaaaagcgatgtaatgaaccccatctacccattactgagattcaataattactaagattttgccacacttgctttatctagtctttaaagaaatttctccactgaatgatttactttaaaatacttgacctcctggccttttactctgtattttaaagaaagctgtagtaatttgtgacataaaccaatagagagcagctaaattttgttatatcttcatagcaattgactatattttggtttgtcttaccaataatttgatgaatgacctttcattttcaatttatctttggtaactaagtagataagtgggagtgtaggtttacttatttaaattctttgaatttgtgtgtgtgtgttgctttcccccccgatagaaactataaatggtagtgttattgtggttaggagtatggggctatggagttggggaaaacatgtatgaatctcagttctactactttaccttttgaatgtgggcaagacaagtctcagagttgttttagtttttttaattttaactttgaaataattgtagaaaaatagcaaaactagtttaatgaattcccatatgttaatatttaccacagctattgtatgtatgtatgtagagtttttttcctgagtcgtttgagagtaagttgcaaaaataatgcctctttaacctctaaatacttgaggtgtggttagtaaaaattcacgttttgttacataaccacagtatatttatccaaaacaggaaattaacatggataaagtattactgtcttatctagagatcttattcaaattttttcagttataccactaatacccttcatggcaaaagaaaaattattttattcttaggttgaatccaagatcacatgttacatttagttgtcatctctagaaactgctggtagtcctagctatttgggaggctgaggagggaggatcacttgagcccaagagttcgagtctgacctgggcaacataataagactctgtctcttaaaaaaaagaaagaaaagaaaagagacagaagaagaaaacagaataagctcatggactgttataaaggcaataaatgtgacataaaggatgctaaccaaaacagataaatagtaaaaggttaaataacagaggacttagctatttgcaagtactgacaaattttcatgattgggcaatgaatgatgtgacgttaacacatctgactttatctttcatgactttgatatttttgaaaagtataggctgcttattttgtagaatgtaccttaagttttttttatgtttccttatgattagatttaggttatgccttttcataaaatactatggatatgacctatccttcatgtaccatattaggaggtacatgatacctgttttatcctattgctgatgatgttaccctttgatcataacattatattttcaaatttctctaccataaagttaccattttccttttgtaatggatctcttgtgggaagatactctgagagtacctaactatcctatttctcattacatgttcacatgctagttttgacatccattcttcctagagacagttattactatggagattgccaaataatgatttgtttttcattccatcattttttctgcatttgttagttggctttcagcttcaatttttatatctgtaaaatgaacctaattgatgtaaaattggttaataacacccaaatcatgtagggtataagataatgcattttattttattttattttactttactgagacagagtctcagtctgtcacccaggctggagtgcagtgagtgacatgattatggctcattgcagccttgaactcctgggatcaagtgatcctcccacctcaggcctccctagtagttgagaccacaggtgtgcaccaacacacccagcatgtatgtgtgtgtgtgtgtatatacatatatatgtatatccacacatacatacatacacacatctttacatatatagacctcatctatatatatatatatatctcatctatatagaagagatatatatagagagatatatagatatagagagagatatagatatatagatatagatatagatatagatagacatagatatatatctcatctgtatatatatagatgaggtctccatatgttgcccaggttggtctcgaaatcctgggctcaagtgatccacccacctcagcctcccaaataatacattgatttgggacaattcttagcacataactctttaaaatattagatattataatttttattatgctagtatctacttttcagttgaagaaatagatcattttaaagatctttgaaaggtcataggaaatgttaaaaatatcaggtattttatgtgtacctaccatgaatgttttacctcatctttggtaaggtcagaagtgagatgatgtaacagccatcatatgtatgtgtattttttttattgacctgagacagtttttggttatttaatgcagaaaatatatttgcagtgtacttcatatgatatgcagtactttaaatacttgttgtaatgtggtcatttaataggagagaaacttagagacatggtaaattaagttttgatttagtatactgaatgatgaaatagaattatttatggtcattttaattctttaaaagtttttaaattagtattttaaaataatatatgtacacagtttactgattttgtccttaagggtatactgtggaaaagagcaataccctgccctgtactttgacagcccttttagctatttcttcttttacctacctccatatttttaatcacctcacctatccaggttagatattatgtacttaccaacttcctactatgataagataaatatttgtctctcttatatacatacattctgtcctctcctcctctccagttctccagtagagtttttgataaatcagttttcagcataaataatattatacagatgtatgtattatttatttctgagacaaattatattctatggtgttttacaacttttagtttctcctagagtttagaattcccttatctttttgtttccttaggtttctttatacctgtggtgacttccatacacatatcttccaatagcttctcacatttattttgtgcatagttaaaaatgtgagttttaatttgtaaaggtaattataaatcatgtgctctgaaagctttgtttttcttatttttttctttctctctctttttttgtttttgagatatagtctcactctgttgcccaggctggagtgcagtggcatgatctcagctcactgcaacctctgcctcccgggctcaagcgattctcctgcctcagcctcccaaatagctaggattacaggggtgagccaccacacccggccaagttcttttgatggctcacatccttcattaactttctgagaaaaaatacaagggagataaatattttgagaaccaaagtgtctcaaagtatctctgtttactcactctggattaatatatgggctccatgtggaattctagtgagaaaatttattttctttagactcttgaaaccattgctctattatattctaaacttacatattgtttttgagaggtctggttcttttttttcctaagcctttatatatgatctgccttttctctagaagcatttatgatctgtctctggttttctaaagtttcatgataaataataatgatgtagatctcttcattaattcattatattaatacattattccctataaatttagacaataagtcagttctgtgaatttttaaatgaaattttacttcctgggttgatcctctatttttcattttttctttctttttgatttttttttccttttttttctctttcattgaagttgagctttttgcatactcttctcaagtgtctggtaatgctggtagtgcatttatatttaagagtgatgcactagacaatgtacaaaatgagacctttcaacttccttagggtatttgagtaaaagacagctttttcataggggaagtaatttacatgcaccttctccagggctatttaatttctccaaggaaaaatggattctctaattttctttttgggtgaacttaagcctaagtactggtcaggaaaagggtcagaagggctatttggtatgtaagtgttcacataaccagcccagcctgttcttagttcagcacttcacccatttccctatcttcctttgtgcttggagttcctgagtctgaagcctttccagttctttcctagcctaccttccctccattattctgcagaggtaggaaaaggacacttgtcaggctatatgaggtgggaatggggtctgaaagttctgctgttaattatctccctattttcagctctactagttacctggtaccaccattttctgaattttccaaggtttggagggtgaatcagcttgatttttgttggaatctcctcttagtaggcttttatactttagctttcttccccctgctaatctaattaccttttctccatatactgtctgacctcagaaattgtaatccaggattatcagtatcttctagtttttttactaatatggttagttgtaatttttcattattgtcttgagatgatttttgataggagaatgtgcagaaatgtttatattttggcatcagaaatatcacctttggagggggcgagggggtcttacctaggctggagtgcagtaatgcagtcacagctcacttcagcctctacctcctgggctcaagcaatcctcctgcctcagcctttcaagtaacttggactacaggcatgtgccactgctatggttttgctctgtgtccccacccaaatctcaccttgaattgtaataatctccacatgtcaagggtgggaccaggtggaggtaattgaatcatgggggtggtttcctccatgctgttctcatgataattaatgaatctcacaagatcagatggtttaataagcatctggcatttccgctgcttgcattcattctctctcctgccaccttgtgaagaggtaccttccgccatgattgtaagtttcctgaggcttccagccatgctgaaccatgagttgattaaacttcttttctttataaattacccagtctcaggtattccttcacagcagtgtgagaatggacgaatacagccaccatgccacactatgtttttaatttttttgtagacacagaatcttgctgtgttgcccaggctggtctcaaactccttggctcaagtgatcctcttgcttccacctcccatagtgctaggattataggcgtgaaccaccatgcctagccagaaatactatcttaaaatcaactctgcataattcactgacccatcattaaaatttgtcagtacttaaaaatagctaagtcctctattattttatttaaccttttactgtgtagtttatttgttttggttggtatcatttaagcctcatttattgcctttacagcagtccaaacagaacctattctgttttctttctcctcctctctcattttttttctcttttttaagagacagagtcttacagtgttgcccaggttggactcaaatgcttgggctaaagtgatcctccctgctcagcctcccaagtagcagagactacagggactacgggcgccaccttgcctagctccccctctctcttatcttctttaccctagttaaattatttctgctttgtcccaaaaaataatatttgtacattactctccacatggctttatggtggagtaagggtgatgcttgagtgtaagaagttttacactgggatgtggtacttttccttttttcacttatagttgttttgaagtttgggcattctttttgtcttcaaattgtgctgaaggcatggtgtttttgtagatttatttttctgtccttgttctatattcttttggagagaaacagggcttaggtggcaaccattgcttcagctgtctggaattcctcaatttattttaactttatataccatcttttctcccacctctctcttcattataagcagactcattcattcacagtatgtttagtgagtgctatgtgccaggcatggttctagggatatggtaatgaacaaatgtctttgccctcataaatattatattctggtggtagagacaaagaataaaacaaaaaagtgaatatatactataatgttaggtagtgattaatgctatgttttaaaaaaataaacaagatgagtgcagtggtacactcctgtagtcccagctgcttgggaggcagagacaggatggtcacttgagcccaggagtttgagtagccactgcacgtcagcctgagcaataaaacaagactgtgtctctaaaagtatagatatatcaatcaagaacctggggaagttctagtgctacctacaagagttgaggaagaccttttcttttttttttttcttttttttgagacggagtctcactctgtcacccaggccggagtgcaatggcccgatctcggctcactgcaagctccgcctcccgggttcatgccattctcctgcctcagcctccccagtagctgggactacaggcacctgccaccacgcccggctaattttttgtatttttagtagggatgggatttcaccgtgttagccaggatggtgttgatctcctgacctcatgatccacttgcctcagcctcccaaagtgctggaattacaggcatgagccactgcgcctggccaaggaagacctctttgaaaaagtgttacattagcaaattttgttttgttatagaatagtaagtacatctttttatattagcatttaccttatgtaaatcattaagattttaccactgatcaggtttccatgataaattgtttaattttaaaacttctgtagtagaatgggcatgtggtgttatggaattcataccaaataagaagaattttacagaaagtaaaaccataagctgtctactattcaactcttctcattctgctttagagaactgctattgataaaagattatttgagaaacatataatctatccttttctctaataactctacactttattttttatttttattatactttaagttttagggtacatgtgcacaacgtgcaggttagttacatatgtatacatgtgccatattggtgtgctgcacccattaacttgtcatttaacattaggtttatctcctaatgctatccctctccccttcccccagcccacaacaggccttgtgtgtgttgttccccttcctgtgtccatgtgttctcattgttcaattcccacctatgagtgagaacatgtacactattcacaatagcaaagacttggaaccaacccaaatgtccaacaatgatagactggattaagaaaatgtggcacatatacaccatggaatactatgcagccataaaaaatgatgtgttcatgtcctttgtagggacatggatgaagctggaaaccatcattctcagtaaactatcacaaggacaaaaaactctacattttatgcttggactatcagaaaaactgtttacttgaaaacagtttacagaaaaactctttaccctgacatgtattgatttgttgctttgtgttttttgagacagggtcccactctgtcacccaggctggattgcagtggtatgatcatagctcactgcaacctcaaactctggggctcaagcaatcctcctacctcagcctccctagtagttgggactacaggcgtgtgccatcacacctggctaaattctgagttgttttttatattgaagccttaatctttcattgaggaataccacaataaacagactgagcttgctgttgagaagttgttgaggacaacatagtcttctgtattaatgtttaacatattaaagaccctatgaaaagtttattttagaatcacgtgtttcttataagaaagtgacatttttggccgggcacaatggctcacgcctgtaatcccagcactttgggaggccgaggcgggtggatcacgaggtcaggagatcgagaccatcctggctgaagcggtgaaaccccatctctactaaaaatacaaaaaattagccaggcgtggtggcgggcgcctgtagtcccagctgctcaggaggctgaggcaggagaatggcgtgaacccgggaggcggagcttgcagtgagcagagatcgcgccactgcactccagcctgggcgacagagcgagactccatctcaaaaaaaaaaaagtgacatttttatctcttcaagcatgaaaagtagataactaggcatgtcttactttttgctttcactgtcaagaaattggaaacaaattcagagctaattcaagacgcctctgccatgtatttctttttctccccaatcttatactgttctgttttctctgatcattttttttaggttgtctcactaattatggaacaatggcagggatgtgtatgaaagagtgagcaggtagataagtcaatagatgaatgctgttgcctcctcaaatcattagttgtatgagcttgggtgagttaaacaacctttctgcactgttaatttcatctgcaaaatgagaggattaatagatcaaatatttgtagctgcagaactctgttttcatgggaaataatttggaagcccgaaatagaagccaagtagtagcagaactgttgtgtcaggccagtgccatagtggccgggaaactaagcctcattttttatccagatcatattagaactgcctcttggaacaaagaaacactacctctagtgtttctgcaatacagtgttctgtattacagccttgactactctactttttcccccactccagtcaagttttacattttgtagtaggcctcctttttgccatcttcgtgaagattctgaattttcctggatggataaaaatcataaggataataaatggatatttcagtgtttttttagtcagtggtttgcaaaaccacctggagggcttgggaaaacacaggttgctgtgtcctacccacacaggtttctgattcagtaagtctggggtatgaccaagatattgcattttgagcaactttccgagtgattcagaaattatactttgagaactactatcctatgtgagtattaaaaatgtattttagtcacttttcttattttaaaaattacatcaaatcatataacttcataaagctcagaaaacaatgtctgagtaatatatggtttttgaaaaataacatttaagtgacatattccgatgtcatggagcaagtgagaaactggtttgaaatgtttgctatctagtgtcaagggctatctatccctttttgacttcttgtgctactggtgcaaatggatagatattaatcctgcagcaatcaggatttgcttcagcaataaagaaattattgatgtctgaaagcaatcctttccttttgacatgttggcagcacctaagaagaaaatgtcagggtcaatataagtgcatttactgacagtttggctctttcctatgttacagaaaatgatttcacatttagcttttatcaaaaacagaaacactgaccactctgaaggatataaacaatagctttcagcttagtcattttccacttataaagtgatactttcatagaaataaacaatgcaaacttcagagagccaaaacaattacacagaaaaaaatcattgcatttttgccatttttaactcagatttaaaacaactgtgtctggtagtaactggagaaaaatcactgttttgtgttctgttaagttaaaacagttaaaatcactttatgataaaatatggccaaaaagaagaatcatcttcaattaggtacttcaagatcacttgtattctctgcttctctttcagagcctgatccatgtatttcttaaacttcttcatcatatataaaatttcgtgtttataaaatttccactaaaacctcaattattagtttcatgaatcagaagttacaattagtttcatttctggctcaccaagatttgtcaatttctggataaaagggactccctattcagaatatccctttaaatcttttttaaaagtgcacctttgatgtgtacatgtttttatgttatttatggcttctgaaaatattatgcaaaaaaattgttatggaaacaacccaaatgtccacaagcaggaagatacattgtgatagatccatacaatggaatatcattcgttcataaaaaagaataaagtactgatgcatgatagaatgtgagtgaacctcaatatcaagaaaatggacgaagccagacataaaggatcacatattgtatgattccatttatatgaagtatccataataggtaaatccacagaaacaaaagcagattggtagttgccagggacttgtggggagtgaggaatggggaataactttttaatgggaagatagggtttcttcttggggtgctaaaaatgttgagaagtagatagaggtcatggttgcacaacactgtgaatataattttatgtgaattttacctcaattttttaaagaaatcagttgatttaagacttaactgaattctagaatttttgaaatgaaggtgtttctcaaggtcatccaacccaatctcctgtttttcacaaatgaaaaaactaaaactcatcaagattaaatactatatatcactaagattgcctagtagctagtccaaacccaggccagaatttgagtatctggatttttagcccagtgatttctttttaaactactgcatgctgctttattatcaattgctattttttttaaatttttttctgggaacatactacaagtgttagtttaaaagtaaactaacataaaagtaaatacaaaaagaagcatagcttcctttgtgccacatataagaaatgtagacatagagagtgtttattgcagtaatttgccaaaaagcaagccatagtttaaattagaagaggtttattccctgcagcactttcacaatcacagaaggcacctatattttaaatgtagtctacattggcctggcttatgaactgcaaccttctatgattgcaattcacttttttaaattaaaaaaaatttcaaaataatttttgcataattattagcacattctaccacttgataattttttgtttctttcaatagacgaaagcactcacattgtaaaaaaattatataaatgaccttgtcttgtgatgaagctagaagatctgttttcaacgaaactattctcagaggcatctagggagaaacatttgagtcaggttgggagttagagatagaaagcagcagcaattaaagcaagataatgtattaccccctggaaattgggtgttatactcaaatgtaaaggacttgtattgatttagtgctagcctcagaaaatagtcagatgtcctcattttaagggaaaactttaggaaatgtaattatatcgtttctttctctctaaatctgccttagttttcaatttctttatgtagttcgttactaagaggaagctacactctcattaccacactaaatggattttctattaatatttatctccaatgttatttttatctgggttgttgttttcatttctacttagtatgtattttcttctttccttttagttcagaggtcaacaaagtatggcctatgagccatacgctacaatagcagagttgagtggttgcaacagataccatgtggcctgcaaacctaaaatatttattggggcattttacagaaaacacttgccagtccttgctttagttgaccaagtagaaaaggaagagcagattctacagagtgaataaatatcaccagcaaaggaaaggatatagaaaggtacaggatttatacttaggctagctagaaactccatatggtcaaagtaagagttttgtggatgtgagtcatcagagattatataggaaagatagattactgtcagatttagaggatttttaatgccacttcaggaacttgagctactattgtttaggaaatgagtcatttaaggttttttgaacaaaggagctttgccagagcaggaaagtgttgcagtagggtttacaaagtaatgagagttatcaactaaagttatattaataggaaggatgacatagttccaggagttgctgtataattaaaattgataggaccttagacactgcattttgagacaaagagataatagtttaaagattaaaacttcattgggcagaaaaattattatttatacacatattagggaagtaaagagctaatttttgtggaaggtttaagttgatggagaaggattataacactacataggataagaaacaaaactgattactagttatcagcattactgaagttgttcactcatcccaggcacaggcaattttttactcgccatattttatctccagggcacccagctgccatcatcttgtcagggtccatctctttataaaatcctcttactttgctctccagaatcccaccctgatacacagatttacttacgctacctcatacagaataaagtacttccattttccaagtactctgaaccatgctcaagaagggctttagctctctcaaataaaaagacttatctcaaggtgtttaattcaagtagagccacagttccgaaactgtgcactgacaccccagggtactgcagcagactcacaagagtgctacaggatattttatatcggtttcaaaattaaattttgctacattccttttggatgatgtctttttaaaaaataattactgttgttgttttttttttaatatgtacctcctgaaaaatcaatgcagaatgggaaatgaaggtagcagtatccacttggaatacaaggcttgaagagtgtgcagtattccataagcatacatattcatttagtaaatacagttaacccttgaacagtgccgggggttagaggcactcccctcccccgggtagttgaaaatccatgtataacttttgactccccagaaactttactaagagcctactgttgaccagaagccttacctgtaacattaatcattgatgaacatgtattttgtatattatatgtattatacagtgtatttttgtaacacagtaagctagagaaaagaaaatcataaggaaaatatattcattgatatggtttggctctgcttccccactcaaatctcatctcgaattttaatccccataatctccacatgttaagggagggacctgttaggaggtcattagatcatgggggccatttcccccatgctgttcttgtgatagtgagttctcgtggaacctgttagttttataagtgtttgacagttcctctctcatgtgccctctctcgcctgctgccatgtatgacatgcctgcttccccttctgccatgattgtgtttcctgaggcctccccagccatgcagaactgtgagtcaattaaacctcttttctttataaattagtcagtcttgggcagttctttataggagtgtgaaaacggactaatacatttattgttcattaagtggaggtggatcatcataaacatcttcatcctagtagtcttcacactgagcaggctgaagaggagggtggggaagagctggtcttcctgtctcaggggtagcaggggtggaaatgatgaaggaggtggaaaggatggcagaagaggtaggcatactcagtgtaactttacagaaatacgttgtaatttctgtcttatttttcatttccctaaaaatgttactctaaaaatgtttctatatggcacctatccttccaccttttgcttttggttcagtgcccatatcatagaagggtccatgttgtaaaagaagtcaaaagcagtcttttgaataactggaatcattctgttatatggtctaatatgaatttgtttctggcactacttattctacatcttctttctcatcatctggcactgatttggaagcactcatctccatcaagtcatcttctgttaattcctgtgatatggtgtctgttagctcttgaattactccaagatccgtatcttgaaactcttcaacttccccccacttttttttttttttttttgccatatccacagtctcttttatgatatccttgattgactctgttgtaaatcctatgaagtcatatacaccattggacacagtttttctctagcatcaatttatttttttgggcttgatggctttcatggctacttttgtaacaatggcgttttccatgatttgattctttcagatatccttggtgttctctaagttgaggtctacttccatagcattgacaatcttttctatagattaccatgtgtaatgatctttaaaggtccttatgaccccctaatctagatctgaattagagatattgtgtttgatggcaagtagaccactttgacacctttgttgttgaactcctggtgtgggtgacccggggcattgttcaatatctaaagaaatttaaaagacagttccttactgacaaggtacttctttgtcagcagaagttacttctcctcttatccattttttgaagccaaacctctttctaaaaatgtcaagccatcctttgctgacattaaattctccagctttaaatccttcaccttccttttgctttaagttgtcatataatgacttcaagtcttactagagtatgcctttcttatagcaattctgtactcacattgtattttaaatataagataaaaagatattttacagaaacttcaaggttttcatgcctgctgtcgtagctgcagtgatggctccacaaagtcctcccccaaccacaatggtccttacactggattcatctatcttgaaatggtgggcaaccacagctgcagacctcaatctacggtacatatcaagcaagtcagcttttttttgtaatgatttttctctgcttcttgggagcacttccagcatcactagtgacatttcatatgggtcccatggtgatgttcaagatttacagtattgcactaaacatgatgaaaaataattcaagaaccatgagagatcactttttattgcaatatgcaatttactgtaagatgtagggttcactcagagatgattagcatcagatgtcattttcaatggatacaacacttgagctcactgcaaaagcaacaggtggtagttacaacgttgttacaatagtacagtatttactgcagttcattttatgcagttaggatttaatactgaatttttacatttgtttacatttctcttgactcaaatgctgccgtgtatggtctgtaagtgtttgcctgtgtaagttttgatagattttaactttttataatacatttttatagttttatgatagtgataaaatagtatctacatatactttatgagttcatgacatacttaacaatttttatcaatatttctaggctacacagtttgtctgtagagtatttcaaactatcacaaatttccaaaaaattttctgatatacttcttgaaaaaatttttacacacaagtggatccatgcagttcaaacccaagttgtacaagggtcaactgtattgtagttattttttaatgagattttaaaaacttttttcaatttatatgtatttttcttaactgagtattaaattctgaagctagtacttattaaattgtttggacttaacattaaacaggactgttaggcatttgttagcataccatgaaaaaatgaaaaaaataacaaaaacactaaaaacactgtaaactgggaaagtttcagattctctgaatttgagagagttgttcaactctaaaatgaatgcattcttccataagcatgtgaaaaggcagcagtctttcttttttctctttttttcaaaattgctttctagactgggcacagtggctcacacttgtaatcccagcattttgggaggctgaggtggacagatcgcttgagcccaggagtttgagaccagcctgggcaacatggtaaaaccccatctctacaaaacatccaaaaattaaccaggtgtggtggtgcacacctgtagtctcagcttctgtggaggctgtgaggtgggagaatcgcttgagcccaggaggcagaggttgcagtgagccgagatcgtgccactccactccagcctggtgacagtgaaatcccctctcaaaaaaaaacaaaaaaacaaatttgaaaacacattctagtgacatgggattttgtgtagcatcttaacaaaaatgtaatcacatatttaaaaattttctgtgctttttgctgtatcaaacaaaaaaagtaagaagtgctcttccctttaaggttatggtcaggtcagagtggtaagacaaatacaagttgcttatatcattaagtaaaataaaataattaccctcatttatttcataatatcacatattatgggcattcaaagaagaatgtgtacatctgttagtgggaatgaagaaagaatttgttagattttaaatgggcattgacatgttggtaaattctaacatgtagaggtagtggacatttcagatagaaggaaaaacataaaaactcaagatttattttgggagaagcaaattattctatatgactgaagcaaggacatatgttatgaagtaatgtagattacagctggtttactataagttggagtactatcgtggagcactttgaatgctggggtgtgaggcatttggattcaatttactaggaaaagaagagtgattagggtgattaatctgtcagcaagatataggatgattaaatcaaggagagaaaggaggcagggatagctttttaaaagggaatgatggattttgctttatgtatatgtatttcaaaggaaacaccaaactgttgatctttaaagagcatacttttgttcagcactgtaactaacagttgtaacataaaactcacttttctgatgggaggcagaagactttctaactttcttgttatttctagaggaataatatcaatacaatgtaaatatgtatggaatgcatactataggccaagaactatattaagcatttatttaattctcacaacccttgagagacattattattcccattttacaggtgagaacagtaaagcctagtaaagttaatgttgtccagagtcacatagttaataagtagacagattagcaaaaatttttaaaataagtttactagttggtttaaactaaggagaattgagttaattctccttgggtcttatcaaattatcttcatctgacttaggcatagtttctctctttttttatttttcatatcactcctgatctcttcccaccatgggtactcttaatgtgtttgatatggctcttacatttggatgtgtcctttaagactgtattgtgttattttagatgcatgcatatgtgtttaaattatacataatatataaaagggtaaattatagcttgtctgatttgatatatatgtttctactctattgcttttatatttttattttataagaaacacacatttttattttataagaaacaaggtcttgctattaatatgttaccaagaccagaatgcagtagttattcacaggtgtgatcattgtgcagatagccttgaactcctggcctcaccctatcctcccacttgagcctcctaaatagctggaactacaggtgcatgcagctgggcctggcttagtttactgcttttttaaaaataatttacaaataataattgtacatattcatggaatacattatgatttttttttttttttgagacggagtctcactctgtcgccaggttggagtgcagtggcgcgatctcgcctcactgcaacctccaccccctgggttcaagcgattctcctgcctcagcttcctgagtagctgggactacaggtgtgcaccaccatacctagctaatgtttgtatttttagtagagatggggtttcaccatgttggccgggatgatctcgatctcttgacctcttcatatgcctgcctcagcctcccaaagtgctgggattacaggcgtaagccaccgtgcccggcccataatgatgttttgatacctgtaatgtatagtaatcagacagggataaatagcatatccatcatctcaaacatttatcatttctttgtgttaagaacatttaatatcctccatctacctatttaaactatttaatatatttttgttaactaaatagtcatcctgcagaggtatagaattctataacttactcttatctagttgtaattttggtatcctttaacaaatttttccctatccttcctttccccctactttcccagcctccaatatcctctgttctaccttttacttctataagatcaacttttttttatcttctacttatgagtgaaaacataccatgtttaactttctgttcctaacatttcacttaacataatgtcctccagttttatctatgttgccatgaaccacaggattttatgcttttttatggctgaatggtttttctttgtgtatacattacacattttctttatccattcatttgttgttggacacctaggtttgttccatatcttggctattgtggatagtgctgcaataagcataggggtacacatgtcccttaaatataatgatttccattcctttggataaattcctagtagtaggattgctggatcatgtagtagttctacttgtggtttttaggaaactccaactattctccatagtggctattcccaccaacaatgtattaagagttcccttttctccatcctcaccaacatttttttttctttttgataatagccatcctaactggggtgagatgatacctcattgtggttttgatctgcatttctctgatgattagtgatgttgggcactttttcatatatttgttggccatttgtatctcttttgagaaatgtctgttcagatcatttacctattttttaataagattggttttttgctattgagatgtttgagttccttgtatattcttagtattaatcccctatctgatgttatgaatagtttgcaaatattttttcccattctgtaggttgtcttttcactctattgattgtttcctttgctgtgctaaagattttcagtttgatataatctcatttgtttatttttacttttgttgcttgtgcttttgaagttgtattcataaaatatttttccagatcaatgtcctaaagcatttcacctgtgttttcttctaggagggttatccttttaggtcatatatttagttctttgatcatttttttgagacagggtcttgctgtgtcacccaggctgcagtgcagtggtgcgataatgactcactgcagccttgacctcctaggctaaggcagttctcccgcctcagccagctgagtagctgggactacaagcatatgccaccatgcctggctaatttttatattttttgtagagatagggtttcaccatgttgtcgaggctgatctcaaactcctgggctcaagagatccacctgccttgacctcccaagatgttgggatcacaggtgtgagccaccatgcccagcctctttgatccactttgagttgatttttgcatgcagtgagaggtagaagtgtagtttcattcttctgcatatggctatccagtttgctcaggaccatttattgaacagactattcattccccaatgacaattcttggcacttttgtcaaaaatcattttgctgtagataatgtggataaatttctgggttctctatgcctttccattggtctatatgtctgtttttatgctggtaccatgctgtttgtgttattatagctttgtgatatattttgaggtctgatagtgtggtacctccagctttgttctttttactcaggattgcttcagctattcagggttttctatgtttccatacaaattttagaatttttttccatttctgtgaaaagtgtcattggtagtttgatagggattgcactgaatctatagatgtctttccatttatttgtatgcacttcaatttctttcatcagtgttttgtaatcttccttgtagaggtcttttatcaccttggttcagtttgttcccaagattttattttcttttctagctattgtaaatgaggttgcctttttgaattcttgttcaactactttgttgtttatgtacagaaacactactgatttttgtgtgttgattttatatcctgcaactttatggaattcatttatcagttctaagagttttttggtagagtctttaggctttttaatatgtagaatcattacatatgcaaatagggacaatttaacttccttcttctcaattttgatatggtttatttctttctcttgcctaattgctgtggctagtacttccagtactatgttgaataagagtggtgagagagggcatcattgtctgttccagttcttagaggaaatgctttcaggtttcagtaagatgctagctgtgagtttgtcatgttgaggtaatttcaacatgttattatgttgaggtactttccttctatacctaatttattaagagtttttatgaaggaatattaaattttatcaaaagcattttctgcttttcattgagatgatcatatgatttttgtccttcattctattgataggatataagacattcattcagtgacatatggtggaccatctttgcattcttgggataatcctcacttgctcataatctttttgagacactgttgggttcagtttgctagtattttgttgtggacttttgcatgtatgttcatcagggatattggcctatcattttctttttttgttttgtccttatctgtttttggtatcacggttatgttggcttcatagaatcaattaggaagtatttcctctgcttcatttttggaataatttgggacaaattggttttaattcaacagtgaagccatccagttctggactttttttttttttttttggtgttggaagactttttgttattaaatcaatcttgtttcttgtcattggtctgtttaggctttctatttcttctttcagtcttggtaggttttacgtatccaggaatgtgtccatttcctctaggttttcaaatttgttggcatatagttgttcacggtagtctctagtgatcctttgtatttctgtagtatcttttgtgatgtctccttttttgtttcctattttaattatttagatcttctctcttttttcttattctagctaatggtttgtcaattttgtttagaagccagctttttgttttgttgatcttttgtattttttttgtcttatttttgtttatttctacactgatcattattatttctttccttccattaattttgggtttagtttattcttttctagttctttgaggtttatcatcaagttgtttacttgaaatctttcttgttttttgatataagcatttattcctataaacttgactctgaatactgtttttgctgtgtcccataggttttggtatgttgtgtttctgttttcctttgtgtcaaagaatttttaaattttattcttaatttctttctttatccattggtcattcaggagcatattgtttaattttcatgtaatggtatatttctaaatgattctcttgttatagatatctaagtttacgccattgtgttcagataagtacttgatattttgatcctttaagaatattttgagacttctattgtgtccttacacacgattgatcctgagactgttgaatgggctgatgaaaagaatgtgtattctgccactgttggctgaaatgttctataaatatctgttgtatttagtctatggtgcagtttaactctgatgtttctttgttgactttttgtctacataatctgcccagtgttgagagtgggatgttgaagtccccaactgttatttcactttagatctaataatatttgctttacatatctgggtgcttcagtattgggtgcatatatatttacagttgttatattctcttgttggatcaatccttttataattatatagtagccctctgtcttcttttacagcttttgacttgaagagtgttttacctcgtataattatagctattcctgtttgcttttagtttccatttgcactgaatattttttccatccacttccagtctgtgtgtgtatacaggtgatacaagtttcttgtagatagcatataattgggtcttgtttttttaaaatccattcagctagtatgtatcttttaaatgtggaacttaatctatttacaatcgtgttattattgataggtgaggacttactcctgtcattttattgattgttttctggtggtttgtatatcctttgttcattactttctctcagtgttatttttgcagttgaatggttttctctagtgaaaaggtttgattcctttctccttctcctttgtacagcagctctatcagtgtgttttatagtttcacatattttcatgatggtgattattgtttttcatttccacatgtaagacccccttgagcatttcttgcaaggccagactagtggtgatggattcccttagttttgctagtctgtgaaatattttatttgtcctttatttctgaaggttagctttgctgggcgtattcttgggctaataatttttttcttctagtactttgactatattatcctgtcctctcctggactataggatttctgctgagaaattcactgttagtctaatggggattcccttatatgacttgatgcttttatcttgctgcttttagaattctttctttgtctttgacttttgacaatttaactgtaatgtgccttgcagaggtcctgtttgaggtgaatatatttgagctttctcgacttggatgtctctctgtctttctgttattatttcattaaatatgtttttctcacctttcccttcaccttctggagatatttatttgcttaatggtatcccataaatcctttaggctttttcattctctttttttttttaaagttagtctgcctgtgttatttcaaaagatcattcttcaagttcagaaattcttcttcttggtctagtctgttgtttagctctttattgtattttttatttcattcattaaattcttcagctctaggatttctgcttcattcttttttatgatatctgtctttgttgaatttctctttcaaatcataaactcttctcctgactttgttgagttatctatcggtattctcttgtatcttattggatttctttaagattattattttgatttttttcccacatttcatatatttccttatagtttggagtctgttactagataattattgttttccttttgacattacatgttttcttgctttttttccttcttcttcttttaagacaagttctcattctgttgcccaggctggagtgcagtggcacaatctcggctcactgcagcctctacctcgtatgctcgagtgatcctcccacctcaactccccaagtagctggaactacagacactcaccaatatgccctgctaatttttgtggtttttagtagagacagggtttcaccatgttgcccaggctttttcttgctttttcacggttgatgtgtccctgtgttgatttctatgcatctggtggaaaagtcacctcttttaattttatggaatagatttcataagaaagaatacgaatgagtcttgggttgttggtttggtggggtacattagccttatttctagatacagttttgtagtctctgagtaatttcttcagctgtaatccactctagtggcatttgtgagtttctcagtggcatgggctgagagagtttgtggcaatggtgatgccactttgccaggggtgggctcactagactgtttctcaggtctggggtatgtatgtgcacatagtaggtcagccaacttggttggtgagattggcttactgagactggggccacaaggctgttactctgaccagaaatacaagtataaggttgcttgggcaacctggggacatgcctgccaggagcagctttcaggtcggggacgtgggcttttggccacttggctggcttggagatattccctgtggcacgggggcagtctgcgggactatctctcaggccattattgggggtaaaggactgttgggcaggccaagggcgtgcctatgggggacctgtgtgtctgtttctcaggttctgattgcttgcaggtagccctactctgctggccctgggccatatcaccttctcagaggctcagggaggtctcctgcttagagaagggagcccagcagtttggccagcttaagagcaggcttgctgtgggtaggactggcagactggtttctctgttggtggtatggccatggttcttggttttcttgctgtgcaagaccagaataacagccagtccagggtccagccttcaccagcttggatcatggtgttcagaaacttgtttggagttggcataatgaagatggagccccagttctggagaggtgcagtggccactttccccccagaggagggcatactacacaggtggctattctcaagatgacgccatgttacagcagtttggctcacagtggtgggatggggagtacacaccttgtgctcttaatccaggtcagtgcgtctgcatgaattcctggcagctctccaaaatgggctcagggcttgtgaggactatgggattcttgtgtagtaaggccttcatgtgtttgtggtggcaaagaggctggtagggatcttctgctgacttttttccctgcaatagcaattccctcccgtctccaggcagatctgatctaggtggggaagatgggaccacgagtttgagtgcctctatgctgccttcctagatttccaatcaccacaggtgcatcttcattctatcagtgcaccccactactcttccttcacactccagtcaaatcttagctgtttgtttgttgccttgatcctttttttgtgtgtgggttagacaagcaccaggtatccctactcagccatcttgctgatgttactcctttattgcttttcttttcttttcttttctttttttttttttgagatggagtcgcgccctgttgcccaggctggagtgcaatggtgtgatctcagatcactgcaacctccacctccttggttcaagcgaccaagtagcctcagcctcccaagtagctgggactacaggcacccaccaccacacccaactaatttttgtatttttggtagagacgggagctcaccatgttggccaggctggttttgaactcctgacctcaagtgatccgcctgcctcagcctcccaaagtgctgggattataggctggagccactgtgcccaactcctttattgcttttaatctctgcatagtagtgtgtgtattagtctgttttcatgctgctgataaaggcatacctgagactgggaagaaaaagaggtttaattggacttacaggtccacatggcttgggaggcctcagaatcatggtgggaggcaaaaacagaaacccctgagaaaaccgtcagatctcgtgagatttattcactaccacgagaacagcatgagggaaaccaccctcatgattcaaattatctcccaccagtctctcccacaacacgtgggagcacaattaaagatgagatttgggtgggaacacagagccaaaccatatcagtgtgcattcaccacattctcatcttttcccctagaaatagacttctaggatttctcacactttatgttcaacagagctatataaatatgctcctatgtattcccttaaagcccatcttctttctactatatctttttcctcattttacttccttttttgagggagttatgtgggatagaagaaaaatggacttcttcatttataacatacctgaagttgggagtattttaatccttaaacagattaaaatgagctgggtgtggtggctcacacctgtaaccccagcactttaggaggctgagggaggcgtatggcttgagctcagtagttggaaaccagactgggcaacatgacaaaatcctgtttctactaaaaatacaaaaactagctgggcgtcgtggtgcatgcctgtagtcccagctacttaggaggcagaggtgggaggatcacctgagcccaggaggtcgagggtgcactgagctgtgattgcaccactgcactctagtctaggcaactgggcgagtctctgtctcaaaaaaaaaaaaaaaagagtaaaagatatgcagactatgtgattttctgcttccaaaaggaaccacatagacaggaagaagatccaagtgaattattctcttctatttctttacattgccttctgtcattggtaacataacctttatggcattcacaagtatatttgttctagctttcttcttttagtaattctgttgctgtcgtttgtgtgaaatactgcatattataacattgtaattataaatgatttatacattatcttaatcgttgtcagggccaacgtttttcttacaagcagataggaactatgctttgttgtaactcatatttgatcgactctgagaacaaaatgtattttatactttcttggagtagtcccacaaaacatgtaggacccattaagaggaagaaagcatgctatatggttgttatatttgttatttttgacttgtaatttattcattctctcagccctgttctctgactagtgttactatggcacctaagttatggcatggaaaacaagctaattatgttcttcagaacagacgacagtgatacatcttgagacacaagcatctggtagtcttagccctttcctcatcagtgctagtctaggcttggttgggctctctggttgtccaaatatttttctgttacaacacatccttctttattttatttttcttctataaatagtggtttatgctttctaaagcctctagtctcatatttagtttgttcctttttgagccttctgtctactcaaagaagtaatatagacttactcccagctgtgtatgatctactcttactcctgtttattgagttaagctttttactatttgtaaacatctcttggttgtgtagacacaaatacaccaaaactaaaaatggttaaattggggtgaaaacttacggatatttcttacaatttatttttcaaaattcagtgatgtagttagatggctctcctgataaaaattgtttaagagatatgagtaatcaatacttttttatcagaagtgacatctaaccatattaccaaattttgaaaaacaaagaaaatattagaattatccacaatttttgtacctaaacttaaccagttttacttttgtttattcccttataatcttttttactattgatttaatgtaggttataatcatactgtgtacacactatttgtatgtcttctatttaattgaatatttatgtgccataagcattttctactttactacttagttttcatcatcatcatcatttgtaatatctttaaaatattctctggagtggtgctattcaatagaaatataatttaaaattttccaggacccatatgaaaaatgtaaaaagaaacagcttaataatggattttatttaatctaatatatctaaaatatttattgtttcaacatgtaaaaattatataccgtattagacataaaaattattagattttaaccttcttttcatagtacatctttgaaatgtacctattttacatatataccagtgaattacgtcactaaactttcaatgtcaaaataaaatgtagtcctaccaaaacaataaagctccagcagaaaaatatgaaatgcttcaatttttacatttaaattaatgaaagtaaattaaaaatttagtttcacgatcatactagccacgttacttatgctcatcatgtacatgtagcttcttcatttaaatttaaattacatttaaaattcaagcctctctttgcactagtcacattttaagtgatcagtagtgagctttagagtatatagccaattcttgactgttcctctgtcatttttttacattgatttcaatgaaataagtacactgataagtttatgaatgtatattttcccatgttttggattactttcttaaagtagactctcagaagtagaattactgggtcaaagagtataatcaacccttcttcatcattgttaccatattgtttctttagttactagagaggaatatttctctacatatttatttactatgtatttctctttcaatggaatactttttaatgttatggtttatttatctattggtgtcctaatgtttgtttaatttttagtctacttttaaatttctttgtggactaaagatactaacgctttgtcttgtttttcctcatcttttgtttatttgtttgtttttttccttctgggagtaccaactgaaccctttacttttactatagcaaatatttagataatacttcctctgtaagcttcaaagtttttcccactctagaagtttgatatttacttctcttttatcatagattttctatgtatttttaaaaaatgtttttatcaaactggaatatatgattatgtaattgtgagaaaataaactaaattacaagttcttaaccttcagttgaatccagtgcttacccattatttttagataaagcctcattatatatagttgctgaccaccactgcatagttttacgcatatgtgtagttaatcaggaagtagatggacccaaatagattaaaatctactgtttcaaatatttcaaaataatatcatatattcttccctattatattctgatcagaatattgttctcagtaaaaacaaagtcttttttttttctatatcaccatgtatccacagttgattaattatagtcatggttattttacataggtttatttccttttgaattaatatagacttatacttccaagagttataaataactgaaatttacatagttgtgtatgcacacatacacatacacatacccctattcctcacataattggtaatagaaataatgaaaagaggttgtgttcttaggcaaggacaatttaaaagaaccccaaatgattaccttgaattaaggtaaacactggtaaaaaaaaaaagagcaaaaagggcaattttttcctttagtatattaaacaatgttgtttctaacattccctcacgtttagactactctgaaaaatccttagagtggttgtgtaatgtgtttaagttttttcgatttccaagcattaagtctggctccactaaaacggttgtttggttctattttagtctgtccctatctgtcctactgctaccactttgtgttgttttgttttctgttataatgaatacaacagtcccacttcattctcagttctaattaacgttatccagcctctaagtgttagcatctactttgcttttggttataggatcaacgataaacagctaactgttgtgcagactgaaatccctaattagtaaagcacaagattttattggttatatatttttctaaactatagacttgattttgttgcaaaccttacatgtagaaaaaaaattttgtaatggcactgtttttatttttggtgatactatagtctggaacatgtggcccagcaaaggttataaatctagcaagaaaaattatggatggcatcaattttaacagtctttgcgatctaacagagcataaaccccaaattgtttaaatactaaatatttacttaaagaaaaacaagagatcattcaaaaatagaatttaaatagtgaatttgccttttatttaaaagttgacaagttttgtatatttataaaattaacaaaattgacatcatactatccatatcacaagactcttgtgttgtattttaaaggaaaacacacacacagcatacatacatttggattggggccagatttagactccaggggcacagtgttctgtaccttaaattacaatcagatgtattttagcacagatcaaattttcagtctgaagttggtgagaagcctaattatttgaccaggttactatttatgtagaccattctgtggctggctgtggttaatccacagctggcagaatgctagctatgggaggtttttatttgatgctggaacagtttggggagaaatagagggggaaagctttaaaatcttctcattaaatgaaagactaaaaagcaagacagtacatccatattactatggagacaagatgctgtataaactgttcgttttaattctccaagtgacagaaatagcaaagcagcagcttggatgctcatagtttgcaagtgataggatacttggttaaaaaagaaagataaaaacatttaaaaataataactaagactaagatttgttgcctcttagaacacttgaatattggtaaagaattaatggattcaatttttaaatgatgagaaatattgttattatacaaaaacattttgtatttcactaaacatactaaaacatttagaatttcactagcagtactttaaagtgataagaggcagttgtaggggagaaaaagtaacatattttcctcatccatcgcaagggtcatgactgaaccctctgtaacgaaacagattaacaagagaaaagcataatttatttaacaaagttttacatgacacaggagccttcagaaattaagacccaaagaccagcaaaaactgtatttttatgcgaagtctgatgaaagacatggatagttgtagagaaacattagacaaaaggggtatgatctaatggtaataaacctagggttgaaggatgtggaagccagcaagtcctgtctgttagattattcttggccaccaggtataggacaggacccctttggaaaagggttttatggccagctttcacacagaaaggtgggagaaggtcagagtgaccttgcttctgcgggttttctcaattgctagggggccatattttggggtattgtattctgggccctgacacaattatagtagacgattctctcttaacgtctcagaatatgtataaaggcaataaacccttccttaaaagatggaccccaatacacatggctcctgccactaaattaatttttttagtcttcttattgtagtctatttgaaatttgaaagtaatattttaaaagatttttttttctttttaaacttttcagagtttgcattatggaaatcgttggtccctcagttataagtgaatatctcagtagcatttttgtaacttttaacagaagtttcttttatattttcaaggttatttcttccatttataagccagttcttctccccttctagtttccagtgctcccacttcctctagttctttgctctaattatcctctctcccttgcctcttcattcttctatttctccaatagatccttttctttgaaaagcaaaatctttccaactttccctgcccttaaaagcaaatctcttctttcctcccttccctgcccacccttccccgcaaaaaagcgtttgtgccttttcctcctcttattatctgctcaaattagcaacatatctggagtcatatgaatccaggcttcatcacatgtaagctgtgtgtcctaagaaacatctcttaacttctctatcttgctttatttatcaaaagaaactaatatgtccacctcataggtttgatgtaaggaaaaaacaataactgagttgctgtatagtatagtgcctgggacacaataattactcattacatttcagatggttttattatcattactgatgaagctttgaaaataattattcttaccttactttctcaccattccttttttaacaactacttctaccatcatactaagtgctttctgttaatcatcaaatcttatgacttttactcattcctttctttctctacttccccatagcaccttcttaaaatttcccttgcttagtttctccaccatcacttctcctctcctcatttggcctcctcttgttttctccttttccttttttatttcctctaatttttgttctccattttttccttcgtcgtcttttgttctgtgttctctgccttgggaattacaccacctctttgacctcacctctttcatgacctttcctctaagtccaactttctggtagatacttagagatcccttagaacctcaactgtagtatgaccacaactaaacactctttaccatctaagccagatcttattctggaattttccacttttattaatggtagaaccagattcaaaaatctcaatcatcttttgactcttttcttctttgccttccacatcttaaacaattgccaagtcctgtatgtagtactcctaatatggttttcttttacacagccaaatgtagacatttattaactgttgctgaattgttgctgcccaggttaactttgctttaaattttcccataagcttgttattccttcctttcacggaaatattcattacccatgatccacccctacccctcttgcacattgcccaccaaatagattcctaccctgccatccaaggccctttgtattcttaacttcgccgaccttttcaagtctctattattgccctttgtgtattcctttacttgtttgtgcaccatccaaactaatttcctgtatatacatgtatgtctttgcttatgctttcctctagaaagcatgaatatgttttaataagactttcattaatattaaagctgtacataaatagcattttaaatgcagctttcctgacatgaaattttaaagaaatttaaagaaaattttaaagaaaaattaaatatttttcttttgcattactgcattcttttctcattatttgaaaattctaattcagaatcttcctcaaaaatcaatttagatatttcttaaggtaacaagttatgattgattgattgattgatatagagacaaggtctccgtgtatttcccaggctggagtgcagtggtgtcatctcggctcacttcaacctccaccacctgggctatagcaatcctcccgtctcagtctcatgagtagctgggaccacaggcacacaccaacacacccagctaatttttgaaatttttgtagagacagagttccgccatgttgcccaagctggtttggaactcctagactcaagtgattggcccaccttggcctcccaaagtgctggaattccaggtgtgattcattgtacccagccagaagttatgatcttaattaacagattattttaaagtcacttataagaatacaaactcagccaggctcagtggtgtgcacctgtaatcccagctacttggagggctgaggtaggaggattgctttatcccaggagttcaggaccagcctgggcaatatagtgaaaccttatctcaaaaaatatatattccaaactgtttgtaagaagctaaaaggattcagtttgccttcatagtacaatttccctaattcgaatgtaattattgtcttgaatgagacctttcaaacattttttctttcatgaatttccagaattctttagtattgagcatataaacctagtatgaaataagtaatgctttattctctgaagtaatggcatgtatcaagcatatggtactcatatgatcaaatatccttccagtcaaatgttgctattttctgccttgcatcttataattgtattttatatacttttgtattttgtataggtttcttttattctcactgagagtgactgtggagatggtatttctaattttccctccttttttcttcatccagggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagtgagttacctttcctttttcaaaagaacctgggggttttttgtttgtttatttctgatgtgtgtatatatgtttagaaatatataaattaaatcctaaatttttgtgtaaatgtccttgagaattgtgcaacaaaattgcctcaatgtcaactgctctcagtattttcaatatttccttcagtatatactaacttctttcttagtgaagcatttatttatttatttttatatttttatttttttgaggtggagtttccctcttttcatccaggctggagtataatggcatgatcttggctcactacaacctctccttcccgggttcaagcagttctcctgcctcagcctcctaagtagctggggttataggcgcatgccaccatgcccagctaaattttgtgtttttagtagagacagggtttcaccatgttggccaggctggtcacgaactcctgacctcaggtgatctgatcgcctcagcctcccaaagtgctaggattacaggtatgagccactgtgcccggcccaacatttatttttttaaggtgtttgacgtttgatttacttatagtaagagtcatcctttttactgtaatttctgtgagtttttacagatggatacctgtcctgttactatgaccacaatcaggataaaaaagcacattcatcacttttttaagtctcttcagagtctaagtccatttgatatttgtttaataaattatgagtaaattttgatatattacatttatatttctttattaataatatttttaaaatattgtctgttatagttgaaggtgataaaatggaatttcatctcaacaagtacagttttttctttctaccaagaatgtattttcttccattctaaattatggaaatgcttatttacttaaatgcttatttactttgattgcttgtttactgtttatacctcttatttactgtttatacctctttaaaaatccatgaaagaggaaaaaatccttcagtgtgtcttcctatgacttggccatgtcacttgatggtttaatgtatacaatgaaggtattgtattaatcatcccagaagttcattctgattctaattccatagttctaacatagtttgaatatattcatcaattttatatctaataactgccatctgcctagaataacataaaaattgacctggaagtttacgagatcacctgggtaaagattaaaggatgatccatagaaataatatcacagtgtatctgcaaaggtgatggttacattggttataaatggtgacattggaaggaaatgctatattcttgataattcacaaattgagatactggcaagaaatagtggtaatagccaagtgccatataactgctagaagcctaatttgactaagatctaccatttagtttttccttattaacagttttattttgtaaagggtaaaagaagtaaatgggaaaagtgctattcaagccttttgaataacattaaagcattggtctcagtagtcttgagaatcattgggagaagttaacatttggtctcagagttctaaatagtcaagaaagatcagactggcagcacttaaataagttctctagagtttaagagacaaatcttaaaacttttaaaaaagataaatatgattccaaagaggccgggcacggtggctcacgcctgtgatcccagcactttgggaggcagaggcgggtggatcacgaggtcaggagattgagaccatcctggctaacacggtgaaagcccgtctctacttaaaatacaaaaaatgagccaggcgtggtggcgagtgcctgtagtcccagctactcgggaggctgagacaggagaatggcgtgaacccaggaggcggagcttgcagtgagccgagatcgcgccactgcactccagcctggacagagcgagactccgtctcaaaaaacaaacaaacaaaaaaaaaaaaacataaatatgattccaaagaatgaaactttggaagtaaagaaagcttagggagattgaatgccataaaaaatgctatttggactttatagtcacaaatgatcttaattaaggagagaatgtggagggaccttttgaaaaaatatagcagagcacgcagaaaactctttaataagagctcaaatttggaggataacgagatagctgcctctgcctttgccggtgcagtgagagcagcttcaggaatcttatggcctctgaatattttggcatcttcagcctaccaaaactgtgtcaaaaatgcctctcttatttctgcattgtccactggacgttttagtcatattcagacaccagttgtttcctccactcccagacttaccacatctgagagaaacctgacatgtgggcatacttcagcgatccttaatagagtggccctcttgcttccaagtgtcttgaagctgccagccagatctctaacatacgtcagtacaggaaaaggcaagagaaggattgtgaaagctgtcatctataggtttcttcgacttcattgtggcctttggatgagaagggctggttataagaaaaaattatggaaaaaggcacctgcaagaaaaaagcgattgagggaatttgtattcggcaataaaacccagagtaaactcttaagataaaatgacgacgtccttctggaagaggtgaaactggtatgtccatgatccttatcagaagtgtcatgatcgaacaaacctgaaagtatagatcagaagtttcacttgtttctcagttattgaatatgtatctttgtgtacatatctgcaaaaatggataagtaaaaatctcgatgtaaattgtatcaatgaatatgtaaacatacagtgacaacactgaacttataaaagttttaaaacttaaaaaaaaagctcaaatttgtaaaagacatgtaaaaagaaggtggaaaatgtatttagaatcagggaatgatgctaaaagtttggtagagacaaaagagaaaagaaagtcccaaaagtggtttaagtttgcagcagatgctgatgatatcaaaacaatcttcacttaaaaaaaaaaaaaagactccaaagtacaagcaacaaatggaaaaaatagataaattagacatcatcaaaattaacaatttttgggcatcgaaggacactaacaagaatgtgaaaagacaactagtggaatgggagttaatatttgcaaatcatatatctgataaaggattcatattcagaatatttaacacagtaacaactcaacaataagcaaactaacaacataattcaataatgatcaaaggaatttaataaacatttattcgaagaagatatacagatggccagtaaacacatgaaaagatgctcaacataaccattcaagaagtgcaaatcaaaaccaaaattagataccacttcacacccatcagaatgacaattgttttaaaaaatggaaattaacaagtattggtgaagatgtggagaaattggaaacacttgtgtattgctggtgggaatgtaaaatgggaatgtagaagacaatttggtggttcctcaaaatgttaaacatagaattattaccatatgatctagcagttctacttctaggtatattacccaaaataactgaaagcagggactcagataattgtacaccaatgtccatagcagcattattcacaatagctaagatagaagcaaatcaaatattcatcaacagatgaataaacaaaatttcatgtatatatacaatggagtattatttagccttaaataaaattttgatacatgctacaacatgaatgaattttggaaatactatgttaagtaaaataagccagacacatcagacaattattggattttctaagaagaattccacttacaagaagtatctagaataggcaaattcatagagacacatagtaggatagtgattacctgggagtggggtggggaggaatgaggcattattgtgtaataagtacagagcttctgtttgggatgatgaaaaagttctggaaatggatagtggtgatagttgcgccacactgtgaatgtatttagtgccaatgaattgcatacttaaaatggaaaattttatcatatgtatagtttaccacaatttttttgaaaaagttttattctacaaatcagtaaacttaaaagttggatcacagcttagcatagattattaaaggaattatttttccccacctagaagaggaagtggtaaaactgtaagctgctacgtggctgtaagtcatggggcaagaaaatcttttctcttttggtatgattattgttcatttgaattcgcttcaagaggtatttatatagtacctaagtacctattatggcagaccaataagcagtggatacatagtatattttagaacatctgtcattacgtggactatagaataataaagattggctataagacaattagaggtatttggtattttattgaagcagtctcaaaaggtctgttgataaataaattgatttctaggggtacgcctcagtgtttaccctgcctttgcttaagtaaacagtgatttagataaagctatatttgcatataattcaaatgcaaataatacaacaccttaatacatactaggtaagttgaaggtcaaaatcagatttttttaaatgttagtagactctaaatatcagttgagtgatgaaatttaatagggataataaaaattatatcgtatttgattataaaaagcaagtagagtaaaatgctttatccctttaatctcatcatccattgtttttctccttgaatactatagtgataatgttatcttcagttttccaggaaaaaagagacattttacttctaaaatgtgacgaaggataaaatatagttatcagagaatatacgtaggattctttaatatttcccccctcaaaaaaataaagtatactgtgtttagtataaatttttaaaatgtcaaaactcagctaaaatcaaacacacttggcccttattttctacatgtcaccttcctcttgtcagaggattgtacagtagtaatgatgatttaaaacttctgatagcctcaatatttaaaaaaaataataccttgtccacaaagattatttcttcacaggcaatgatcaatgatccctgtgagacaagaaataaataagataaacctgatgattaccccagctaactccttggagataatttccaggcaacagaagaaaggtaactaaggccaagcacagtggctcacgcctgtaataccagcactttgggaggctgaagcgagtggatcctttgaggtcaggagttcaagaccagcctggccaacatggtgaaaccccctctctactaaaaatacaaaaaagcctggcagggtggttgtgcgcctgtaatcccagctactcgggtggctgaggcatgagaattacttgaacctgggaagcagaggttgcagcgagccaaaattgcaccactgcactccagccagtgtgattgagactctgtctcaaaaagaaaaaagaagggtatctcaagtagacccttgcagtctcttttaatgaggagttggagccggaagttcaaggagtctaagacagctagtgtttgtaagttaaaagtaccagagaagaaatagctgaatagagggagaacacaggacatttgcagaatcccaacaagtcttcagctgagtatgaatcagtgcatttttgtgaagaaattaaggaagaccacaaaaagaaccacctaaaaagattgtagaagacaatcctcagtgcacacatgaggacctataaccattcctatcctactagtcagagtggataacctcgtaattcacgaggcttcaagtagagtattaaaaggaattttgtctcattagcaggttaaaatcagctctagactagatgttctggtccctcctgtcaatattattacaatatatttgacaacctttatgaaatggacaaatttgttaaaagacacaaagtactaaatcatactcaagaagaaatagaaaaagtctgtttagattattaaagaaattgaatttgtagttaaaacccttgctacaaagaaacttcaaaggctgaattgcttcagtgtttaattcttttctgtttgtttgtttgtttgttttgagacaaggtctcactctctcacccaggctataatacaatggcacaatcatgtctcactgcaagctcaaactcctgggttcaaatgatcctcctacctcaacctcccgagaagctaggacgacaggtgcaaaccaccacagctggctaatttttaatttttgtagagaggaggtctcgttttgttgcccaggctggtttcaacctcctgcactgaagcgagtccttctacctcagcctcccaaagtgctgggattacaagcatgagccactgcacttggcagtgttgaattttaacacagatttcagaaagatgtagtaccaattgtatacaaactgtcccagaaaattgaagagggagaaatatacctatcttatttcatgaggtcagcattaccttcataccaaaaacaaagtattgcaagaaaactacagaccaatatccctcataaacacagatgtaaaaattcttcaaataattttagcacatcaaaccgaacaatatattaaaagagtaattcatcatgactaggagtgtagaattggtttagcattttgaaatccatcaatgtaattaaatatgttaagactaaaaagaaaaatcacatgattatcctaaaagcttttgaaaaatccagacatctatttctgttaaaagccctcggaggctgggcatggtggctcatgcctgcaatcccaatagggattggtgagggtcaggagtttgagaccagcctggccaacattgcaaaacctcatctctactaataatacacaaaatagcagggcatgttggtgggcacctgtaattccagctacttgggaggctgaggcaggagaatcgcttgaactggggaggcagaggttgcagtgagccaagatcatgccaccacacgccagcctgggcaacagggtgaaactgtgtcaaaaaaaaaaaaaaaacccttggaatagtagaagcatgaaaaaatccagatttagaaagaaggaagtaaaactgtctctattatcaaaagcatgatcatcttcatacaaaatctgatgtcatcttcaaaaagctattagaactggctgggcatagtgcatcacgcctgtaatcccagcactttgggaggccgaggctggtggatcatttgaggtcaagagttctagaccagtgtggccaacatggcaaaaccgcgtctctactaaaaatacaaaaattagctgggcatggtggcacacgcctgtaattccagctacttgggaggctgaggcaggagaacccgggaggctgacctgaggcaggagaacccaggaggcggaggttgcgatgagccgagatcatgccactgcactccagtctgggcgacagagcaagactctgtctcaaaaaaaaaaaaaaaaaaaaagctattagaactaagtgacgtagcaagattgtagcatacagaataaaaaatttaaatctcaaatgtatttttctatattagcaagaaacaaccagaaatttaaaaatacgatttccaataccatcaaaaagtataacaaagtatttactttgggataaaccagaccaaagatgtatacactgaacactacaaaacattgttgaaaaaatttaagaagacccaaatgggagatatatcatgttcatagattagaagactctgtattgttaaatataaattctactcaaaataatctatagtttagtgtaattcagtcagaatttcagaagttttttttaaagtcaagttgattctaatatttatatggaaaagcactggactagagtagccaaaccaacgtggattttaaaaaccaaatcagaagacctttacatgatttgaagacttattacaaagctacagtaatccagacaatgtggcattggtgtaatgatagacaaatagtcaatggaacagaagggaacgtccagaaatagacctaaatttatttttcaacaatgtttcagaggctttttcatggaggaagaaaacagtctttttgacaagtcgttctggagcaattaaatatccatatctaaaaacgcaaacttcaacccacgtaacaaacaactgcacggctattagaatgtctgaaagtgtgaccataccaaatattggtaaggatatatggagcagctagaatgtaaaatggtacaactactttggagaatggtgttcttgtttcttacaaagttaaatatacatcctccaaatgacctagctatcccactcctagatattcacccaggacagatgaaagcatctgtccatgtaaagacatacacaggtgtttatagcagctttatttgtaatggccaaagtctggaaaacaaaccaaacatccacaactagtaactggttaaacaaattgtgatatttccatagaatagaatactactcaactataaaagaattgtactattgataagaaatgaaccaacagcatagaagaattttagaatacctatgctgagtgtaagatactgtaaagtacattctatatgattctatttatattctagaaagtgctaacaaatttatggtgatggcagatccattgttgtctggggacagggttatgctatgaggcagtgatcacaaacgggcatgaggaaacttttaggagtaatagatgtgttcccattgaggttgtggttgcagtactttatacatacgtcaagttttatctaattaaacacttttagtttgtgcagataattgtatgtcagttatacctcagtaaagctattaaaatgaatatatactttgattccatttatatgtttaaaagtaggaaacattattctaaagccattaagttccaaaaatacactgctaaaatgaagaagtgccaatttgttattttttgatcaccatatatgaaacttctgttatttccatggaagatccccttatatttaagtagcaatgtcaagccagaggaagagtgttttgatagtcctgggttctaatcatgacaactaaaaattatcataacctaccattgaataatgctttaaagttaaaaagggtattcacaaaaaccgtcatttaatctacaaggcaattccatgtgtttttctaatgcatgtaaagtttcagcttggctcatggaatatattctcaatttttgttaggtaatgttggtagtagttttaggagtattgatcatgttatctattaagtttcacttcactttaacttgctttgataactcacactcttcattcattcctgttaaaacataatgaatatagtaccaagtgcatgagggaaaactcacagctattgggctgctctctgctataccaccttacttctgttccaacaaagttatttgcttacaaaagttaattatgtttttcctaaacttggtgaaatttgtgttcattatttaattatttaacattatatattctgatgaaatatgaatgcaagtagaatgagaattagtttaatgagttaaggttggttccaaaactaaatacatatgagttatttttaatgttgctattgaattggatgtgggcatgaaaagtataaaagattaaaggcagtaaaaagctgtaaacatctgtattcaggagtgcttcataggtgtttttatgttttctctctgctttaaagaagttgaaactaggccaggaaccatagcgcacacctgtaatcctagcactttgggaggttgaagtgggaggattgcttgagcagaggtgttggaaaccagcctgggcaacatagttggaccccatctctccaattattttcttaaaattagccaggcatggtggcacacacttgtattcccagctattcgggaggctaaggtgggaggatcgcttgcacctgggaggttgaggctgcagtgagctacgatcatgcaactgcactccggtctgggtaacagagtaagaccctgtctaaaaataaaatttttaagaaagtaaaatgagaattcataaactatgaattctagatgtggttctacaagaaaaactctagaatgtcagtctgtaggcatgctcaaaggttttgaccctatttttttttttttttttttgagacagagtcttgctcttattgcctaggctggagtgcagtggcaccatcacagctcactgcaacctccacttcccaggttcaagcaattctcgtgtctcagcttcccgagtagctgagactacaggcgtgcacaaccatgcctggctaatttttgtatttttagtagagatggggttttgccatgttggccaggctgattttgaactcctggcctcaagtgattttgaactgcccacctctgcctcccaaagtgctgagattacaggtgtgagccccccacccagctgaccctattttaaatattagcaaatgatgtatctttatatattaaaataaaatgtttagattatgaaagctattttttgttcccttaatttaatcatcactctgatttatttatcaactactattccttttcctcatctgtaaattgaggggatttgcatagaaatactagataatcttttaaattttttcttaaagcttaaacatgttataaaactgatgattcattttttttccacattctaagattaatactgttagattttattataaattaataaagttcctcttttaacatgtaaaataatgcctgacatttcttttaggtagttctgattttttattatgagtgtagccttaactgtagtgcctttgaagctgaattctccccatttgtgaccccagtattccttttttgtttagtgaacctaggggaaatgatatttctctccaaaaaatacctgaaaatatttggttagacacgtgctgggacaaaaagtgaagtatccacagtaataccattgctatgttcttgtgatataaccagattataattactaaatgatacaatttactttctttttttaattctggtaaaaaaaaaatacacaatataaaatttagaccattttaactatttttaagtgtacaaatcagtggcattaagtacatttgcaatgttgtacagccatcaccactattcctctccagaactttttttttttttaatcaacccaagcagaagctctgtacccattaaacaataactcactatttcctgtttcctccttcctcctcacccttggtaactgttttactgtctatctatgaatttgcctattttaggtacctcatacaagtaggatcatacaaaagttgtctgacttaatttcacttagcataatctttttaaacttcatccatgttatagcatgttatcagaatttcatcttttttaaggctgaataatatttcattgtatgtgtgaaattttgttttttgcttcattttgttgatagacatttaatttgtttccacctttgattattatgaacaatgctactgtgaatgttaatgaacaagtatctgtttgagttcctgcttttaactcttttggatatatacctagatgtggaactgttggatccacaacaggtacaccattttacattcctaccatcaatacacaagggttccaatttctccacctcctcaccaacacttattttgcatttaaaaaataatagccatcctgctgggcacgaggtggcatctcactttggttttgatttgtgtggtttactttcagccaaggttcagaaatacatagtgacaaatttctgtttctttaatttaaaatctttggtaacctgttacattgcattttgtacttttaaattacacatctgaattgattggttatccttgttaaagtagttccaaaattactgtagtttaaaaactctttaaatattacattgtagttttaatttgtttctgacatcttcaaagtttgaaattttcccttcagcaacaaccatttgttagctacattcacacgaaagcagcttaataaaggacattctacacaaaggtaattataatccattgatgccccttaatgcaagctgctttgtagtcattatctagcagtagatgactaaagaacttgattattcttgtttttcatttttattaaattaagaaggtttttttaaattatgtcattttgcaaatggttcttaggagtaatgcctttcaaggctccataatcactagataattaacctgcaaggattaagtacactcaactttgcctcaggatgcttaactctcaaatacagtcaattatctcatgataataactgctttgtcaagagttaccacttaactccacagtgaaaagtcaaatcacccataccatgcactttaagatagtttcaataataaaataacagtttgaaatggggcagaagaattcagttaaattttttcatagggataagaatgatatgctttagataaagctccccctcatatctagtattttgaatttcacaaatgacttcaatttataaagataatataggccaggtgcagtggctcatgcctgtaatcccagcactttgggagaccaaggtgggcagatcacctgaggtcaggagttccagaacagcctggccaacatggtgaaaccccatctctaataaacacaaaaattagctgggtgtggtggcacgcgcctatagtcccagctgctcaggaggctgaggcaggagaatcctgagaaccctggaggcggaggttgcagctagccaagatcacaccactgccctccagcctggcaacagagcgagactccgtctcacaaaaaaaaaaaaaaaggtaatgtattgctctgcttcatcagtccttttgctggcagtgttcctgcattgcaaattttcttataggaaagccattttgtctgttaacctcacagaggattcaatatattaaaaatctctaatatacaccaagaaaatggaaattactttctttacatattgatttaacttttaaaaaatctcgtttatcaacaaacgaattacaaaacagtgagcaaaattctgcagtttgttgtggttgttttttgttgttgagtagcttcactcatatttggacaggatatgccaaaaacagaaagactgctagatagatcaggacattttgaaagaaaatataaaaatgtctttaggtttgttatccatgtcctctaagcctgaatgatgcttgtatctctttataagtaaactatcattatctttttactaaaccagatgggatacattggctttttcttctgttatatattttactgccatggggatgggaagagactttattgatattttgtttacacttttaaaccctttttaatgtttctaatagttaattaataatttgaaaccatcaattctttaaattgtaaataactttgatacaggttatcttatttttcagtttctatacttctgtaaaatagaagtcatttgctcttttaagataaaaaatctgtgtgaatctatgtgtaattatgtacaccaaatagtgctatacatgcatacaacttctttcagatattcttcttttggttaagagcctttttttctttgtaaaggtattattttaatttttagaactatttttctgtgcactggagcacatgtttgggaggaaaaaagaaactttctgtcaagtccctatacacagagaattcttgtttgaatttttaaaaaattttgtcaagtctagttcttttatttatttatttattatcagttagagacagggtctcactgtgttgtccaggctgttctcaaactcctggcctcaagcagtcttcccgccttggcctccctaaggttctgggattacaggcatgagcgaccaagcctggccaagtctaattctttaaaggatgtgatttccaagtatttccaggaattcaagactgttacctagatccgtattctgacaaaagagatgatcttttctttcttcatatcagaatatttcccccatgaattgagggaaatggggctgtatctaaaaatggtaactctgccctttaaagtatacagaagtgccctgtttcttcctaagagaggtggaagtcccctttctgagactgtgcatatagatctctttattcccctttttctgctataagtgataagaggggctatgtagacaaaatgtaaggttgttataaaatcatcaaggaattgggaaagaaactttatcggaggatatacataaccccttcagaaaaaaaaacaaaaacttatggtgctttttggaagaaattctgacatagttgtattttctgagaaggataatgaaatttcagttaacatggaactgtaacttcgtaaaattgctgctcagctcctagatttaactttctccctagggtttttctaatatatttactcatctgaaaaaagtgagattgactgtagcacaagggagacttctgatgtcagtggcatgttgtaaagatgtgctatgggaaagattcagaaaatgcaaaggctatttaactatatgctctgcatctctcttcctttctacatagctctctcctttctttcttactccttcgtctccctctttacgccaactacattgcctctctgaagatgaaatgcttttaaatcatccccaatctaacatccatcactggtaaaaagccatctaattattatgtgttgatttttaaaaattaaaaaaaattattagaaaattaagaagagcatttaaatgtttttaattgcaaggagaaaataaatacactcaagtaaagaaaaacactgtgtaatttgaaatagtttgaattactacggagataatcatattttatgcagtaatgcctttctattttattcactatttctattaatctttatttgtttcagttactgtactataaatttgtaagtgattattttggtattatttgtatagtatgccataatataaaaataatgaaaaatattaaatatatatttaatgttcttatttaatgcctttaattttttttttctttgagacaaggtctcactctgttacccaggctggagtacagtgatgcaatctcggctcactgcaaactccacctcccaggttcaagcgattctcaagtctcagctttccacatagctgggattacaggaatgcgccatcacactcagctaatgtttgtatttttagtagagatggggttttgccatgttggccaggctgatcttgaactccaggcctcaagtgatccacctgcctcggcctcccatgtgctggggttacaggagtgagacacctcacccagccaaaaattattgtttattaaaaatcatttaatgacattgacatccttataaataaaaactgtaaatttatatcacagtagaaaaagtgctagacctaaatttagaaaacctgtcttttatcctagctcttgagtttttcacagagaaaataggagtcaagaagccaaaattctgacatgagggaaataattagcaaaatttaaataggtgccattgattagtcaatggtattttatcaacattaatttttattttattatttatttatttattttgatatggagtcttgctctgttgcccagactggagtgcagtggcatcatctcggctcactgcaacctccaccttccgggttcaagcaattctcctgcctcagcctcctgagtagctggggttacaagttcctgccaccatgcctggctaatttttgtattactagtagagacggggtttcgccatgttggccatgctggtctcgaactcctgacctcaggtgattggcctgccttggcctcgcaaagtgctgggattacaggcatgagtcaccgcacccagcttaacattaatttttttagttttggtaattttaatatggctatatagaatgtttacatttggaaaaatcctaatatcctttttgactgatccagatccagtccaggttgctcacattgcatttagttaccacatttccttcgtctctttaatctagaatggttcttcagtctttgtctttatgaccatgacaattttgaagagtcctgactggttttttgtagaatgcccttcagtgtggagtttcctcatgattaatacattttttataggaataccatagaaacagcctgggcaacatagcaagatgctgtctctacaaaaagtaaaattcaccaggcatgatggcacattcctgtagtcccaactacttgggaggctgaggcaggaggattgcttgagcccaggagtttgaggctgcattgagccatgattgccaccctggactccagcctgggttacagaacgagaacccccacacaccccccccccctaaaaaaaaacaacacaacacagaaatgctattgtgtcttttttcatgcgttatactaagattttagtgtgtttcgttactggtaatactaactttgatcacatggttaagaaaatgttggcccagtttattcacttcaaagttactatttctggccaggcatagtggcttacgcctgtaatcccagcactctggggagccaaggaggacagatcgcttgggcttaggagttcaagaccagcctgggcaacatggtataaccctatctgtactaaaaatataaaaattagctgggcatagtggcatgcacctgtagtcccagctacttgggaggctgaggtaagaggatcgcttgagcccaggaggtcacatggtgaccttggaagcaaatgctccctcaaacacgagatgactgcagccctggtctacatctcagttgcagtcttgtgaaatcttgagtcagaggcactcagctaagccatgcctggattccttttcctggaaactatggagataataagtgtttgttattttaagtcactaagttttggagcaatttgttacacaataataactaatatgctgtgaaaaacaaatttactaagagctcaatatctgtgtacaattttttttgtctttagccttttgtgtatattgtcaaaacacaggcttttagttaaagttagttcctttccccttcaagtattttaattttttttaaatatgtgaaacatttatatggttcttaacatcagaactatatgaaaaggtttactcagtagtgtcgctcctcccttatccctcatcttcctcattccccattctgtctctattcctaccctgtttcttcctacctaccctctataaataatctcattagtttctggctcacatttctaaatttcttttagcacaaattagcagctaaatgcatattttactgtatcttctttgttacatgaaaggtagcacactatagatagatcctctttgaacttagctttttttcaatcaagtgcatcttagaaatcattccataaaagctcatagagatccttctcatttttaattttattttagttatttatttatttatttatttatttttttaatgagatggagtctcgctctgtcacccaggctggagtgcagtggtgcgatctcggctcacagcaacttccacttcccgggttcaagggattctcctgcctcagcctcccaagtagctgggactacaggtgcctgccaccacccacggttaattttttgtatttttagtaaagacggggtttcaccatgttagccaggctggtcttgatctcctgtcctcgtgatcctcccgccttggcctcccaaagtgctgggattacaggcgtgagccacagcgcctggcctatttcatttaaaaaaaaaaaaaaaactgagacagggtctcactgtgttgcccaggctggtcttgaactcctgggctcaagcaatcctcctgcaatccttctgccttgacctcccaaagtgctggtattacagacatccagccacaataatcctcatttttttagttggattttccccattgtgtgaatgtaccatattttacccagtcactctcttatgtatggacattaagactgtttccagagtcttgcacttaaaaacaatctttcaatgaataatcttgttcatacatatttcttgggttgctagaggtatttcttcagagtaaattccttgaaatggaattgttgggtcaaaggataagtgcatataacgttttgttagatgttgctaaattcctctccaaaataattagaaatgttttcattctcagcagtagtgtaggtgaatgcctgtttttaatggggttattttaatatttggttatcaattattaagcattgctatcaaatggaattcactagaagcatgtaaaattctagctttatttcaaatacttagttgaaccagccaattcattttagcacagtaaaagtaatccaagaactaaaaagtgatcattctttaaggtacagattttaaagactcttttatcttttttttttcttttttttgctattttatcagacacattagaggaatatgaattaatccccattatacactctttagtttcattttctggccctgtattttcatcttatacttctctcctacaagcacctcttcctttctcctgtactgcctaactattcatgttttcttatcatcaatactcatttcatatattccctacctcacattctccccttctttccctcccttctccactcccattcagttggttattttataaatgtgattctgtgatcttgtgtatataattacaatgcttacatgtttcttttacactagaatgtgttcctttacagcagtgactttcattcttcactacattctggccacttgattggtgatcactttctgaccggaagttccaattatttaatcacaaagttggactttctggtgaccacttcccatcctggggctgacagtgagtcgccccatcagcataacaaaggcacttttaacaatcaggaaattctgagggtttttgaagctctgtgctaggaatccagacaaggacttgatatattttttactataccagtttaagggttaatgataccatgtaacaactttattaatagattactatttatagaaacttgataaatgtggtgggaggtggtgcagaatcatgtgatataatcaattataaatgaaagcacagataaaatttgaaataataagagagaaataagaatgaaggttggccacggtggctcacacttgtaatcccagcattttggggggctgaggcgggcagatcacgaggtcaggagatcgagaccatcctggccaacatggtgaaaccccttctccactaaaaatacaaacattagctgggcgtggtgatgcatgctactcgggaggctgaggcaggagaatcacttgaacccgggaggtggaggttgcggtgagctgagatggtaccactgcactccagcctggggacagagtgagattctgtctcaaaaaataatgaaaaccgaggagttttttctttctttctttttttttttttgagacggaatcttgccatgtcgccaggttaaaataaactttcaattctcttctcttgaatatctctcacccaacaatgtttttttcatgttgatcactttactaaagcgaacaattggggttttaccaaaattgtgaaggattttattcttccatacttatgtctgtgttcagggtcatacagattctactttttccttttagtttaaggtattctcttggagatttaatgtacttaaatttgaccacaatttattgagagcatattctgtgtcagacattgcactctgcactagatattcaggaatttctaaaaagaatgttaacattgctgttacatagtcagttactgatcacattcttttcctctcaacttttttcaaaataggaatctgcggtatgttttcacgtatggagttcaggtcaggcttaggggtccctgacaatgtgaatagttttaagctgggcctcaattcgtggtacccttatactaatttaacaagccgtggactctaggttccaccaaaaatattttgttccatcctctctggtttcagtccatggtgtacagaaagaaaactaaggaacttcagccccaaattgtcaaattttgctacttaagaaacagaagatttaaatctatcattttgtcttatattccagagttgactggttcctcctgtctttaacttcttgtccttgaagggtattctaattttcattcagaaatatgacttctcatagggtttgtgttagatattttcagggccagatggatatgatgttcccatttctgttttattgttaaactactattccttttgagctgtaatgaacaattcattctgagaggcaatatatgttttcagtaattgacttgaataaaagtaaatgttaaacatggagttactaagttaatacagtgggtattagtactaatttgttcaaattaagatagaattcttaatttgataaatagaattcttatattacagcatcagtccaattggattgatagtttgtagaaaggtaatttcttacatgaggaaagacaggttttctttctcttagcaaggtattaatgcaaaaatgacctcttcatttcctaccagcttccagaagggaaatgctggttaggaggtaaattcaatttactctacaagcaaacttcacatctgttatgctgaagtcagagtttatctttcttgttatgtggaacctagaaatataccatgaggaatactgaaaaataaactagcagaaattttgcgtgatgctgaggatttttagatggctgcaaaatgggtgaaagtaatataaacttaacaaagaatgttgtcacaactctctggaacttagtactgtttttcaactaacaaatggaagatttgtgagactaggtcgacttaatgtgatttcaatgcagtaattactgtgtggcatgggcatggtaagagataggccttttctagaaatattctcatctctgttttttttagttgctcttacttagatttatattaactcagcttcacattttcatttctttttattttattttaaacaatgagaaaaatactccacgatgtcactgatttagttatcagatttgctttatttctgtatataataggtaatgtgagtacaggaaatatatctgaaaaggttacttgtacctaaattttaagttagatcatttaaaaattacttataagtctcttgagtgttttatatagtagggcagatggaaaaacttatttgatattcatttttggtacctcttaggaaaataattgggaatgtattcagttggaaaaaatgttgagaagagtgttttatataatgattatttagtaaaacattaaaaataatttcttattctggaggtttatagacatcaaaattgacaaagattcatggattatacatttcatcaaggtacctttaagcgattttttaaaaaaaattctgactctaacaatgcatgctcattgtagagcgttaaaaatacaaaaacatgcaaaagaaaaaattaaaattaacatgtgtcatatcacccagcattaactactctataatttttcctgtgtttccttgtagggtttttcccacacatttttatttgtttttatcatatttatttttattccacacactttttattttgaaatgatttacaatctaggaaagaattataagaagagtacagagttctctcctactacacttttgagcattcttgctttttctctctttctgtctctctaaatatatgtgcttaaccatagtacatattcagatttttctagctgtcccaagaatgttctttctagtgattttgttttccaggatcatggatcatgcattgccttaacttgtcatgtttctttggtttccttaatctggagttccttgatctttctccttcatgccattgcatttataaagagtgttgtcaactgttctgtgtatgtaaattcttaaccaattgaaatagattttacatcatttttcccactttatatatatatatatatttatttatttatttatttatttatttttattttattatttttttttttttttggagacagagccttgctctgtcaccaggctggagtgcagtggtgcaatctcggctcactgcaacctccacctcctggattgaagtgattctcctgcctcagcctcccaagtagctgggaatacaggcgcgcaccaccatgcccagctaattttttgttttgttttgttttgttttgagacagagttttgctcttgttacccaggctaagagtgcaatagcgccatcttggcccaccacaacctccacctcctggattgaagcaattctcctgcctcagcctcccgaatagctgggattacaggcatgtgccacaacatccggctaattttgtatttttggtagagacagggtttctccatgttagtcaggctggtcttgaactcccaacctcaggtgatctccctgcctcagcctcccaaagtgctgggattacaggcgtgagccaccgcgcccggcctaatttttgtatttttagcagagactgggtttcatcatgttggccatgacggtctcgatctcctgaccttgtgatccacctgccttggcctcccaaagtgctgggattacaggcgtgagtcaccacacctggccacttaatatattttcaacattttccaatgtctttaattatgtcaattataattttggattgctgtataatataatttattttcattagtcttctagtgttggaaatttttactgtttgttttcttttcagtattgcaaatacaattgggaaataaactttgtaaataaatctttgttgtaattttaatttctgaatctatcaagtatttgttaaaacataaagcaacaaaacaaaaatcctacagaagaggataattaaatgttaatctttttgattctgaatacaattagaatggaaatttggaaaaggggaaaattgccagataaagaggttgccagatttagcaaataaaaatacaggatgcccatttaaatttgaatttcagaagggacacacgatatctgggacatacttatactaaaaaattattcattgcatatctgaaacttaaatatgactgagcatcatgtattttatctggcaaccctaccagtggtttgagtattcgggaagacttcatggtagagataaagagagggaataaagaagatgttttacacaaaaggaatggttgagattacctccaaaacaagagtgaacatagtttatgtgaaatagtctccataaagataaagactttgtgtctcattcactgctgtatccccgatcccttaaacaatctgtacactgtagtcactcaataaatatttgttgaacgagtaaatgaatttgcactataaataaagccaggcaacttgggacaaagattacctgttgtaactaagtagataaagataaaatttccatgaaagtggaaaacctggcagaagaatttggacttcctgccttcccttatttattttataatgattcattaagtgactgttatgtgccacatgcacaggatactttggagaacaaaaacagacatggcttctaccctcatggattttatagtctgtattagaggcagacattcaatttataattcaattattcatttaatagtcaataaatttcaattcaattatagcgtacaacttataaaattgaatttttaatcattcaatttataaatatgagtactgtaagggaaaagtatataatacttacattctgaaatcacacacagtgagggggtattcttgaaagaacctgatcaagataaatgtacatggtgttgtgtcttagggatagatccaatcttttctttgaaatcttcattcattcactaattttccctcgaatttatagaacactctttggactattacacttatacatcttttaaaatctttttatatgtgcaatttagtttacttactagattgtaaattaattaatttatttatttatttagagacagggtctcactcacatcacccaggctggagtacagtggcacaatcaccactcagtggcagtctcaacttcccaggctcaggtgatcctcccaccttaacctcctgagtggcttggactacaggtgcacatcaccactcctgtcttatttttcatatcttgtgtagagatggggttttgccatgttgcccaggctggtttcaaactcctgggctcaagtgatccgcctacctcggcctcccaagatcctgggattacaggcataagccctgcacctggcctagatcgtaaattctttagtgagctgggggtatttcaatttgcttttatcccctattgtttcatgtatgtaaaatatacacaggcgttaattattgacatgttgattcattgaaattataatggggcttttaatagctatagatatgccatgagcacataaaagacgatttcctgattctttgaccctcttaaagaagtttatgatgcctacttgtcattcttgggtccttagaccttctgtggcaatattaggtcggggatagatgtctaatgatttgcagtcagggagctttgataaccattgtcacatgttagcataaatcagaacccaatcacttttttttttttttttgagatggagtctcattctgtcgcccaggctgcagtgcagtggcgtgatcttggctcactgcaacctctgcctcccgggttcaagtgattcttctgcctcagcctcccaagtagctgggatcacaggcatccaccaccatgcccagctaatttttgtattcttagtagagacagggtttcactgtgttggccaggctggtctcgaactcctgacctcaggcgatcctcccgcctcagcctcccaaagtactgggattacaggtacgagccaccacgtccagccgagaacccaatcacttttgactctgccttcaatatatattgcaaatctaactaccttttactacctctacttcttcccttctagttcatgatgccattatcacttgcccagattattacagtagtctcataattgctctccctgcctctggttttgcctctcccctccagcagtgataggaaataatggaagtttttaagtaagcatggtagtatcactggatctgttctttgacacagctggctagtagtgtttggtagattggaataggggcatagtaaatgtgggttgacatggtatagtaggtagtcaagacagtccaacaatcaatcttaaagacatttcattttcttggtagttaaagaatataggcctaccagtacttgtaattttaattttaattgatttatatcattttacttattaatattcatttgaatcttagtttataatatctataatcatatgctatgctcaaatgtaattgagttactttttagagacaaggtctcgctatgttgcaggtttcaccatgttgtccagggtggtcttgaactcctgcgttcaagcaatcctcctgcttcagcctcccaagtagttggatctacagggatggcatgcaccatcatacccagctctgaactattttttaagtaaaattttttttagatgaagacaagcttgtatacaagagtagttaagacagtgtggtactgactcaaggatgtactaatagacaaaggatagaaaacagacccacacacatacagtcatacagttacagcaaagatgccactgggatatagaggagaaaggatagtattgggatcagtggatattcatatggaaaaaattaactcctaccttataccacacaccaaaattaattctatatgattgtacataaatgtaaaatagaacaataacacctctagaagaaatcgtatgaaaatatcatggtcttggttaggcaaagctttcttacaaagaatttaaaaatgttaacaataaagaaaatatagtctggtccaaatgcagtggtatttacaactaattgatcacagccagttacagatttctttgttccttctccacttccactgctttacttgactagccttaggaaaaaacaatttttcaggaaaaataagttggatgtgtcaaaattgaggacctttccccagaagacattgtgaaagtgaaaaggcaaaatataaagtgggcttaagaattatgagaagttcagcacagaggactagtggaagaaaatatgtttgtacataatttctttccctataaccaatactaagaatagagaaccctatatttaactgaaggcagaaaatattttgaggccatatttgttctcattttatgccatttacttagtaaatgtacataccttatagattcatgcatataatatacagtcctcccttggtatcttcaggggattggtttcaggacccctctcacacatacacaggataccagtattcaagtcccttgcataaaatggtgaagtatttgcatataacctatgcatatactcccatgtactttaaatattaatctctagattctttataatacctgatacaatgtaaatgccatgtaaatagttgctataccatggttttttgtattattattattattttttattgttggatttttttcatattttcagttcatagttggttgaatgtggatgcagatacagtgggccaactgtatacatattttgggatcattttagtgggtagtaaaacttggttttccccaactgtttctgttaattcacagccagttatgaaatatgccacatttgtcctgattaaatagtgaaatgtcttagccctttccactgattatattgatagaaaagattaaaaagtggtggataaacctaaccaaaaaaaaaatgttttcataagccactgctgtcagcacttatttgagattttaaaacattttgtagttctttatttttaaatgaccttacattttcaaaagggtttgttaattcaaaaggtctcctatggttaaggcagttcaaatagtagactgagggtagaagagggattgactgtaaataggcatggaggtatcttttgggggtgatgtaaatgttctaaaactggattgtggtgatgtttgcacaaaatttgcacaaaagcattgaattatacactgaaagcatattttatagtgtgtaaatgaatgccttaataaagcttttttttttttttaaggataccattaagataatgaattgtccagccacagattaggagaaaacatttacaattcatgtatctgacaaatgattgtatccagaaatcaataataagacaaatcaatagacaaatagcataatttttaaaaattgggcaaaagacttggacacttcatagagggaaataatctaatggccaaataagcacactaaaagaggatgaacattattaatcattaggaaacacaaattaacatcacagtgagatactgacccatcactcatccacttgaatggttaaaatcaaaaggactactaattgttgacaaggatgcagaacaactggaactctcattctttgctggtgagaccatgcagtgggaccacacatttgaaaaactgtatggtagttttttattttttttttcctggtaaaaattaaccgtacatctaccctatgatccagcaagtcatttacctgagaagaacaaaaacatatatccacaaaaagagttgtgcaagaagattcatagcagcaaacaggcatgttcattaacaagacaatttttcagcacattgtgtttttttttttttttttttttttttttttgagacagagtctcactctgtcaccaggctggagtgcagtggtgcaatctctgctcactgcaacctccacctcccaggttcaagcgattctcctgcctcagcctcccaagtagctgggactagaggcacgcaccacgacacccagctaatttttgtatttgtagtagagatggggtttcaccatgttggccaggatggtctcgatctcttgacctcatgatctgccctcctcggcctcccaaagtgctgggattacaggcatgagccaccgcgcctggcctatgtattcatttaacagtacactactgggcaataaaaataaatgaactactactacccccaactacatggataaatctcaggaacattatgttgaacaagaagagtcagatgcaaaacagtatttgtgttctacattataccattcaaacaaacaaaaacagtctataatagaaatcagaaagtagtttcctttttgttagggggtatagggattgactggtaagagacagtagaaaactttctgggattatagaaatgttctatgtcttgttttggataaccatttaagatccgtacatcgtattttatgtgatcatacctcagtaataagaatgcaaaatgctacaaaagcaagtcaacccaacatctctactaataaatctcaccattttaaaaagaacagtaaatcctacatctctattttgagaaaaaataattataattttatttaatgctatttaacatatgcttatatatgacatataaattgtgaaaagattatttaaacaaattggctaaagaaacttcatgaagaaggtgaatcttttgccttattgcatatgcttttatattgagtaaaaccaaagtgatttcccatggtagcttcttatactctgttctcatactctttcttgtgataaaatggaaactgatgttcttcccatgaaagggtaattatacattaatgtactctttttccctcctgtcctttttttattatgaaatatttcatatatcaaagaatatgtctaacatatgtgtattacaaagtatatcctctgcctccctcctcatttgaagatcctgccaatcctctgcagagctaatgcttattctgactttggggttttcatttcctttcatatatcccttatatatgtagtcctagtaggtgtatacatatgtatatcatgaatagttatatatataataattgcaaatacatcctgtttatttaatgggttatgtttctttaagttccaatacaatattttctaaattagaaaggtattacaattttaaaaaatgtgccaggacaaaattaataccaaattacaagaatggtaaagcttagaacattgtcattgactataaataatagctgcaattctattgttggtttcttttttcactagtccattttgataatatttcttgttgtggccaggcacaatggctcatgcctgaaatcctagcactttgggaggccacggcagatggatcgcttgagctcaggagtttgagaccagcctggacaacatggcaagaccttgtctctatttaaaaaaaaaaaaaaaattgttgtagtgaagcagtgttttctttcccacagaatatcgttcttcatttatttataaaaatatgatttggtatatatgcaaatgtagcttattttatatataaccatactgtaatagtctttgtggtaagcaattcagttaatatgactacaggtttaagatataatgtgaaatttggaatagattttaacttttaaaaaataatttatgttaggctgggcacggtggctcacgcctgtaatcccatcactttgggaggccaaggcaggaagatcacttgagcccaggagttcaagaccagcctgggcaacatagggagaccccgtctctacaaaaaaaagaaaattagccctgcatggcccatgcctgtagtctcagatctccagaggttgaggctgcagtgagccatcaccatgccactgtgctcccacttgagcaacagagcaagaccttgtctcaataataataacaataataatataacttatgttaagggctggtctttctttttctatatttaactgattaaactgattaactgtttgttgtttttttttatgtcataggtgtcagatccagctagcagtgccataagccagaattatagatggaagtgggggagagagagaattgtcagaaaaacttactaagatttctatcctggccaggtatagtggcttatgcctataattccagcattttggaaggccaaggtggaaggatccctggaacccaggagttcgaagctgcagtgatctatgatcatcccattgcactctagcctgggatacagagcaagaccttgtctcgaaaaaaaaaaaaaaaatctaagtggcttcatacagaaagtttaaagttaaatgtatactgttatgaatatcttattaaaatgcaagacaatcagagactgatctaaaagtaatcaaggatgatcatgtcttgggagtatcctgtttctcagttgctctggacagaaagcacctagaaggttgagataattcaatgcaaaatcagagatttccccccatgtaatcaacctcagaacttgagttggtcctaacagtagactcaaccccttggaaaagactaggcagagcaattttcctattgactacatctgagacgccattcattcttgtgtcacatgagacatagcatatactttttaggtctctaataatagcagttctctaagaagcaaactgggatgaaagacactattcacttattttcttaaatggggaaggcattaaaaggagtgaaggtttattaatgccacttttaaagatataaatagtagatttttattctaataagtcatacatcaataaaatttgttattgcagctccggggcagcaattacttatatattgacaacttatacatgttttacatgcccatttgctctccttttcactactgaaatgtagttaccatagcaatgaacacatcacatggttcctgtgctagttctaaaatagagaacagcaatatgccatatgagctctgcttattttctacgtaaggactgcatatacaacttgaggctattccataaccttctcagtgcagatagcttatcattgatttagaaagctttcaaagtaaaaagcaattggcagtaatatatttcaagtctctagcttctcttgtactgttatttgccactgagctaaaagaacagtttcactagctttgaccaccagggactctgctgttgtatatttagccatagattgtctatggaatagcagtgccacttagaagattggtgggagaggcatatatagcattcatggacacattttctaagtcttactgagcaattcttaaccaatcttagcttttctcctactgtctcccttaatgtttcaagtttttaaaaatataggactctgttttagaatttgaggaaaggaagatgccaggcacaactggaggcatgctattagttccttttatgtccattattgttgtgtaaggttttaaaatgcattggttatatagcagtttatctatagaaaaggacttcagatttcagtgcctggtggtatcaggccgtatttatgccttactatcacatttagagtgtgttgtaggctgtcagacctccagaaataaagtaggaacatacccctcttactgtgactcttaccagatacttatttgaaacagtccaagcactggcatattagggaatggtgctaactctttctaaccattaataagcaaaataaatttcaatgtgagcttttggctatactatacctatggtcaagtggcactacaaattcaaaattttaaatattctttattgaaactactaggaacaactgttttatatatagtagaggaaaccagggctttattctcttgactgaaacgtgtaagaagtgattcataggtcttcaaacacaaattagtaaatttaggaagctaaaaaggcatatatatttgactactgatgggggcaatatgttgattgtgtaatatttttatctaccctttcatctcagttataatttaaaaaccatttatatactacataaactatgtaatattggatacttctgtgtctatataatttgcaacaaagtagaataaatggccagagatgttattgtaatcttatggttgaatgttatttcttttttctaggtcattgtttaaaatctggacatcatagaaacagataatgcagagagaaaattctttcataattccaccacatctcaatctttgttattagttttaaaatatgtccttctagacatattttattgtaaaaagtatttaaaatactcattttattttattgccgcaagagagagaagggcatttattgtagggcaccaagcaaggaagatgggcagctcatgcttaagacccaacctccctgctggcttacaagcatgggtttttaaaggcaggggtacatttcaggaaagtagaagttacaggcaaaattgttaatcaatacatagaggttatacatgggttggctcaaaaaggagtaaggttttgagtgggggcttacaggtcatcaatggattaggagattctttgatttgcagttggttaaggaagaaaggctttgtctaaaaacttggggtcagcagaaaggagtgttgaggtttggccttaacataggttagttaggataaggaaacctgttaatcattatggggtgctatgtcagggtcaaggtatgagagcaagccacgatgcactgggtcagagtgaccagtttaggaaattgatagcccacaggtgtgactctctccaggcccctcaggaagcaatttagaacaaagagcagcagtcagagttcagtcttcagtttccctttatcaaaggtctatgtgacagcagttgacattttcttttttctgttttcttaaatttatttattaaaagaagtgtctcattctgttgcccaggctggagtgcagtggcacgttcatagctcactgcagtctcgaactcctggcctcaggcaatcctcctgcctcaacctcctgagtagctaggactacaggcacatgccactgtgcccagctcatcattttctatctggtgggtatgctggcatgttggaggaaggacctggcgagaggtgcttggatcatgggggcagttttccccatgctgttctcatgacaggagtaaattctctcaagatctgatagtttaaaagtgtgtggcagtttcctgctcgtgctctctgtctctcctaccactgtgtaagatgcaccttgcttctccttcaccttcagccatgattataagtttcctgaggcctccccagtcatgtggaactatgagtcaactaaacctcttttctttttaagttacccagtctccggtagttatttatggcagtgtgaaaacaggctaatacacttggtttctgaaaagtaatttggctggctttgaagtggggatgggccatgagccaaaggatgcaggcacttctggaagctagaaaggcaagaaaagattatcccttggagcttcaaaagaaatcaaccctgcatgcaccttgattttaccctagtgaggccgggctggacttctgatgcttcagagacaagggttcctccctcatctgtctcaggaagacttaggactaactttaggctttgaagtaaacagaagctgaaacatttgaatgtttgattttcatgatccagaactcaagcctcataggtcccatgcattccctgaacccaataggatgtcacagtctgcataccttcacaccatggcagtctggcttcttccctctcaggcctgcagcctcatgctctgggcttccctggaagctggtgttgtgggggcctgcagttgccaccctgctgtgtgtcagcactgctccctgacgctgttcatccactgacctccattccttggcccagctgcccaggcatggcagactacacgcaacctgggttgtggggaccaggcggagccagcagcactaggacctgatggccaaaacactcattttaatgaaatcatactttaattctgttttgtatcttctcacataaaatagctagatctcttttcctagtagtacaaacttatctatctgccttattttgtataagagtggtattatatgaatacatcattgtttattcttctattgaaagcttttatgttgttttctgggtttttgttattatagttctgtagtaatatgtcttatgtacttttgtgtaaatagttctataggctcaatctccagaattgaactgccaattcttagtaaaggaaaatttaacttttgatacattttaccaaactgccccttcaggggattctaccaaatcatattctctgtttaaatgtctttttaagctttgccaaactgatatatttaaaatggtattttattgtttcaatttgcagttttagaggtaatgttgtaattctatatcttttcatattatagtgcatttatattttcctcttctcttaactccttgtttgcctagctttctttttcttttggttggttcaatttttccaactaagttttttcatgttgtttttttttttctttttcctttgtatttgggaaataaatccttacttgtaaatacttcttgcagtttgtccattgactttttttttgagacaggatcttgctttgtcgtgcaggctggagtgcaatggcatgatcacagctcactgtagcctcaaccttgcagccctctggccacaggctcctgagtagctgggactacaagtgcgcaccaccatgcccagataatttttttaaaaaatttttttgtagaaaaaggacctatgttgcccagactagtctcaatctcctgagctcaagtgatcctccctccttggcctcccaaagttctgggattgcaggcatgagccaccatacccagcctgtctgttgattttattttcggtgctttttttgtatatggaactttttctattagtatttagtcatatttgttagtcttgtcctttatcccttctagcctttaccttatttagtaatatcagatgatgtgtttcatatgggtctaatttatgcattcattcacttacagaagctaatcatttgagtcctagtgtaccaagtatcttagatgatgggtcattgctgactgtacaatctaagaagaatcttatttgcaacaatgatgctttagcgtagcagcagaccaaattctctaggatgattagcagctaattctgaatattgctgtaaagtcatagtagcatgtaacatgtacagcaatagtaaaaacatgtaacagtttgttccttcctaaaattttgttaatttagtcttttatgtgtccttatatttataaatattagttttgtggctaaaatgtgtacatttttccaagttatagtattgagaagcatagctagtagcatttcacccaacagaaaaaattcctttagataaaagccaaatcacagttggcctcattctacatactgttctacaaattacaaaatcagtaaatgtttattgggtacctgtttttattgctaagctcttgcaagagaaagagagaggtggtaggatttttttaaggtgcgagctattatcctatttttaaagagctcataatctagtttggaatgtttggcataagtacatccaaaggtaaataataaaacaaatgataattgctcaacaatatgtaaagacccccctctccaaaccaaaacaaaacagaacaacaaaattgtcagtctcttctgtgagcagtattatctgctgaggacatgttactggtcgaagagctttggctgcagtcattcctagaatgcaaaatgaaatcatccaaaaaactgagagtggccagttttactagtcaaatggagtaagtggtcatctgtgagtttgtgaatctgtctgccagaatatatttattttcttgcttattccaccagttactccttcttgttaaagctttcaccgttattaaagagaagtacctcctggaaattttagcctgctagatgttgtcaaacctgatagcacagtgtgataggctaagattctttgttcatttgttttggatagggaaggaaagacacaatgaaaagactaggagtctgaggtgagggaagatgatgaagaatatgaatcaagggatcaggcatcaagataaccgttcatttatttaaatgtagactttatctgtcttgatcaggcatcaatataacctacatttatttaaaagtaaactttatttgtctaatgtatgtgttcctaatccctgaatctattcatttcattgaaattgatgagtactttcaatacaaatagttacaatattttaagatgttcactgtttataacatcattatatgagtccatgttaaaccagagaagcagaaccagtagacaatatagatttagagatttgttacaaggaattggatgatggaagtatggaggctggctaagcgagtccaaagcccagtcaagaggaaagcaggctagaaacccatgggcataagctgtttagagtccctcagctcagggaaagcctaagctctctttcaaagggctcacctaactttgccttgtaattttctataatggattcctagagtttaccaactaatatgacggtctagagttacatttaagtgaaatttgattgtgagattgtattcttaactgtctatatctggtgctcttgagcacgtatacaaccttctcgccttctctaggtccctaaaagtcatttcttaattcaaaaaatatttaaatgcctgctatgtaccaagcacttctcttgatagagtggtgagcatgacaatctagtagaaaagtgagacagggaaacaccaacattactgtggaaaacatagttacaggggaagtagaaggacattagtcatgtttttttcttcatgacccactgcctaacacatagtagatgcttaataaatgccttttaaataaataagaccacatggcatttttaaaggagtaaggacctctttaaaaataagtatatatggggaaggaaagagatgatgagaagactaggagtctgagtcttgctacagaactagggtaactggagctagtagaaaagcaaagaagcttctgatttggggatggattcaagagtatattgggatgggtgcaaacactttcactgattagcagtttacatatttccttcaaggatagtcttactctccttgtcctaacttttaacctttgcttcaaattagtttagcagtttgtactaagaggaattgccagtgaccaagtgaatatgatatacatataaaagaacagagaaaatcaagtctttactatgttgctgtatcactaattcaggcttccagctaaatgccagaacataaattaggtcccttatcaaatctggcacaaaaatatttaggatcctttttaatatagtacatgtgctttcaataaatgcctgctttggcaaaaaataaaaccagtgttttttgtgtcaagtacaagctgttgtactctgtaacttttaaactgtccttgtgaaccaggttgagggtaaaattaaatttggattttgtattcagttttacaatcaacaaataccattttttttctttgtgttgtgttgtcttatgggtgtttgttttattttggtttggttttggtttggttttcacttagaacaaaattcaaaatctactaaatactccctagccacactggcctgttttcagtttgagatttttttatttttaattttttttaaagatgacatcccactgtgttgtccaggctggagtgcggtggctattctcaggcatgattatagcacaactacatccttgaattcctgggctaaagaggtcctcctgcctcagccactcaagtagctgggactataggcttgcacctccacacctgacttctttctgtttttaagacagttgagctctttcacctgtcccctcaaactgtttgtacatgctcttccctctgccttgacctatttttacatcatgttcagtgttactcacccatcttactctcactaatttattaagtctcaaatattttctcagagattctttcttcacccatgcctccatatctcagttagatctcccttaaaaatctcttctgtgttactagttcctagcatatagtggatgtgtgataagtgaaaggatggactgaaacatagagcacatacaataggtatattctagtcattataaaatgtcctcaaggaactttcttaaatctgagttccaaagggccatgttattttgtaaataatattcttacttttactttagggaacaaaatcagcatttttaaatgaaatagatttaaaaatataggcatgtacattgtataaatgcatgtatacatatgtctaaatatggcaagttgcaaagtaacatgaataccatgattgctgtcataaaccttgaaagccactgtgttagtggatactgttgtataataatctccaaataagcacgtctagaaaacaacctgttttacttatcaatttccccaaacatctctctggtgactgcgtctttggcttcttttttatttatttatttattttttattattatactttaagttttagggtacatgtgcacaatgtgcaggttagttacctatgtatacatgtgccatgctggtgcgctgcacccactaactcgtcatctagcattaggtatatctcccaatgctatccctcccccctcccccaaccccacaacagtccccagagtgtgatgttccccttcctgtgtccatgtgttctcattgttcaattcccacctatgagtgagaatatgcggtgtttggttttttgttcttgggatagtttactgagaatgatgcgtctttggcttctaagagttctttgctgagagtaaagagccagaatctcagaaatcccccagaaagacgatttaagttaaatgcacccatcaagctttgaaggaaggcggcttaaaaaaagaaaaacactatattacattctacttttaattttcaaaacctgaaaaccttctcaaatccaggaaaactaatggtatttccatctattctctttgatagcccacaattcctatgattttcttagcatcccataatacattttgcttttatccttttactgtttttcttcctagaattttctttcaaggtccaacacagaaatcctttttctcaacaaacctttcctgactaaccctgtttccttttttaaaattctttgcattttctcaacagtttttgatatttattttttaacgtttgtatacaatactataatacagtcagttatttataactttattttgtgttagaagtaggttttttgtgtgtttgcattcttcctaattttacatgtgcaaaaagttactttaatcttatttttcttaaatgaaataatccaattttaaatccctttcctggagaattaaatataagtcattttgggggtgctttccttcacctcccccagaatctcacacaaaataaaacattcagagaattaatcgcccctgccccaccccaccctaatcttctgtccatgttggctgtcctgagttgtccactgttaaaccacataatcccttatagttcagtggctctgttgcttcttaggacatgaacatcttggccaaggcttcaatagctttctgtgttggatattttctcctggcatctccagatagactttttactcttttctttccctattctgtgcccaaaggccctgagaaaattgctaagtattagtaacatggagaaaaaagggatatagtttctgggactgtaaattattcaaaggatagttttaaagctctgggaaagtttggtgaaagttaaaaacgtgttcagagaggaggagttggagcctagtcaagtcacaaatcttctaattcagccaagctctagtagcactcctgaaacattactactatatccttaacatgtgcttttttagttcatgaaacaatattggcataactgttcccctaacaacttaatgagaaagttaaagattttaacaactcaagattgctgcctatgatacttatgatttttaaacaagttgtcatatcaataataataataaaaaaaccataaacctagctgggcatggtggctgacgcctgtaatcccagcactttgggaggctgaggcgggcagatcacctgaggttgggagttcgacaccatcctgaccaacatggagaaactccatctctactaaaaatacaaaattagctgggcatggtggcgcatgcctgtaatcccagctactggggaggctgaggcaggagaatcgcttgaacccaggaggcagaggttgcagtgagccgagatcatgccattgcactccagcctgggcaacaagagcgaaactccgtctcaaaaaaaaaaaaaaaaaaaaaaccatgaaccttcctttaggaaatagagcaatgtagtataaccccacttgcaattttatttttcagattaatgaatatgattaaaattaagatggaataaaaattaaaacaattaaataaaatacaaattggttgtataataaagacaaaattgttatcttgagacacatgttgcatctttccatatgttctaaaattccttaggaacttggcacaagtgctgctgaaataatttctgactgataagtggcagatgccttatcttttattgtggtattaattctaaatcccatcaaataagacaatgcatgatacaaaggataaatttataagcatttgcctcccaatttagacacagaatcattatcatagtacattcactttcaacttgtttctatgttctttctctccttcacatctggcctcttcatgtttttattttctctctctctcttttttttttttttttttttttgtggagacagtctcactctgtcacccaggctagagtgcagtggcacgatcacagctcactgcagcctccaactcctgggctcaagtaatcctcccacctcagcctcctgagtagctgggaccacagacatgcaccaccacacccggctatgtttttgatgtcttgtagagacagggtctcactatgtgagaggctggtcttgcactcatgggctcaggcagtccttcctcagtctcccaacgtgctgggattacatgcgtgagccaccatacctgggcctgttttctctttcttttcattctaaccataatcacttatctatttatggtttttgtttctatttctgaatacatttaaatgccagttataaaatcagaaattcttatttgtgcttaaacatagtaagatttagcagtagtttgaacttcaacatgattattaaatgtggattttaatactagtgatgattcacattttccaacttttatactttacaatttgtttttcttgatgagagtttaggtatctatgaatgaggagaaaagttaattgaattttggcttctagaaacaagtaattaatcttttcctgttaccttttaaaaagatactttactttttatagaaagatagcagtagaaaagaacaggtatttaaatctactcactgacttagaccaattatttcataatggaatctctacttctgtgaatatgtgttttgcttaacgagacctcctaaaaactcatttttatggtcattgaattttagagttagaaaagactttagaaagtgttattagcctctcattttttaaaaacagtttgtatcttgcccaaagtcacactaggggtaaagtaagaggcaaaggaagaactggaattcaagtttctagattccaagtccaggactctttctttttatctcattattttatgaaacatggagagcaagctgattgttcatttaagttcattacactgtatcttggaatttgtcatttctatgcttcactatttaaattaaaatattttatgtttatcacctgttttttgatctgccatgtaagaattttcacttattgtcttccctttaacattgagtctgcatactgctgctaaataatctttctacagtatagtcctaattatgtccctcaaaaaccataatatatctcaccccttctatcagccacatagttaaataaattaaatccaatcatttaacccattgcagactaaatctgcctttcaaatcttagtactttccactcctctgctcatattttatgggccaggcaaatggactacttacttgctattctcaggacacacgtctcatttttcataccactctatcctttcttatacatataacaactttgcctaaaattgtgcccatttgttgagactttgatcaaatttcacatttcccatttcttttgttctctctctctctgttttttttgttttttttgtttttttttttttttttgagatggagtctcgctctgtcgcccaggctggagtgcagtggcgcgatctcagctcactgcaacctccgcctcccagattcacgccattctcctgcctcagcctcctgagtagttaggactacaggcgcctgccaccacgcccagctaatttttttgtatttttagtagaggcagagtttcaccgagttagccaggatggtctcaatctcctgacctcgtaatccgcccgcctcagcttcccaaagtgctgggattacaggcctgagccaccgcgccaggccctattctctctctttttaattccaattacagtgtagtacaagcttgtccaaactatgacccatgggccacatgcagccctggatggctttgaatgcagcctaacacaaattcataaactttgttaaaagattatgaggtgggtgttgctgggtgtgtgtgtgtgtttagctcatcagctgttgttagtgtttgtacattttatgtgtggcccaagacaattctttttcttttaattgtgaccaaaggaagccaaaagattggacatcctttatgtattatattctgactttaaatattgctttccccttaatttttttttcattgtcatctcctcactttattgcaagtacagtcagcatcaatgttgagaactttttctcctaggaggtacaggatttggctctgatacggtgttgcctccacagttgctcagaatctaggctccatctgttacaggaaaggggtcctaatccagaacccaagagaaagttcttggatcttgcacaagaaagaattcagggcaagtccacagtgcaaagcaaaagcaagtttattaagaaagtaagagaataaaagaatggctactccatagacagagcagccctgaggactgctggttgcccatttctatggttatttcttttttttttttttacatgttctattttttaataaaaatatttatttggtcttatgaatacagaattattttatttttatttcaaatgcctaggtattataattctgtataatagttatttgtactttttatatttttatcttttttttattatactttaagttttagggtacatgtgcacaacgtgcaggttagttacatatgtatacgtgtgccatgttggtgtgctgcacccagtgactcgtcatttaacattaggtatatctccaaatgctatccctcccccctcccccaaccccacaacaggccccggtgtgtgatgttccccttcctgtgtccatgtgttctcattgttcaattcccacctatgagtgagaacatgcattgtttggctttttgtccttgcagtagtttgctgagaatgatggtctccagcttcatccatgtccctacaaaagacatgaactcatcattttttatggctgcatagtattccatggtgtacatgtgccacgttttcttaatccagtctatcattgttggacatttgggttggttccaagtctttgctattgtgaatagtgccgcaataaacatacgtgtgcatgtgtctttatggcagcatgatttataatcccttgggtatatacccagtagtgggattgctgggtcaaatggtatttctagttctagatccctgaggaatcgccacactgacttccacaatggttgaactagtttacagtcccaccaacagtgtgaaagtgtttctatttctccacatcctctccagcacctgctgtttcctgactttttaatgatcgccattctaactggtgtgagatggtatctcattgtggttttgatttgcatttctctgatggccaatgatgatgagcattttttcatgtgtcttttggctgcaaaaatgtcttcttttgagaagtgtctgttcatatccttcgcccactttttgatgaggctgtttttttcttgtgaatttgttggagttcattgtagattctggatattagccctttgtcagatgagcagattgcaaaaattttctcctattctgtaggttgcctgttcactctgatggtagtttcttttgctgtgcagaagctctttagcttaatcagatcccatttgtcaattttgacttttgttgccattgcttttggtgtcttagatttgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacttatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactatagccttgtagtatagtttgaagtcaggtagcgtgatgcctccagctttgttcttttggcttaggattgacttggcgatgcgggctcttttttgattccatatgaactttaaagtagttttttccaattctgtgaagaaagtcattggcagtttgatggggatggcattgaatctataaattaccttgggcaatatggccattttcacaatattgattcttcctacccatgagcatggaatgttcttccatttgtttgtatcctcttttatttcattgagcagtggtttgtagttctccttgaagaggtccctccttgaagaggtccttcacatcccttgtaagttggattcctaggtattttattctctttgaagcaattgtgaatgggatttcactcatgatttggctctgtttgtctgttattggtgtataagaatgcttgtgatttttgcatattgattttgtatcctgagactttgctgaagttgcttatcagcttaaggagattttgggctgagacgatggggttttctagatatacaatcatgtcatctcaaacagggacaatttgacttcctcttttcctaattgaataccctttatttccttctcctgcctgattgccctggccagaacttccaacactatgttgaataggagtggtgagagagggcatccctgtcttgtgcccattttcaaagggaatgcttccagtttttgcccattcagtatgatactggctatgggtttgtcatagatagctgttattattttgagatacgtcccatcaatacctaatttattgagagtttttagcatgaagagttgttgaattttatcaaaggccttttctgcatctattgagataatcatgtggtttttgtctttggttctgtttatatgctggattacatttattgatttgcgtatattgaaccagctttgcatcccagggatgaagcccacttgatcatggtggataagctttttgatgtgctgctggattcggtttgccagtattttattgaggatttttgcattgatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactctttttggttggtaagctattgattattgccacaatttcagagcctgttattcgtctattcagagagtcaacttcttcctggtttagtcttgggagggtgtatgtgtcgagggatttattcatttcttctagattttctagtttatttgcgtagaggtgtttatagtattctctgatggtagtttgtatttctgtgggatcggtggtgatatccccttattttttattgcgtctatttgattcttctctctttttttctttattagtcttgctagcggtctatcaattttgttgatcctttcaaaaaagcagctcctggattcattaattttttgaagggttttttgtgtctctatttccttcagttctgctctgattttagttatttcttgccttctgctagcttttgaatgtgtttgctcttgcttttctagttcttttaattgtgatgttagttttgagcctatgtgtgtctctgcacgtgagatgggtttcctgaatacagcacactgatgggtcttgactctttatccagtttgccagtcggtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctgatggtgacaaaatctctcagcatttgcttgtctgtaaagtattttatttctccttcacttatgaagcttagtttggctggatatgaaattctgtgttgaaaattcttttctttaagaatgttgaatattggcccccactctcttctggcttttagagtttttgccgagagatctgctgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtgtttgctgaatctgaatgttggctgccttgctagattggggaagttctcctggataatatcctgcagagtgttttccaacttggttccattctccccgtcactttcaggtacacaaatcagacgtagatttggtcttttcacttagtcccatatttcttggaggctttgtttgtttctttttattcttttttctctaaacttcccttctcgcttcatttcattcatttcatcttccatcactgataccctttcttccagttgatcgaatcggctcctgaggcttctgcattcttcacgtagttctcgagccttggctttcagctccatcagctcctttaagcacttctctatattggttattctagttatatattcatctaaatttttttcaaagttttcaacttctttgcctttggtttgaatttcctcctgtagctcggagtagtttgatcatctgaagccttcttctctcaactcgtcaaagtcattctccatccagctttgttccgttgctgctgaggagctgcgttcctttggaggaggagaggcgctctgctttttagagtttccagtttttctgctctgttttttccccatctttgtggttttatctacttttggtctttgatgatggtgatgtacagacgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagcagattttcgtgaaccacaaatgctgctgtctgattgttcctctggaatttttgtctcagaggagtgcccggccgtgtgaggtgtcagtctgcccctactgggggatgcctcccagttaggctgctcaggggtcagcggtcagggacccacttgaggaggcagtctgcccgttctcagatctccatctgcgtgctgggagaaccactgctctcttcaaagctgtcagatagggacatttaagtctgcagaggttactgctgtctttttgtttgtctgtgccctgcccccagaggtggagcctacagaggcaggcaggcctccttgagctgtggtgagctccacccagttggagcttcctggctgctttgtttacccaagcaagcctcggcaatggcgggcgcccctcccccagcctcgctgctgccttgcagtttgatctcagactgctgtgctagcaatcagcgagactccatgggcgtaggaccctccgagccaggtgcgggatataatctcctggtgcgccattttttaagcctgttggaaaagcgcagtattgaggtgggaatgacccgatcttccaggtgccgtctgtcacccctttctttgactaggaaagggaactccctgaccccttgcgcttcccgagtgaggcaatgcctcgccctgctttggctcacgcacagtgcgctgcacccactgtcctgcgcccactgtctggcactccctagtgagatgaacccggtaccccaaatggaaatgcagaaatcacacgttttctgcgtcgctcacactgggagctgtagactggagctgttcccatttggccatcttggctccgctactttctttctttttttttttttttttttgagaaagattctcactcagccaccaggctggagtacagtggtgcgatctcagctcaccgcaacctccatccacctccgacattgaagcgattctcctgcctcagcctcccaagtagctgggactacaggcgcatgccaccacgccctgttaatttttgtatttttagtagagacggggtttcaccttgttggccaggatggtctcgctctcttgacctcgtgatctgcctgcctcagcctcccaaagtgctgggattacaggcatgagccactgtgcctggccattcttgctactttcatagcaaaacatttggctttggctttgctattctgctttattgtactctttgatatccagtatctaccagtaatgtctggactgcatacatcgttgaaaatacaactgtaattaaagatttaaatgcaatattctttcaggaaaatctctttccctgattttgtttgatattggaaatgaaacaataccataatccttcaggataacttcccacagcaggacaactgcaggaatggcacaaaatatgaattgcataaatactcttatagaacacatcagactagcactttcccaagtttttagtcagatctttgctaccatccctgaaactgttaatgcatatgagtagaaaaattttttacctttgtaagcaaagattctactactagaataatcaaattaactcattctaatgcacatttacttaattcatactatgtgtgaggcagttttaggatgtgatagaaaactttgttttgaagaagctgataaactaggtgggggggaaacagagtacaaataaattataatgcaacataagaaatagcataatagaagaatattcagaccactaaagtcagtcaactctgatccccaaaattaagtatgaaccacaaaaaaatcaagtcagtgtcaatctaatgcagatttatttgagggcttctcttttcttctttgcttaatgtaggtgagtgctttatccttgctatttggtaaatcagcaaggatttattatctattctttgcagagtagtatgttagatgctttgaggatactaaatgaaaaagagtttctgcaccaagaatgtataatctagtagaggagataagctatctatacaaataactgtgtctgcagtctgcacataattgttataaaagaagcctttacaacttgagccaaattcttttacaatgcagaaagccactcctggaggtagagaaaggagagaacatgaacaattcaagaagacttctgttatgcaaaagatggctgaactaaccctggagggatgggtaggattttgacaagagtggttgaaggtattctaattcacttagtacctacatgtgcgaggcagcatgaaggcaaaaaagcctggggcatgttcagagaatagcaagtattctagtttgagtggcacctggtacgtatataagggaatagtaaaagatctggctggaaaggaaaagtaggggcaggttacgaaggacctctgaaagtcagactgtggaactggaacttttatcaggaagcagtagttagttttttcaagcaaaagctaattagagttgatatttaggaggatgaatctaacagttgtgtgcaaggatgccttcaaactgagtgagactagtactggagactggttaagagactacaacaataacctgagtaagaattaatacaggcctgacctagttttgagtgagtaggattggaaacaagagttttaggtattataggatttatgcatataaaatggacttgacagaacttgaagaaagagaaagtgtcaaaaggacacagaaagtgaggcaggatatcttacaatgttaaaggaaaggaataatagaagttaccccccaccccagagaaaaaaaagtaaagagaaaagattggaaagttaaaaactgaacttttagagaaagactgcatttagggaatgtagcaaataagataagcaacagaaaagtgagagaatgggaataaagatatgcaacagaaaagaagggaagagagttcctaggaaagggtggggaaattcaaattctaaaatatcgatgaagtctcatttttcatgtattaaattatccagtggagttggaagatccaaaagagagcaattaaatatgctagagtgcatggggaaaattgacaaaagacctaaaagaaaaatatttaaccacaaaatgaaaagtaataggagatgctaagaaattttggatgggagttaaaattaaatctctgaaagaataaaagggaattaatactcaatttatatcttaaataaatatttctaaatgttacactatgcagaaatccttcttccctggaaaaaatgagatcaagtcctattcaaaaaggtcaagaagaaagactgaggttggtgacccgtgagaaaagtttctgagataagtgtaggtggaatttgtagtattatttatcataagtcagatggctgttaacaaaaagttaattttacatctcatctgttagcccagtcgctttataatgttcggtacaacagaaatgccactactttgtaaccacctaaatgctgtattaccttcaatttccattgtgttgttgatacccaagcagaactcattctttgtcatggagactacagaataccacaagcaggcactaaggttggataatgtgttatctcacattctgaaaggagggtctacatggtagatacatttcttgattctgttttgggataattggctcctaagataattggctatttcattattaaatgcagtatgaactttgcagaagtattcagtatctcttaaaacctgtttcttttccatatagcagtggtacctactttcaatttagtatttattcaccatctactacatgctccacttagtgttttgtattatttctctgtgtgtgtgtgtgtgtgtgtgtgtgtgtgtgtgtgtgtgtgtagtctaacttgtacatttggccaatttctttttcaagcatgttagatttttctctctgacttctttgtagatgtggggtagttttgttttttacttaagagacctgtattgattatttctatggctgtccttgctaattcccactggccattgtgaaaaatcttgtctatggtgtatttgtttctaagacagccacattacaatacactctgtacataattactatgaatcagctggcaagaaagaagaaaataatactggttattggtaatatttgttgattttatatgttagctttattaaagatttttttttcttatcttttttctttcaactattgctacctctgaagaggcttttggtagtatttagatgggttgtgctatccataggtaaaaattctgacctgggggatattacctttatttttcactagatgtaggaaagtagatgctgctctgtttttactccattttgttacattaaaaaaaaattacaatgtagtcctataagtttctttttttattttatccagtactattttagactgtgaatattactggaatttctagttctattccctcttctccctctaaaaatcaaaagtgccaaagagtagtagaccttttgtgatatgttctagtcaaaatagctaaaaactagcgctctctctttaaagttcatattcatctagaacatctcacaccttactcttaccactttactcacagtagtttaaaaaataaaactgtaccctgtatatttgttcatttttgtgttttatgtagagtttccattttgtttttactttttttcaagagtgaattttgtaaaacttccagagtagagtaagttacggccattagagtagccctggaggatgagacttatagtggcaatgattatcacaccttgacaacttgggaagggccatgggatgtggatgtggaaaatatataaaaggacattggttcacatttgaacaaagtggaaggaattattagaaaagcacttaacaagggtgctgatctctccccatctgaggtcttctttcttcttttcatctaattttaagcactgatcagtgaattctttctcattattttacataagcaggtatctaaacttataaaaaattgattatttatcttgtcttttagtgcctttttattaatataagttatttggtttttaaattgtgttgccaatgaatgaaggaagtcctgtcaaaagatatacattttacttatcttaaggctaacagccaccatgtccagcctagcaaacattttttttaatgaaagtccaagtagtatggtctctgttaagctactctacttcaactctgtctgtggtagcataaaagcaaccatagataatatggaaacaaatagtcatttgctgtattccaataagactttataaaaacaggtggcaggatgaatttgtcctataggctgtaggttgctgatcctagcataatgtattgattatacattatggtagagccctctgttggttggaagagaggaccagggaaaaaaaagtgaagatgtattagctatacagaactttctagttggtaagacaaaaagcaagaaaattacagtaatatagaatatgtaaaataaaggaggattcagaactgagtaggtaattcttcagagcatgtcaaatgtagattatggtaaagtagaatgtttatggtttaatacatcaagaactatatccttcataaaataaaatgtagctggacatggtggctacatcttagccaccatatttttacatgtacatgtttggtacaggcttatggtggcatgtaattccaacattttgggaggccgaggcaggtggatcacctgagatcaggagttcaagaccagcctggccaacatggcaaaaccccatctctactgaaaatacagaaattagccgggtgtggtggcgtgtgtctgtagtcccagcttctagggagactgaggcatgagaatcgcttgaaccggggaggcagaggttgcagtgagctgagatcatgccactgcactccagcctgggcaacagagtgagaccctgtcttaaaaaaaaaaaaaaagtgaagaacaaggtaagacacatttaatatatctgatcaagtggtcttgtccaaaaaatgtcctgatacatttttttaaactaataaatggaggattgcagacttactgaatatggcaggatcctttagcatgtaatactttaaaatggatccacactgaacttctgctggatgtactggagtaagagtggccagatttatcctccctcctcaaacaatgcaaaaaccagacaaggtatataacataagagtttttagacactagacaatactgggcagtgatccctgagagaaaatgaatgaggcatccctacaatttccatagcattctgcctagatagcttccagtctgtagtctgcaggaaggagatccaaaacagaaagaacccagtggcccaactgaatggagacaaagccaaggtggctagaatttgcatgagacagtgcgagagaagacagagctccacagagatagagcacacacactggatatctgcagagggctccccttgatttttaagccaagtactgaaccacataagtatgctaggaaactacttagggacagggataaagccactggaaaggaataagtggaacatttcctgaactcagataagattaataatagtttatagccccaataatcacagtggaaaagcctctaataaattggacatcttttttagtactcaaaagaatattacatcagttggggacaatattagctctagattaagagctgctctcatctcacctagtaaagcttctaaataagcttgtaaagaatcaagttgtttttgagtaaccaactgaatttcagagtaaagttagggccattagagtagccctgaaaatatataatgagaaacaaaatatttgatatggtttggctgtgtccccatccaaatctcaccttgaattcccacgtgttgtgggacccagtgggaggtaattgaatcatgggagcaagtctttcccatcctattctcatggtagtgtataagtctcatgagatctgatggttttaaaaagaggagttcctggccaggcacggtggctcacacctgtaatcccagcattttgggagtccaaggcaggtggatcacttgaggtcaggaattcaaaaccagcttgaccaacatggtgaaaccccatctctattaaaaatacaaaattagccaggcatggtggcacacgcctgtaatcccagctacttgagaggctgaggcaggagaattgcttgaacccagaaggcagaggttacagtgagctgagatcatgccattgcacttcagcctgggcaacaagagcaaaactccatctaaaaaaaaaaaaaaaaggagttaccctgcacaagctctctctctttgcctgctgtcatccatgtaagatgtgacgtgctcctccttgccttctgccatgattgtgaggcttccccagccacatggaactctaagtccaaataaacctctttcttttgtaaactgcccagtcttgggtatgtctttatcagcagcatgaaaatggactaatacaatattctacacctaaaacataaaattcataatgtctgttatccaatcaaaaattacctttcattacctgagaaaggcattgttaaaaaataaataagtaagccaggcacagtgacaaatgcctgtagtttctagctacttgagaggtggaaacaagaagatagcttgagcccaggattttgaggccagcctgtgcaacacagcaagaccctatctcagtcaatcaataataaatacacacacacacacacacacacacacacacacacgtatatataaccattcatgcgaagaagcaggaaaatacaacccataatgaggagaaatattaatagaaatggatttagaaatgatacagatgttaggattcgttgacaaagatgttaaaacagcatttctaaatatattatgtatttcaagaaggtaaataaaaacataatcctattaaagagtaatgtgggaaatgtaaaaaaagacctaatttctagaaataaaaaataccatgtctgaggtgaaaagttcactgggtaagatgtggcactacagaagaaaagattaaggatcttgaagacatagcaatagcaattgttcaaaatgaaacacctagagggaaaaaaagactggaaaaacaagcagtgtcactgtgagctgtgagacaactttagatgatcaaatatataaagactacggatggggcagggagacagaaaaaatatttgaagacataagggctgaaatttttccaaatttgataataactgtaaacccacaaatccaaaaagctcaacaaaccaaaagcagaagaaacactgaaaagctacaccaaggaacataatcaaattgcataagatcagtaataaagaaaaaaaacttaaagtagctaggtttctaaaaacaacaacaacaacaacaaaaatgcattacatacagagaaacaaagataagaatagcagcagtctcctcaacagaaacaatgcaagctagaccttggaacacagaaggaaagagaatattaacccagaattctagacccagtgaaaatacctttcaaaaacaaaagcagaatactttttcagacgtataaaacctgaaagagttcatcagcaggagaccattcagaaagcctcagatctaaatgctgcctgtaacaattacctgctgtatggccttggacatacttgaatctctctgaaccttcaaattttcatctgtaagataaaaataatgctaatttttaggggtttcgtgagaatccaatgatagaaaggaaaagaactgacattcattgaatgtcttctttataccaaccacgtattatctcattaaaaatggaaataacctgcctgggcaacatggcaaaaccctgtctctacaaaaaaatacaaaaattagctgagcatggtggtgcatacctgtagtgccaactgtttgggaggctgaggtgagcctgggaggttgaggctaaagtaagctgtgatcctgccactgtattccatcctgggcaacagagtgagacccaatctcaaaaaaaaaataaaaaataaaaatggaaataaaattcccaataatagggctactatcctaacatttttcttatgctagcctctttcttcttgttctttaatactaaaaacttgggttgttctgaaagaaattagtctaagtagcttgtctgtcttacgttttgatgaagcactttttcctaacttaatttgttctttagttaccagattaaatatgcttaaaagtgggaatgaacaactctccttgctagaatagacaagtcagttaatcactttgtgaaacagttaagtttcttgtaaactgcactttatttttttgcctgtgttttggctgcttaatttttttcagttatgtttattgaggtataatttatatactgtttatctaatttttattataaacctattggatagaggcatgagtgtctttatagctgtgcattgccccatagagtttttggcactcaataaaatgttaaataatatttttattcagcattctgtagacgggaagcatatggtaacaaatgtcagagcacaggttgaaaatctccaaaaagttatatgatatattctttggaaaagctagtagagatacttttgtgaatgaaatttctcttaaaaggggttcccagactcacattttatgcaacaaatttctccagccttcagttactttatttacaaattaaagtttttccttatcagaaataatgcataagttaaaatagtataatactaacgtggtatcataagaaagtatataaatggtttgatagataacataaagtaaaggtaactcatagtttgaaggacagcatgagaaaatatttagaagctttagcagtataagtctttatgttgtgatatattgtatgaaaagaaatacacagtggatagttctttattgttaaatttcagcatgacttagttatgtcactgctacagctgttgcagacattctagtggtaggagactttgactcaatattgtttttctcacctgaggattctagcactatttaatactcttattttagtgtcagaaacaatcattgcttcagaataacagaagacattgtgaattaaaacttcaaataaatttcatgcaaaggataatatctcccggttaatctgtgttgaagaaatggttgaccataatcaggtatacaaagccatttagatagcatatatctaaattttctttccagaatttgcttaccctctgatttgctgaccacacttgctttgaagttttggtttttgttgtcttgctatgttgcccaggcatgtctcaaattcctggacacaagcaatcctcccacctcagcctcccaaaatgttgggattacaggcatgagccactgcacctggccactttgaagtttttattaacataatttgaatgtgaaattacctgagtttttcttgttaacctcatgtataaaatgtgggatagggaatccaggcactgcttacttagcttggtgcctctggctctcataagacttttaataaaggtgtcaaccaggtttgtagtcatcttgctgctcagctaggggaggatcttcttccaagcccactcatgtccggtcacagccctcagatcctcactggttattgatcatgcaccactccatagtcctcacaacattgcaacttatttctcctagagcgagggctcagagagagaaggcttgtgatcaagaagatgaacaaaacataccatcacttttgtcatatatttgttaaagcaagtcactaggtctagagcacattcaaggggaggagaatgtacaaggatttgaataccaggttcaaggatcattgaaaaccattttgaagactgcctcctacacatataatccacagatgggacagatcattaaagtactctaggtgctctgacactcatttgtttatcctgagatcttaacaagaacttgaattcaataggcaaaatgatttcagtttcacataaagtatttcatttattcctagcaacaatgcaacgaaataggtatggttaaccccaatgttattgatgaagaaattgatgtactgagtgactggctcaagattacatagcaaataatttgtaaaactgggaccttagtgtaggccttttgattctagaccctgtactctttccattggctataattgcttcctaccagtactatgttgcacttaaagccattcaaggagaatattatacctctaaatttatatacaattatatgaatttttattatacagagatttttatacatatatgtagagaaagacagacacccccctgtcttaatctctaacctataccactccgtttaggagttatagtattattgagtcaaagtctaatatcattataaggcctgtaacagctgtagcaatgacacacatgtacacagatgctagcagcctaaaactacacttaggaggtaaatgtttgttgcatggagagatgaagaagcaaagtaagaaaacagacctggtctggtggctccattcccccttggcttgtcagtatacagaaatcattgtgtttctatataactagtaacaaataattggaattgcagtgagtatgggcaagttatggttttagtttaatattgattatagataattctactttataagtaagaacttgtgttatcagatgaaatatagagaaagttttctcctccatagttgtctttcatatacgcaaacatgcacttgagtttctttcctttcctgcataatctgaggattgtgctttttaatagtggcttgctgatccctttaaatagctcttaatgtaagtattccatagttttcattaatctgattaacatagtttttccctaacctccattcaaaaactatatttggttgttgttttaccctggttgctgaagcagcaagcctactgcaaaacctaagtggtgtggtatagatgagagtctaagactttaattatatgtcattttattcacaacactcaattccaggaaggaaaaaatgggtctgtttttgtaaaggacatattatgtgagtatcattcattgtaaaccaaaaatgatactgtattatagcatagacaacaatgagaactgattctgaaaatgtgacctgactgagaaactgagtaatagtgaaagttatcaaaatggaaaaaaagcgttaatgtgaaatccagccttctcagaaatactctttcctggcctgtttagttttgcttttgttgcttgtcatgcatgaatgaaagtgctgtactctcaggggagcaggaaagcctctgtgtcggttgtttatttccttaatccctcctcctttgtgatttttgatgtcagatctaaaatggaaagcctgtaaatataatgattatcacacggataatcacctgcattaggaaccgccctgcttttctattctaacccgagctgttctccacatgtcacatccactctgtggttggattttaacctgactgcttcattagatttgtgaaactcagtacgaggcgccctggggcagcacagatggggacttgcttgttttcttttctcacttttactgcaaaggcacactaaaaagtccttttcaatttagtgcgatcagttcacttggaattatctctgatatttggaacctgtcttgctcttctgcccaccaactatgcctattctttcttccttactttctgacctaatgtcttttctttctgcctctgcatgtcatgaatctgacaactaaaattctgcttacaattcttactgggtcaaactgttcccccgtgttgttttgtttgttttgctgacagggaaaaataaatgttgttccatcattgtacctacaaacaccttcagatcagaggttagctgtgggaaagtctgcagtgatatgagccagctgccttctctaatggagtgacttggggcaccagtccaagatcagaggaaggtgggaggaagtcagaagataagatcattttaagccacagaacaacaagcttagcttttctagtgatagggcacagctcagcaaacctgtgtgagggggcactaagacaaaaaattgagttgactttttttaagtacatctttcctcagtcagaaatatgttgatgcttgaaatagtttacagacatggaagtgtcctagggcctggtttccttaaaagataatgatttgacatttatatatgtgtcttcttgcagttagtcagctccataccataacagatcacagttaatttttaaaaataatttttttgggctgggcatagtaactcatacctgtaatcccagaactttggaaggccaaggcaggtggatcacctgaggtcaggagttcgagaccagcctgatcaatatggtgaaacccccatctctgctaaaaatacaaaattagctgggcatggtggcacacacctgtagttccagctactcgggaggctgaggcaggagaatacctttaacccaggaggcggaggttgcaatgagctgagatcgcaccactgcactccagccagggctacaagagcaaagctctgtctcaaaaaaaaaaaaaaatatatatgtatatatatacacacacacatatttatatacacatatatatacatatacacacacataaattttttacagttaatttcttatatttgagcaaaactggacattaaaaaaattttactgtatgtgaattttgagcatttatggcttagtgcaattttagtcctacacattcttcctttgaactttgtcttacagtcccctggggttctctcatgtctctgatgaagttccatataaataagtggttctagtatagcttttttgttgtctttttcatataagaatttgcttggttcagagtgacagcttgggaagcactacatcaatagcttttgaaccttttcctattccttgatatcaccgccagcaaatgttactgactatgtgatgtacaaagttctaaccttgcttgcacaaattgaccagttgtcaagatcaatatttatttgcttatttttgtctacatgaactaagggtaacttggtcaggcttatgtttctctagtaaatagcgtaaggagttgtactttcaacttaacacttcctgttgacttcagtgtttagctgtaatcatacattttgacctttctaaatcctcaaaatggttctctaacctatatgttattagtacattggaccataggtgcatacatgtatttttttcccaatgttttcccaaatttctgctgaagacactgactgtactttctgccttacatggcttgatgctacagtcgttttagttgagttggatctgctcactactcaggctcaaatcccatccttctattaatatctcttggcaaagataattttggaagaatgtgagttaagatgtagagactcttgacagttgtctgcagttttttttttttttcattttcaagagggaagtagagttgaaaagtaatattgcctcccttttctatctgtcctaaaattaaagtataagcacaaagagtgaagaaagggaaaggatttgattacacatatgtatttttgtcatttagtaacctgttataagagccttagggtatataataatcattagattgtgtccttaagatatttaaaatctagaagaactttgcatattaaaattttttaaccatacatatttttaatgctcaactgtttttaccctgtcatcttatattaaagaggatttttggactgtttattataaaaaatttcaaacaaaaaaggagacattggacccctacatagcacatacatctagatttaacacttgttaacattttgccacttttgcttcattttaatttttttctgcagtattctaaaataaattacatatatcatgacatttcatttctaaatacctcaggattcatcttaagaattaaggacttttaaaatcaaactgataattcctaatattacctaattttcatttcagattcaaatttctccccttgtcccaaaaatgtcttttatagctggtttgtataaaccaattaaggtttatacattgttcttggtcattttcccttttctactttacattacattgacttgttaaaaacattaagctagttgtcctacagaatgtcctaccctatgaatgttttcagttgctttctctgtgtatactttaacttgttcccctatcctctgtatttcttatagactgcaagttactggactaaagttttgattaattcatattaaagtatttaggttagaatactttataggtgatggtgtgaacttcacactgcatcacaacagaaggcaaagaatatttggtgatcccactattagtgatgataagtgatagcatcgatcactgggttaaagtgatgacagcttgatccttccattataaagttatgctttgctcccgtgaccagcatataatctgagatactttgattccatggaaatacccagttccctatcatcctttttacccaatgagtttaacatctactgaggatccttgcctgcataaatttcgttatgaggattgcaaaaagatgatttttctgaatttatacatttattagcaggcattcttctctacataagagctttttgagaggtattgttttaattaaaaacacaaccaccagcatattccttggattgtctttctttgctgaggtcagaacacctgaactcactgtggcagctacagtaaaaacatgtactacatcttctttattccaacttgtgaagtgtgttgacattaggctgcctttttttattattattattccaagggaaaaaagaaatctttattgctgtaagaataaaaattgaactatgtgggtatattgagataattgtgtaaagaagaagactgaatgagtttcaaaaaatggattatttcttcattaccgagcactttataattaactgttcttttttttttttatttcaggaagctgccacttttgctagagagcaaggctttgaggtgagttaacccacaattgcacactaaacagatcctaaaggttttttctagctgataatgaagttcttttggacagtgattgatgtgctattatactctcagagcctcgcagcagttgccatggaaacttggcagtcgtcatggtttctttgttctgccagcacagtgttatgacgcactctgctaggtctgcacccaacatcgcctacagatgttatttattgaattttgaaaagcctcttgggaagccaagaggttgggcacggtttcaagctgcctctgcagatatggggcctgtcagtttgttcagttaaaaagctacctcattagctgcattacatttcataaggattcactgctaaagcagtggtggaacaagactaaataatgaaatataatgtcgtttaaataatttcagccctatcacatgtagattatcattatgcaaattaatttctaaaaggttgtacttaacagttgttaggaactgattaatttaaatcctgcttttataaacttactctttgaacctatcttttcttctctctccctctttttttctggggagacggaggtagcataaaatatacatacattttctgaaataaaatatcaataattggatttaatttctaggtcctaattctgtttttctgatataagtgttatcctgtcaagattcaaaactccatgtggttgttgttggcaaaactgagataaccgtgttttttatctgtataatacccctcttccaactgattgttagaaaacactgactaatatgaacccaggttaactgacagagaattaactaagttggagttgtttatgactatgatatttattgagtgaactatgtagaatgctgtgttcttacagcaacttaaagtgttacagggtagtaatttttaaaaatttaatctaaccacagccgaaatgtaggaactttctttttatttgcatattcagtattgtctatcaaacagggaagaggtgagtggtgattgaatagtatcagtaaggactagtaagctcactttgaactctagagaaagatattatatgagtttgtgaaactctttttaaatgtagtaaaggcagattatcaagcagcaaagtaatacatgttcatgttattcatgtcatcagacttgacaaacgagacatagagcttcctcttcatagaggaaagacaaggaacatgtgatacagatattctgttctgaagatcctataaaagaactactccagagtagggaaacttgcttctttgtactcaattattaggagctgtgatagtttcttacaagtttgcttttttatgctttaccatattatagtaaatctaggtttaagtcacatttagaaaaaggatttccaagtggtgggtttttttctaatttaagtttcacattttaatttcccaaactggcaattatatgtaggacaaaatgtaatcatgggaatattcaattaaaaagtcaaatgttttgatcatgagaatataaataaaaattttcaggaattttttaaagttttactgattttaagttttaatattacaaaaattatattatctgttgatacatcagaattctccatagaagaaaactttcagaacatacatttgtatcctgtcagtttactgtgttaccataaaaaatgtatttttggttctataaaataaccaattttgcagatacttagaaatataatttgttatataacatgatcatgatcctgtagtatctacatagcagtttttaaaaaatagtttattaagcctgattaatacttttatttcccccttgagctacttgcttttcatgtgcctggtttacattcagtcatagcaacaaactactttttctattttccattaactagcactatattcacctttccattagttcttacttactgattcttgaattgtttttgccataaatctgccataattgattacagcatataagcaaaatgataatgattataatcacataccttattacctcctgacatagcaaaactgctctgtcagtgatattgacagtgatatgttagactaaataaagcacatagtgtcttgatgtgtctcttcgtagattcccaaaaccatcacaagcattgcagaatatatttgaaccatgagtagggtaccctcaaatagatatttttaatcaaatgtaatccatgtatggaacactatctagagaaattcaatgattttataatgtcactaaagtttcctaggtcattagacagaaatggcagagcataggtttgaaacttggtattcttaaggaataaaacaaaaataaatcactttatcttaatagttttctgtgtgaaaatgcattaatactcttggctagtgtgacaaactagacaaaaatctgcattttatcccttctaactttaattttgactctaaatttggagcatgaatgagaagaaagaagtgaaaagattaaaagaaaggaaaggtgagtattttttccttccatcagtgccgctgtcctaccctcattttctcctataaatcccaatcagttccaaaagccactgagtattgccactagtgatctggctgctgacagaccaatccaagcgcctctaaaaataaccagtgtttattcgtcaggaaatattctcagtggcattttttttttaattgattattattctggttagcttctctgcaaattttacttttgtaaaaaaaaaaatctttaaactgaattcggcagttttcagtgagaagcagcagcttaggagagcactggagaatgagataaaaactggagctgggcagaacacaaagcataagagaggatttttttatatatataggtgatggaaaattgcatagtgcctgatttaaatgacagacctgctaagaatttaaaatgacaattcttggggtaaaaagttttataaggccttttattattctagaaaatcagttcagactggagtgtgtttttaaatctagcttttcttgagccgaactgattaaatgttcgtatttttagaacataaataaaaataaggtgctcaaaagcatgtttcattataaagccttttttaaactattgaaaattgatttaaataaagtgaagaaaatacctcaaaacctaaatatatatattctctatcttttcattgtctctgcaactgagtaaatgacaaatgatgaagagaattcataccttctctattggatcatttatttccttttactccaagtaataaattttagattttttttaaattttagatctctaagaataatacttctgctcataggggaaacaaagcaatccttttcgcctttttcacttcctccatagcccctgactacccagaagatcctagacttgtagtctttctctgaccaatgaggattctttcatcttacaccactgaaagagaaaagtatggaattgtgctatccaatacagcatctactagccacatgtggctatttaaattaggattaattaaaattaaataaaatttaaaattcatcacttcttggccttttggctaagatcaaatgtaaaattttaaattcagtccttcagtcatactaggcacatattgagtactctatagactatgtagctaatgactactttattggataatgcaggatagaacatatgcatcatcacagaaagtttcattgatcagcatggatagaaagtctacagagaatgtattcaggcagtgttgattaccaaagaattaccttaggtgacttttaggttcctgtgttcttcacaaatataaatagtgcaatgaatgatcactcagagtttcagagtttctgaaaataagaccctaaatcaggccctgctggctaagagagtgcagtgttgtttttgtaggtgcctgaaccccaaaagaggacaattttagaacagttcagttaagggaaagcaataagctagtcttctaattctcttcatttaatcatttatttattcaacaaatatttactgagttcttactatgtacataccactttgatagaccccaagacaaggtggaagtgaccagagagtgtaccatgaaagagcatgtgggaagggttcccattttagctatgatggctatggaatgaccctaaaaatatgaatatctagcaatgacaaaaaaaaagcgacacaaacagcaaaacaaatttcaaacagagagaacaggactataaaagtctctgaacgagagagaacttaatgtactatgtactccaggaactgacagaaggccagtgtgactggaatggagttagtggggacagcatatgagatcaatctggcactgacacatcatataaacagcataactattaaaggagtttctatttggaaaacaaaacaaaatggtatggctagatgactcaatgtgtggaaacactacagttggttttctacagaactaggtagactgtgacaggattgcttaacctttgtataaccagctggttaaaaatagaataaagattttctttatccagtctatcattgatgggcatttgggttggttccaagcctttgctattgtgaatagtgctgcagcaaacatatatgggcatgtgtctttatatcagaatgatttataatcctatgggtatatatccagtaatggtattgctgggtcaaatggtatttcttgttctagatcctttaggaatccagttcatgttctttgcatggacatggatgaagctagaaactatcattctcagcaaactaacacaggaacagaaagccaaacactgcatgttctcactcgtaagtgggaattgaacaatgagaacacatggacacagggagggcaacatcatacaccggggcctgttgtggggtggggggttggggagggatatcatcaggagaaataactaatgtagatgacaggttgatggctgcagcaaaccaccatggcacgcgtatacctctgtaacaaagctgcatgttctgcacaggtatcccagaaattaaagtatgattaaaaaaaatttctagtaatagtaacactactagtaattcaaatgaagtgtgtgtaacagaagaaataaaaaaaaaattaaaatgctacatctgaaaatacctatttcatacaaagcaaggaggtaaagaagggatagaacatatttttttaaaatatgacatatggaaaacaaatagcaaatggcagatattaattcaactgcattaataataatgttaatctggagtaaataatatgataaaaaggcagaaattctcagactagataaaaaaactgaggtctaactatatgctgtctgaaagagatgtatcttcaattcaaagatacaaataggtaaaaaaaaaaaaaaagaatgaagagagtatgttctttgatttggaagacaatgtgatcaccaatgacaataaaaccatatttctacatttataaaatgctcacagtttataaaacctttcccaacatatcagtaatacattcatacttgcacaaaccttgagagataggtagggcatgtattgccatatcagttcaacagattaaaaaaataggctatatggccgggtgtggtggctcccacgcctgtaatcccagcactttgggaggccaaggtgggtggatcacctgacatcaggagttcgagaccagcctggccaacatggtgaaaccccatctccccttaaaatacaaaaaaatagccaggtatggtggcagatgcctataatcccagctacttgggaggctgaggcaggagaattgcttgaaccaggatgtggaggttgcagtgagctgaaattgcaccattgcacaccagcctgggcaacaagagccaaactccatctcaaaaaaaaaaaaaaaaaaaaaggctctatgactttttcaaagtcatatagctaatacattatgtagccagaaccagagctcagctctctatgtctggtgctctttactataaagcacacagctttctctcacacattctaacatgttggaagaggagattagatttcaaaatgactttgagaaatgaaaaatacctttttttttttttttttttttggggagggggtttggctttgtcacgccaggctggagtgcagtggcgtgatctttgctcactgcaagctccgcctcccgggttcactccattctcctgcctcagcctcccgagtagctgggactacaggcccccgccaccacatccggctaattttttgtatttttagtagagacggggtttcactgtgttaaccaggatggtctcgatttcctgacctcatgatccgcccgcctccgtctcccaaagtggtgggattacaagcgtgagctaccgcgcccatcgccatatcagttcaacagattaaaaaaataggctatatggccgggtgtggtggctcccacgcctgtaatcccagcactttgggaggccaaggtgggtggatcacctgaggtcaggagttcgagaccagcctggccaacatggtgaaaccccgtctctactaaaaatacaaaaattagttgggtgtggtggcgggcacctgtaatcccagctactcagaagcctgaggcaggagaatcacttgaacccaggaggcagaggttgcagtgagccaagatcgcaccattgcactccagcctgggcaacaagagcgaaattccatctcaaaaaaaaaaaaaaaaaaaccactgaaattcgctggagtaaaaatatgagccaaattaattaagaaaaaatagcaaacttaaacacaagatcaggaatgacttgtgaatgtggtaggaaaatggtttaggatgaacatgctatagttttgtgataaaaaaaaacaacaaaaagcacattgctagcatttatagaagcactataataatggttaagtgtattatccttggagtcagactgtgggtgctagtctgttctccactacttgtatttatgaccttaggcacattacttaacgtctctgactcagtttcttcatctataaaatggcatattgtattagtacctactgcctagagtagttcagatttaatgagtactttattttattgattggttgattgattgttttgagacagcctcactctgttgccctgactgaaatgcaatgatacggtctcagctcactgcaacctctgcctgctgggctcaagcaatctgtagattcaatgcaatccctatcaaaattccaatgtcattctctctctctctctcttttttttttttgagacagggtctggctctgttgcccacgctggagtgcagtggcgtgatctcagctccctgaaacctctgtctcccaggctcaagccatcctcccacctcagcctcctaagtagctgggactataggcgcatgccaccacacctagcaaatttttgtatttttttgtagagatgaagttttactacgttgcccaggctagtctcaaactcctaggctcaagcgattcacccgcctccgcctcccagtgtgctgggattacaggcatgagccaccacgccttaccttaatgaatactttagagctttatacatggcttttagtttcttcatctataaaatagggataataatagtacctactgactagagaagttaagatttaatgagcactttagagctatgtacatggctcacagctcaattttatgagctttcaactcatacttcttactcctccctgtcttcatcttcttcgttatagatactataattgaatgttccatattcaaaactcttgaagccctttctagcgattttggggcaacctaagtatgtaaccattttagagagtattaaaatgagagtaattagaggaaataaattaatatttaagttcttagcatgtgctaaaattgcattaagctatttcacttacctcatcttctttcatcctcacaatttttaactttttattttaaaataactttagtcttagaaaaattacaaaaatagtacagaattcccacatacccttcacccagtttaccctaatattaacatcttacataaccaaagtataatgaataacagaaaattaacattaaactacaataactgaactatatacaggctttattctggtttcaaccgttttttctctagtttcctttttctgttccagaatcgaatcccacattgcatatttgtcatgtctccttagtctcttctaatctgtgacagttcctcactcttgttgttcatgaactttatacttttgaaaattattggtcagtcattttgtagaatgtccttccatttgagtttgtctgatgttttctcatgtacattgagattaggcatttttggcaggaaaaccacagaagtgatgttcctttcttggtgcatcatatcagggaggtacacagtgtcacagattcttattgctggtgatgctaaacctttatcactaggtttaggtggtgtttgctagtttatcctctgtaattcccattgtatttaataaatatcttggaggagatactactttggggctatggaaacattctattttatccactaattttagcatcactaaactaatctatctggcttaaggtgatgtctgtcaattttctctactataacattatgatttttccttttgtaatgaatatcttagggggacatactttgagactgtaaatatcctgttttctttaatttttgcccactaatcttagcatacttatccctcaaaatcttttaatgtgaacattttcttagttttgtagatgaggaaatggatcttagagaggtttattaacttgccccaaatcatacaaatagtaaatccaagcctgtcatattctaaaagtccttgtaatttcattgtttgttaagatgtgtgagcttaagtgtaagggagaagaacctattggggacagaggagaggaattactgtagaaggagaaataaagttttacatacatctgggaagaattatgttttgtacttggaaagtttattttgtcctttaattgccattttatgaggtttaatttgagacataagaaacatttctttgattaaattaccaaagctctcaacaaaatatgtcttctcacagggttggtagaaagcaaccatggaatcttattcctttttttttttttttttttttttttttgagatggcgtcttgctctgtcaccaggctgcagtgcagtggcatgatctctgcacactgcaacctctgcctcctgggttcaagcgattctcctgcctcagccctcccaagtagctaggactacagacacgtgccaccatgcccaactaatttttgtatttttagtaaagacgggatttcaccatgttagccaggatggtcttcatctctcgacctcgtgatctgccctcctcggcctcccaaagtgctgggattacaggcgtgagccactataaccagccagaatcttattcttaatttattccttatatcaccttgaagaaagactttcttttaaagaacatctagtacattcataagattctgctttcaagatgatgaagtgaatgtgtttttctcttatctttattaaatatgagctgtacttaatcacaagcaaaaatcctatagtagtaaaatatatttgtgctaaggaaattgccaaaatatacatgagtcattttaattatatgtgtacacttatttaggtgagtgaagacattgcatggcattttttggtcctttcagctgttactagtcatttctaaaagtctgtctcctgaaactgagggaatttcttctcatcttatcagagttcagacttagttctgttctaaaataagcaaccgaaagcgaaatagtcagcatgtttgaagtcagcagcactgtcctactacaaatggctattcttttcagaaacaactgtcctctagaagtcatcctgttaggtatattagaagcttagcttcatatattatctggaatttattaaatattgagtgaacaaacaatataaaaatatttcaccactaattgtcatccctttaaaaatgccagtttctggtgacgtttgtaacgattgcaaaccattgtgacttgtctgctttgcttgcctaaatgttctctctcatatattctatttgttctcttatatatactttatttatgccactcagctatatttccgctctgataggtgtttctttctctataactatttgaaactttgcatagtgatagaataaactagttttgttagcaaagcccaaaactatggacagttttaaaagcccactgaatacagacatggattttcaaattatccaaaatggttgaaaagatgattctaaaacctctgcctttagctcaaggttaggtttcaagatttcagaaaacttcaataaagatttcagtaaaactttatggcctatgtggtgtgaaaaacagcatcagagtttgacaattagtttgtcattttttaaactttatcttttttaaagaaaattaagtctttgtaggaaaggattagcatttctttctctcaaatcagtcctttgaaaaattgacattataagaactgtattttttccaaagtcagcataattatgttctgtaaacctctaaaataattaaattttcctctttataaaaacctctctttaattgggaatttgaaaactgcctggatatttgctgatacttagtcattgttaataatttttgaagtatgataatagttttgtggttatgtttatcattacctttcaaagatatatactaaaacatttatagatgaaattatgtatagttcttggagtttactttagaataatttgaaaagcaagtggatgaggatataggtgaaataagattcatcatacattttaaatttgtgtagatcattgatgggttccttggaagtcactgtgctattctatttacttttgtatatggttaaagaaatttttaatgtctcttaatagatatgcaggtctcttattttgatcaatagaagctaaattgttaatctactaataaagttttgttttattttattggtcatgagaattttttccttccttctattaatagactaaagacattaaagagatagccaaaaagacacaagccctgccaaagatgaactcaaagaggcagcgaatcgtgatcttcacccaagggagagatgacactataatggctacaggtacatgtgggaaatgtgtgatgaatctagtattatggagattaatcaattacaaaaaaaaattctgtattctttctattataatatatacaatatacatatacaatatatataaaatgaaatattttattttaataaatatttctaccctgtatctcagtagaaaagatttcatgttcaagaagatagtttattaacatttagttaaataaaccactttgatataatttatttacttagttatcttggggattttgtcaatcaagaaatatctttcctgaaaaaaagaatacatttcatttataaaatacctgcactagagtaaaataaatttactcaattatgaacaaataaaatccagaactaagttacattttccatttttccttcaagaagaaaatctcattttttgttttatttcaccatctattttatagcactcataaaacaggaatttcatctagtaagcaaacatgttattgattaaaatgattaatagtgttaatatggagctacccactattaaaaatataaatgttttaattctgtctgtaccattcagattaaaaccaatcagttgattagttattgtaaactggagcaatttagtattacctatgtgtttgttcagtactctgctgaacactgaaatataaaataggaaccttaaagatctaactgggaattaatattcataaaatataagtacaaagtaaaatataattatagttcttatctattggtgctaactatatggattgtattgactcaggagatcagtaaatcttgaaaaaagatgttatagtgaatatgaagtacatttgtgttgaattaaatataaagcctgaaataggccaaagatgaaattactgtcaagatattttctttcttttttaaaataaattttattctttatatttgaggtttataacatgatgttataggatacatagatatatatagatcaactttcttatttcagaatggtcaaaagcaagattcagagatttgtttcaaaaaatatttgcttcaaagtagttcagtgagtggtagataaagtgagggtataaatgaaatgagactggtaatgaattaattgttgaagctagacagtggatatatgggggcatcattatgctattatctccacttgtggatatgttttaaattatccataattaaaactttaaaaaaagaaagaaaagtttttttttttaaatttcaaacaagattcagagatgttgagtggctttcccaagatacattgatatccttgctaatccttaaattctaggaaggattaaaagaaaggaggacaagtgggcacagtggctcacacctgtaaccctagcaccttgggaagtcaaggtgggaggattgcttgatcccaggagttggagaccagccttggtaacagcaagacttcatctctacaaaaaaaaatggaaaaaaaaaaaaaattagctgagagagtagtggcacatgcccatagtcctggctacttgggaggctgatgcaagaagatcacttgagcccagaagttcgaggctgtgttgagctatgatctctccactgcaccccagcatggatgacagaccaagaccctgtctccaaaaaaaaaaaaaaaaaaaaaaaagaacggagggcaatggagtcaaagaggatcaagtaagcaaaggcacaagtactagcaatcttttattgtgatggcaagaagaaccaccttgttaatttgtacaagagagaaaagaaaccatgaaaagatatccctgcactgatacaaactatctgaattgctttcttcctatagtataaggattattcctgtcttagcagtggacagtttagaaaagtgaaaaacatacaggcttcttataggaattgtagtactaccttcagatttacaaaatattctttggttgctctttgtggagacattcattttaagtctttgtatattctagatatacatactgtacaagtgtcttccttattgtgaatttgcagttttcccaaaattgaaaattaacctccccattctgtgactgtatttccttgtgaactcattttattctttattaaatctattaagccattcttaggaatgcttacaagctggaatttatttgaggaaagacactggctaatctttgctgttcctaccatatgaaaatgaacttaaatcaaaggatgcactatatctgcaatgcatgataaatacaagatggatagagaatctgttcagtggtgtcagctacaaaagcaaacatgataaatgttaatgcagttttgagccctgggataagctattcagtgcacaagtgtagctgaatctctttgctatgttgttattcattgcagccaaataaatgtcaataataaaagagaattaaagattttcatttcccagaggcagtcctctaatacggcttgatctttcatttcatttgtaattcgttctcatgtcaggatgcaatcattcgccaggctctgggtgtcatgttaagccatttaataatgattaagaacataaaaatgcttggcctgtggggcaattcacaaaagagatgccaatttgttattgttttccctcctttcctcttgaatatggatcagctttttcccacctcctagcattaaaatactaatggaagatagggagggaaagtgtcccttaatttaccataagtgacattccagaatggcacaaggcagtgctaacacacatattaaaagactaattaggaatcattgtgccttaaacctatttttttttaatgatactttaagttctgggatacatgtccagaatgtgcatgtttgttacatagttatacacatgccatggtggtttcctgcacctatcaacccatcatctacattaggcatttctcctaatgctatccctccctgagctcccccaccccccgacaggccctggtgtgtgatgttgccctccttgtgtccgtgtgttctcattgttcaattcccacttatgagtgagaacatgcagtgtttggttttctgttcctgtgttagtttgctgagaatgatggtttccagcttcatccatgtccctgcaaaggacgtgaattcatccttgttatggctgcatagtattccatggtgtatatgtgccacattttctttagccagtctatcattgatgggcatttgggttgactttgctattgtgaatagtgctgcaataaacatatgtgtgtatgtgtctttatagtagaatgatttataatcctttgggtatatacccagtaatgagattgctggatcaaatggtatttcctgttctagatccttgaggaatcgccacactgttttccacaatggttgaactaatttacacttccaccaacagtgtaaaagcattcctgttcctccacatcctcaccagcatttgttgttttatgactttttaatgatcaccattctaactgacatgagatggtatctcattgtggttttgatttgcatttctctaatgaccagggatgatgagctttttttcatgtgtttgttggccgcataaatatctccttttgagaagtgtctgttcatatcctttgcccactttttgatgtggttgtttgttcgttttttgtaaatttgtttaagttctttgtagattctggatattagccctttgtcagatggacagattgcaaaaattttctcccattctgtaggttgcccgttcactctgatgatagtttcatttgctgtgcagaagctctttagtttaattggatcccatttgtcagttttgacttttgttcccattacttttggtgttttagtcatgaagtctttgcccatgcctatgtcctgaatggtattacctaggttttcttctagggtttttatggttttatgttttatgttttaagtctttaatccatcttgagttaatttttgtataaggtgtaaggaaggggtccagtttcagttttctctatatggctagtcagttttcccagcaccatttattaaatagggattcttttcccccattgcttgttttttgtcagatttgtcaaagatcagatcgttgtagatgtgtggcattatttctgaggcctctgttctgttccattgatctatatatctgttttcataccagtaccatgctgttttggttactgtaggcttatagtatagtttgaagtcaggttagcatgatgcctccagctttgttctttttgcttaggattgtcttggctatacgggctcttttttggttccatatgaaatttaattttctctaattctgtgaagaaagtcaatggtagcttgatggggaaagcattgaatctgtaaattactttgggtagtatgaccattttcacgatattcttcctatccgtgagcatggaatggttttccatttgtttgtgtcctctcttatttccttgagcaatggtttgtagttcttgaagaggtccttcacatcccttgtaagttgtattcctaggtattttattctctttgtagcaattgtgaatgagagttcactcatgatttggctctctgtttgtctattattggtgtataggaatgcttgtgatttttgcacattgattttgtatcctgagactttgctgaagttgcttatcagcttaaggagattttgggctgagatgctggggttttctaaatatacagtcatgtcatctgcagacagagacaatttgacttcctctcttcctatttgaataccctttatttctttctcttgcctgattgccctggtcagaacttccaataccatgttgaataggagtggcgagagagtgcatccttgtcttgtgccggttttcaaaggcaatccttccagcttttgcccattcagcgtgatattggctgtgggtttgtcataaatagttcgtattattttaagatatgttccatcaatacctagttttttgagagtttttagcatgacggagtgttgaattttatcgaaggccttttctgcatctattgaggtaatcatgtggcttttgttattggttctgtttatgtgatggattacgtttcttaatttgcgtatgttgaaccagccttgcatcccagggatgaagccgacttgatcatgatagataagctttttgatgtgcttctggattcagtttgccagaattttattgaggacttttgcatcaatgttcatcagggatattggcctgaaattttctttttttgttgtctctgccaggttttgctgtcaggatgatgctggcctcataaaataaattagagaggagtccctctttttctattgtttggaatagtttcagaaggaatagtaccagctcctctttgtacctctgatagaattcagttgtgaatccgtctgctcctgggctttttttggttgataggctattaattactgcctcaatttcagaacttgttattggtctatttagggattcaacttcttcctggtttagtcttgggagggtgtatgtgtccagtaatgtatccatttcttctagattttctagtttatttgtgtagagatgtttataatatccactgatggtagtttatatttctgtgggatcagtggtgatctcccctttatcattttttattgtgtctatttgattcttctctcttttcttctttattagtctagctagcagtctatctattttgttaatctttgcaaaaaaccagctcctggattcattgatttttggaagggttttttgtgtctaactccttcacctctgctctgatcttagttatttcttgccttctgctagcttttgaatgtgtttgctcttgcttctctagttcttttaattgtgatgttaggatgtcgattttagatctttcccgctttctcctgtgggcatttagtgctataaatgtccttcttaacactgctttagctgtgtcccagagattcgttgggtctctgttctcattggttttaaagaacttatttatttctgccttaatttcattatttacccagtagtcattcaggagcagattgttcagtttccatgcagttgtgtggttctgagtgagtttcttagtcctgagttctaatgtgattgcactgtggtctgagagactgtttgttatgatttccattattttgcatgtgctgaggagtgttttacttccaattatgtggtcaattttagaataagcgtgatgtggtgctgagaagaatgtatattctgttgatttggggtggagagttctgtagatgtctattaggtctgcttggccagagctgagttcaagtcctgaatatcgttgttaatttttggtctcgttgatctaatattgacagtggggtgttaaaatctcccactattattgtgtgggagtctaggtctctttgtaggtctctaagaacttgctttatgaatctgggtgctcctgtattgggtgcatatatatttaggatagttagctcttcttgttgaattgatccctttaccattatgtaatgcccttgtttgtcttttttgatctttgttggtttaaagtctgttttatcggagactaggattacaacccctgctttttttttgctttccacttgctttgtaaatattcctccatccctttattttgaacctacgtgtgtctttgcacatgagatgagtctcctgaatatagcacaccaatgggccttgactctttatccaattccccagtctgtgtttttcaattggggcatttagcccatttacatttaaggttaatatattatgcatgaatttgatcctgtcattatgatgctagctggttattttgcccgttagttgatgtggtttcttcatagtcttgatggtctttacaatttggtatgtttttgcagtggctggtaccagtttttcctttccatatttagtgcttccttcaggagctcttgtaaggcaggcctggtggtgacaaaatctctcagcatttgcttgtctttaaaggattttatttctcctttgcttatgaagcttagtgtggctggatatgaaattctgggttcaaaattcttttctttaagaatgttgaatgttggtcctcactctcttctggcttatagggtttctgcagagagatcagctgttagtctgatgggcttccctttgtgggtaacccaacctttctctctggctgcccttaatactttttccttcatttcaaccttggtgaatctgacaattatgtgttttggggttgctcttctcaaggagtatctttgtggtgttctctgtatttcctgaatttgaatgttggcctgtcttgctagattggggaagctttcttggataatattctgaagagtgttttccaacttggttccattctccccatcactttcaggtacaccaatcaaatgtaggtttggtcttttcatatagtcccatatttcttggaggtttgttagttcctttccattcttttttctctaatcttgtcatgatgctttatttcattaagttgatcttcaatctctgatatcctttcttctgcttgatcaatttggttattatatttgtgtatgcttcacgaagtgttcgttctgtgtttttcagctctatcaggtcatttatgttcttctctaaactggttattctagttagcaattcctctaaccttttttcaaggttcttagcttccttgcattgggttagaacatggtcctttagctcggcggaatttgttattacccaccttctgaagcctacttctgtcaatttgtcaaactagttctctgtgcagttttgttcccttgctggtgaggagttgtgatcctttggaggagaagaggcattctggtttctggaattttcagcctttttgcactggtttttccttatcttcgtggatttatctacctttggtctttgatgctggtgaccttcggatggggtttttgtgtggacatcctttttgttgatgttggtgctattcctttctgtttgttagttttccttctaacagatgcctctgctgcaggtctgctggagttttctggaggtccactccagaccctgtttgcctgggtatcaccagcagaggctgcagaacagcaaagattactgcctgttccttcctctggaagctttgtcccagaggggcacccgccagatgccagctggagctctcctgtatgaggggtctgtcgacccttgctgggaggcatctcccagtcaggaggcatgggggtcagggacccagaggcaatctgtctgttaggagagctcgagcactgtgctgggagatttgctgctctcttcagagctggtaggcaggaaagtttaagtgccgaagctgtgcccacagctgttccttcccccaggtgctctgtcccagagagatgggagttttatctataagcccctgactggggctgctgcctttctttcatagatgccctgcccagagaggaggaatctagagaggcggtctggctacagtggcttttccaagctgcagtgggctccacccagttcaaactttttttgcgaactttgtttgcatctttgtttacactgttaggggaaaaccgcctactcaagcctcggtaatggcagtcgccccttcccccaccaagcttgagcatcccaggtcgacttcagactgctgtgctggcagcgagaatttcaagccagtggatcttagcttgctgggctccgtcggggcaggatccgctgagctagaccacttggctccctggctttatccccctttccaggggagtgaacagttctgtctcgctggcgttccacacgccactgtggtatgaacaaaaactcctgcagctagcttggtgtctgcccaaacagcagcccagttttgtgcttgaaacccagggccctggtggtgtaggtacccgaagaaatctcctggtctgcgagttgtgaagaccatgggaaaagtgtagttatctgggctggagtgcaccatttctcatggcacagtccctcatggcttcccttgactaggggagggagttctcgaccccttgcacttccccggtaaggtgacgccccaccctgcttccgctcgccctttgtgggctgcacccactgtctaatcagtcccaatgagatgagccaggactctcagttggaaatgtagaaattacccgccttctgcgttgatctcgctgggaggtgcagaccggagctgttcctattcagccatcttgccagccacccaaacctatttttaaatgatcacactgttaagtttgcagtacttagcaataatgtatcaaaatgtttccttggagttttattctacagacctatctccttttgagatatgatatacataaactactttgtcttattttataaatttaattctttaaattgcctgtaaatctaaagtattttccgctcaccctgttttatgggtcatacctctttcagattgagtttccatctaccctagaggttctgtcacataccaatcattgtttcagtccttgcaggttaattgagtttcaaaaaaattttcaagggagtgctgggcactgaagaatattaagagtaacaggctgggcaattccacagcagagtatatgtccaaaataattgaagcaggaacctaaacagatatatgcccacccatcttcatagcagcattattcacaataaccaaaaggtagaagcaatcaaagtgtccatcagcagatgaacagataaataaaatgtgatatatacatacaaaggaatattattcagctttaaaaaagaaggaaatcctaacatgcactacaacatggatgaaccttgaagacattatgctaagtgaaataagccagtcacaatgggataattactgtgtgattccatttatgtgacatacctagagtagttagctttatagacaaagtagaatgatgttagccaggggctgggggagggctgaatggaaagttattgtttaattggtaaaaagtttcagttttgcaggatgaaaaagttgtaaagatgggtagtgataattgcacaataatatgaatgtacaatggcactgagctgtatattcaacaatgcttaaaatgttacattttatgtatatttttattttttaagcatatttttcaatttaaaaaaaattaaacataacctaaagagtaagatgctgggggtgaaggcagaaaagatgactgtccattttgatcctctttataaatgttgaatgaatctgttgaataacatggcagtaaggtgaaggaaatcatttctgtgtttataaactggaaaaactaacagtgttctttacctgttggagagcaactactaatgagatcttcatacaataaaaccttattatattaagcatggtagtaaaaaagtaaatatatatatgtatgtaaatacatatatagtgctttatagaaagtttaaacttccccaagtttctatactaaataaatcaccaaaaattggagaaagcaatacaacttttgttctgaattggaaataatgtgtttccaattaaataggtccactgaaaaataaactgtagatttttctgtttcgtttgttttaagaccaggcctcgctctgtcacccaagctggagtacaatgacacaatcatggctcactgcaacctcaaccgggctcaagcgatcctcccttcccagcctcctaagtagccgggactacaggtgcctaccaccctgcccagctaatttttttgtattttttctttggtggagactggattttgccatattgcccatgctagtctcaaactcctgagctcaagtaatctgccttcctaggcctccctcctaaaatgctaggattacgggtgtgagccaccacacctggcctaaattgtagacttttctgaacactcagaattcttatttgaattgtaatttttcacaaagggagaaaatatattaagtcagatgttttcaactggaagactggtgctatcacatcaaaatcacctagtgagtttttggtaaatacagtcctaccttttttttttttttttaattttagaattgggggagggtgtgatactttttcagggttgttacatggatatattacataaggctggggtttgggcttctattgaacccatcacccaaacagtgaatataatacccaataggtagtttttcaactcacccccacccacttcctgcctccccctttatgtccatgtatacccattgtttacctcccacttataagtgagattgtggagcatatggttttctgtttctgggttaattcactttggataatgtcctctggctgcatctatgctgctgcaaaggacattatttccttctttgttatggctgcatagtattacatggtgtatatgtaccacactttctttatccaatccgctgttgatggacacttaggttgattccatgactttgccattatgaatagtgctgtaataaacataagaatgcaggtatctttttgatagaacaatttcttttactttgggtagatacccagtagtggggttgttggattgaatggtaatcctgtttttagttctttgagaaagttccaaactgctttccacaggggccaaactaacttacattcccaccaacagtatgtgtttccttttctctgtatcctcgccaatgtgtaatttttttactttttaataatagctgtgctaactagtattatgatatctcattgtggttttaatttgcatttctctgattattagtgatgtggaacatttttcatatgtttgttggctgcttgtatgttcccatttttaaaaattgtattgatttatttgtattttatagagaaagtgtcttgctatgttgctcaggctggtctcatacttcctgaggctcaagcagttctcctgcctcagccttccaaagtgctgagattacagacatgagtcaccatgcctagctgtatgtcttattttgagaagcatttgttcatgtcccttgcctactttttaatggagtaatttgggtttttcttgttaatttgtttaggttccttatagattctggatattagtcctttattggttgcatagttagcaaatattttctcctaatctgtaggctgtctgtttattttgttgatagttacttttgttgtgcagaaactctttagttaagttacaatggtcaatttttatttttgttgcatttgcttttgaggtcttagtcataaattctttgcctaggcctatgtgcagaatagtttctcctaggttttttctaggatttttatagtttgaggttttatgtgtaagtctttaatctatcttgagttaatttttgtatatggtgagaggtaggggtccaatttcattattctgcatatggctagccagttttcccaatatcatttattgaattgagtgtcctttcatcactatttatttttgttgactttgtttaagatcagttggttgtaggtttgtgggtttacttctgggttctctattttgttccattgatctatgtgtctatttttgtgccaataccattgctattttggttactataccctagtagtatagtttgaagtcaggtaatgtgatgcttctggcttcgttttttgcttaggattgctttggctattcagctaccctgccttcttaaaagcacctttctttcaatctgatacaaccctgtgaggagtattagaaaatacaacttcaaggagatgtttgagaatgcgggcagtacagtctggggcaaggggagtgtaggattatgtatggttgaaaatgttccctttggtgatatagcaatgctgtctatcctccacctgtcactttgagaatcactggattaggtgatttaataatgctgcaagttccgtaatctgctggaaaaacgaaaacagaactttttaacagctaagggtctagttcttcaataactcaggccttgggaaatgcttcttttttcgatccttcaaaatccatccacacttacaggcaatctacagtttactttaaatagtctcctacttttgaggtgcttataatttaacatagttacatcccaatgccctttgtcattttattttaagtaaatggggttattgacgttacttgtcttcatgttcctgagtccttaaagaaacgtgttacctcatctgctagttaagttttcatgttctatgaaaacactcaatgctgcccattactctgtaagaaaaggtcagtgtgatttgcaattctggtagacgtaaagttcagaaaatgtgcgttagaaaatgcaaactctaaaggaaaacaatctcagcattggaagaataatgtcagcacatgatcccaactcaaaatattaatataaatcattttgaaaatgtctctactacagccaaatcaattttaaatgataaccttgttggcttagattggtgatggtaaagatagaataaactaagtggcattcttttaaaatgtcttgtatggcattcatagaaaaaagttcttaccaggtaagatcttagagaaaatatatttctcacctatgaatgtaagttactaagttattagctcatggtccatttttagattattgtaatcacaaaagataaactcctttaattaattggtcaaaaataatttagaataacatgtggacctgtcacatttttgacaaagtagtatctttgggatgtggttcatttagttcagtgatctcaagcctgaagaaatgagacttctttcaactcccacctttttattgaaaaggatcctgctagaaggcaaaataagaggcaacctatcctaagcagatataagccctattatagcactgatttctggagggatgtttaagtcagatttgttgagatatagattacatatagtaaaatccacaaatatgttactaaataacatgtaacaaccaccacagactatagaccaccttgtacagtttgtattgaagtataatgtgcatacaaaattgatacaacttttcattaagtggatggacctgtgtagctataaccagatcaggaaatacaatacttatagcacttaagaagcttctccttgtgccccctcctaatctttatccccactgaaggtaaccattgtcttagcttctactactgacagttagctttgcctgtttttgaaatggaaccactcagtatgtagacttttgtctgctctatctccatccatttttgtgcactttcttactttttgacaacataagatcccccgggctcacgttgtattttctccacttcagtcctataatcaactatttctccaaggaaccctggttccctttattgaagaatggtttttagaaacctgtaactgtgctctagatatgctctttgttccttgagtgtctttgcttctaggccctcttagcaaacagaacttggcaatatatgtatgtataataacctatgtatactcactcatctatatttatttctgtatctatatgtttatatatttttaaaacatgaagtcatactgataaattttatttcagtccagcagcacaaggctcattctagccttcattcttccttttgtacaacttcttcctttgacattgaaaattctggctctcattatctaaaatgtatttacttatttgttttatcctaaagtagttttgaattgcttgcccatacccttgtatgagaaagagatttaccctttagagtataatatttgcttacagttctttttttctgtagcccaatagtgtccagtcaatatatagttatccaaagtaaattagctcttttatttcatccactcattatggttacattattcatttgtaatacaggtagggtcacttgttaagagtattccattttggtttcttttcacatcctgattggggttttattttctcaataaaattcactttttgtagtgtcaagttctgtgggttttgacaaacacataagatcatgtaaccaccaccatagttatgataccaaagagttacatttttcagctccggatttgcaaggatggtaccaatataaactcccccaattttatgagacggcactaattgttccacatctctaccaatatttgctactatccatctttttaattttagccattctggtgagtatgtaatagacctcataatgattttgattggaatttttctgatgtgtagtgagatggagctccttttcatctgcttactggtatttgtttttttgtgtgtagttttgttttgttttgtttttttgagatggagcctcactctgtcgcccaggctggagtgcagtggcgggatctcggctcactgcaatctccacctcctgggttcaagcgattcccttgcctcagcctccctagtagttgggactacaggtgcccaccatcacgcctggctcatttttttatttttagtagtgacggggtttcaccatgttggccaggctggtcttgaactcctgacctcaagtgatccacctgcctcggcctcccaaagtgctggggttacaggcgtgagccatcgtgcctggccttgcttactggcatttggatatcatctttgattgtattgttgttgggttcttttgcccatattgagttgtcttattgatttagaaatctttttacagcctgtatgccagtcttttgttagataaatgtattgtagatatctcctgctactctgtggcttgccttttcactctcttcatggtatcttttgataaacaaaagttcttgattttaatatagggcaattcataatgttttccccttatgattaatgcttcttatattccattaaagaaaatcatggcagatctcaaacttgtgaagatactcttctgttgtttttttctaaaacttctattcttttacttttttcaactagcacaattcatctaagattaatttatatatatatataaggtgtaggatagggagaatgattcatttattttgcccatatgaataaccaattgacctggcatcattcattgacaggaatatcctttccctaactgcattacattgacacctttgtcatgtttcagatgaccttatatgggtgagtctttttttaggctatttcattgtcctcattctctatcctttaccaattgcacactctcatgataacttaggtttataatcagtctttttatctggcaatgtcagtcttctgagtttgttcttcaagattatcctggcttttcttggctctttgcatttctacttaaattctagaactggcctgttaattgtcaccaaaggaattttttaaaaattccttactagagttttttcagattatattgaatctgcaagtcaatttggagaaaacttatttctttacagtattttgtcttccaatccatattttcctctatttatgcagtctttaatttttctcaggatgtttttttcttttcagtgtaaaggtcttgtatatgtatcttttgtaagattcttaggttttcgatgctatctatttttaaatggcatccttttaggtttctgtttctatttgttttttactggtatatagatttctaaataatgatctttttcacatattaactgcaataacatatcagataattattttggattttctatgcatataattataccatctgtgaataaaaataatttgcatttctgcttttccaattctcatacagtactttttttcttactacactagttagcacggtaagacatgtagaatacaagtaaattgaaatggttatagtgagcacctttgtcttattcccgatatcagttgaaaaaccatcaatattttatcaaaaaggataatgtttgctatagtctctttgtagatactctatcagataaaggaaatttctttccattaatagtttgctaagagtttttgttttgttcttaagagattttttaaaaatcatgaatagttgttgtatttcatcagataatgtttttgcatgtaaaattactatatgattttttcccttttttcttttaatgtgtgaattacagattgattatggaaagatatttcacctttgcattcttggaataatgccaacattgacatatctttttaatgtcttattggatttgatgtgatgttattttgttttctgtttgtttttttgagagagggtctcgtcttgtcacccaggctggagtgcagtggtgctctccaggctcactgcagcctccacctcctgggctcaagcagtcctcccacttcagcctcccaagtagctaggattacaggcacgtaccaccacgctaattttttaaattttttgaagagacgaggtctcactgtcttgcccagactgatcttgaactcctgggctcaagcaattcacccaccttgggctcccatagtgcggggattacaggtgtgagccaccatgccagccttgctttatgtattttaaagctatcttaactaagtgtatataaatttataattctcacgtcttcctgatgcattgaaccttttaccttatgaaatgtccttcttaatctctaatgatgcatcttgccttaatatctatgccagctttctattggttagtgtttacatgatatcttttttcattcctttattttcaacctttctgtgttcttatatgacttttgttgttttttaattaattctgacaatcttcatattttaatcagcctgtttatatttaatataagttactaatgtatttgtgttcatatcttacatcttactctttttgttctgtcttacatgtgtatcttcttttttctctcctttcctgctgtttttggattgatcaagtatttttttctttttcttctcatttagcttctcggtcttgccctgttgcccagactggagtgcagtggtgtgatctcagctcactgcagcctccaccttccagtttcaagtaattctcatgcctcagcctcctgagtagctgggattacaggcatgcgccatcatacccagctagtttttgtgtttttattagagacagttttgccatgttggccaggctggtcactaactcctgacttcaagtgatccgcccgcctcggcctcccaaagtgctgggattacaggagtgagccatcgtgcccagcctgaattctcagtttttgtttgtctgaaagtttccttttgcctttcaatgtgtatagttctctatgttgggagttatactttttgagttctttataaatggctttccattatcttttggattctcttatttttgttgagaagtcagctgttactcttattctgctcttttatatataatatttttattttctctagctgctttttagaatttgtcaaactttaactttatccttagttctggttttccttttatttatcctgctgggatttttagtgcttcttgaatctgtgattgatgactttcatcagatttggaaaattctcagccattatctctttagatactagaactgtttatacttgggaatctagttatacatatactaggtcttttcattgtatcccatatgccttttatgctctttgtgtgtgtgtgtgtgtgtgtgtgtgtgtgtgtgtgtgtgtgtgtgttttaccccttttcctccccgagcttcaggctgtatattttgcactgacctggcatttagttccctgattctctcttctgctttgtcccatctgcatttcaaaacatccagtgaggctgggtccagtggctcatgcctgtaatcccagcactttgggaggccaaggcaggcagatcacttgaggccaggagttcaagaccagcctggccaacatggtgaaaccctgactctaccaaaaatagaaaaattacctgggcatggtggcaggtgcctgtactcccagctacttgggagactgaggcaggagaattgcttgaacccaggaggcagaggttgcagtgagccaagatcgcaccactgcacacgagcctgggagacagagcaagtctctgtctcaaaaaaaaaaaaaatctagtggatgctttatttcaatagtcccttttttattttctaaagtatctgattatttcttattcatcctagttctgtagtataatcctctaccttgtcatctatttttttctaacatattaatcatagtagtaataaattctgtgtctgaaaactacaatatctcagtcatttgtaggtctggtttttaaagattttttttaatttccacataataattgcaaatatttatggggtacatagtgatgggtttggtgttttaagagagggtcttgctctgtcaccgaggccagaaggccagagtgcagtggcgtgatcacagctcactgcaacccgtatcttgcaggctcaagagattttcccaactcggcctcctgagtagctgggactacaggcacatgccaccacacctggctaattttttttatttttattagagatgaggtctcgctgtgttgcccaggctggtctcaaactcctgagcttaaacgatcctctcaccttggcctctcaaattgctgggattatgggcgtgagccacaacaccctgcccatcgtgatgttttgatacatataatgtatggtgatcagagcagagcaattagcatatccatcatctcaaacatttatcatttctttgtattgtgaacattcaatatcctccttctcactatttgaaactatgtaatatattattgttaactgtagttatcctacattgctgtagaacactagaatttattcctcctatctagctctaattttgtatacttttaaaaatctctccctattgcctcctccttcttacccttcccagcctctaatatcctctgttctactttttacttctgtgagatcaactttttttagcttccacgtacgagtgagaatacatagtgtttaactttgtgttcctggcttatttcatgtaacataatgtcttacagttccatccatgttatggtgaatgacaggatttcattcttctttatagataagtagtattcgatcatgtatatataccacactttctttatccatttatctgttgttggacatttgggttgatttcatgtcttggctatagtgaataatgctgtagtaaacatgggggtgcaaatgtctctttaacgtactaatttcctttcctttggagaaatacccaatagtgggattgctggatcatatggtagttctgtttgtttcttttctctgcatcctcaccagcatctgctttttttttctctttttaatgatagccattcttactggagtgagatgatacctcactggttttgatttgcattttcctgatgattagtgataatgagcttttttcccatttttttggccatttatatatcttcttttgagaaatgcctgttcaggtcatttgcccttttttaaaacagagtagagttttttgtttttatttgtttgtttgtttttttactgttgagatgtttaagttccttgtatattctggatattaattccctatctgattagatgagtaagttgtatgtatttttttctattccataggttatcttttcactctgttgattgtttcctttgctatacagaagcttttcagtttgacataatcccatttgtttatttttgcttttgttgcctgtgcttataaaaggttgtactcataaaacattttcccagaccaatgtcttgaagtgtttcccttatgtttccttctagtagttttattgttttgggtcttacatttaatccattttgagttgatttttacagagggtgagagctaggagtctagttccattcttatgcatatgactagatgcatatttagttttcccagcatcatttattgaagaaactgtgctttctccagtgactattcttggtgcttttgtcaaaaatcagttgactgtagatacgtggattaatttctgagttctctattctgttccattggtctttgtgtctgtttttatgccaataacatgctgttttggttactatagctttgtcatatattttgaagtctgatagtatgatacctccagctttgttcttcttgctcaggatgttttttaccatttagggtcttttctgattccacagaaattttagaatattttttctatttctgtgaagaatgtcattcgtattttgataagggttgtattgaattggcggatcactttgggtagtatataggtctgtttttttgtttttgttcggtttggtttctatttccttttggggcttgtttcttggtttgcctgataattttttatcaaatgttaaacattgtccataataaattatagagcttctgttagtgtagagtccaattagatctaggactaagccacctcaaggttgggttatagtttttgtaagacccagtctacctctcatttgcttccacttctataccatggccctcctggaatctcagctgaaatcctggtgtttttatgagatccctactcattaatgggttctgaactccaaattttatctgttttgtgtaccatacaactagcacaatcaccactctgccttatggatgccttatacttggtgtcttggcctcttgtcctgcttcctgacaagtgtggcaaataccttgagtagagtatttcctctcctgagtttcaggcctactttattgttttcccctcctcttcaggatcatgaccctcagttctgtctgtcttgacagtcccaaactcgaatttttgtcttaccacccactagagattgcaaaaagttatgttggcttctctgcctcttagtagtagtccattgcccagattctcagcctcttacccgacacaggaatttgcaaataccctagggagaaaacgactttttgaatgtcagtttagctctttaagatcctcttctctctgagaccttctcttgtcaaattttgactaccttgtcagctctctcatcccttctttatttaaaaaaaaaaattaagcttttctgcctttttatggtctgggaattggtttactacaagctatggcattagagcctaaccaataggtcccttattgaatacatttttttattattaaatagaaaaatacatagcccgagaaagttaagtgggcttatctgtgtattaaggaatactgtttttaggaatgtgacttaggaatactgttcttcataccgcactttgggaactgctggattaggtcactttcccaaggtctcagaattagaaacaaaagcagctagattagaacccagcctcggcctggtgcggtggctcatgcctgtaatcctagcactttgggaggccaaggcgggagggtcacctaaggtcgggaattcaagaccagcctgaccaacctggagaaaccctgtctctactaaaaatacaaaataagccaggtgtggtggtgcatgcctgtaatcccagctactcgggaggctgaggcaggagaatcgttagaacccgggaggcggaggttgcggtgagccgagatcacactattgcactctagcctggacaacaagagtgaaactccgtctcaaaaacaaaaaacaaaaaacaaaaaaagaacccggcttcttgaatcccagactagtccaatctgttccataccatgttaactcattggcttacatctgtggttttcaaccagaaacaactttcccccttcctttcagttatgacaactggctggtatggaagagttgggtcttccactggcattttgtgggtaaaagccagggatgctgctatatatactataatgcacaagacagccaatccacaataaagaattatctggcccaaattattaattgcctcaagattagaaaagccctgtcttacagtatccctcaaaatttatatatttaaaggatcactggctgattcctctttacacttaatcataaggtcaacaccaataggctttagtaggataaagcatctttatcctactaaactacatccagaggccctttgacccaagaaaatgtccatatatgatctagtccgtacttgcttaactgtgtttctcaaagcttttgccaaatatgctccaattctaagacttctctttagttagaatttgttagagctggaaaactttctggtgtagaattgtgcgtgcatatcttgtaaatgcattttgtatgcatgaatggatatctagatgatagtgacatttacctacacatttatagattttatttatatatatacacatatatacataatatatatgtattctaggcatatatatatatatacacacacattagtctaaatggttcttagaaaatttattcattttggtttataactctaatcaatttctataatcaaaagctcttgaaaatgtaatacaaatagatatttaattaaagaggtatattaccaaatgtttttcagaataattattgtttgtaccagtgagtatttctttcagaaattcaattagactctaaaattcatttttcagagcattacaacttggcggcaaaattttcttttggctgaaacactgcatgcaagcttttggctcagaaaaaaatctttggaagtatagctgaaaagtctgattcagataactgaatggctaaaattttccttgtttaaaaggaataaactggttacacgtgaaatattaaaaactgtatttaaatggatagttaactattgccttatttcttttaagtcttaaccaagctggcttatcctatttcaactgctctagaactcacatcatttttgattcattgattttttttttttttttagtatcccaatagaagccatcatttctaaggttccaccccaactttgctgagccttggcccagaaaatttgtttagcttttctctgctgttgttaagctattttaaattttaaatttttgtgtttttaaacctttctgtgtttttaaagcctttctggtttaataaacaattctaaaatctcaagaaaatatccaaattcttttgttaataatttggcacttagccatctattcaatttatttatcatggtaaattttgcttatacttaattatttcctctagtcctagaactccaccccttaccataataaaggggcagtttataaaacaggtgtttttgtaagtaatttacatggtttagtatgcaaaaagtacaataatagagctgtttagctgtcagtacttgtgaggaagtaagcagttttttcgttattaggatgaccatataacttattagaaaaactcagatgcttttgagagtgaaagagtggggtgctattaataatactaggacagttctgggcaaaccagcccatatggtcacactaatcattatagatatttaaacaaaaatatttggtaaaatgaatttgtgtattggttgaggtttttggctgtgtttatttctaacatttcttccagtgaaaagattcttgatcatgtgctaagtatatgccaggtaatatagaacttaaaaaaaacatgagaacctctaatctcaagcaggacaagttggagaggcaagatacttatagataatgcagtaatgtaacagcacaaataaattcaattcattatggttttattgagtgcctactgtatgtcaagaattgtggttataaagatgaacaaaacaaaaactccttttcttgaaatctagaagagacatacttaaataatatgatgtgaaaaatgatattattttcatgaactaatttttatagaacaaatggaacaagaagttggggaaagcttttcaaagcaagtgatgtatgaactaggccttgaggaatccttacaattttggcaagttgagattacaaaggtattcaaagttaatgaggtaataaaagcaaaaggcagagtccttcatatgatttgttacaagaaatggcagaagggagatatggggcaaccatctctgaaatggtaattgtgatgggatttaaatgctatgctgggcaatacattattaagtgcttaaagtatatatatatatagagaagacatcctttggactgagaaacattttgtgatcagtttaccgtaattccataaaagaaaggaatcacacttccatttgtttataaagccctgtttcagagggatcaacaaatactaaagatgaaaatcctttttttaattaaatgctaaagaataaaagctgcaataatccctctaaaaagtattagtgatgaacaatcccatggggttatagtgagacaaatgtgatagggttagaaaaattgtagagaaaaattatggtaaaagcactagggaaatgccttagaaaattaataaagattggcttggtttaaagacggtaaataaagactaatgcaaaaggctaatgaattcagtcatggagaaagtttatactatagtgtttgctaaaagaattaccactagatgggattttattaagcatttttttattcaaagaaaaagggtaactcattaataaaatgtgtagttgatactaaataaataaatcaactagtgtagttgatactaaattaggagatagtgtagttgatactaaataaataaatcaactagtgtagttgataataaattaggaagatactgtagctgatactaaattctagaaattctggtaatagactctagaaatagatgtttgaaataggtgtttaaaataatattttaaagaaaatcatattcaccccattttaaatccacatagaagcagcagttaacattaaaaacttgtgtccacttccaggagatagtcatggtttaagggtccagaaatcaatggtagaatcacctgaaatttagaacagtagaaatatgtcttcactaaagagtctaaattttttttttttttttttggaggagtcttgctctgtccccaggctggagtgcaatggcacgatctcagcccactgcaacctccacctcctgagttcaagcgattctcctgcctcagcctcttccaagtagctggaactacaggtgtgtgtcaccatgcctggctaattttttgtatttttagtagagatggggttttaccatgtttactaagctggtcttcaactcttgacctcaagtgatccacctgcctcagcctcccaaagtgctgggattacaggcatgagccactgcgcctggcccaagagtctaaatttataggatgtatatgattaaaagtgacttttgtgaacatttaaataaatatttgtgactgaattttctatggaacatttttccttcagtggcttgcattttaatgaaggaattattttaaaattaccttattccctcccaatgttgtttaaatatctagagggtatctagggcttaaggaagattggatgtggaacaatgagtggaggcctagagaacaagggtagtttcctgcaacagttatatggatccctagcaaggttcatatttctgtctatactgctggttaatctgaatattcccataaattgtggaacataatccatggccttggttttctgtttcttgtagtaagatttatcattttatttctaccataaattagagatcattacatgattactatgaaggatctacattgctatttgttatgatcaaataaacagtatttttgcagttgactattcagggatctgttaaagcatttagaccttaggccctcatagcatatatatataagctttttggagacttggctctcactactttgagaatttggcacacagggtaatcaaaaaaaaaagctttcttggctcttgcctgtaatcccagcattttgggaggctaaggcagaaggatcccttgagctcaggagttcaagaccagcctgagaaacatagcgagacctcatctctactaaaaaataaatagtaaaaaattatcccagcacagtgatgcgcacctgtagtcccagctaatcaggaggctgaggtgggaggatcacttgatccagggagtttgaggctgcagtgagctatgattgtgcacactccagcctgggtgacagagtgagaccctgtctaaagaaaaaaagctttctttcgaaatggcctcaggtttatcgatttttaatttaacattgctctacagatttattttgttgagtttttttttttttaagtactaagagtgttttgggcaggggaaagaaattcacagtgtttttttgttgttgtattttgttttgttttctgagacggagtctcgctctgtcacccaggctggagtgtgcagtggcacgatctcggctcactgcaacctccgccccctgggttaaagcaatcctcccacctcaacctccccagaagctaggattacaggtatacatcacctcacctggctaattttttttggtattgttagcagagatggggtttcaccgtgttggccaggctgatcccaaactcctgacctcaagtgatccacctgccttggcctaccaaagtgctcggattataggtgtgagccaccacacctggcctaccacaatgttttttaactgaacagttggctgcagtaagcttttagaagcctacacgttggtatttgagcatacgaggtggatcataatggggatcattaggtttctttgacaggtgatattaagaacccaacccagcatgccacttgtaaaccatctatacatagagacatttgtcaccattgacagttgtgacatttaatctgggatctatttgcaactcagcttcctatgtattactatgtatttaacagtctcaattcaggctcaaagcatcagcttttttcttctagtttttctaggttttacttaacaaaggaaaatagaaatatctgtttactattgaggtgatcatttctcctcagatgagtcatgccagtcacgattcttggatgttgacctcttgtgctgtttttgtagttcacaagccaaagctgcactaaataggattatggaaattagattaatggtccaggaatgaggcatagtgctttggttgaataggaaagtctgtaaagtggagccagtagtacctgaaaaaaacttaatccaggtgaggcagatgttctgaagaatctcactcgtctcacctggattaagtttttttcaggtcctgctggctccactttactgactgctattcaaccaaaccactatgcatcctttttggagcactaatctaactccaaaggggtacaacaacctcatcacttctaatatgaatacaaccaagatattgtgtgagctgagagtggcagaagaaaactggaaaaagctctctcttagatagccagtgtcacttggagaagtctattcttatgtaaaaggagttatattggtcttctaagaagaaaggttgtcaggaactggcaagcactaaaatgcctaaccaacaccttggagttagagcagtctagttttagaaggcagagactaggagggataatcagtcatagctaaagatagggaatctagaccaaagctcattccagttcctaggattagtgcagaatacaatttattaagctagaacagaagctttgcagtcacaattagatcatcacaacgtacatctggatgtcagaaataattctgcaccctactcttttttttttaagttaaagagactgtctcccaggctggagtagagtggagtgatcttagctcacttcatcctggaacacttgggctcaaacaatcctcctgcctcagcctcccatatagctgggactacaggcacacgccaccatgctggctaatttttttctattcttttagagacagggtcttgctgtgttgtccaggctgatttcaaattcctggcctcaagtgattctcctgctttggcctcctgagtcactgggattgcagggcaccctattcttgatttttattcttcccttgtcaggactagcttagaactgttaccccaactgtataagtaagtgcatccttaactatcaagacccaagaaagatatgagcagagcaaaatgaggagctcacgcaagcaaaattaagacttgaaatgtcagcagataaggtatctgaacatgtctatgacaggaagccagttgcaacttaactactgcagtgctaaattaaaccactgctatgtataccatatttgaagtaataattggatacaaaggtatatggcccttacttcaaagagcttatacttgtgaagtgtacactagaagacagtatgtagaaattttaccaaatttttatcaatttacagtatgaattttaccaaaaaattcactatagaaataatgcatgacttcacatcacactggtgatcagagaaacaatgtattttaaaagtgacatatgaactggtttgtgaaatacaaatgaaattttgatgcaaaatataactagaaatgaccttagatatcagctggtacatcttagaaattcgagaaaaattaagacccactactagtgggataaatgttggtgtacagtttttcttggtgacagcttgagaatacatatcaaaagccttaaaatatgcatatcctttgactcagtaactttacttacaaattaatcctatggaataatttaacatatgcacagatttacatgcaagaatgttcttcatagcattggtcttaaattttttaatttttttaacttctcattttgcagcaaaaaaaaagttgtaaaaatagtagatattttccatatatccttcatccagctttcccaaacattagcattttatataaccagagtacatatatcaaaaccaaggagttaataaataggtagaatttttgtcaaataaataaataaaattttaaaaccagcaaactactatagatgtgatactattattgaagctacagacctttttcagatgttcccaattatcccacttttttttttttttggtccaggatacaatctaggattctactctgtgcttaataggtaatcatattcttttattctgttactatctggcataattcttcagtctttttttctcctccttaacattaacacttttgaagagtactggccagttattttatagaatgtctctcaatttttgtttgactgatgtttccctgtgataaaattcagattatgcatttttggcaagaataccacagaaataatattatgctcttctcagtgaatcatattcaaagacgtgatactaattagcctcgatagtagtgatgttgactctgattcactttacttggttaaagtggtgcctgccagttctctccattgtaaagttagtattttttctttcttattgaataaatatctcatggggaggtacttcaagatacgtcttccatacatacatggattaatcttgcctgaaataattattactgtggtattagccaaagaattatattttatttttattattccttataaacttctcaattcaaaattatacacttattaatagagaagagctttcccctttttttgtttattaatttacttatgtcatatggactcatgaatattttattctattatttaaaatatattactatcactatttattgtgtttctcaaattgtcgtagatttgaccattggaagtgccctcaagttggttcttatgaacttccaatgtactacagttattttctgacttccttacattctgcgaccacaagatctccaggttcagcttgtgttttccttgccccagccatgaaataggaatttctccaagaagccctggtttcttttattgtacactaagaatttatacacacatctatatctgtgtctatatttaacctgtgtgcgtgtgtgtgtgtgtgtatgtgtgtgatatatatatgatttatttatttttttttttttgagaaggagtttcactcttgttgcccaggctggagtgcaatggcgcaacctcagctcactgcaacctctgcctgctgggtccaagcaattctcctgcctcagcctcccatgcccagctaattttttgttttgtttttttttttttagtagagatggggtttctccatgttggtcaggaatggtctcaaactcctgacctcaggtgatccacccgcctcagcctcctaaagtgctgggattacagacgtgagccactgtgcctggccctgtgtatatatttttaaaacatgagtacacagtagtatcacctattgcaatccaataccacagagttcaggactggcttagagctgttaccccagctctgtaagtgcagcctgaaccatcaagaccagggaaacatataagcagagcaaaatgaggagctcacacaaccacacatcctggttaattttaattaagttttttaaatatatagaaaattaccatggttctaaaagtcaagaactattcacaaagatagagtaaaagaagtgtcacttccctgacattactttttcgccattcttgttttagcgttcttcccaccctgttcccacctacctcttgtaggtaaccaatctcagttttttacttatcttttctgtatttcttctttttttttctaacagcttcactcagatataattcacacaccatacaatttccttatttaaagtatacaattctttttttttgtatattcataggttgtgcaaccgtgaccacgatcaattttagaacattttcatcatcccagaaactgtctctctccagcttcacccatcttctcccaaccttaagcaacgattaatctactttctgcctctatgcatttgccttttctggaaattgcatataaatggactcttacaatatgtggttttctgtgttaggcttctttcacttaacataatgttttcaaggttcatccacattatagcatgtgtcagttttttacttctttttattgccatgtaacattctattgcatggtttattcatttcctagggctgccataacaaattaccacaaagtgagtggcttaaaagaacaaaaatttattatttcacagttctgaaggctagaagtccaaaataaaaggtatcagcagggccttgtaccctctgaaaactctaggaaattgttccttgtctcttcctagctactgggctcctggaaatcaattcttggcattccttggcttgtagctatatcacttcagtatttgcctctgtcttcgcatggccttcttccctgtgtatatctttctgtgcccactccttttattttaaagacaccaataattggatataaggcctaatctaatctagtgtgacctcatcttaactaattaatctgcaaagactttatttccaaacaaggtcacattctaaggttccagatggacatgaattcaggggcaacactatttagctttctacatatagagatacaacattttatttacctattcttcagttaatggaatttcattcctgtatttatttatgcccagatgagcagatacatgagcattttcttatttctccttcctttttatttgaaaagtggcatactgttgatatgtttgttttttccttttttcagtttataatatattctggaagttttttcatatcacttcacagagctctagctcattctaatctaaatattcagccatagagaatttattaatatatacataagatggaaattgatttagtattttaatttttatgaacatggaatgatgtatacaatatattggggatgttttcttctataggttttttaatctgtgttttcaaggtattatattcacacagtatgaaattcctccttctagatgttacccatctaatcagccctttcccagagtgaaccaatgcttccactgaatgtcagctatacacattgttccacaccttgcctttttgcttaatatatcttagagattgttccatttttttatagctgtataatatttcattttcttgtcacatcatactttattttactaatcctcttttggtacacatcttggtatttctagtcttttgctacaacaaatataacagcactatttgcaatgaccaaaataattggaaacaaccccaaaggtccataaagagtaaactgaatatattatatatttatgtgatagcatacataatgaagagagaatgaatggattaccactcaactcaacaatatcaatgaatataacaaacataatgtggaacaaagtcagacccaaaagagtgtatacagaattccaaactaaatagggtaggaatagctcatgtcagaacagcccttcttcaggtagcaattataactcttaacaaaatattacaaaaccaactacctggagacactggagaagaatgaaaatcaggcagaaactgaaggagagtctatacttggaggaggagaatggccttgagtacatttcctatttttatgactctttctctagggccagcccaagttggcaccaagtagcatgcctaaaagttggtagaaaacacgcagtcttactggcttgaagatccagaggaagagtttaggtaaaaagtgagtgaggaaatttcagaaaggagaaaaaccatacagaggtagccctaaattctacatacagaccttatccaaatctctggatgacccctcaattacgcatatgcagagtggattcctagcagcccagctaaggctaaaagaacttaataaagatgtctcattgtccattgctggggtgcagagtttggaatttcattctagccaagtttacttgtctccttaaaaaaacaataataatcccctccttagaaacatttgagtagactgtacaacagaggtcagcatttttatttattttttttttttgagacgagtctcgccctgccttccaggctggagtgcagtggagtgcagtggcgcgatctcggctcactacaagctccgcctccccagttcacgccattctcccgcctcagcctcccaagtagctgggactacaggctcccgccaccatgcccagctaattttgtttttctatttttagtggagacggggtttcaccgtgttagccaggatggtctcgatctcctgacctcgggatccgcccggcctcccaaagtgctgggattacaggcgtgagccaccatgcccggctggcatttttttcttaaaggaccagagagtaaatattttaggttcacagggtactctttcagtaatttaaatatgacaaggagcaaacttgaatataggtatgtagaaattatcaagtgtggaaaatgaagagaaaaaaaacaatgaacatggccgggtgcagtggctcacacctgtaatcccagcacttttggaagccagggtgggtggatttcctgaagtcaggagttcgagaccagtctggccaacatggtgaaaccccgtctctactaaaaatacaaaaattagctgggtgcagtggcacacgcctatagtcccagctacttggtagggtgaggcaggagaatcactagaacctgggaggtagaggttgcaatgagccgagataatgccactgcactccagcccaagtggacagagcaagactccatctcagaaaaaaaacccacaaaaacagagaacagagcttccttgacctttaggacaacagcaaaaggcctaaaatgttcataattggagtctcaaaaggaaaggagctagagaatgaggcaagataaatatttgatgaataatggctgtaaggtttcccacttctggtgaaagacatgaacttacagatttgggaagccctgtgaaccacaggcagaataaatacaaagaaaaccacacctaaacatttaattagactactactgaaaccaaaagatgaagagaagatattgaagagcaaagtagcacattgcatagaatgggaaattatatgaacaactacagattccttacagtggagatcaaaagaaagtggaacatctttgaagtgctgaaacaaaactgtcaacccagaattctatctccagcaatattttccttcagtgatgaaggtgatattaaaacattgttatataaacataagagtatatactatgtgattccatttgtataaagtcaatggaaacaggcctcaagttacttttgatggggattagtaattgcaaggaggggagggaatttttcaccataatgaaccactccataaattagtaacataaaaaacagcagttttattttctcatgattctccagtcaaggctaggctcagccgagtagttctacttgtcttgacagtggtcacttgttggctacattaaggtagtacgttggctgcaggctagactcattagggatgttcagaactctctatttagtctaaaggccaacatttccagagtcagacttccaatttgtactcttctctgtatgtgtcatacctcaattaaaagcccactttcagactaggtgcagtggctcacacctgtaatcccaatactttgggtggccaaggtagaagaattgtatgaggccagggattggagaccaacctgggcaacacagcaagaccccatctctaccaaaaaaaaaaaaaaaaattagctgggcgcagtggcacatgcctgtagtcctagctactcagaaggctgaggcaaggaggttcgtggagcccaggagttcaaggcagcaacagtcagccgtgatcacaccattacactccagccttggcaacagagtgagaccctatctcaaaaaaaaaaagtctactttcaaagggcaatagataattatttttttaattacaatctaacaaaaatagaataatctaatataaatagaaactacaaaatgttccagaaaatgtaagtattcctgtgtgactagtgtagaattaatataagaaacattaataggtgataaagtaaaaaagataacttagggttagattacactgagatttgagtgcttggctacagagctgggtcttatttgaagggaagtgggaaactattgaagggttttgagcagaggaatgatatgttcaaaacagtggtttaggaatataatcccatgctagtgtacaaattagactagaggagggagagactattatcaaacggatcaatttggaaacaatttagataagcaccaataggaattgaattaaaataatagcaagctaatgaaaaaaagggaataaaatgtattaattctacatctacacagattgagagcctactatgttctatgtacttggtaaaggactgtatatatttttgtctttatagtcaaggaattcacaacatatgaaatgtagaagtatgaaaaaataacaatttgttgtaataagaactataatagatgaatatttaaggtgttaaggacacaagaagaggaagcagccaataatacagaggagtctaagacatgctttagataagatttaaccttacatgagtagttacagtttaccaaacaaagaaggcaaagaacaacattctagccagaagaaacagcacataaaaagtcacaggcaaagaagagtagagcatggtgaattgggggacatagttcactatatctacatgtgcaagctaagcataggtacagaagctagaaagataaggatcacatcactaagggcaaaagacatgaaaaatttggtgactatatgagatgaaacaagatttagtgactttataagaagacaaggatgaccttaatattttgaatttaagtgactagaaggataatgataaacccaatagtaagaattgtataacttatagacacttttcatctgagtggacattaaatacctaggagttctttttatatgtgtgtgaagaatagcactagatgtgtttcatcaatgaaattctgaatataaaataatcatcataggttcttaaagccagtcaacaaccaagaattgatactgaccactggcacagtttttttcaaaaatgacaaactttaaaagaaaaaaaaatgccttgaatgaatgtttttcttaactcagaagaaaagaaaaatctttaactacatatagcttacctgaagaaaaaacagaattgcagaattgctgtgaatgttctaaagacctggttctatataatcaagttaattcctctttcatgtgttttaaaatattgttgatccaagaaccaaccatcagctatgctggaagtctataattatgcattgatatatgagaaggctatcattctctacagacgactggtaccatccttagcagaatacttgaggctgcttttggtttagggaatctgtagctcagagattttcctagaaagtaacctctgttgttcaaattagatagccatttgtggagacaaaacccactgggtataggtagtattacctgaatcactaaaagataattgattagaaatccaaatcaaaccttgagactgctgagtctagatgagtggctgcctagggatagagggcaggaaggggtgggaccttacaaagacacatgaagaaacttttagaattgatatgtttgttgttttgattgtggtgatggcttcatgagtaatacctattcaaacttttccagttgtacacttaaatagtgcagtttattgtatgtcaatcatgcttcgataaagatgttagcaaaggaaatgactttcatcttagaatggtcagataaactgttttaagtgctacaccattatccatataaagaagagatggccatttaaaaatatttatacaagacttgaagcaatgtaggtaacctgaggtataataaattgagtgtcttgatatttagagtcctgatgtaatacactttattaagatatagatttgtaaatttatgctaattctggatgattatttttcttgagttggtttctatggactgaatgttaaagtgggttttaagcaggttttatataatatatcaataccacattagcttgattttttttattgcgagagatgcagaaagatcaatatcttacatgctctatatcaccataaatactttcaataaagcttttttggcctggtagggtgactcacacctgtaacctcaacactttgagaggctaaggctggagaatcacttgaggccaggagttcaagaccagcctgggaacatagtgagaccctgcaaaaaaaatatggaaattagccaggcatggtggcacacgcctgtagtcttggctacccaggaggctgaggcaggtgatcacatgagctgaggagctcgaggttacagtgagctatgatcataccacttgcaatgtagcctgggcaatagagtgaaaccatgtctcattcaatcaaacttatttgaaccttcgtacatttttgcttttattaatgagcttttcttttaaaatcagacttttaatggctttctggcagtgtcatcctggttgtggttgagactaatatgagctctagtttgtgttttttgttattgtttttgtttgtttttttgagacagggtctctctctgttgccaaggctggagtacagtggcacaattacagctcactgcaaccccttcttcctcccagactcaagtgatcctcccacctcagccttccgagtagctgggactataggtgcacaccaccacacctggccaatttttaaatttttttgtagagacagggtttcatcatattgcccaggctggtcttgaactactggactcaggtgatccacccacctcaacttcccaaagtgctgggattataagcatgaaccaccatgctcagctgagctctaattactgaagattaattctataggttgaacctggatatgttagaagacataggggactttcataaagaagttcaaattagaatatgtgagataggagaattttttaaaagaattgttatttgatacttagggtgtagtcatatactcttaatattgctagagtgtaaattggtaaaagttttcatatccttttatacagcaatttcagctcttggaatttaaataatcaaaagtctgggagcatctacatgtgaagacattcatgtcacttttatgtataatagtgtagcaacttgaaactatatatattatgttacatgaaaaataaactaacacagtgggttcattcactttgtgaaacttcatcacttatttgaggactttgagtataaacaaatcagaatataaaattacctgctattacgaagtagcaagagaggctgggcacagtggttcacacctgtaatcccaacactttgggaggccgaggggggcagatcacttgaggtcaggagttccagaccagcctggccaacacaataaaacccatctccactaaaattacaaaaattagccgggcgtggtggcatgtacctgtaatcccagctacatggcagactgaggcaggagaatcgcttgatcccaggaggcagaggttgcggtgagccgagatctcgctactgcactccagcctgggtgacagagcgagcaagagcaggcgagcaagcgagactccatctcaaaacaaaaaacaaaacaaaaacaaagtagcaagagtgagtatgccagtgtgctgggggtaagatgatttagatactctgtattttccatgtcttattttcatactttaaaaaacatatcagttgtttctaaaagaacatattccttttagttacaaacatatacattcagcaaccctaaagtagcatagactactactggctgaagctctggggttttattagtacagtgatgacttaattaacaaatcctctttgaacaaagcctcttcactcaagactggccttggtgcagtaggcatgagagaaggaccagttttctctgagctagatcggtagcagcagggactaatgaggcagggccttgaaagtggctctctctcagatctaactcctcagggactggctaaagctgaagctgagggtactggtgcactcctgggacctacacagcctggttacccaggtgttgaaaaaacagtttctgtgccaacaccatatgtggcttttaagagactcggcaggactcttgctttaggcagagcattccttgtgtggaatgagtaagctggaaaataacaaagagggaatcccatgtgctaggaagcttcctcttgtcttctgtgtgctccgtgtactgctttttcaattctctgggccttattttgttcaactataaagtaaaaggagtagctaaaaaatctctaatatatctttcagttctaatagactacatgtttaaatcaggaatcggcaaactttttataaagggtcaaatagtaattattttctgctttgcagggcatactacctccattgcaagtgctcaactctccctctgtagcgtgaaaacagctgtatataaacaaatgggtgtggctgtattccaataaaactctatttataaaaataggcagctagccagatttggcccacaggccatattttaacaagcccaggtctagatgttaatgtaatgggaatgtcatattaagagaattatttgatgaataggatataattcttatttcatagagaccattctctcagactttttatttttaaagcgtaggcaaatataaaatattatttcactgtcaggatgtaataccatgggaaaaagattaaaaatactctggcaccaaactgttgtagtaaattatctgaaatagagcctttgacttcccaattaaggaagaaaatggtgtctgcaacacctgtgactgggttattttaagtcttcaaaagttaggggcctagtagaagagagtctcaagggcttgttcattttctttctcatcaaatgggccaaatcatgcttttcatagtagaaggtaggctgtggaccctttactattttatttttaaatatttctcttggctaggcataatggcccatgcctaaaatcccaggctgaggcagaaggatcccttgagcccaggagtttgagaccaccctgggcaacatagcaagaccccgtctctactaaaaaaaataactttttaaaaattaaaaataaataaataattttttggtggtccagaaaggggcagctgccatgctttgcaggtttcagatccccatctatcttgggttgggtttctatcttggtcttaagttatcagtattctaatatggagataagtctgccttcactttggagacctttgttagttcttccatgtcaggcttcagctagtatagtttgtctaatgcatttatataaaacttgtttccaacaatgaaaaagcaattacaggttgggatatgtaattcaggcccattactacataaaaggatcagcacagtggtactttatctgactagggaagtctaaaatattcttgttggccagcttgctttcacataagcactgttcgggatcttttctaagttgcagaacatgaattccttattggcctatcccactagccacagctgtgagcacaacagaactgacacatacctggtaattataccttatctaaagtgaacagggccaccttcccagcatagtgacagctatagcccttaatctaatgcagtggttctcaaagtatagactcactgggggtgccctttctgaggctctttcaaggaatctcttctatgaaatcaaaactacttcacagtaattcaaatatattatttgcctttttgactctcaatgacagtagagttttccagagactacataatgtatgatatcacaacagattgaatactgaagcaaatgttaagaatccagctgacttctgttaaccagatattaaagagattagcaaaaacttaaatgtcatactctctactaatatttttgtttggaatatatagttattcttatgaaaatatgttaaaatgtaggtttattcagaaattttctgagatcattttattttctaatacagtaaatattaataaatatgactcacacaaaatctatttggagtcctcaatttttttttcttttttttcctggcttacattttttgatgcactcaatttttttttttttttttttaatttaaaaagagacagggtctcactatgttgcccaggctggtttcaaacttctgggctcaagcaatcctcctgccttggcttcccaaagtactggtattacaggtatgagccagtgcacctgacctcaataattttttaagagaaaaagtttgagaacccctcctctaatgtaatacccttagttgcaatactctgatctcatggttactgatatcatctttaccatattccctcttataaaatatttactaaaattatccccagagataacccttgttaacaatttagtgattacttctagacatctttctactgagtgcttgcattcacacataatatatatacttttacatttattggatcatactgtggtctttcaaaacttattctcctgagtttaatttttctacctgatcactctctgaattcttataaaatcttaagttcttttttttttttttttttttttttaagacagggtctcactcagtcactatcacccaggctggagtgcagtagcatgatcatagctcactgtagcctcaaactcctgggttcaaaggatcctcttacctcagcctcctaagtagctaggactacaggtgtgtgccaccatatctggctaactttttttatttttagtggagacaggcatctcactatgttgctcaggctggtctcaaattcctggcctcaagcaatccacccacctcagcctcctaaagtgctgggattacaggcatgactcaccatgcttagcctaaatcctaaggtcttaaaattgaaagggacagaggggtcatcttatctcattcccaactcaagtcagaaaccctctctaaaacattcacaacctgagaggtccatttaatttggttttataaaccctaaattgttagaaactttttccttctcttggacataaatttgccttcttgatcacttttacccataggttctagttctactttgggaaactatatagaatgcatcttatctgtcttcactgggcttcattgtgggtattttcttctgttctatcttccagttcactaattcttttttaagttgtgtctaagcttctattaaaactatccactaaatttttactttcaatttccatttaaacctgttgtattctagtcctctgttaaaattctcgattttatctttaactcttgctatttcaaagtttctgtttgttaagttcaatatctggaactgctttattaagctgtaatttctgctggttttaatttcctgcttgcctctttgtattactgtttattttttattgtgggtgatatgttgtatttgcaaaattgcttatagaaataatttgaagtataggatgattcatgtttgcttttggcaggcatggggacattggcacactatatttatcttcatctaagtttaaagatttagatgattagaggctaagctacaatcccttgtctaggtctttctactgcctgttcacacacccttaatccttttgattcccaccctgagataaggagattttaactaggcccattactcttgacagactgggttccagactttgtcctcctagcatcaaacaccagactcacttctctgggtttctatcatcctctgtattatagcctggtaattcttcattcttttgttaggacttcaatgccttcaaacagattttttaaaaatatgtccagatgttctaattcttgataagacagttggtctgaattacctaggctgccattagtacctgcaacctactttaatccgtattaatatttttctgtccttctggattgcttgggaaactgttaaagagcaggaataaccctgaccaggcatctgtaccacattcaaccagatgctctgtaagagctcctcttgaaggtttaatctgatattaatcagataggaagtacagttcttatgaacagattcagtcttcccacagggatgagttcagttaagaggggcaatggatacggtgtacagtggccccattttcctttatgtttatattctagtcttgtaataaaactaatgctcagaatgaaaggtctcaatttaggatttaaaccaagtataaacaaaaagttaaaacaagctattgttcaaactttgacttaagtgaaagaattggtttttttatttgtttgtttatttttgaggcagggtcttgctctgccacccaggctggagttcagggatgcaatcatagatcactgtaacctcgaactcctgggctggagcagtgctcccgcctcaggctcctgagtagctaggagaacaagtgacaccacacccagctaattttttaatttttttgtagagatggggctttgtatgttgcccaagctggtcttaccttctggcctcaagtgatcctcttgccttggcctcccaaaagtgctggaattgcagacatgagccaccatacccggcctggttttattttaaaaaacacttttgctgcccttctgtaaaatgttaattatatgtatgcacattttcttttatctggtgcttctctaaattcctttagcccacgtcttatccaactagtcatgtgggaatttcctctttggggaattaaatatttaatattaacttctaggtagtacagagcagcccactgtgtttcacttttgtattattcctttgttagcactaagttttctgtatcagcttgtctagaatttttgtttcaaaattgtattcttctaatttatttgcagtttttctcttctaattgtttaattgtccatcccctaccccctgccccaaggcaaatgtactgtcttttatccatatgtgcccataaattctaaactcaaagatttctggttctcccttatatttatggtatttttctacttctctgttcagtatatttttgcaagtgtttcagttttcttcagtgtttgaggttctctagtgtgtcatttcattttcatgcatcagagtaattcctaccattcttatatggagtctcttacctgatgattttttaattagtaaagtgcaatattgaacaacattgaagattttatttcttaatctaaaacataatatttatttaataatgaaatggaaatataggttttgtgaaagggagaaaggtgtttctctaaatattatacctgtgtcaaaaagctgcaagtgctactaccactgttttgtgacccctgaatgatttctgctttctttatattaatacttactctaatagtaattgaactcccaaaaagatcacaaagtccccaattgctagctttataaatacattgatgtgtaccttgtttgatgagataaaagcttcagtaagtgatatccccacctgtgtggttaatttcaaaatattgtttgtctaatacattgttgtcagtgacaactgaacaagaacttttagaagcagttggctgtccattaatggcagatttcaaggctatgcaaattgtgccagttcagccctgcattttttcgatattatcatatcaattgagtcagttcagagtagacaaagcaaggttatgggaaccacctagagcatcatgcaccatttaacatcaatgcagcatacatgaacatctgcaacttcgatcttattaacagaggatagaatggaaggcagtaaacagctttcttcatcacttaattgcaaaatagtatttcctaatgtttgcattgtttatcaacacgaacttcatcaataattgtataattatggttgcctagatcacagtgccctcatgcatcttgtcacttattatagagtggtctgagtttaatttgaatttgaacacatgatacaaggataataatacaagttccttgaaatgtgagttgcataatacaaaaattttgtgtagtaggagaatggcaagttatgattcttcagtcactttggggattaacacaaggaaaaacaggactgaaaggcagtgaaagatgaggggaagccactagttagattcaaacatagacccattggacatgagagtaggttatgttccttagaattaatcatgagtaattcgatgtttgctttaggcccaaattgagctgaattaaaacaggattattatgcttaggtcttcccttcagtctctgtagttaaagagagaaaatggcagaaaactacaaatatagtgaggaaaaagctatggtggccaaagttaaaaataccacatgctgaggaaagccttgacatagctgctcagccttcattgctgttgcttttgaagcctgataatgccacactactcctaattagcaaatgttagtattacagtaagcaatcaagtgcagtcttcaggctttgtggcagcagtttcgcagtgcaaaatattgaagaaaaaatgaaggaaaacaatataagctcagccacagttattggtgtggtcagtgggagttgtctcacaagagagcaggaaaaggaaaatgtgaaaaacagtgggtgcatttaaagcatgtaagacaagagctggctagtctgaaaagtttgtctattttaatcatgaaaatctcacatttttacttaaatccattttatatttaaggaaaaatctaaggcttgttcatgaaattacacttgaaatattttaatttgtggttagagtctcctccccatctcaaattaaaaggtattaaattgtatattgagtgagctccgtttgtactcagctcttcccaattaataaacatagtcatttccttaaaaaaaaaaaactctagagttagaatgttttctctcactaattagtctgtatttatgcctttaataattatctgttcattttctagcagcaaatgtttgttctcagattaaattggagaaggaaggaaaaaaaagatagctacccacagtatagtatccacagacgatatagagttatgtccctctttgtgtggttcttgagtataatagacataacagaagctttcttaatatgatagttaatctattattttctgtatttgggggatgctaagaactggtttactagaggtaatagtttgatctgtagttatttatgttaaaatacttttttaaaaggtaattacagcttctactataaacttgaaaaagttggtctaactctgtgccgaatgagcggggagatattactatatacatacatataagtgtatatgcctcttacctgaatacctcagggagcacacttttctgaaccagggttttgtaataaatgtgtgtactactaattctgacacatgtatagttctcctttaaataacttgtatgcaaacgttattcagaaacgtcttctaggagctatttatcaaaactgctataataataactttgtcctaatgagtttcagtctctgtttagggagtaatcgataaactacaaattaatgttccataattcacattataatgcacatataattattttgagatgaggcaaaccctatgcatttaatttacagctataattaagtaagctcatttgatactaattaagtaagtctaaaaggatcataggtttgtgtatttaattatcaaggtacaatcagcaactaattccttgaaaagctttcctatcttcagttcaacactgatctcagcccacactacaatttatcttcttgcatcttcaatagattaaaatgcattgtgaattgtggagaatctacttggtaagttagcttctttatttaaaaagtatatatatgtatatatatatacacatacataggcttaagaatacagaaattctataatctggcaaaactgtccttaagaagtgaaggagaaattaagacatttccagataaaagataaagaggtttattgccaatagacctgtcctacaagaaatgctaaaagggaatgcttcaggattaaatgaaagaatgctagacagtaactgaaagccatatgaagaaataaagaactcctgtaaaggtatctatataagtaaatataaaaaccagtattgctggtttgtaactcttctttcattcatgaaaggaaaatgcctaggccgggcgccgtggctcacacctgtaatcccagcactttgggaggccaaggcaggcagatcatgaggtcaggagatcaagaccatcctggccaaaatggtgaaaccccatctctactaaaaatacaaaaattcgctgggcgtggtggcacacgcctgtagtccctgctactcgggaggctgaggcaggagaatcgcttgaacctgggaggcggaggttgcagtgagccgagatcacaccaccgcacttcagcctggtgacaaagcgagactccatctcaaaaaaaaagaagaaaagtgcctaaaacaataattatatgttaatggaaagacatgtaaaatatgtaatttataacaacaacataaagagggaaacagagctgtataagagcaaggttttttatactgtccaggctaagttggtaacaattcaaactagattgttatgaatttaggattttaattgtaattgccatagtaaccactaagaaaataagaaataggtcagggcgcagtggctcacacctataatcccagtgctttgggaggccaaggcaggcggattacgacgtcaggagatcaagaccatcctggccaacatggtgaaaccctgtctctactaaaaatacaaaaattagctgggcgtggtggcacgcagcctgtagtcccagctacttgggaggctgaggcaggagaatcacttgaaccccggaggtaggggcaggagaatcacttgaacctgggaggcggagtttgcagtgagtcaagatcgcactactgcactccagcctggatgacagaccgagactccatctcaaaaaacaaaaaaagaaataaaataagaaataatgaagttttctctagttttgttaaagtagtatataaaaattagattattagaaaatacacttaattgctagcttagaagtcttttaaattctactgtcagccgggcacagtgtctcacccctgtatttccaacactttaggaggccaaggtgggaggatcacttgggcccaggagttcaagaccagcctctgtaacatagggagaccctgtctacaaaaaattaaaacaattagccaggtatgatggcaagcacctgtcatcctaggtactcaggaggctgaggtgggaggaccacttgagactgaaagattgaggctgcagtgagtcttgattgcaccactgtactccaacctgggcgacagagtgagactctatatcaaaaaaaaaaaaacaaattctgtcagtcaatcaactaatattcaagtatttaatatagtaggcttcctgctaagtttcaacaattgtctccatttcttcccactaaattttttaatgtatagtcaagaaggaagagctatctgatgtctagagtgacattctagtgttgggaaatgctagataagatgttcacattttcagatttcccagccacatttaagctcaaaaaatatgaatacttgtccccatgactttcctgaaggtctaaaagatatttctgtctccatcccttcaaaaccaagatacctgattgtgaggagtagaagacccctatatggtccagtgtatgttctcttcaatctcaaagcgtgtttagagtattgccattgctatcagaaatgtgaactttcccctcagatcctagattttcagattaagctaatcttagaacatgggctttcctccttccttatcagaggccactgtggtaaaatattatagaaagtaattgttggccagtcgcagtggcttatgcctgtagtcccaacactctgggaggctgaggcgggcagatcatttgaggtctggagtttgagaccaccctggccaacatggtgaaaccctgtctctactaaaaatacaaaaattagccgggtgtcatggccggcgtttgtggtcccagctactcgggaagctgaggcaggagaatcacttgaacccaggaggtggaggctgccaagatctcgccactgcactccagcttgcgtgacagagtgagactctgtctcaaaaaaagtaataataataattgctaatacctaatgttgcgctttacagctcacatagaacatttacttatattatctaaaatgaggtattaaaatagatgaacaaactgatatctgggctgggagggagttgttgcttcttttatttctttggggtactactagcacagcctgtcagtacattaaaaatagagactttttggcattactttgttttttccaagattaactagcacaacacaaatttcttgtgcctaggtgtaaccagtgttgagacttcacataccacacacaattaatgacatcaaccttgcagtactgacagcgatatcatgcccagtttgtatatggtgtctgggtcatctgaggaagttaaaatagtattgtgatctgtgaacaggccaagtctagcaggtgccatttgcatagactagaatataaatagtatcctctaaagctatatgatgtaatgtccctaaaatgaattatctcccatcttctttcattctcagaaacaaaaatactgattcttgtattgtttgatggaaaactattagttgttcaacataaccagcaaagtataaagacttgacacctaatggcttctgttttctctgagagttagaattagtatgtagcttaagaagagctgtaggcatttagaatgatatttggggtggtggtggggaaatggaggcatcagctagggatagtttagaaccagttctaaattgagtggaattgccaaaattcggtatggtattggataacaaatatggcctattttgacacagggtcttaattttttttttaataggcttgtgccattcttcttaatctaataggcattggcaatccctaattacggagaactggtttgtctagtgacatcccaaacataggaagaatgtttccttctttaaaattttttgatagacacttgagtcaaatgaagaaatcccagatgaaaaattttagaaaggacattctactctcctgtagaatgggaaaattgtcccattcagctagttgtaagccaaaggagaaaacttaaggggttgtattatgcagctacatttttgaactgataacagttacccttccctgtcctttcctgcctaaacagatcctgatgctgcaaaccaacatttctttctttttttttatcactgttgatgaaggttatttaaaacagaatcagtgatatgttagcaaatattttatgactggctttcaggaaaaaagaacatagattcatagcaattgtgtcatggtttaaatactcccaccatcaatgtgaggtcactgaatgtagatttgagaagagctttgtatatgcagaattaattctcattagccaatctgagcaggctccagcacaccactgacagttaaaagaggtggatgactgatgtgagtaaccacatgaatgaatgtcaaaaacattatgctaaaaaaaatgtgctgaggtaagaagccagatataaaagaacatatactgtatgattacatttatttgaatttagaacaggcactattaatttacagtgatagaaatcagatcagtagctttttggtttttgttttattgagaaggaatttggctatgaagggatatgaaggaactttctttctttctttttttttttttttgagacagagtatagatcttgtcactatgctagtagcgccatcttggctcaactgcaacctctgcctcctcagttcaagcaattctcctgcctcagcctcccgagtacctgggattacaggtgcccaccaccacgcccaactaatatttttgtatttttagtggagacagggttccaccatgttggccaggctggtctcgaactcttgacctcaggtgatccacccaccttggcctcccaaagtgctgagataacaggtatgagccagcacacctggccaagaactttcttagatgaaaatattcatagcagcattacccaatagaactttctacagaactatcaacataacaattgtattttcaatctctgcttaggaaaaataaccaaacagcaatttaaagatagcctgtaggccaggtgtggtggctcatacctgtaatcccagcattttgggaggccaaggtgggcagatcacttgaggtctggagttcaagaccagcctggccaacatggtgaaactccgtctctgctcaaaatcaaaaattagccggctgtagtggtgggcgcctataatccaagctacttgggaggctgaggcaggagaatcacttgaacctgggaggcagaggttgcagtgaactgagatcgcaccactgcactccagcctgggcgatacggcgagacttagtatcaaaaagaaaaaaaaaaagcctaatagtaagatggaacccagtatgctagtatatatttaacagtcagctcatagcaaaccaagccctagtttgttgtgttttctaatttctatggtgtaaatactctcaccatgactcaccattcaaactaccaagatgaaggcattgaatggtgagttggaaagagaaatgtacgatcaattcataagctggtgtgaactcagtttctgaactgcttctacccgtcactattattgacggactgaattttcttggttttagtttagttctttagattattcaatctttcccagagctgtgtctttgcccagagactttattgaacctcagagatgtctggctaggctgtagctcaactttagatcctttaacagaaggaagaacacgagggctgagtgcggtggctcaggcctgtaatcctagcactttgggaggctgaggtgggcagatcacttgaggtcaggagttcaagaccagcctggccaacatgatgaaaccctatatctactaaaaatacaaaaactagttgggcttggtggtgggcacttttaatcccagctacacgggagggtaaggcaggagaattgcttgaacccaggaggcagaggttgcagtgagccgagatcatgccattgctgtccagcctgggtgacagagcaagactccatctcaaaaataataataataaggaataacatgcgtatgatccttaaaatatttctgcaactttttttttcccctggtgctgcagcttctattcgtaaagaatggtgaggaacacaaccaagctttaaaatcagtgtacttgagaggttttgttgttgttgtttttacaggtaattaaccatatgttacacattttaatctgcttttaagtgcaagagagattggcaaatgacttaataaagaaatgacttctgcttaaattggataaaatggttgtttactggtgtttattgctgtattccaagtagacaagtaatctgtgaatccagtttagtttattggacaataaatggtactcagaacttttatcagtgtttgattgtcaggatgcccattgaaattgacttcatacttagggaactttaattttattgtacagtatgcactgttaaaaaaaatatccttgtctttcagtataaacctatgacattgccttgtggcattatcatccctgagatgctttcttgctctaagatttcttctatgtcataaagaaaaaaggaacttttggttccttcatatctaatgcagttttttcttttgtaaactctaaatattttccattgccaccatcaacaattcaaataacaatcttactgatggaaagtccatgattagaaatagctgcttcttcaaaaataaagaactttgtatgtacctatccattttgaaaatcttaaccattgtgctcagaaggagagatatgattttaagaagggtcacatttagaataccaataatgtcctactcctgaaataattgggaccaggccgctaaaaagaaagcacctgatgtttggcctttcagtattttctataactatgacgccttggtccaaattatctaataaatgcttcttcctattctcccgccctaagagtccatggtctctttataaagaagaatcatatacatacagatattacttgaatttatatggcatcctcatgaggtgaatcccacctatgtcacttaggattcatttgattgccctggtttgatccaattcaagtattaattcaggccaggtgcaatggcacatgcctataatcccagcactttgggaggccgaggtgggcagatcacttcagttcaggagttcgaggctagcctggccaacatggggaaacccccgtctctactaaagatacaaaaattagccgggtgtggtggcaggcacctgtagttccagcaacttgggaggctgaggcaggaggattgcttgaacccgggaggcagaggttgcagtgagtaagccaagattgtgccactgcactccagcctgggtgacaagagtgagaccctgtctcaatagaaaaaaaaaaaaaaggccaatatgggcccagggcctgccattcagacttccgcttgtggcagagaccaagggatggcagcaggttagtcgcaggtgaagtcataacaagcggtgtggagccgcacctgggcaacatgtcggaaggaaatgcagtgagcgaacccagcactctgcaagggccccgacccctcctgactggggcccaggagctcagcaggcagcgactggcaccccttcaccccgggccgccttcccttcatccgctctgggaaccttaccctgggggttgaggttgggggtcaagaagaaaaccttcaccccaaatatcatcagtcagaagaacccaaggaagaagtaaccgtcaagaaggagaaacatgaaagggacagagatggacagagacaggtgcatggacagggatgaggccacccagaagtgatccagtctcactccatctttgagaagggcccagctgaaatgatgaagaaaaaaggaactggaataagaaagtgaatgtgtcagacatgggaccttctcatatcgtccacatcaaaaaagagaagaaagagttggacgaagacacgaaacatctcaccatgctgtagaaggacgatttcattgatgaccctgggctgaggaatgacactcgcaacatgcctgtgcagctgccactggctcactcagggtggctttttaaggaagaaaacaatgaaccagatgttaaaccttggctggctggccccaagaaagaggtgggggtacctactgtgaaactgaaagaggagctacaagatgaggaggaggccaagataaaggctccttccagagcagccaggaagacccccgggcctcccgaaggacatatccgtggcagagctgcccagggagctgagcctcaccaaggaggaggaattgctgttcctccagttgccagacaccctccctggccacccacctatccaggacatcaagcccatcaaggcagaggtacagggcaaggacagagaggtggtactcatcaagcaggagaacgaccaggaagccaggctggcaaagaatgcttctaccctagctgacctgacagagggtcaggttggcaagctgcccatctgcaagtccgaaagggtgcaactcctcctgggcaaggtgactctggacgtgaccatgggaaccgcctgctctttcctgcaggagctggtgtctgtgggccttggagagagtaggactggggagatgatagacctgggacatgtgaagcacaaacttctgtgttcccccgattttgaatccctcttggatcacaaacactggtaaaatgatcagatggaggaggatggcggctgctgtctgctccagacattttgttctcgaatctctgcaacccaggagaggccagttgagcccacccactccagcctttggcagccattgtcccagtttcccccagggcccacagggcttcctcccacagcagctgtgaatggcacagttaccttcccacagtgtgaagatggtacatccttgctgctggggacttgtccatgctatttgtttttgtatttatattttgtattttgtcttaatctcttcaactgactgcatcctcccaagggaggagggaggatctgtgggaaggtgcaggcttttggtggctgttgggccgtcaggcagcaagtgtgaggactgcagcttttgctggtgctcccttcttcctcccagaggcagtataggagagagagcaaggattgagtctgagacttaagcatggggtcccaactcatcagttcctggttctgtatccttgcgcaaactacctaacctttctgagcctcctgttcctcatctgacaaaaatggggatgatacctacttcacagggttgacgtgaggattacatgggatattatagatgaaaactccttgcacaaggccagaaccagtagccactcaataaatgttaatttccttttaagtaaataaataaataatcaaatgttaattcaaagtcccacatgagagcgttctgtgttttgtggtgtttgttttgttttgttttagagacagggtctcattctttcacctaggctggggtgcggtggcacaatcacagctcactgcatcctcgaattcctggactcaaaggatcctcctgcctcagcctcctgagtagctggaactatagacatgtgctaccatacctagctagtttttttttttttttaatctgtagactgcctctgtggacagtttttcaaattttttgtagaaacagggccatgctttgttgcccagactggtcttgagctcctggcctcgagtgttcctcccaccttggctgagacgacaggtgtgagccactgcacgtggtcagccttctatctttaaacaggatctgaatctagattcatcaactcataaatatgttctcatttttaaatgatggaatgatggaaagtgaaagcaccaatcaaatcatattttcattatttccagaatgtgttcagcacagttaggtctggaaaggtttttgggaaaggttgtgcaaggttgaatttattcactgttgaaatagcacctctaaatttcaagcaattgtatgatttacttttatacaagtgtcagaaatgctaaattattaaatcccaatggcaggatcactgacaactagaaacttgagtttatttgcttccgtggtttactaaactaagctagagaaatatagtacagttatttactacttaagatcagccagaaaatgtatagtgagttcatactgtactagattctgggagataatcaaatgtaaaacatataccagtctcaaggaagttaaaatctagtaggaataatcactatattcagcaataattgttaattgagcacctactctgtactagatacagtactaagagctgggaataagattaagtcataattcctacctataaggagttcaaagtttagttgagaagacatttgtaaagaagtaattgtaactatgatagataccttcctggaagtatgtgaaggttataagtgatggcataaaagagaataatcagttctgcttggaggccaaggactatagccaagaagacatgccttatttggaactaagagtgaaagacaatttgaaatgtagacttgatacatacacaagaataaaagatcatggcacatttgggacatcatgagtatgaccaaagagtaactgactaaagttactcttttggtcagggaaagataaagtttgaacaataggctggattcatatcctagagttaagagttcattcaatagagaaccattgaagagtttttaacaggggaataacatcagatttgtattcatgaaaaagtactctgtttattcatcatatatttattgagcccctataatataccaggcatagttctggatgctagcaatcatcagaaaaaaatattgccttttctatagctcctcttacctaggcagccaagttttgtgccctgagccctagctcctttcctgtgctcagctgagtgaatcagggttaggaacataaccaaaggtagacagtccatagatggtcagtgagctatgagctaaaacagcagaggaaatcagttttttgtctgtctgtttttgatgtaggatctccctctgtcacccaggctggagtgcagtggtgctatcatggctcactacagccccaacctcctgggctcaagcaatccacccaccttagttagcctcccaagtaactgggactacaggcacgcacccccatgcccggctggcttttaattttttttgtagagacagcttgttgtgcaggctggtctcaaactcctgggctcaagcgattctcctgtctcagcctcccaaggctctgggattacaggcataaatcaccatgcctggctggaaaccagttcttcagataagagagtgcagcatgtaacatttaaagaagtagagaccaggttgacatgaacagctttatagtaagattaaagtgatatgcttcatttagtgaacctattaaagataacagaaacctcgttaattcattatacacacacacacacacacatatatacacgtgcatatatatatgtgtatatatatagtcaggtgcagtggcccacacttgtaatcccagtacttcgggaagccaaggtgggaggatcacttgagcctagaagtttgaaaccagcctaggcaacatagggaggcccatctctataaaaaaaataaaaataaattagctgggcatggtggcgcatgcctgtggtcccagctacttggaaggctgaggcaggaagatcacttcagcccagagctcaaggctgcagtgagctgtgatggcaccactgcaccccagcctgggtgacagagagagatcctgtctctaaaaaatttcttaaatgcagtcacacacactaaacaaaggggaaataaggttttagagcagtaattccatctatcattgttttcttggtcatttttccatggaaaactatttttgtattcaaagtcaacactcattctcttatatgtttacattcagaactgaagaccttaactggaattaacttaaaacatttgtagaaaatcagatgcaaacatgaacaaactaagagattttaccacaaacaatgatgtagaggcaggtagtctgcaaggtcagaaccatgccttcagaagcagcaattttaagtgagacctgaatctcctatactcaaaggtcttgcattagtcaggattctctagagggatagaactaataggatagatatgtatctatataaatgggagtttattaagtagtattaactcacacaatcacaaggtcccacaatagaccacctacaagctaggagcaaggaagacagtccgagtctcaaagctgaagaaagtctgacgttccagggcaggaagcatccagcgcaggagaaagttgtaggctgggagggtaagccagtctggccttctcatgtttttctgcctgctttatattctctggcagctgattagatggtgcccaccaagattaagggtgggtctgccttccccagcccactgactttggcaacaccctcacagacacacccaggatcaatactttgcatccttcaatccaatcaagttgaccctcagtattaaccatcacaagtttcatttcaagattaataatatccttgtccatttaatcataaaaaggaatgcttattatgtgccaacttttccaagtgctttatatgtattaactaatttactcctcagaaaaatcctgtaagtacctgcaaatgctattattgttccttttttctttctttctgagacaacatctggctctatcacccaggctggagtgcagcagcactatctcggctcactgcaatttccgcctcctggactcaaaccatcctcccacctcagcctcccgaatagctggggctacaggaatgcaccaccacacctggctagtttttttgtatttttttgtagagatggagtttcgccatgctacccaggctggtctcgaacttattagctgaaacaatctgcccatctcagcctcccaaaatgctggggttacagacacgagccaccgtgtctagcctcctattttaaatatgagaaaattggcctggcacagtggctcatgcctgtaatcccaacactttgggaggccaagttgggaggattacttgagcctaggagtttgagaccagcctgggcaacatgacgaaaactcttctctacaaagaatcagctgggcatggtggcatgcgcctgtaatcccagctacctgggagtctgagataggaggatcacttgagccagggaagttgaggttgcagtgagccgagattgcaccactgcactccagccagggtgacaaagtgagaccctgtctcaaaaaaaaaaaaaaaaaaaagaggccaggcgcagtggctcatgcctgtaatcccagcactttgggaggccaaggcaggtggatcatgaggtcaggggttcgagaccagcctggccaatatggtgaaaccccatccctactaaaaatacaaaaattagctgggcgtggtggcacgcacctgctgtcccagctactcaggaggctgaggcagaagaatcgcttgaactcaggaggcggaggttgcagtgagctgagattgtgtaactgcactccagcctgggtgacagagcaagactctgtctcaaagaaaaaaaaaaggaaaaaggagaatttaatctgattaccagattgtaaatggcaaatctggaatgtgaacccaagcagtctgacttatgcacttaaccacagttatactccctctactctctatggagaatttatcaacttaatttagtcaaatttggttatcagtaccaggcttaagggaatttaaatgtcagttaactgctgtgtaacaatgaatcaaaatctatttattccatcatcacctttttttcaggaaaatagtagcaacattacttgaatgacaactttgggatcatattttactacttctctttcattcatttgtcccaaattcctgcctttgccatgggactctaggcagttgacaaactctgtgagcctcagagtcatcatttataaaataaggttagtgataccttactcatgtgagaattagatgagataaagtatacaaagcatttgatgcagtgctttttcactcagataactaccgttgcattccattgcctgatgtatcaaatccaaacttttgcgtggctttcaaagtctccctagaaatggctagatcccacccatcttgatttatttcttgccttacttgatatataaactttcttctgtctctattcctcttgggacatacacacctttcttttcctctctttttcattatccacatgtttaagacctagtttaagttcagtcttctccgtgaaagcatctccagttaaactatattgttctttcccttttttgaactcctgttgcagttataatagatgttacattgtgtgatatttcacaaattctttgatatatgctaggtttctctttccatctagattctaagctccttgagaagatagatcatgtcttaatatttttcctgtatctcccccagaggatctaacagagtatcataactattgttctatgagatctaatgagctcacagctattgttcaacaaatacttattacctgattgaagaaaataagctcctaaaaatacctgataatattatataggtctttatattgtcagggtgtttttataacactgttaatacttaatccatataatagtcacagaaaataggtagaacagatattatcttcattttttaggtaataacactgagtttaaattacattgtggcttgcccaaggattcttggtaagtagcgttattgaccccaccctcaacccctgccattccagtccattgtccgttctctatcaggctgccaaaataattttcttttgagacagggtgttgctctgtcatgcaggctggagagcagtggcacaatcatagctcactgcatcctcaaccacctgggctcaagcgatcctcccacctcagcctactgagtagctgggaatatagatgtgcaccaccacatccagctaatttttccattttgggtagagatgaagttttgccatgtctcccagtctggtctcaaactcctgggctcaaccagtcctcccgcctcagcctcccaaagtgctgggattatagacatgagccactgtgcccagcaatattttcatatcaaagatgagattgcatcactcccttatttaaaactttccaacagtttcccattttacatagaatgaaatcctgcaaaacccccacattcagtatactccaggtacagtggccttctttagcttcagcagtcttagtttgccaagcttgttgctagtctggggcctctgcacttgaatgttctacccctggaacttcacatggcttgttccttcttacccttgaaatctcaactcaaatatcacctcctcagtgaggaagtaatacctatgtaaattaactcccctcccttgtcacacttcatcatatcatcctgttttattttctgtatggcacctattaatatctcaaattaggccgggcatggtagcgcatgcctgtaatcccagcactttgggaggccaaggtgggtggatcatggatcacttgagctcacgatttcaaggcaagcctggccgacatgatgaaaccctatctctactaaaagtacaaaaagttagctgggcatagtggtgcacgcctgtaatcccagctaagagtagctgaggcacaagaatagcctgaacccaggaggtggaggttgaagtgagccaagaccacaccactgtaccccagcctatgcaacagagcaagatgctatctcaaaaaaaaaaaataatatatatatatatatatatgtatctcaaattagcttgtttatatatttgttacttgtgtattgtctatccccactagaatgttggcctcataaaagcagagtttttatcctattcacatctgtattcccagtccctaataaagtacctgacacatggtagagtcttaataaatatttattaaataaaatagctaagcccgaactagactaaaactatggcttttttgctcctaatcaagtgtacttcccatgaacatttaatttttcctactttttgtggaagcacttatacctttggaactacagtaagaattgatgttcagaataatgacattaagatgtgctgtaggattctctattatcaaagaaaaattttattcagttcaataaactaaactaattaaagcagggatgtcatggcatattattatattaacacatttagaaagatttccaaataaaaagactttctgctttttctttagttaactagaaaattaaattaactcagagctctttatgcctcaaaagtccttgttaattaggattgttctataaatctctattattagcagagttcatcatcttttttattgccctgtttattagggcagtctaagcagggtgtctttgctcatatcctgatatgtgtgtcctagtgaaaagaaaagcatttccggattctcattttttccctattccttgatataggcatatttcatgctgttagtataacaatttagtttccttctatcagttctctccataaagctggaatgatattattgacctatgaagcaaaataattaaatttaaggtctgtttaaaagcattaatgctttgtgacgttgtttatgataatagaagattgaaaatagcctaaaagtccatcagtaaaggattggttaaataaattatactatatccatgtagtggactattatgcagcaataaaaaataatgaggacattctctgtttaccaatatagaaagatatccaagattttaaaatatgatccagagtagcctagatagtatgatacctttttttgtgtgggtgaggggaggaaaaaattaagaatgtagtttattgtatatgcatagaaaaattctagaaggatatataagaaagcaataacagtgataaccagattgggaagtagaaggagcagaaaccagctgaagggcagagatgaggagagggagattttatagcatagcttttcatatgttttatatttttgaatcatacgaatacattacctactcaaaaagttaaattaaaaacaagcacaactaaaagtaatatgtggccaggcatggtgcctcacgcctgtaatcccagcactttgggaggccaaggtggatggatcacttgaggtcaggagttcaagaccagtctggccaacatgatgaaactccgtctctactaaaaatacaaaaattagccgggcatggtggtacacacctgtagtcccagctactcaggaggctgaggaaggatatcgcttgaacctgggaggtgaaggttgcagtgagccaggatcgcaccactgcactccagcctgggcgacgcagcgaaactccatctcaaagaaaaaaaagtaatatgtgattctggactgaattctataccagatgaaaaatattgctataaaatacattaggacaattaagaaaattgaactgtggactatagattagattaaaatgttgttttctgtgtttatcaactataacctggctaacagaatatcatcactcttaggaaatacacactgaagtattaaggggtaaaaggcataatatataccacaaatgctaaataaaactttgaaagaataaataatgttatatatatgggaggaatgatcaactaaatgtggcaaaatgttaaaaaatggtaaatctggataaatgttgcatagaaattgtctgtatttttctgggaacttttctgttaatttaaaattatttctaaatagttttttaaaagaaacaaacaaaaacattttaatactatggatattaccttattataagcaatggcataagaatgtgaagggttctggtttttacgtagtcatacttttcactttctggagaagtttttaccatcacttttctgtttcttccatgcctattgatgctgggtcagaggcagtggcaggggtagtgactgaattttaccttgaggttgaaaaacaccaggccaagtgtggtgactcatgcctggtgtttaggaggctgaggcaggaggatcacttgaagccaagggctcaagaccagtctggagaacacagcaagaccctgtctctacaaaaaaaatttaaaaattagccaggcatgttggcttgcacctgtagtcctagctgctcaggaggctgaggcaggaggatccttttagcccaggagtttgaggctacagtgaaccatgatcacaccactgcactccagcctgggaggcagagtgagaccttagctcttgagagagagagagagagagagagagagagagagagagagagagagacagacagacagaaggaaaatgaagaaaggaaggaaaaggaagagagagagaaaagaaagaaagaaaaacacctgcctacctgcctttcaacctgctggatcaccttcacttgtatcttctcaacagtttaggacatcaacaaaacagtaacaatgtggcattttaaaaattctttgaacaaaattttctaaggatatcgtgaggttgtgtgtatctagtgctaaaatatatagttaatttagtggaggtaaacctgcagaaacatttaattgtttggcattgagtaactggatttgtattattgttcaattagatattgtggcaattgtagaaacttaaccatctctaatataattgactttcattattgatgcatgaagatgtttttattctaattagattggcctcttaagtgattaggtagtgaagcttgtctcatatttaagtgaagagtaaattatttgtatgaagtgtctagaggatgcctaaaattgattattttgtattctaggtaagctaaattttattgttttgaatgaaggcactctgcaagtcttatctaataaatgacacaaaacaaatctgttatcaactgaattgttagtgtttgtttcctgtctgcttggggaagcttatgatttagtggttttttagaaatccagaaagtaggaataataattattcccaacccttttccttctcactttacaaaaagtttgtgaagaattgagaaataaatgctacgaataatcttaagctcttaggtagaagtacttgatcaaaactaaccaggtcatttttctacaattagtgcagaaagctagtttttactaattgttcccacagctactccaggcccatttcatgcctaagaaaactaggtcccagtgagagtcatgtgagtgttgtaggcttcattggttgaataacgtccttacctgtaagtgtatattcagatttagtgaatgtacttcatgtgttcatataataaatttcctagaatagctatggagtaggtcatgccggtaaaaactgttagttttgtgacttttttttttttttttttttgagactgagtctcactgttgcccaggctgaagtgcagtgacatgatctctgctcactgcaacctccgcctcccagattcaagtgattctcgtgcctcagcctcccaggtagctaggattacaggcacatgccaccatgcccaactaattcttgtatttttaatagagacagggttttaccatgttggcgagtctggtctcaaactcctgacctcaagtgatccacccgcctcagcctcccaaagtgctgggattacaggcatgagccactgtgcccggccatgactttttataatagatctgtaaaccagcttaagtcatttgaaaatcagagcatactgaaaatgtaataaaacataaatattattgaagatttttcagagtcatcattttgaaaggagttcttgtagttctttagataatagaaaataatgaaaactgagtttatgacgcatcttttgcatatatgatattcttatatacttatctgtactgataagtataaaaaggtagaaaataattctactttgtatttcaggaaattgagcttcatatgaaaactaaggataaagtatctcaatgatgtgtgtgtgtgtatatatatatatatatctccagaaaaaatcattataaagctgcatttatgtagaattttcagcaatttagataaataagtcatgatttttttttttttttcctccgagagggagtctcactctgtcgcccaggctggagtgtagtggtgcgatcttggctcgctgcaacctccacttcctgggtttaagcaattctcctgcctcagcctccagagtagctgggatttcaggcatgtgccaccatgcctgacaaatttttttttgtatttttagtggagccgggattttaccatgttgcccaggctggctgaactcctgacctcgtgatctgcccacctccacctcccaaagtgctaggattacagatgtgagccaccatgcctgaccagaagtcatgattcttaagaataaaattcaaaataatctcttccgttgtcgattaggttctgttcataaataaatatttatgcagtcaaaaatgaataattgttttcaaacgaggagctcaaggaattctatgtaattttggtttacttactatttatatataattattttccaatctgtaagtctagtgattaattcttatattacctaaaatgttttatagacatgttagattattacataatgtaaatgtattgtaaatagtaatggtttcattaacttgagctcattttacttatttagtacctgtttggttttagtttatagttgttatttccctgtatagtgtagcttgtacttggaagtagtaaaaccagatttctttataagtatttatggtacagaccttttcctaaatcagactgcagacctttcctgagtatttctaataaagtctgcttacattttttttttggcctgcatagtagtttgtgctatatatactctctagaaaatgtaattctggatatttgtgccataactttcaattaatcaaaatcttgtcaactgccatataggccctcatgttacaaaatgtggaaagttcagttacttaaagagtttggctgggcattgtggctcacacctaatcccagcactttgggaggctgaggcagtcagatcacttgaggtcaggagttcaagacgagcctggccaacatggcaaaacctatctctactaaaaatacaaaaattagctgggcgtgatggcacatgactgtaatcccagctacttgggaggctgaggcaggagaattacttgaaccaggaggcggaggttgcagtgagctgagatcacgccactgcactccagcctgggcaatagaatgagactccgtctcaaagaaaaaaagtttaagccagatgcagtggctcatgcctgtaatcctagcactttgggagaccaaggcaggaggattgctcgagcacaggagtttgaaaccagcttgggcaacaaagtgagaccctgtctctacccacccgccccccaaaaaaaagcaaaaaattgaccagctgtggtgctgcgtgtctgtggtcccaactacacaggaggcagagagaatcccttgagcccaggaggtcaaggttggagtgtgttatgattatacaactgcactccagcctggatgacagagcaagacctaaaaaaaaaaaaaagattttaaaaaagattgactaagtgaatgagtcctcttcttgaatatcagtcattccaggagagtattttcattaacatatttatgtctcttgttgaaagtatccattaagagcaggtagcaaaagctagacagaatatgcttttgaagattctctatgctctttattaatacctttcttaagtttctcaagatctccttttgcctccctcttgatcttaaacgagactgaagtttaagagtctttagccactctgtccccatagggatgcaaatttatgatttcagaagttccagcccccaataagaagcactgtccaatcgtttgcagatgtatcttgtaagccagatttcatgacagataagtccattccactgtcatgtgccatgtttaaagtactaaattaggttactctgtagtcaaaacaagtaagccctggtccagactactctagggcaaaatcccgttgcactgtcccttttgttctgcccatgcattcagttgtagctttcccttttgccagttgacagatagtgacttctttgcaaaacataaccagattaggttatttttagtaaaccaactaaaataaaaaattcttgacattgggaagaagtattttaacagaataatagtaatgtttttattgtgccattgtgattttctataaagaaacacccaatattcattatttatatttttttaaatttacaactctttaactgtatccaacatttcactgccaggaatatagtcaggctcgaagcttttttagaaacccatgatccaatccataccaacacttcctttagtttatggcttctgttcatttgcactgtccagaaaggtactgctaccatttgtagtcactccaaaaaaaagtgtgaactacctaggtataactctcataagacgtatacagcagcatctgtatgctgaaagttaccaaaaaagtattacttgcagatgattttgcaccttagttcccaagtgcccctgtacagaatatggagcttatgtcctgtctctctttgaatgatgagtgatgaaggagcttcagatgttactgggtgagcttgtattgagtgttacaaagagaagtcattctgcctttctttggctctaattgcagaaagtgaagtcactgcttttgctgtcttggatcaagaccagaaagaaattattgataccaatggagctggagatgcatttgttggaggtacagactaatttatttcattcttacttacaagtaaaacattttaacccttgtttctaccatataaccaagatttattcatttagtaacttctaatttcttcttttaaataattaacttctgaagttctttccatatacttctatcattgtcagtattagagggttttaccagaggaaaaatatgtgtttggaaaagataatttgctactatgctgtaccccagtcattttcacaagattaattgtatctgtcagaaaattgcataaacaaactgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatgtgaactaatgattttggtaatgaatactcaaaaataaaatcaaaacaatagaagacttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaaagcaagcaagtggagctgatgattgtccctttttctctggaggataatttgaatcatgggaaacttatttaagtttgtgtgatggttttaacttaatattttattttaatagtcttttgccaacataaatttttatttttctttctctaaaactattcatgcccagtcttttttttttttctcccaggctggtgtgcagtggtgcaatctcagctcactgcaacctccacctcccgggttcaaatgattctcctgcctcagcctcccaagcagctgggaccacaggtgcatgcctccacacctggctgatttttgtacttttagtggcgacggggtttcgccatgttgggcaggctggtcatgcccagtcttaaatgaactattaaccattaggatgccccatgcccttgttctttggaaagagtctgtaccacagacaacattctacttcactgttatgattgtgttttttatttccttgctcggaaagtcttcattattgataatattagagtacttagcagccaattttcctattttttactttttagagctatagatgtatgtaggctaaaatattttattctgaatttaaccatattctgtaatacattaagaaaaccctagtgatttcttggttagaaattggtcaaaccaggaatcttagtctagaaacttttaaacttatacactgtatgtacattacttaagtactttaaaatctttaaaacatgaagtattctatttctttgacattcagtgggacacataatgaggccatcatagatttgatggtgacctaaatagccactacctctggccttgggttacttggcttcctggcccggcaacaacagattctgttacagacacctaactatctgtaatgctaccgatactaggtgagaacatgtagactttttgagggagggagaggccattcttaggatactgaggtaggaacagctagctaccatttgtattgtggttacaacgataaataaactacttcatcaaagcaattgggatttttttgttagaggatttttcagcctctttttatcctacttcattatatttattgttggggtatagttaggtaagcaaaaaagaaaaagagtatagaacagggatccacagtcgtcttttttaaaggccaaatagtgactattttaggctttgcaagtcatatacaggctgtattgcatatcttcttgttttgtttgcttccttgtgttttgtttttttacagcacttttaatacgtaaaaacctttcctagctctccagctgtacaaaaacataccataggccagagttggcctacagactatagtttgccaaaccctctttaaatcatgggcagcttcctcactttattcatttctagcatttcaaagctccagacactggatttcactatacattgttgaaatcagaatagagaaagtagaaagcaggtagaaactaggcaggactttactggtaatacaattagatagccatttttctcactttgaacctactcagttcccagggtaatcagatcccaaaacactgggtcatgcaatgagatgaacatcctaatgtcagtttattaatagaatacttatgttgccatctttagcacattctgtcaaatgtgaatcaagctacaaagtaatagcaatagataacttttatacagtacctactaaccaaccaatatcttaaacactttatatatatattaactaatttagtgttcacaaaaacttcttggggtagattatttttacccctattttactgatgaaaaaaacagagacaaagaaaggtgagataatgtgcccatagtctcatggctagagagtagcagagccaggattcaaacccagaaagtctggctccaaagtcagtgcttttactcaccacactaatactgcttctctaaacatttatgtaaatctcaccattagaactgagaaccacagaccagccttcctgacaaaagctggttttgccagagaatcttcctgttatctgagtagatgacttactttattgaaaaggatctgttgtaatctgacagggttctggggactctaaggtaagattgttgaggaaaagaaagaaaaactgaaagggaagagaatccaagaactgtagtccctggtgagtttcaaccaagagctttttgctaagcagtagaatcgattgcactacagagatacagaaagccagatgataaacttgcttggttagcatgggctccaaataagagagttatatgaatcagctgtttaatagtgaagcaggatatttccctaagcccttctcaggcagaaattgcagtgtgtgggcgcaggaactagccagccactttggtgccagcaggagcgaacttcactcactcgcttctccactgctcacaggagggtgagcacacgtgagcaggtgcaggagctgggctgagcgcttttgggcactggtaagagcgaactccataccagaccagtggcagcatctaagggaagctgcccgtgacccctggatccccagaggaagcgttacagtgcccttttagctttgctgtctgtagacagcttaagcattaacagctcagttgagtgaccctccattgtcaccaatgtgacagccctttgcacccacactcatggcacccgagttcttgtccggcatccaggataaatgaggtcacacaaacgagttggagatggtaaatgcaggggattttattgccgatgaaagtggctctcaacaggaaggggagctgaaagggggatgaagcaggaagataatcccctggagtccggtcatccccagccagactcctctccaaagctatgccatcaagctgtccctctgaagtcaagccgcttctctccgatgtccaaccgtggtctacaacatccagctgcttctcctcttctttctctgttggctgagcctggggtttttatgggcacaggattgtgggtggggtgggccatgggtgattttggaaaaggcaacatttgagcaggaaaacaaggatgtaagttctcactttgggccatggtattaggctttttggctttaggatggggcgctcaccagagacctaccctcttctgcccagaaatttgcctgcctcctgtccctatcaatagcacccatctaacaactgatgcatctatcttacaacagaaatggtcttgttagttggaaatactaaaagatccattggttaaaaccccctgctccctctccacaccagcaggagcctttctactgggattggaaataacagctgttggcttgacacagtggctcacacctgaaatcctagcactttgagaggccaaggcaggcggatcacttgaggccaggaatttgagaccagcctgaccaacatggcgaaactctgtctctactaaaaatacagaaaattagctggtcatggtaacatgcacttgtagtcccagctactcaggaggctgaggccctgcccgtatggaaaaattaacaaaatggatcaaagacttaaatgtaagtactaaatcagccaggtgtggtggctcatgcctgtaatcccagcactttgggaggccgaagcatgtggatcacttgaggccaggagtttgagaccagcctggccaacatggtgaaaccccatctctactaaaaatagaaaaattagccgggcatggcgttgcatgcctgaagtcccagcaacttgggtggctgaggcaggagattcacttgaacccaggaggcagaggttgcagtgagtcaagatcttgctactgcactccagcctgggtgacagagtgagaccctgtctcaaaaaaattaattaattaattaataaaataattgtcgttgactccttccaccttgggaatgaatctcaggcagtggcaacttttacatttactatgtagtttatttttcttcgcttcattgcccaattaacatatcttctttctgattgacacattctatatttggatggttaatatattcatcctgtaactttcaagttttgctggcctaagagtatttctgtcttttgtgactttgcatatctatattttagtccactttgtggtaatttaactctctgaaggacaataattttctttgcataaatttcaagttttggataaagtatcactccagctaccatgtgctaattatctatatcagtaccagagtgccatgtgttcctttagccagctaaaaagatatatgactacatcatggattttcatgtataatttaaaaatgagtaacccaaatgtacataaattaaattaaattaaattcgtagttccatctcacgggtttagtgacagtaacaaatccctccagcctctacaagcatcgctccttgttctatttggaggtcttaagcactttgtgatatttgttctttatttgtcactgcccagccctgatagaactaatcttttcacattcttcctcaaaagcccaagtgctaggattgtactcttggaaatggatacaattctataatctctaagtatgatttcctaatttcctaggtcaggaaaaaatttcttcctgttgtcctgctgtgctttgtcacagcaggtctaccttttcatttggaaccctctttgtcactgccatagtaacaaatggaaacattgagaacattttgtgacaggcactgtcattgttcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaattaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggctggtctcgaactcctgacctcaggtgatccacctgcctcagcctcccaaagtgctggatttacaggtatgagccactgcacctggccagaatattttatttggaatgataataaagtaactgtgctgactcataatactttttttggagggggagatggggtctcactctgtcacctaggctggagtgcaacagcacaatcatagctcactgcagcctcaaactcctgggctcaagccatcctcccacctcagtctcccgagtagctgggactacagggtttttaaaaaatgtttttgtagagacagagtctcactctgttacccagtctggtcttaaactcttggcctcaagcagtcctcctgcctaggactcccaaagtgctggattacaattgattaaaatgacaattcatttgggattacagacatgagccaccacccccagccagaatactctttattttaaaaatcctcacaacagcttcagcagagaaaatgtattacccttaaaaatattacctataatatgcaaatgactctgaaaaccactcagcaatcacaatgcaaataattctcctatttcccatctaataaaaaggaacactaattacattctctaggctgggagcagtggctcacacctgtaatcccagcactttgggaggccaaggcaggtggacagcttgagctcggcagttcaagaccagcctggacaacgtggcaaaaccccatttctaccaaaaataaaaaaattagctgggcatggtggcataagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcatgtggcacctatctatacttctgagaaccatgaagactctctaattatcttcatattttctatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgaacagaaatttttcttaaaaccatcaaatgaacagtgaaattggcttggtcattaggaatatgaaacagaccaggcatggtggctcacacctgtaatcccaacactttgggaggcagaggcaggaggatcacatgaggccgggatttcaagaccagcctgcacagcacagtgagaccccagtctctacaaaaaaaaaaaaaaaaaaaaaaaaaaatagccaggcagggtggcatgtgcctgtagtcccaactactcaagaagctgaggtgggaggatagcttgagcccaaaaggttgaggctgcagtgagctgaggtcacgccactgcactacagtctgggcaacagggggagaccctgtctctacaaaaaaaaaaaaaaaaaggatatgaaacattcaccacagatagtagttcaggttcatgcaacagaaagcaagagagagctatacccttgcacagtgataggatgctttattacatgccacactagtgttatacatccagagtcttagtcaagctgaagctagaccagcaccaaatttcataaacactgtctatgattatttgagccttcgttagttaaaaaaatgtaaagattatcctctccagccatgatttaaaaaaagagagagagaaatcactttgttcatgtgaaatacaggatgattttagagtgaagcctgtaatttctcatcaacgcaaatgttccctcaaagacctaatatcctgaatggccttcatctagaagcaattgtaaatagataatggaattgaaaggagtttatcttctgggaatgtggataagacacagacagtctgaaccatgtaggctatcagactccaaagctcagatgtgaaacttaggtttcttatatttgatgattattgagaaatatttattctaagaaaatgatgttgatatggaaatttttatttagttgcagaggtccacaggaaatgtagtaagtaaaatttctgaagttcattttcttaaacagaattgtgacataacaaaatatatgtgtgttagttccctgacctagaatattggtgagccaattggaagtaatttgaatcctaaaattctctcagctgctattaaatgaatctggtcaattttacctgtctgatacatccaacatgtatcagttagcttttactgcataactaaccactttcaaaacctagttacctaaaataacaactcatttatttagctccacaaatctgtgggttgacagctgggcctgtgcttacctggacagttcctctggccttagagtgttgagagattaagtaatttgcccaaggtcatattgaaagctaagattcaaactcaaaatttggcctcaaagttcttagccctagccattttgctatactcccttttattactacaacatcttagcttcctctctaaaggaggagaaatagccaaagtggttttataaacactggtctgtcgactggtaccagtctatgacataagagttttcatcagtcagtatcaaaatgtaaaaaggcaggggcaagaaagtaaatttccataaaactaaatgtattcagttttaaatcttgcccttcctactttgagggagttcagttttctttctttatgaataatgttggtaatagtggattttttaaaaatgttcttatctagcagaattaaagtttgccagctctgtgtttatccctaaaatcttttgggcaagtttcaatgttctgtgaaatcccaaagtctgggattcactgatcaaccatattttttcataaattctacaaaattatttggccttttttttttaatgccagtaaaaaattactgatgacgtgaatgccattcatgttgggcttttctaatatctggcccacttcttcatataaagaagatgagtataggccaggcgcaggggctcacacctgtaatcccagcactttgggaggctgagacaggtggatcacttgaggtcaggagttcgagaccagcctgaccaacatgatgaaaccctatctctactaaaatacaaaaattagcaaggtgtggtggtgggtgcctataatcccagctactcaggctgaggctggagaatcgcttgaacccaggaggcggaggttgcagtgagctgggatggcaccaccacactctagcctgggcgacacagcaagactccatcccaaaaaacaaaataaaaagtaaagaagacaagtatagaactgtaagttctatacttactgtaaacagatgagtacaggccgggcacggtggctcacgcctgtaatcccagcactttgggaggccaagacgggcagatcacgaggtcaggagatcgagaccatcctggctaacaaggtgaaaccccgtctctactaaaaatacaaaaaaattagctgagtgtggtggcagacgcctgtagtcccagctactcgggaggctgaggcaggagaatggcgtgaacctgggaggcagagcttgcagtgagccgagatcgcaccactgcactccagcctgggcgacagagcaagactccatctcaagaaaaaaaaaaaaaaaatgatgagtacagagcaataagtataatatgatgtgatttgtattttgttaaaaatggtcttatgtgtgtatgttgtaggtatacttataaaagcatataaaagttccaggaagaaacactccaaacagctaacagtggatgtactgggaggtggctgaatgaaataatcactttctactctgtatgtctgaatttttttttttttacaatgtgcccttattggctttgtaattagtgtaatctttaaataaataaaatcacatgtgtgtagcactgatgcagagcctagccaaccttagtacctagcagaaatcttcactgtggtaaataagtcatcagacacagcatttcaaactatacgataatttacataaaacataacctctgatgttttaaggctacttatcagcaaaggtctgaataaaacaaaattagcagcatgattgtcaaattaacagctactctctcttcagatatataagttctgaaaccaggggtataaacacaggcttttaatttatttttcatttaattatccaattaacgttgacattttatagaatttagatatatttctagcccacaaagtaaatggcaaattaaaaactgatttctgtcatcaaatgctcttaaaattttagaaccatcatgctatgagaaattttcagttgatcaaatgtaggtttttgaattgagttaaataataacaaaatgatccttcttatgaattagggcataagcacagcttcacataaacaatgttaccatcatcttatcccagcagctattactttgccccattgaatcttttgtttttaactatatcatttagagtgtttgtgctgaaaggaaaattttaaaaaatcatattttctggttttcagtttccagtagtgaaactcttttcaaatgagatcttatctgaatcagaatgaaatgaacccacaaaaattaaaaattaaaaatgtttttaagaaagaatgaaatgagattaaacaaactcccatttgtccctatccacattttatttggtggctcatgatgtcacgtaggaaaaccatgacctattcaaaagcccctatttgatgaatgaagaaagtaaggcccaaagaaaggtaagatgagttgtccaagggagttaattgcaaatacgagacaagaagccagattactgaattcatgaagcagcagttacttgtgttcataatccaaatgaaagttgtcagttaaggctgagcgcagcagctcatgcctgtaatctcagcactttaagaggccgaggtggacaaatcacttgaggtcaggagttcgagaccaccggccaacacaacatggtgaaaccccgcctctactaaaaacacaaaaaattagccaagcctgatggcgggcacctgtaatcccagctacttgagaggctgaggcaggacaattgcttgaacctgggaggcagaggttgcagtaacccaagatcacgccactgcactccagcctgggcgacagagtgagactccatctcaaaaaaaaaaaaaaaaaaaagttgtcagttaagctgtctgttatttagtcctcttggaaacatataggtcaagagtcaatatcccaaatgcacagaaggaggggttttttgttttgttttgtttttgtcttgatgtttgactttaacaataaacagaagcatacgctaaacttttattttgggaaccacatcaaaagatcacacattagctttaaaatcaaatactgactcagtgttgtacatctatgctccatgaagaagaatgacttttaaagcagtgttttgaaagggattagggtgaaagggcatcttatctatatgagtgcaaaatactgcttagcagtactcttcaagagctttcttccgaaattaagatcatttttaaattgatgggcttttggttttgtttttaattcaaatacaatgtcccataccatgttaacagaacttagtaagcttccatttttagccaccacaaagaaggaataagaagttattctcaaagctgtagctataggacaataaagttattctttcttatagctacagtactgaccacttgcctgtatattacacattgcttctcagttgctcactttatgtgggagggtgtgttgtgctgaactatcttaaagcaacctttgctctaaattgacttcctgtacatgtcaacaattaacaccatctgacaccaattaagctttagttttcttttcttttcttttcttttttttttttttttgagacggagtctagctgtgtcgcccagaatggactgcagtggtgtgatctcagctcactgcaacctctgcctcccaggtttgagtgattctccagcctcagcctcccaagtagctgggactacaggtgtgcaccaccactcctggccaacttttgtatttttagtagagacagggtttcatcatattggccagaatggtctctaactcctgacctcagatgatccacccgccttggcctcccaaagtgctgggattacaggcatgagccactgctcccagcctggttttcattatgcaaatacctgctaggtcagaccttaccctggcaggcacagtagctttttcagttatttcaaaatttaatatttattattttccctgaaaaatcagttttctaaaatttgggtcacaagttgttatttgagttcatgactaattggtagtcaatatgaagtcaaaacaaaattttactaactagactacatagaaaatacaaaaagtttacatctgagcacttttcagcagggggaaaccattactttgtcacatctggatattctaagctagccaaattgaagtgggaatttcctgccagatgttagttctttgagcaacctgtgaacatctaagtaagtgaggggttatgagtccttgtttggtagagctatacccactctggaggcttgctcctaacaggcagcagacattttatatgtactaccaccagtcaggaggttgtgcaacctatttgaagtcaatatgatgtgctcttgttaaatgtcaaaacatccaaggcctcattttgaatgtacaacatcagtcttacagatattatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaaatatgagggaaataaagaatctgaaatgacatgaaaaataccaagtatttatatcaacctcctgttctagacgcacatgggaattaggaagtgaaaatttcattcagaagagctgtgcacaaaaagtggaaatgcattattcaattgaaacaagtaacatttttaagggggataaaatactttctacatgatctcactggttttgtcgtcctccgtaagggaaaatattgacatttaccagactgtttgctccagctttctgatctcctgcagtttatttttataacaaccttatcgatgggcctcttacccagctctctaggtttaactgagttgagtcgatttgttaccacagcttcaagtagctgttacagaacaagcaagacatcctaataaagctgtaaacgtgtttactcaaacagagtattgattttacttggaggggaagaagccggttcttagcacagtgtcagggtggatgaatttcactgcagtttttcattgtcatctgtcagggttgtgaaacactaagtaaagccatcagaggataattagaagtaccagaagtttagcccctaaaatcagttaaccacttgggagttttgtagcttaattagcttttattaaaactttccctagtattaatagccaagcacttttaatggtatttccaagtagatcaagatatcaagattgtgacttgttaaatatatgaatttaatggctaagggtttttcagaccttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcgcagtggctcatacctgtaatctcagcactttgggaggccaaggcaggaagattacttgagcctaggagttcaaaatgagcctgggcaacatagtgagactcccatgtctacaaaaaattaataaattagccgggcatggtggtgcacacctatagttccagctactcaggaggccaaagtgggaggatcgcttgagctcaggaggtcaaggctgcagtgagccgtgatcacaccactgcattccagtctgtgtgacaaaacaaagccctgtttcaaaaaacaaaaataaaacatgtctttgtagaaaaatccagtttgcgtctttattacacttaaatgtttttgtaacacaatgtgatctaaacacataaaactgtcaatgccacccttatttttaaataccttgattaaagcagattctaaaatattctagcttactttaagttagtcattgtcttaacaataaaagctgatgcacgttgtgcaaaaggtaagcatcagagtaaggagttgcttaccttctgtagaaactgcattagctactgagcttcatgaaaagcattcatgtgaacactacctgacctcttccaaatgtctagaaaaacaaatcacagttgaaaaaaatcacccacctagaaaatgaacaaaaaaactggaaatttattaaaaataagtttgaccttctctcatgatgctgcagtcaagcaaaaatgaaaaataagtttgaccattatatttaaagtacatcttcccatatctaaataattcatttagtgctttatggtaaactttttatgtcttcttgcactactgcctcggcctgtctaaatgactaataaaaattatgatatctctgggatgaccagttctaaagcctaagggtaacagactctgtcagaaagaacagcaaaagatgttgggttttctttgtctttgaaatgctttgtcacgtgtttatctgtgcatatagttctaagccaaattctaccctgaattgctttaagccacaaagtagcaggttgtaaaatattgttgcataagagggcacctctagagcttgctcttctaatttttctaaaggtagaagaaattgacttttcacaattgtatttagatcattcttccatattaaggtattcaaaaacagaaaacataaaggatatggatttatgattatatcatttttatgtgcatttcaaaaggcccacaatacagtaatttattttattctatgcaattttcttgagaatgacagcatgtgagagagctcgttggatggggaggggcagtatatagtagggtagccatatttgagcttcaaggcactgtttactctgactccttcagtcaaaaggagcataaacccatttcacctagttcaggttaaggaattttttttttgtaaggaagatattataacagtggttaagacactgggtcaaaatatgtggggttttttgtttgtttgttttggttttttttgaggtggtgtctcgctctgttgcttaggctggagtgcagtggcgcaatcccgactcgctgcaagctccgcctcccgggttcacgctattctccttcctcagcctcccgagtagctgggactgcaggtgcccaccaccacgcctggctaattttttgtattttttagtagagacgaggtttcaccatgttagccaggatggtctcaatctcctgcctcctgatctgcccgcctaggcctcccaaagtgctgggattacaggtgtgaaccactgcacctggccccaaaagatgtggttttaagtcctggtaccacattaactagttgtgggactgctgtggtttgaatgtgtcccctctaaaattctagcattgtcaatgtgatagtattaagaggtggggactttaagaggtgattaggccttgatggctcctctctcattaatgggattaaggcccttataaaagaggcttcatgcagcatttggctagcttgctcttccactctggcttacccttccaccctcacaagacaccaaatgccaacagcttgatcttgaacttcaaagctgccataattgtgagacaataaatttctgttctttatgtattacccagtctcaagtattctgttgtagcagcacagactatgagagagactatggaaaagttaattctcttttttgtttgtttgttttttgttttttgtgtttcttttttagatggagtcttgctctgtcaccaggctggagtgcagtggcatgatctcggctcactgcaacctctgcctctcgggttcaagcgattaccctgcctcagcctcccaagtagctggcgactacaggtgtgcgccaccacgcccggctaattttttgtattttagtagagacagggtttcaccatgttggccaggatggtctctatatcctcacctcgtgatccacccgcctcaacctcccaaagtgctgggattacaggagtcagccacagtgcctggccgttacttaacatctctaagcctccgtttcctcatttataaaaatgaagataatgagtacctatctcatttgggttattatgaaagttaaatgaagtaatgtttataaagcacaacacctgatacatagtaaggattcattaagtgttacatattataagaggggtctcaaagaagtctcagacaagagccagaatgacaagttttcactgaaagtatagccagatggtgattgtaggttcaagtcagttctggagacctcagcagcagatactggatcttcactccagttcttcactaattaatcctactcagctgcattacgtgtctgcgtcttactgtctcacagtcagcttcccagcctgtctttgttttccattctggctcctaaaagagaacactgggttattagctcaattcactttttatacaatgtcatcagtaggacactaggagaaccataagttgtttgcccttgaacgagatgcctaccctttgttccatttaatagtaaaggttgaatttacgtgcacaaaacattctgcagtgctggaagtgatttttcttaaaagggtaatacgtggatgggctctataaacattgtgtttgcatgccttgtccactaccttcttcccatatttatagttctgaaaatgttccctacaacgtgatccatctatcatacaatacatggaacatcaaacagcttgtatctcaagctagaaacctagacgcccttcctgagtccttccattccctctctccaaaccgtcagtgagttcttttgattccgctttaaggatgtatctcaaatttgtccacttctatttctctgtcatgactttagcttaggcctgttttccacttactgtagtagtttcctaactgatgtctatgccttcactctttctggaactttattccattttctgtataatagccaaaataatcactttaggaagaagttgaattatttcattcccctgcttacaacctttccgttgcttctcactgcacttagcctaaaaatccaagctcctgtggtgatttaaaaaaatctatatgatctgctatgtttgtatctttatttcattccattttcacctttgcctgcatgatgtagctatactgtcagtcttctttcaggccttagacactttgtacagtggagtttactttgcctagaatgttcctcccctactctttaaaagtcaactcttctgtaatcatcctatctaaaatgggtcccttgactaatattctctcctgttactcagttctttttcatagtagcacttaacactctggaattgtcttatttacttatttgtttacttgtttttgtctatttcccccattacaatgtaagtttcagaagaacaggaactgtaagtgtcttatttaccagcgtatccccgggacccagcacagtgcctagcatagaagactcagtaaatattagttaaataaatgaatatatcaatcatatgcacagctgcaaaccgatttgcccctaccatcaagtaaagaccatttagtcggtatttctaggaatttggttattgaggtatatcataagaaggggttagaataagtcaggaaacagagtaggccatactttaggatcaggtcaacttggtttaagagtaacccacgctaggccaggtgcagtggcttacgcgtgtaatcccagcactttaagaggctgaggtgagacaataaactgagcccaggagttcaagaccaaccagagcaatatcgtgagacccccattggtatcaaaaattaaaaaattagccagacctggtggcaaacacctgtagtcccagttactcaggatggtgagataggaggatctgttgagcccaggaggtcaaggaaacaatgagccataatcatgccactgcactccagcctgagtgtgtatgtgactaatccagaaacagagagactgatcatactacctttagtatcacttaaaataaaggatgctgggctggggggcatggtggctcacgcctgtaatcccagcactttgggaggccgagaccggatcatgaggtcaggagatcgagaccatcctggctaacatggtgaaaccccatctctactaaaaatacaaaaaattagctgggcgtggtggcgggcgcctgtagtcccagctactcgggaggctgaggcaggagaatggcatgaacctgggaggtggagcttgcagtgagccaagatcatgccactgcactccagcctgggtggcagagcaagactctatctcaaaataaataaataaataaataaataataaaataaataataaaggatgctatggagagaatacatgtgttaggaaagaaggtagtatttaataataattgtactaagtagttatagtacagatacaaaaaatttattctcaagatcataatcctgaacatcagttcctgctgtaataggcagtaacatacaggtcagagactccagtcaagatttcataaaatatattaaagttatccagtagatctccaagttgattcctgacatcactctcaagtcccctaatacacacatcacactctcaaacttacaaatttggtttgccaaaatgtccagtgggaagggtttaattcagcagataatagaaccttgccctgtcctacctaggatctttgctgccattccttcgtttataggtgtgagtggggtaaaaagtagctcatccataaaggaggcagtgaaaatctctagtgaagagcactgagcctgggacataacctgtttcattttccacagcttctttacctcaagccacagaattgttcttagctctttaacttttgtcagcacccacatcaaatcaacaaacttgtttatttttcttctttccttactatctatcacccagaatagtggttctcaaacttgagcgtgcatcagaatcatctgaacacttgttaaaagatctgttgctggaccctctcccagggcttctgatttagtaggtccgtgatggggcttaagtgatactgaagcagctggttcagggaacacgctttgtgaaccatttctggaaagaattttacagtagattcccatttgatctctctgcaagcagtctctttcctagtaagttcatattccacacttctgccagagttagctgcccaaaagcaatgtaatatgcctcccctgtatcagagtttggttggctctctatttattatagtataaaatccaaatcaggctgggtgtggtggctcacacctgtaatcccagcaatttgggaagctgagatgggtggatcgcttgaactcaggagtttgttaccagcctgggaaacatggggaaaccccatctctaccaagaatacaaaaaattagtcaggcatggtggcacacacctgtggtccgagctactcaggaggctgaggtgggaggattgcttgagcctggaaggcagaggttgcagtgagctgagatcacaccactgttctccaacctgggtgatagaatgagaccccgtctcaaaaaaagtccatatcacatcatacaagatccttgacgatatgtccccattttgtctttcccgctgtgtccccaactcagctgacctttgactatattgcaaaataagctttgtcctgtcaacagcatggctttttttcctgcttataatgtctatctctgcaaaatgttattcattcaacacccagctcatgtcaccttctccaagatgcatttctaaatgtcccccaattgaggtgttatgttatttttaaagtgcatacgtggctttctctcctaaagctataaaaccctcaaggacaaacactgtgttttatccatctttgactcctttggtgcacccaaagcccagtacctagacattcaatagctgttggttgatggaatgaatccaggtacttctgacagattccagattttcactttcttttgtttcttataataaaaatgtagtatagaagcagtcatggcatgagtctagtaaactgaggattcagatcagtcaaagttataatttatcttattccctttcctaaagcagctagagataatgaaaataaaacctttaaaaagaatgtaacacctttaagttgactgcctcgtgtacactgtggcagcatatatctggtaatcattggtataggaggtaagtttaacaggccagtttaagacagcatataaatcatcactaaaggacagatagctaagaaagatggaaaataaacaaataattgaaaaaccagattgacccagaaatgactaagaacaaagtttgtgcagggagacagggagaattgagtttagtactgttagttgctgtaaaatatatcaggtttgctttaattacatggtaatgcttctaagaacaaaggtaattacatgataacttatgttactactcccatattatctctaaataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatctgagccagagccatggagaataccaaacgagtctgaggtaaattctccatggcttgtcacagtgtcttctgaagaccataaacatacaacaaagtaagttgacaaagcacgcaacagatcaatgagtttgggatataatgcatgtaattttaaacagttccttttatttggggaggtttttcttttaagtaaatactaagaattttttttaattgaaaaatatttcactcatctcattttccaacatcctgaggttatatgtgtggcctatggggtgaggatgtgtagcactgggaactctcatttattgctggtaaaaaatgcaaaatggtaaacaaccactttggaagacaatttggcaatctcttacaaaactaaacatacttttaccatatgatctagcgatcaggctccttcgttgcccaaatgatttaaaaacttacgtcttcacaaaaacctgcatgcatatgtttatagcagttttattcataattgacaaaacttggaagtagctacatatctttcactaggtgaatggataaacattatcgatacaataaaatatgattcagccaacaaaaagtaatgagctatcagctgggcatggtggctcacacccgtaatcccagcattttgagaggcaaaggcgggcagatcacttgaggccaggagttcaagaccagcctggccaacatggtgaaaccctgtctctactaaaaatacaaaaattagctgggcatggtggcaggcgcctataatcccagctacttgggagactgaggcaggagaattgcttaaacccaggaggcgaaggttgcagtgagctgagatcgtgccattgctctccagcctgggcaacaagagcaaaactctgtctcaaaaataaaaaaaagaaagaaggaaagaaatgagctattaagccaagaaaagacatgagggaaccttaaatgcatgttgctaaatgaaagaaggcagtcttaaaggctacatactgtgtgattctaactacagtcatgcaccacataacattttggtcattgacagaccacatatatggcagtggtctcataagattataaaaccttatttttactgtaccttttctatgtttagatatgtatagatacataggtacttaacattttgttacaattacctaaaattcaatagaataacaggctatacaggattgtagcctgggaacaataggctataccatctaggtttctgtaagtacactctgatgttttcacaatgacacaatcacctagtgatccatttctcagaatatatccccgttgttaagcaactcaagactgtatatcacattctagaaaaggcaaaactatggagactgtaaaaaagtcagtagctaccatgggctggagctgtggcgcaaggagagagggatgaataggtagagagcactgaggatttttagagcagcaaaactgttttgtgtgatactttaatggtgtatattattatatttgtcaaatcccacagaatatacaacacaaagtgtaagccctaatgtaaactatagatattatttaatgataatatgtcaataatggctcatcgattgtaacaaatacacccactaactaatgtaacaggttaatcataggtggaactggggagtaaggggatgagggaagatttgggaactctctgtattttctgcttcattgttttgtaaacctaaaactgcccaaaaatataaagtctaatttttttaaacccaagtgggaaaacctttcttcgatccatcttattctactgacatcttgggtgtgtatgatggtctgtgtttcccagtgtcatcaatttcactgccttaaggtgctatggcttagacttgtgtcctgtggccagtgacctcacagtttttaccaaaatacttgttttcattgctatcacgtgatagctactctaagtatgattatccttcttaattctgttaggaatccccccggcattccctgtgagggaagtattagtccttgaatttccgtttcaaaagatgcgtactgatttacttggtatatagcttctgtaagaggaagtttcatttgggaaagaaaggttgtgctaaggttccctcagaaactttctaaattgccttctctaaaattgcctgtgtttccctaagcctaagagtaaaatacaggaaatagtgatgatttttatgtgcttgaggaatcttctaagaagagtgaccaattttattctacttatactgatacttgtactgatttaccttgtggaaaattcatccagtggctacaattactaactcactccaaaggcatgagtgggaaactattaaaataacacatcacttagctgaaactcttgaatggttgctcttaataaccatttttctgaataatttaaagttcccatgttttttaaaaaggtttattgacttagatctgatttgaaaagtgtaatgtagcttattatagaatatttaaaacataagaaaaacaaacaggaaaaaagtcatcccaactctagaaacttaacttttttcaaacacattttttttttttttttttttttttactattttgactaaacatgtttctaaatgtacttcttggatctgactaaagactaaaaatggaaggaaacacaagtagaaattataaagtcaggatcaggccagtgtggtagctcatgcctgtaatctgaaaaccttgggaggctgaggtgggaggatcacttgaggccagaagttggagaccagcctgggcaacctagtgaggccccatctctaccccaaaaaaaaaagaaaaagaaacttatttatttaatttcctctctttaaaggtatcatatgcaaaacagaaggtttgggggttttggggttttttgtttgtttgttttttgagacagggtctccctctgtagtccaggctagagtacagtggcacaatcatagctcactgcagcctcaaactcctgggctcaagcagtccccactaccttagcctcccgagtagctaggactaaaggtttacaccaccatgcccagctaatttttctattttttgtagatacagggtcttgctgtgttgccagggttggtctcaaactcctgggctcaagcaattctcctgcctcaacctcacaaagtgctgggattacaggcatgagctgctgtgcccagccagaagttttcattttagcacagtttaatctttcactttctggtttctgctttttgtgtgtcttatttaagaaatattttctacctctaggacataaagatattttttattttcttctaaaagtcttactatttttccatttacatttaactcattgatagacctggaattctttttttttttaatatagagtgaggtaatgttatttttccaaattgaaaactagttgcctaaacactacttttctaagaagccatcttttccccatgaatttgcaatggcaactctgttgtagctcaagtttccaccttttctctatttatttatagctatgccaacaaacactgcatttattattatagatttttagaagtatttaatctggtaagactagtctctcctatcatttttacttcagtaagtgtatatgcctgttcttgatcctttgctttttcatataaattttagaatcaacttatcaggttcccaaaaacattgttgagactgtgattgaatttgtattgaatgttatcttcttctccaataacccagcatatctctccatttaggtcctttgtaatatctttccataaagttctatagttttctttattagaggctggcataacttgcatcgcttttgtatttttaccaaattacatttttaaaactgttgctcttgtatatatatatgtgtgtgtgtgtgtgtgtgtgtgtatgtgtgtatgtgtgtatatatgtatatgtatatatgtatgtatattctatatacaaagctgctctcaatgaaaatattgacaaatttatttcttcttttacaattcctgtgtatgtgtggggtgtgtgtgtgtgtgtgtgtgtgtgtgtgtgtgtgtgtgaagatctcgcactgttgcccaggatagaatgagtacagtggcatgttcacagctcactacagcctcatccttctgggctcaagcaatcctcccacctcagcctcccaagtagctgggactacagtcatgtgccaccatgcccagataatttctgtattttttgtagagccgaggtttcaatttcttacccaggctggtcttgaactcttgggcttaagcgacctgcccaccttagcctcccaaagtgctggaattacaggcacaaactactgcacccagcctccctttacaattcttaaattttttttagtcttgttactcttgttagggcttccccactatgttaaatagtattgattttttattttattttattttttgatacagagtcttactctgttacccaggctggaatacagtggcacaatctcagctcaacacaacctccacctcccggattcaagcaattctcatcccttagccaaccgaatagctaggattgcaggcacacaccaccacacctggctaatttttgtatttttagtagagatggggtttcaccatgttggccaggctggtctcgaactcctgacctcaagtgatccaccagcctcggcctcccaaagtgctgggattacaggtgcaagccattacgcctggcctgattattattattttatttttattttttatttatttatttttgtttttgtttttgtttttttttgaaacgaactcgttctgtcacccaggctggagttcagtggcccgatctcggctcactgcaagctccacctcccgagttcatgccattctcctgcctcagcctcccgagtagctgggactacaggcacccgccaccacccccagctaatttttttttttgtatttttagtagagacaggttttcaccatgttagccaggatggtctcgatctcctgaccttgtgatctgcccgcctcggcctcccaaagcactgggattacaggcatgagtcaccatgcccagccctcattattatttttaatgggactgtgtatgttttctatttatttgtaattttactgtttccctttttccacattttctgcagttattgggtatgacttttataatcagaaaaacaatattttcacttgctttcttaaaaataaataatctcttagtgaaggcctgaggggtccttataggtgtaatatggatggccatggagctgctatggcttcaggctttatatatatgaggtattgctgtctattcacagtattctctgacctttaaatttatgtggcttaaaatctattttcaatgcataaacatttgtatatttttccaggtgaacaatgtactacctagatgtataataatttaaatttagtgtaaaatgagattttttacaacaaattatatatttccaaaaactttaaaatgtttaaactctacataggcatatggtggtctactatatataaaaggtttctgggaactatttaagaagataaaaatagagccactgacatgtatttgtactgtatctttgggaaaacaatttcagcgtaatatatacttgtaaaaagtgaattagtaaaactattctggccgggcacagtggctcacacctgtaatcccagcactttgggaggctgaagtagaaggattgcttgagcccaggggttcagaccagctgggccacatggtgagactccatttctacaaaaaatagaaaagttagtcaggcatagtggcacacacctgtagttctagctactcaggaggctgaagtgggaggattgcttgagcccaggagtacaaacaaaaacaaaaaaaactttattcctccaagtttaaaaagtgcagcttgcttacttgttgacaagctgctgaatatagaatgaacagtaatagagtctactgggttttaggttccagctaccatgaaaaactattaaggaactataaatagaaaagaaaaaatggactcataaagactttgttcatttccttctaaaatatccctagcttattaagtgtctccattaaggcttccgtacccactgacaatatttcttgattctctgtaaatgacactaagaaaattctagatgctatagctcttctatagtaactacatggaatagacagcttaagttaggaaattacattgccttttgagcacaccagcaatcctacctctgtgtgctttgaggaaactagtgtagcacctcctctttttgtacaactttaacatatgtttcaggtctcatgtcaaataccagatacaatttgtcaatttattgatcacattttgtaacatcagtaaaagtctaaataaaatcaaccagaagataataggctacaccaattgttaatgaacagaggtttatttggaaagattgttccaggattcagagccagctaacaatagctctaggaacccaatttattgtcgatgagagattctcaccttatgcctcgtcagctagaggacctaaagtctataacgtctcctaaagctgggaaaagcctgagaggcccaggttgatacgcctatgtgtaacaggatagagagaaggaaccaaagtaaaaaggcaacaacaactgcctcagcatatgagttcttgatttggaaaaacctgcactgatggttcttgttctctggtgtaatgcctcctatgcctgctctcttggctgtgttgaaaagcatacatacagagctgtgctcttcattttcaagatgatgtactgataaggaccacaagccagtggcactgggaaaaagggatcctaagagactttttcttattaaacatacattcaaagtcagttatttaatattttgctttttggactcttggtaagcccaaatcttgttctaaaaagagcagacttttttgttttgttttgttttgtttgagatagtgtctcactctctctcccattctggagtgcagtggagcgatatggctcactgcagccacaacctcccaggcttgggtgatcctcccacctcagcctcctgagtaagtagctgagactacatgtatgtaccaccacgcctggctaaatttttgaatttttttgtagggacggaattttgccatgttgcccaggctggtctcaaacttctgggctcaaatgatctgggtgcctcagcctccctaagtactgggattacaggcatgagccaccaggcctgacttgtttttgtttttttgttgttgttgttgcccaaactagagtacagtaggctcaatcacagctcactgcagcctcaacctcccacctcaagcagtccttccacctcagcctcccaagtagctgggattgcaggtgcatgccaccacgcccagctaattttttttttttttttatgtagagacgagtctccctgtgttgcccaggctggtttcctgggctcaaatgattctcccatctcagcctcccaaagtgctcagattagaggtgaggcatgagccacccaacctagccttttttttttttttttttttaatacctgcaagccacatttatctgctatagtgtttaccaaccacactctggggcctgaggctgtgtttcagtgaatgaaatattaaaaagtactttgtttacttgctgacacagtacagtatttgtatctattaatagcatattgttattgttggttttttttttcgaaaaacactttattggaataatatacttaaaatgcagggaacttttaaaaatagagtgaggccaggcatggtggctcacacctataatcccagcactttgggaggccgaggcaggcggatcacctgcagtcaggagttcaagaccagcctggccaacatggtgaaacccgtctctactgaaaatacaaaaactagctgggtatagtggtgcatacctgtaatctcagctactcaggaggctgaagcaggagaatcacttgaacgctggaggcggaggttgcagtgagccaagatcacaccagtactccagcctggatgacagaggagactctcaaaaacgataataataattataaaatagagggtgaaagaccaaacatcctatagaaaaataagcaaaagataaaaattaattcacagagagatttgttctttaaagatatataaaaagatgttcagcttcacttaataagagaaatccagattaaaattatactgaaatatttctaacccatcggactggcaaaaattcaaaagctggacagtgtactatattggtgaagttgtggggaaatgggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaaatctctaccaattgatgtataatgattaccaggagattttggtctctgactacaggagtctcgctctgtcacccaggttggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctcaggtgatccacccgcctcagcctcccaaagtgctgggattacaggcgtgagccatggcacccagcctccaagagatacttttaagtggaaaaaaagcaaagtgtaagagagcatatatagtgtattacctccttttgtgttaaaacaaaaaaaaaaagaaaagaaaaagaaagaaaaggaagaaaatgtacatacatctgcttacctttactaaaagaatacaggaagataaaccagaaaacagtgaaagtggttgcttaaagggatggtgaggaggacatggtaaagagagtcactcttctttgagcatatcttttatagaatttttacttttagaaacatgttaatgttctacatattttttaaatattaaatcaataaggatagaatgtaagaaatgggactaaaactgaaagcaaactgaaaaacatgaacccaactatttccaatcttttcttaagtaaaatgagctccccaaagggggtaaaaaagagaaccaatctaagttacatgctgaacacagtatttgactacaccagagaacagaaaattaaccctaaactctttttagtagatttggatttttttcttttaaagttagggatgaagtgacttggaaactattttagatgtattacaaaagtgagtaaacaaataaatttgttgatatttttgggagctaggttctcactataaaagaaggaacatacaaataatgggatgaggaaaggcaagaaagaaccctgtggagatggactagaattggaagtactggtgtcagctcaatttctaaaataggtctctgtacacatgtatacgtatacagttatggatgtaagtgtgtgtgtgtgcatgactatgtatacatgcatacttcccagctctgttcattaacatggtctagaagcaaagagcacagctgccacccagatcttggtctctaataccattctgtgctaaaaagaaccagttatcctcagataaatggctgattccagggcatagtagagcccagaacattatgccagaacataaagaagggatcaaaaataatgtgatggcatatccaatgacacgggagccaccagcctgaacggctcccactggcaaaaactggaatattttaaggaccaaattaattaagggctgtaagggattataaaccattgatttaaaaagaattgtgggccaagcatggtgtctcacacctgtaatcccagcactttgggaggctgaggtgggcggatcaccttaggttgggagtctgagaccagcccgtccaacatggtgaaaccctatctctactcaaaatacaaaaattagccaggcatggtggctcatgtagtcccagctgctacttgggagactgaggcaggagagtcacttgaactggggaggtggaggttgcagtgagctgagatcgtaccactgcactccagcctcggtgacagagcaagactccaccacacaaataaaataaaaataattgtgcattcttattgataataaatagattttaaaataataaatgggagaagaggtaggctcttgtttatggtagaatggtgagggctgactggtaaatgtgaaaatcatttcacagctgcagttggaaaatcatcacagtatgagttgcttcagttaaaaattatgagtggatactcaatctgggagggggttgggacttttgataaagaacagaatatttatgtgatttttttttttttttgagatggagtctctgtcgcctcggctggagtgcagtggcgtgatctcagctcactgcaacctctgcatcccggattcaagcgattctcctgcctcagtttcccaagtagctgggactacaggcacccgccaccatgcccagctaatttttgtatttttagtagagacagggtttcatcatattgaccaggctggtcttgaactcctgaccttgtgatccgcccccctcggcctcccaaagtgctgagattacaggcaggagccaccatggccagcctaatttgatttgaggatttgctcagtctgtcttccttccttctttccttccttccttccttccttccttccttccttccttccttccttcctctctctctctctggtctctttctttcttttttctttttttttgagatggagttttactcttgttgcccaggctggagtgcagtgacatgatctcggctcactgtgacctctgcctcctgagttcaagcagttctcctgcctcagcctcccaagtagctgggattacaagcaagtgccataacacctggcaaatttttgtatttttagtagagacgaggtttcaccatgttggccaggctggtctcaaactcctgacctcatgatctgcctgcctcggactcccaaagtgttgggattacacgtgtgagccaccgtgcctggcctatgtgatcttaaattgtctattcacaaactgcttgttagatgcaagggaaaaaataggtactatacaatggagaagtaggacaacaccttgatcaggtggtcagaattcctatcaccagtgcacagcagatggacatgatgtgcctctaaatgtgacactttgagaaggatccatcataatgtgtgtagtagtctgcctgggtgtgcatagtctgaacttaatcatgagaaaatattagacaaatccaaaattagaatcagtctattaaaaatgggaaaataaataagtaatgggataagcgcgtcagacacagtggctcacacctgtaatcccagcactttaggaggctgaggcgggtggattgcttgagtccaggagttcgagaccagcctgggcaacatgacaaaaccccatctactaaaagtacaaaaaaattagccaggcgttgtggtgtgcacctgtggtcccagctacccgggaggcagaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgaggtacctagaataggcaaatttatagagacaaaagtagagtagcagttaccaggggctagaagtaaagaggagtggggagttattgtttaatgggtacagagtttcttttggggtgatgaaaaacttctaaaaatgcatagaggtagtagttgcacattgtgaatgtacttaatgtcactgaattgtgcatttaaaatttgttaaaatagtaaattttatgttacgtatatttttcaaaataaaaaagtatcttggggatgtttacttccattataaaaggattccctacaattatttaaatataagctccctttgtttatttaaacaattttatacagctttcaagattcacatcagatactttttgaagattccacttataactgattatgtagtatctgtatttcattttagttggtttttaaaaatagattattgaaaaactgacattcaccttgggcaaaggtcttagcttttttcagcatccaggttctccacttgtcaaagcaaaagattcttcagaatacttcattcatcatctagttctcttagaaaaaggatgctggtggttttgcttcacaaaaatatttcataaacatgagctttttctttttctcacaatgatcataccaggcggaatgaagaaaacagatgttgcttataaggcgtctaatagacatgtttgcattgtaagctgatctgactctgaatttggcatctgctccattcactgtgtggactgagcattttcgcctcacagtttggcagaaaagttaatattgacttttgactgttacctgaaaacttggtgataaaatactcttactaaacctcttgagagagtgattttacagtctcagcaaatgtctttaaaatacatcattctattaaccattttaattttattctttggttgggaatacttatttgtttcatctaatacagagcattccccaaatctgactgggaaaagtctgtgtggtcagaatggtagaagaaggaggacataaatcacttataatgttctctacaggtcattataccacagcttctcaattaaccttcatccccctcaggctgcccagggcctcagggaaggcccagaagcctagctgcagcacagtttctcattattatctgctcttctgagtatttgagtgttaactgcagcagctcagcagctcaggtttcccctaaggggaaggtagcccagattcttctgctcttgacctgtcttatttgcaattatcctttttttcttttttcacagttttattgtggcataatagacatacaataaacggtatgaatctaaagtttacaattgtataactttggacatatgtgtacacccatgaaaccatcactatggacatatccactgctcccatggccttttctaatcatgccttcctgctccttctcatccccttttggattgtttccagtttggggctattacaaataaagctgctgtgaacattcatttacaagtctttgtgtggatatgtgctttcacctaccttgggtaaatacctagaaatagaacggatcatatgatatgcacatgtttagctttttaagactgacagatggtttgggaaagtggtcttagcattttacattcccacaattagtgtgtgagagttccagttgatcacacccttgccaacacttgttatagtcagtcttttcagttttagccattctgcgagtgtgcagtggtatctaattgtgattttaatttgcatttctttaatgaataatgatattgaacattttttcatttgcttatttggcatctatcttctttgctaaaatgttaaatacttttgcctactttgtgttgagttgtttcttgttattgaggtaccaagtatttaattgtgacaaagttcagattattttttcttctataaaagttgcattcttagccaagtgtggtaacttatacatgtaatcccagtgctttgggaggccaaggcgggcagattacttgagcccaagagttcaagaccaacctgagcatctctacaaaaaaatgcaagaattagaggaaagctgaggtgggagaagagcttcagcccagaaggtcgaggctgcagtgagccatgagtgtgccactgcactccagcctgggtgatagtgagacactgtctcaaaaataaataaatttttaaaaaagaaaagttcatactttttacctcttactaagtgatctttagcaaacccaagatcactaagattttcttctatgttttctcctcaagagttttaggattttattccttacatttatgtctgtgattcatttcaagtgaatttttgtagatagtgtaaggtaaaggttgaaatgcttttttttcacacaatttgttaaagtgtcctttcttgatgggattgtttgggcacctgtgtcaaaaatcagttggctatacagaagtaggtttatttctggactctgttcagttccattgatctatttgtctatatgctaataccatagtgtcttggttattatcattctataataaattttgaaatcaggtagtataaatcctctggctttgttcttctttttcaaagttgagtttttgctaacctaggtcctttgaatttccatataaattttagaagcagcttgtcagtttctataagaaaaatctgctagaatttttattagtattccaatgaattaatagaaaaattcctgcagaactgataatattgaatcttctgacctttgaacactttatgtctatttatttaggcttcttttatatttctcagcattgttttgtcattttcaatgtgcaggccctacacaacttctgtcagatttattctaaggtacttcaaatatttgaagtatgtgaagtaccttagaataaatatggataaatattcttaactttttaatcaatttttgtttttgagacagggtcctactctgttacccaggttggggtgcagtgatatgatcatagctaaccacagccgcaaccttccaggcttaagcaatcctctcacctcagcctcctgagtagctaggtctacaggcatgcaccaacatgcatggctaatttttgtattttttgtagagacaggatttcgccatgttgctcatgctggtctcaaactcctgagctcaagcaattcacccatcttggcctctcagagtgctgggattataggcatgagccacgatgcctggcttattcttagtaacttctaattgttcattgctcgtatgtataattatatatacacattaccagtatagataatttacttttgtatttttagtagagacggtgtttcaccatgttgattttgagaccctatcaacatatgcttccctggctgggtgtggtggctcacgcctgtaatcccagcactttgggaggccaaggcaggcggatcacctgaggtcaggagtttgagaacagcctggccaacatggtgaaaccccatctctactaaaaatacaaaaattagctgggcgtgatggaaggcacctgtaatcccagctactcgggagcctgaggcagaagaatggcttgaacctgggaggcagagattgcagtgggccaggatcatgccattgcactccagcctgggcaacaagagtggaactccacctcaaaaaaaaaaaaaaaaaggaagaccagattgacttgatggcaagttgttgtgtctcaacttgagctctttagaataaatattaggggaagctcatgatgtttgggaaaagatctcccgaccgggcacagtggctcaacacctgtaatcccaggccaaggcaggcagatcacgaggtcaggagtttaagaccagcctggccagcatggtgaaaccccatctctactgaaactacaagaattagctaggcatggtggtgcatgcctgtagtcccagctattcaggaggctgaggcaggagaattgcttgaacctgggaggcggaggttgcagtggccaagatgatgccactgtactccagcctgcgtgacagggcaagactccatctcggggaaaaaaaaaaaaaaaaagacctccctaacggtaacgcacaagactttctcttactgtcaaggctgaagaatgagacaggtgcttagatcatatattggtctgacccaatatgacatttctgctgctgttatacaatactcatgtgtttttttttgcctgtgttctaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataat

SEQ ID NO: 1516 - DNA, 532816 bp, Homo sapiens; identical to SEQ ID NO: 1515
  source 1..532816: mol_type = genomic DNA

SEQ ID NO: 1517 - DNA, 10681 bp, Homo sapiens
  source 1..10681: mol_type = genomic DNA
caagtttattccatcatactgattttttattttaacttcatataaatcacttttatattattttatttggtattttatcttcacagcttccaaaattatttatcatttatttaactgattgaaagtgagccagaagcaaatttgctgtcataaaagtttactaaaaatcaagagaaatggcttcgtagcaccattactgcaatgttacaattacatacgttgttattagaatcatttctaaagttataaatttatgaagctttgagactccatttcaatatatcagaaaaggaaatcatgttaataaaaaatcattagacgcaaaataatataaaatataaatgaatacatgaagtaacaatttttaactcttttacaaacttatgtacaataagattaaaataagacagttgtgcattcaagttttcctgtggatctgctcatcttcattgcaagggttgctaggtaataacggcacagggatatggttattctgaatatttttctcactgtcaaagacagttgttagggacaaatagacaccaaaagagacaaatagggatcccttattggctccttacattttgttggataaagcacaatttccttgcaatgcttccccatccttctctcccaaatattgttctctttctctctctctctcttttttttttttttttctgagacagagtcttgctcttgtcgcccaggctggagtgcaacggcacgatctcagcttactgcaacctccacctcctgggttcaagcgattctcctgcctcagcctcccaagtagctgggattacaggtgcctgctaccacgcctggctaatttttgcattttgagtacagacggggttttgccatgttggccaggctggtctcaaactcctgaccacaggtgatccgcccggctcggcctcccaaagtgctgggattacaggcgtgagccaccacgcccggccctctctctttcttttttttttttttttttttgagagacaggatcttgttatgttgcccaggctggccttgaacacctgtgttcaagccatcctccctcctcaacctcccaagcagctagaactatgagcgtgtgccacggttcgcagctttatcattctgttttgtcacaactctcttatatagttaatatacctttgggagaagcatcacacacatacaaaatgtagcaaaccttgacctgattggcatttctgagatgaagagacccacgagagccaatagattttcctctccccaacattcaagcaacttccttccaattgtttgctaattatgatatgtgaagtttgtgggtgtttctaaattagggacttccttaaaagagtttgcgtttccagaagatttgctacttcagacatcaacccattattagggtgtcttgttcacagtcctcctgcccattttaagatcctttattaaagtagcttgaaggtgaccatgcatggtctatacctccatccccacccataacaatcttcttttgtacaaacataaaaacatgcttctgctgattaaaacatacagcgcatgattggatattaatgctttggagagatggtttggggtcacaatcacccagatactctcattaggaggtcctatagatcatggcctgatggaagagtttgtgttacttgaaagtaaacgtcaagggaaaagaatagaaaaatctatcactaacaccactgttaactcaaatgaatcaaataataaaggatgttgatataaaaacatttgatcctctcaccatgctttttaggatctaccttctgctctcatcctacctaaaagtcatagaaaaacgttgacactttaggatgctcccaggtcctgcagttctgttattcccagtaggggacaatgttgcattcaaaactgcaccaattgcagcacgtccctggccagacctgtgttccttctctattttcaagacatagatctttttaaagagtcgtatataaatattttttctgtaaactctaagaaagtgagagttgaagaataaaaacagagaagacttgaaggactgttttttatccactgtcttcagcagagatatttcatcgtgtgtgacattcctggaagttgctatcaaagtcccaaagtacgaaatgcgtctcgtaagtcatcaacctcatacaggggctgtagagaaagagagaagcaaattgagtgaatggcttcaaaacgaggttgggggtcggtggggccggagagtcttctaaactgagtggatggctttgtaacatgttggaagaaagtaaattgggaaagagtttttttgggttttttgtttgtttgtttaaaaaaaaaaaaaaaaaaaaaaaaaaaggagaaaagaattctgaccaggaaggaaacgcaaccctggggagagacagaaatttaaagatgtgaaacaacaaaagaaagaaaagggagggaaaaggaaccttagcagagggctctgaatggtgaaacagcagaagaaaaagctgatgtggaggagaaataaagttttcatcagatgaaaactgagagtgattgaacaataagaaaatataagaaatatacgaaactccaaaaaagactgtagagaaagaaagaaaatttaaaaagcgaggaagccccttaccaaaaggatgcgccgaagctgtctggagagacgaactgaattttcatgcagcccttcccaggctttgaaagttctttcgtggttttctacaaaagtattccagcagtaaaaataatcttcaaaaaaaaaaaaaggaaaaaaaggcggggatatgggggtagaagacagttcaggttccaaatcgaggggaaagaagcaaccctggccccattttctcatttcctcggggccttgtctctgagccattcactcttttctctgcttctaatctttaatttcggctccagaggtgaaccagaatccccgcccacttcttcccctcgagcttccccactaactcattcattccgcatcgcaatcccgaatgcgggctgctgcactgcgcctgcgcggaaggccctttcgcacctttgaaggtcatgatggctatttgcaccccggcgcggtgcagccgccgcagcccctcgggctcagccttgcggtcctcacagaagtagaggcgcgcggtgaagatcctcagactgaggttggggttccctcgcagaaagtcggccacatgtcgggcacagtcgtagcaggggctccaggaggtgaaccaggtgacgcggtagcagcggccagggtctaggtcccagtccgagatgtagcggaggaagagcaattccacgtggcagccgttctggagagacagagaggaccacgctaaaattcactgacttttattgcggctctggtagccttagtcattgtctcctgcaatgatctttggggatgcttgcagctattgtccttgtgttacagagaggctaagcaacttgctcaaaagagcacaccagtaggtagagctgaacccttggcagcactagtcctgcagagtgaaggaaggctatgggtttttgtggaatgaggaagacgaagtgcgctgagttgggaggaagcagcatcacactacctcaccgaagatttaatttgtgtttatgaagttgctttttgcaccttttgagaaggaaaatggctagaagtgcctgttgatgtaacattgtggaaatatacctggaccactaggtggaggcaggacagtttatgaggaccatttgggaggatctgaaaaggggaaatagattttggtaaagcagacagatgggtattgtaagagaagtaataggcactgccatgagaagtaaatgaaagtgcttgataaaatcaaagccttctgaaatagaatgtgtcatgtcaccgaataggaaggagattgggatgtattcaatacaaatgtaggcaaagaaaattgcatggtaatataaccatcaaacaacgagccagacgatgaccttccaccccacggatgcttccctgagattccaccaagcccagacgtcacagcgtgttaggagagaggagatacccgtgggcagaagtttatgtaaacccatctggattttggtgaagaagtctcttggaaatgtaattctctcgggtagccgaaagatcaatttaattaatcatcagccgaggcttctctgagttttctggggatcaccatgttgaatgtattcactggcctacgacccatgtgagtaggagggaaaagaaatcatttggaagacagaattgagccaccgttaattttttcccaaattcttcttccttaattttcaaaaatgcttaagacacaatttgtttttcacatttaaaatttttgcttggacaagctgataatattctcccatataaaaatgcttttagcttaattaatctcaaaggcaattcagatgctgaggaaagctggtaaacagtttgggagcagttgttcttggcactgaaggaaggagtggtattagggtgcccagcattactggggaggaattaaatcacatattttgggccatgtctaatatgggtgcatggacatggaaaaagaaataaaaaaaaggatttgaggaatgtgatagagacacaaatgccaaaaaaggatggaagtaataccatcagcaggtggctctaaaagcactcacagttgaccattaaactgcttgcaaagccgactttaattgataccttattgcgaagataaccaaagtccagtgaaaaggatgtagcactgtcacgcctcttcactacgtagcacaggtaggtctcacgccgacccttagcccagcggacatttttgaattggtaaagaaacttcctccggttcatcaagaggctgtgggtgagaggagggagagaaaatgcaagagtacagtttataatctggtcactctggattttccttcagctttttaaggaagtcattacttgggctaaaccaaagaagatgctctgacttcctctgctggctgcctgagccctcctgagccctgctgagcctggaatccatcataaactccttttcctgcttatatttaaggccaattgagagatactcatcaaggaccccaaacccttacccacaagacagtcacctcctgccactgtcttctagatgctgatgacttgggattacaattaaatttgttcttcaacaagaaaacgaaacaaaaaataaaataaacttgttcctcagtcccataattgtatattcagatttcccctccagtctttacctaagtgtccaacttgtacctcaaactcaaaatgatcaaaacaatattcctcaactgccccctgtcctaaactgccactcctcccgactttgccacctcaggtaagcagcctagcagcctggaaccatccttgactcatttcttattcctcagtcctcatatttaattaatcatctaaatgtgttgattcaaaccccccaatatttcttgaatttgtaccttccctgtttgctcttctctgcttcggtccaagccctcatcttcttcctccttatctgttgtgctggccttttaaccggtctgtctgcctccagtccctccaaaataacattccccacactgtcaccaccatgatctcacaaaaaccaggtgcaccatgccattcccatgctgaagaccccctgatggttctcttctgcctgcagaataaactccaaactctttaatgtggtgtttaggccactttttacagttggatcttgatctaaatttctttttttaaatttttttttttttgttacggtctcactttgtcgcccaggctgaagtatactggcatgatcttggcttactgtagcctcaacctcccaggctcaggcagatctgccaggctccgcggatcctcctgcctcagcctcctgagtagctgggattacaggcgcccaccatcatgcccaggtaatgtttgtatttttaatagagacggggtttcaccatcttggccaggctggccttggactcctgacctcgggtgttctgcccgccttggcttcccaaagtgctgggattacaggcgtgagccactgcaccggcctattttttaatgtataagagcaatacctggctgggcgcagtggctcacacctgttttttaatgtataagagcaatacttggccgggcgcagtggcctacatctgtaatcccagcactttgggaggctgaggcaggtggatcctctgaggtcaggagtttgagaccagcctggccaacatggtgaaaccccatctctactaaaaatacaaacattagccgagtgtggtggtgggcgcctgtaatcccatctacccgggaggctgaggcgacagctttgcttgaacccaggaggtggaggttgcagtgagctatggtcatgccattccactccagcatgggcaacaagaccaaaactccatctcaaaaaaaaaaaaaaaaaaaaaaaaagaaagagtaatacttgatcattgtcaaacttgaatactatggaaaaatagaagagctctaaattttaaaatattaaagattttttaaatctcaaatatcatagtgtctaataataataattagacttagtgtctaatgacaatgactgttaagattcttgtgtttattcctctagtctttctacaggcacatatttacatgatttggattatactgattgcatgtgtgattttgtactctgctgcttttttaactagtcaaaatgatctaaatatcttgctatgttgttcccacataatgactgatttctcctcctctttgttttctggctcctagcacagtgtcttgcatatcataagcactaatttgaatagcatttgtggaaatactctggtaacccaagtttccttaaagaaatcaagagtccccattgcagctgcagacagcaacacaagctgtacagcatggttgatatgaaagcacaagtgatgcctggattttgtccctagtcttttccagaaatgcatttatccaatttgtggagctagtgctgtcacctaatggtacggggcagaagtgcagagaatttgcgaagtaaagggctcaggaatttgaataacgtttgctggcaagagaattgaaagttttcttacacattattttttcttacattgaggtataatttacatacagtaaactccacccatttaagatgcataattctacgaatatttttggatgtaaacaccccaaactgctaccacagtcaggatacagaacctgaatcaccaccctcaccccaccagagcttcttccctctttgcagtccttcccctccccacaggacaaccactgatttgctttctttttttcccatttttgtggagaatggagtttcactgtgttgcccaggctggtcttgaactcctgagttctagcaatcttcccacgtggcctctcaaagtgctgggattacaggtgtgagcctctatgcctgccctgatttgctttctgtaactataagttactttcattttctagaatttcgtatggcatacattatctcctccttcatgtctgactctttcatttagcgtcatgactttgggattcatccccaagtagcttctttgtactgcagggtggtattccattgcatggatatagcacattttgtttatttgttcacttgttgatggatatttggatagtctctactttggggttttgtgaataaaggtactatgaacattcacgtaccagtctttgtgtggatatacattgagaattgatattttaataatgtagtgcaggtgacagaccctgactttaaaagttaaataccaaaatatcagcctaactaagtagctcatctaggacaacagctctttgtagttgtttccatttatttttaatttttcttcttatttttttgaggcaaggtctggtcctgtcacccaggctggagtgcagtggcgcaagcactgctcagtgcagccttgacctcctgggctccaacgattctcctgcctcagccccctagtagctgggaccacaggcacatgccaccatgcccggctaatttttgttatagaaacagcgttttgccatgttgctcaggctggtcttgaactccagggctcaagcgatccacccacctcagcctcccagagtgctgggattacaggcgtgagccaccacacctggctgtctgtttcactttaaatgtctcccctcacgtacatgaagcttactggaaagcactttaaactttaggcagcaaactagatttattgccagtatacacattacataaggtaaaaattagccatattattttaaaatttaaaatgcatattttaatctaaatggatcctaggccagatgcagtggctcatgactgtatcccaacactttgggaggccaaggcaggaggattgcttgagcccaggagttcaagactgcagaaagctatgattgcaccactgcactccagcctgggtaacagggtgagattgtcttttaaaaaatcaaaaacataaaaaacataaaatgaatactaaaaaagatccaataataattagctttattttaaaaggataataatttttatggtaattaccatagtaccaaccaccattactattactatattagcatataataaccctttgtatatataagctcaacacataataggtgcttaataagtacagaagaaaagaaattctctctttgaggcccagtgttaaacagattaagcatcatctcttaccaataaatccctcttatattaacttaccctcctgggctgtgtagatgagaaaggcagaggaatctacatctttttacatgcaccttggttggcggggtgtgtgtttgtgtgtgtgtgtgtgtgtgtgtgtgtgtgtgtgtgtgtgtgtgtggagagagagagagccttatcataaggaagaaaaagtgtcctggaagtatagataagaaggatgtggcatagataaaggactttgggtggatttttgggtcctactctacatgaaaatacaataagcctacactgtttctgtcacatgttaccagtcagagtgaaatgaattgcgtgatcctgacctgctagttaactttgttgatccattacttcccttctctggttaggggcctgtttccagctccctgttctcgtcatttctgtcctgagtaggaaggactttaccgagggagtgtttcaggcttgcaggctgacagctgctctggacagctgtgctccctgaggcagaaccctagctgcatccccagccgtgcaaaccagaaacaagcgggttaaaaataatcctgaccaagtcattttgccatcactaatgagctctacagatactgtcctccttaatgataatatatttcccttctgtcctgttgaatttcatcttttctccttttctgtctttctctgaatttcaactgctgattttacctttgctttccattttactttgaacaagtatttccaatggacccttcacaaggacctatagctcagacttgttttcaaaatctcagtgtaaactgaggagacatttgacattgtctgacctcaagaaaattttctgaagaacattaaatcctccattaaaaatctttattctgtatattggatgtgatggctcatgtctataattccagcactttaggaggcccaggcaggaggatcgcttgggccaggacttagagaccagcctcggctgggctaagaccctgtctctacaaaaaaatatatttttaaaaaatctttattctgtaatgtaagttctttataaaggagttaaattgaggtaaagtataaggattaggtgttattctcatacatccatagtaatcataaatgtaggaatagaataagttctatgacaataacctatcaaaaactgcacataaagacattatgaggaccttaaccaaattcacacctaagaggtaagttaagctacgtctgaacaaatggaaagattagttaatagtaaaagtgccattaactgcctaacaattgggcctttaacattaaataacttgcttgaatgaatttgtctccttataatggacacaatcatagtgactttcaagcaattaatttagaatgcttggcatttctaaaattacaaattttcttactatagctaaattatttcagtaacgcctccctaggaaagtgtgtcttcaagttgttttactgttgaatatttacaaaattattacgaaaattagcactaccgtttttagtacagtactgctattaccttttcatgatttgagtctctaaagatttgctatgttaatattattaccataaattagtttcaaccatggtacaaatctcaggacgaatcagtacattgtacgcactacttcttttgccacatgaaaaagagggaaatcaagagaagtctgaaacagaaagaattgggctgacagcgtataagatctgaatagaagaaaaggagacagatcaaaaaatatatatgcatattgatcaagctgatcttatcagtcagacagttacatgagagaaagggatagctaccagtctcattactcagatttgctctgagaggaaggccagtgcaatcacccacgagaagactgcctctttacctgtccatagtggtgtccagagtgtcttcttgcctccctgcaagtctcaggccagaaaaatctcacttcaattaatgatggttctct

SEQ ID NO: 1518 - DNA, 28972 bp, Homo sapiens
  source 1..28972: mol_type = genomic DNA
acagggttatcgaggagaataaatgagataatgcatgcagaacctctcacacagctaagaatttaatatgttagactattattaattatgaaaacacataaagaattctgcatataatttcagaggtctatgatttctaggggatccttagcctggttccggatggtcagtaagacaactttcttcaatgcctacattttccctctgaattccatctgtgtttactaagcatctgctgtgtcctgggcagtccaacccacatgagtatcttggtcactagtgtcatcagcacctttgaggggtagggatcattcctattctactgatgaggtgagataacttgtccaaggtcgcatggtgaagtcgctgttgaaatctgtcttctgactcgttgctctgtcttcatctgaggaaagacttgtgaggcttctgaggaggctgctctccatcctgctgtgttctgtcagtgacactttgtgcacacaggagatcctaagacacataccctaggccctcagagccggcagtgacttcttcaaaatcagttccggcagcgctgagtgtccatggaaaagagctcttattcagagcagcccttcctgtgtgcagagctacgcaagtaattaaatcacttcagcaacaagatcaaggggacggataagtgttagagactgtgtttcagtcctgactgcctcttatgcatgacctcaggaatgccacttcacctctctgagtctggtttcctcacctataaaagtgaaggacagttctgactccacagggtgctgtgtgagggttacgtgaagtcgagggttacatgaagcctttgcataatacctggcacaacgtcagtcttccgggagtggtaggactagtctgcattcttggtttgcagattagatgaggaaacccaggcccaaagaagcaaacaaacaatagctcacccagtcttctctgtttattcttctcaactacaccatgctgctttgcaggttggtttgacaaacatttccccacaattagatgcatgatgaccaagggaggaaagaaaattttcacagggtatttaaaaagctcagggaacaaacagatcagtgcaaatcagtaaggctaacacctgaaaatgactctgcacaggtgaggaagtggagcagaagagggaggggctggttcagggaacaggatttaatatgtcagtgaagaccctgcctctctctgtaacaagatgcctaaagaagaatagtggtgcttccagcccagctccctcttgttttgggaacaacagtcatttctcagaaacctcacttgcaaaggcagcccttccaaaaacatgagagctttagtttggagaaattatttaagctcacttttgctggagaggaaatgaatttaaactaggacacacagagaagcaacaaagagtgttaaagaagcaactgaaaaggtagtcaaagatctggcttaaggattagaagcactggctttctagactatggacaagtgtccattcaacagttatccagcctggcaggaagcagatatctttctgtgtatatctggatccaactaacatttatccaatgtctgttgcatgccaggtactgagcaaaaaccttcttcctataaatttcatttaatgccattaaggccaagaaggtggcataaccaacttcctttttcagctgaggaaacaggagcacagtgaataactaactggctgggatttgtcctaggtcccctgaactccaagcacagtgctatctccactagaccaagctgccttgtctctgggctcaagagaagcctgcataggagctgaaggtcaagaggttgcaggcttatctcatatgcacatacttggacctccctaccacacagctgccagcgacaagaaagggcttcttttccttccagccaggtccagaattcaatgtcatttttctagcttagattatctaaaaaaaatgccacaacaggggatacaaattttaacatattttattgatttaggggccaaacaaggcagcatttggtcagttaagaaaggcacctcattgaaaataatacatcacagtgctgttgagtgatcccagtcacaggatttgagaatggaaaggacaatctttggatgacatagcttaggacacttgctcatttatttaaaagagtcccttcacacagtgcagataaaagaaggcaagagcataggattgtggcatgtgctgggtagctgtgagaggttactcatgaaagtaggtagcctagtaaattagtggtaagtcaggggaagggaatcagcctccctttccatttcattcccttccccctccccttgattccagtttgcttgatttgttgagccaccatccctatgaatacaccttacatctctttcaaatgtggagatggttttttgatcttacagtgtgtggaaccggagtcagtaatcaaagctccctgttccaagctatagacagacaggacaacaatttgatttcctgtactcttggtctggaacccatggggttctgagataaaagctgaggtcttagagcactggctttaaaaaatattttcaccagtccagagtaaatgaaaacccgattccttagaaataatattgtgtctatttctacccccaccctccaagcatggtgttttttaaaaaattaatttttcccttacactttaaaaactctcacctatgtataaaagaaactgccacactacaataacactgctgttgttccaagtattcctctgagcccctcaccagccctccctcaccatcctcaccctgaccacccttcccctctgcccagcacctaagagcagggatcacgccgcggggtgatgagcagtgttgcagtctcgcctggccttctgatactaggctgaaatagagaggaaacaagagagaacaaaatgggtttttaaaaaccaagtacatatcagaggaggctggcatgtaagccccagcaaccaaatgcattaaacactggacatttctgtgacaggtaaaagcagaacctgctgaggctgaggaactctggaattaaatgaagcaaaaacagaatcctaaccatactgagaagggtatatgcattccctatgaatcttccagttcttatgggcagcccaaatattacttgtacatgttgtatgcacacgtgaatctatgtggacggatgacaaatatttgggcaaggatcatgcacataaaattagcaaacattcaagaacctcaactttgaggccaagtgcttacaattgtccctagttaaaggggagctgattctaagattcatgatgccactgtcacccagagaaggatcccagaccaggcacacatagctgacagtttttgtttcactcctcttccttgcccattcccagaagtcatgtgcttcccagaaacacacaaagccagactgagtttccattaagagtgggtggagttggtttagagccaggaaaacaaggcaggacagaggcagcagacactcacttggaccaggcaaagagggaagcaaggtggccaggtactcatgcccagttgccatgtggacagcagataagacctctggtagtctcacagatggcaggagagctcaggtcaggaggctgggcactttagagtccactgaatcgagtcagcagcagattatgctgaggctggcgatattatttactggatctgccactgactttctaatggtttttccagaggctgccgtttttgtggtccttcatagcagtctgttacttcatctgtttgccacaaatcaaaccagagaccaaaagacagcagggaccttagaaaatgctcaatagttgggaagctaaggttatgaataaaagctggtaactgtcacaggtggtcttatttctgggtgatcttttcttggggaagtccatggctatagccatcataaaattaggggtgaagggttggatctagaaaggagagggtttgggcttaaaaagaacatatctgatttcagttttatgtcctggagagagactgggtttgaataaatactgatcaaaatgaatccaagaatagatcacacactgttttgttcacacttggaaacacaggcaaacattaaaaataaaagcaaataaacctaccctggtctctttttggggaagtagatttgactgctctcagatgatcagcctggatgttcagaagacaatctgaattcaaaaggacctttcacctggtttaattctctggcaacaattcagttttcaaacccaattcccaaataattgctattttcagcatcatgatgcagatcacaaaaatattccaatttggcctggctctttttatgacgatatcctctcccagtaatttctgtaacctgcaaagtaagtgcctttttccttccacctagggggaaaaaattaatgatccctgttcacacactgactcacgtgggttttcatcatgggttagaaaacaaaatggaattctctgtccataatgtgccatcaggaactgtgaccctgcctgacttcacatgatcctggacttctaatcagctgctggaaatggaagaaatactatgaggttctggaattgcggtccctggaagattacctgggttagttcattttggtcaaaaaataaaatcaaaagtatggttaaagaagtaaacagctgggctgggtgtagtggctcacgtctgtgatcctggcacttcaggaggccaaggtgggtggattgcttaagcctaggagttcaagaccagcctgggcaacttggcaaaatcctgtctctacaaaaaatacaaatatcagccaggtgttgtggcatgcacctgtagtcccagctgctcaggaggctgaggtgggataattgcttgagccccaggaggcagaggttgccgtgagccaagatcacgccactgcactccagccagggtggcagagcgaaaccttgtctcaaaacaacaacaaaaaagaagtaaacagctggtaaagcaacctagcctaaaacttacaaagtagcagagtgaacacatatgtgcatgcacacacacacacacacaacacacatacacacagatgagagtagcacacacgccaaagatacatcaagcaagtgcttttttaatcaatacatcaaatgatatttttgctagcctgaggaagcttctctttgcctgtcctatcattcccacccattgcctcacagggatggaaagaaattccttcttggacccaacattagataaacataaccaagtctttacatgtggctttggagaaggctgctaggatgcttgcgaacacgacatcgggggtctgggatgcatcgatggcggagtggatcccccgtttcctgtagtactctatgagtggggtggtttgagtgtggtaggcttgcaggcggattttcaaggccttttcattatcatctgatcgacggatcaagggttccccggtgatctgagaacaggaagacagcaatgaaaggctgggactgttagcaaggttttcttattccatgccagatgcagatttgagatgggaccattctgcccaggatgctgtctgttcccaaagcccatcagagacaaagacaggcaatccagaccctctccagtgaagaactttgctactcccaggagcagagcagctggtgaacagaagtcagagagtttgtcagaaacaccaactgtgaggaaaggggctcatgaggggaagataggcaatgactttctcatctttgtgctcaggcgattcagcttccaagataaacacttctagggtcaaaagtaaggaagtcaaaaaggcccctaagaccagaatacatcaaaatcaaagatacattagcaattgtaatcttagttgcttaaatatttagtgtatttactagagtgtcacccatcaacattctaaaagtggcaagtaaaataagaactttcaatggtagaattagcaactttgcaaaatgtgactaagttgccataacggctctggaacctgtatttatagaacctgaatgacctgatgaacttgtttcataggacaaaggtaaacccaggaaattcttactgttgcctgcatgctttaaaacaaaccatatagactctttatggcaaatggtgcagtgaccatgtatgaaaccccaggacacagtacagcagcaataactataaaaagaatatttttctggaggactggtcatcaaacttctcttcagtgccacactcttcccactctccaattgtaggcttttaagaaagcttctcctgattagctgatcacttaggtggccatgatgccagaaaaggggctgctcttgacagaagacaggtacaatctgggcactgcaaaaagctagcaccactggaagcaaccttgaggccaagcaataaaccacctgaggagacactgaatagatctgacacaggccatgtgatttacttgatagtgttatttttcatgactaagttagtaatattggtagaaataaaaggaagatggaaagaataaaggaaaaagaaaaacagtgaagaaaggggaaggaaagaaaaggaaattttttgtcctgagtttacatacgtcatctttcatgggctcttttggagggttgaactcctcgtggtaggaacggccactcttggggtgaatcagcctgaaagacagcaaatgaatatgagttaggttaactgacagtacgcgcctgcactccactctagggggctccagaatgacaagcagagatagggacgctggatgcaaggacccagcacccagcagaaaatccagctaaataactgggcttccaggagagcttatgccagcggcagagtatattttctattttgaccaaacattattatgagtatctggctgaagagcaaactgctggcataactacctaattcaggacttgagagaaggaactctggtgctggtctcacacagccatccattctgttcacccatttacttaacaaacattaataagtattccattcaagccttaagctgaattcagaagctacaaagcaatgagtaatgatccctgctcacaagtagtgcttagtgggagagacaaatgtggaaataaataacaaacgtgataatcctttaacagagatttgtacaaagtgctatgggggacagaggacaaagaaatgaactctattttctaacctagtttggttacaaaaccaggaaggtactaacaggaaaaataattcccatggatgcaaacactgccagataatggaacacatcttttcaatcacacagataaaagatagcctaacccttatggagcaatattcaagtaatcgggaaaaatgacttattaaacaagtcatggaatatagagctcaagaacaggcatttatttggcactgaatgtatagtgggcagctgcatctgtgctgagtccctacagacaacaagcccatgttcctgactgggaatggccacaccacaggagcctagaaacctaaggaaaggaggcaggccaagctctgctcagcagccaggccttgcttcacttctgtggtttctcaattctctgccaaccaagtgtttgtttgcttatttaactaatggttgcttttctcatgaaggtctattagactagagctccctaatatttttcaccatttggcaggcatagcaatatttgggccgggcccagcagcttatgcctgtgatcccaacactttgggaggctgaggggggcagatcacctgaggtcaggagttcgagaccagcctgaccaacgtggcgaaaccccgtttctactaaaaatatgaaaaatttagctgggtggcaggcacctgtaatcccagctacttgggaggctgaggcaggaggatcgcttgaacctgggggtggaggttgcagtgaaccgagatcataccactgcactccagcctgagtgacagagcaagactgtctcaaaaaaataaaataaataaaaattctattcaattctatttagactattgaagtagcacctctgtaaaatgtgctactttcttttttgttaatcacagcatattttggggggacaagatggtccatttggcataaagtggcactgggttatgggcaggagggaggtgacagtagagaaaataagctatagagtcatcccttggtatccatggggggattggttccaggagccccctctgtggataccaaaatccatagatgctcaagtccctgatataaaatggtacagcatttccatataacctatgcatatcctcctgtgtacttttatttttattttatttttgagacagagtctccctctgtcacccaggttggaatacagtggcgcggtctctgctcactgcaagctccgcctcctgggttcacgccattctcctgcctcagcctcccaagtagctgggactacaggcgcccaccaccaagcctggctaattttttgtatatttagtagaaacggggtttcaccgtgttagccaggatggtctcgatctcctgacctcgtgatccacctgcctcagccttccgaagtgctgggattacaggtgtgagccactgcgcctggtctatttattttattttttgagacatggtcttgctctgttgtccaggctggagtgcaatggcaatgaccatagttcactgtaaccacaaactactgggctcaagtgaccctcccgcctcagtctctggagtagctgactacaagcatgcgccaccatgcctggctaattcttttattttatttaattaatttattttattttattattattttttgagacagagtctcattctgttgcccaggctggagtgcagtgtcatggtctcggctcactgcaacctctgcctcccaggttcaagcaattctcctgcctcagcctcctgagtagctgggattacagatgcctgccaccacgcccggctaattttttgtatttttagtagagacggggtttcaccatgttggccaggctggtctcgaactcctgacctcgtgatccacccacctcggcctcccaaagtgttaggattacaggtgtgagccaccgcgcccggtctagttttttaattttttgtagagatgaggtctcactatgttgcccaggctggttgtcttgcatactttaaatcacctctagattatgtatacctaatacaatgtaaatgccatgtaaagaattgatatactgaattttaaaatttgtattattttttcttttcttcagctttcctgggttatatttattggtggttttgttctgaatatttttaatccacaaatgcttgaatccgtagatgagggaaccatggatatggaaggccaactggacagaggagtaaaggttcctgtgactgcagtcatgtactgtgaggttgcaccttccattatttgagtgcctggaaggattcctctgatgcattcattcagaaatggcatccactgggagacccagggaaaggagagagcaggctgctgggctcagctgcagcaactttgggaggggctaggggcatgagatacggaccaggatatttttttaccttctagagagcacagggcacatagcagccaggctgcaacaaatatgactcccacacactgctcttttgccattcacaaataccactttttaaaacaatacaaggctcattccacagaaggtaaatgaaagaaaccccactctccaagttctcaaaatgggattgctctcaagtaccaaccaaaatagctccatgagccactgagcgtggcttggaggtatcatcaggactgggaatctacaatcactgctaccgtgagtgtgatactttatttttatttttttgagatagggttttgctttgtcacccaggctggagtccagtggcctaatcatggctcagtgcagcctcgacctccctagctcaagcaggcctcccacctcagactcccaagtagctgggaccaccaccgcaggtgcacactgccacacctggctaactttttttttgctttatagtagagacgaggtcttgctatgttgctcaagctggtctgaaactcctggcctcaagtaatcctcctgtttaggtccctaccaaatgctgggatcacaggcatgaaccactgcgcccaacattcagtgcgacactttaaacacttgttttctcatccacaaaattgggatggtaccaggtattaagataataccggagagccaactggtaggataattaggatttgagagagccaatattgaataagttaaaaacaaaaaccacaaccaccaactattcatattcaagaaacagaacaatgactcaaaattactagaagtgaggtcagagctaattcagaagattgttacaatgggtccatatcatctcagacttgaaaaagatcctgtgtgaggtccggggtgcattccccagcatcttcaaacagccgacatctgtgaccaacctgggcaacagagtgagactctgtctcaaaaacaacaacaatgacaacaacaaaaaaaaacagaaaagaaaaagatccatattaaactgactggttcctgcctcattttcttctaaccatcaacattttggactacgaggcagaaagcaggcttccagggctaaccctgccactcatctgttgggtaaacttggaaaaacaccttcagcagtgacatgctctgtgaggacgggggtccttctctctgtgaggaagtcacactaaccacctacttccaaatggagggaatgaatcttctctctttcaccctttacagcaatcctgctgtttgttcttcagaatctctctgttctctcccacccaacctcagttagaaatctccaccacatcatgtggatcataaacaggctcctagatggtatccttatctgtttctccttgccgtaatttaccttgtacaccaggaccaagctaatgttcttagaatactgtttttgccacaatacccagtggctcaagactatctcatgagtcctgaactccgtcaagtctaccctctttggtttggcagatctccccagtaaagctcttctcaacagcattccttctaccttcctgccccccagaccactgggcagacacgtctgctactagcctcagcgaaagtccaacccataatcattccggcttctcctcccttctgggaaaggctctctgaaatactcttcatcgaggaagagtttaatgttatctctatcctaggcagcctttcttccctgtccccaggctttcttcttggacttcctactacactgaacagcccaagtttcatatatgactctctgaggtcagagatgggcatcactatatggttatcctagagcctctcgtggtcctctgctcccagggtctagtactgtgctatgcaggaagcaggtactcaggaagctgggcccatagaatcaaaggtctccagtatcacctgattctgctaatacgtgcttagtgcctaagagaccccaggcctagtgatgtctttactgttaaccctactgcttctcgacctacatcaactttgtctactctgtgcccagtggggatacaaagaaacagaagttcctgcattaaaggagcctatggaatagccggagacatgtaacctggacatttgaaaagaaaatgaatataaggtagagtccactgtatttcatatcgctttccaggataatagtgctaaccctgtgctgtctattcacatgtttgtctcttcttgaaggtatggactacaaacacatggaaaagatgttcaacctcattaggaaatcaaagtaataatgtctgaaataagaaaacattttttccctaatccaaaaatttacatgcattatgatggccatagtatcattttaacagtggctaactggaagaaacataaatgtacaacaataaggaaataagtaaacaatggttaacctactgtgaaatattacacagcaattaaaagtaatggtcatggatgtctggttcaagatggttggctgaccactttcctgagacaccattaaaatgacaaagacataaaaaagctacagcccacaataaagaagggaatggagggtccatttgcagttgaaagcttctgtcatacttctggaaggcacaaagcagatggcagtgattagtgaaacagggtagagacaactgtaggctaaagcagtgttggtctgtcagaacaaacgtgtccagaagcagaggcatttctgtgttcaatgctattacagagaaacaaacatgttaaaacacacacacacacacacacacacacacacacacacacacaaagtggctgtactatgagcaaattcttcctccattttctaaactttgtacagatggttatattatttttacaataaaaagtctacagcaaagtatggcaactccagctgaaatcagatttaaggagcactaaaatggaggagatacacatgtaaagacattaacatttcttaagcacctaatataggcaaggctttgaactatgcattttatgttacctaacacgtgaaatagcttctcaaagcaggtgttatcaacccccttctacatataaggaaacagcctcagagaggttaagaaatgtgcctagggtcacagttaaaaagtgacaagaggccaggcacagtggctcaagcctgtaatcccagcactttgggaggccaaggcaggtggattgcttgaggtcagaagtttgagaccagcatggccaacatggtgaagacctgtctctactaaaactacaaaaattagctgggcgtggtggtacatgcctgtagtccgagttactcgggaggctgagacaggagaattacttgaaccggggaggcagaggttgcagtgagccaagatcgcgccactgcactccagcctgggtgacagagtaagactctgtctcaaaaaaaaaaaagcaataagagccaggcacagtggctcaagcgtgtaatcctagcactttgggaggccgaggcaggcggatcacttgaggtcagttcaaaaccagccgggccaacatggtgaaactccatctctactaaaaatacaaaaaaattagccagccctggtggcagacacctataatcccagctacttgggaggttgaggtaggagaactgcttgaacccaggaagtggaggttgcagtgagccgagactgcgccactgcactccagcctgggcgacagagttagactcccatctaaaaaaaaaaagtgacaagaatgagatgctgtctgacttcaaatcccttgctcttctttccatatcccgatcccatctcaccacttcagcggatgtcaccaaataaaatcaatccatgttgaaatggcactaagcttcatggccgggattaggcaagagcaattctcagagtttgagaaagctctgagaagcatgaaaagggaccttcaagggacaaataccttcctgtgattcttcggatcagcagagagtctgggatgctgaattcaatcacagaatcaagcttctctttcctcttctccatgaggtcatcgagctgtaaaagaatgtgtggcccacctaagctaccagagcttggttagacccatctccttcaaaggaattaagaaagacaaaggacaagaatttggtttcatgcagtagtaatataaaaactaagctacccaccatttctgcctgcctcacagtccgagggaagccatccagaagaaaaccatttttgcacaagggggtctccaaattcttctcaatgagctccactaccatttcatcactcacctggaagttaggaacaaaatagccttgggtttaaatccattacctaggtgactgacattagcccaactccacagccaaaagtttgtgtatataaccttattactaaacagcaagttttcttggacccaaagaagcaaaaataaaagcaaacgtgaaatggctccatttggaagatccagtttcataattttatctctgtggttgccaaatacacactctcgtctcttgaaattctcctgtatcccaaaaatctgggtgagggaagacagattccattacttgttacttcaccaggagagctttgtatcttaggtcctgaaggtccctcctgccactagagtccagagtccaaactgtcagataacagcttatcagcaatcagtgatcctcaaggcacaggaaatgtgaggacaaatggctgacagaccacctgagagagtgccaggagagaatggggttgaccaaaacacaggcatcagctttccctgttccacagctgtcattaggctaacagtaacgtgactgatgtgtgtacttggttacacatctgggccatcctggacatgaggaaacagagaagttcactgaattggcaagattgggtcagaaccaaggaactgaagagccaagccaacactcttccctcacttttttttttttttttttttttttgagacagtctcattctgttgcccaggctggagtacagtggcacaatctcccctcactgcaacctccaccttccaggttcaggtgattcaagtgcctcagcctcccaaacagctgggactacaggcgcacacgaccatgcccagctaattttttgtatttttaatagagacggggtttcaccatgttggccaggctggtctcgaactggtgacctcaagtgatctgcctgtctcagcctcccaaagtgttagtattacaggagtgagccaccatgtccagccctaagccaatatacttctgagtctctctaaaaccccaataaggacttctcccagttttcagaaactggtttttctcttgggctgttatagaaagaaaagtctccagcctgtagtgaagcctgcccatcttggcagctaatgcttttatttcttggtgctaactgtgaacttggggacaaagtacacactctgcaactaagtgaaggttggagataagcaatctcattgccacatctcaattttttcttagtacagagtcttctgtcaaaactcaaagtccaaaatatctagctttctggtttgactcagagattcaattacatgaagggaaaactagatagaaatgggcaggcagaggtatcatttgatacagctacagaatctcaaagcctaacagaaggtaacttgaggattaaagcaaagtccagctccttccccaaccaacattctaagataaaaaaagaccagaagaccaagcacaaaatgacttctgaaggtgattctcagaggccaagttccagaataactcagttataattaatctagcaatctttgattagtgccagaaaataatagattgtatttgtccaatcaggtcaactggcctaaagaaggagaaaatgtggctgggcatggcagctcacacctgtaatcccagcacttagagaggctggggcaggaggactgctcctgggtttagctcagttcaaaaccagtgtgggcaacacagtgagactccatctctacaacaacaacaacaacaacaacaacaacaacaaaagtagcagggcatggaggtgtgtgcctgtaaccctagctactcatcaggccgaagtgggaggatcacttgagcccaggaggtcgaggctgtagtaagccatgattgcaccactgcacaccagcctgggtctcagaacaaaaaaaaagagagaaaatgcaattatcgtccccagataagaaggattacctttgtcacaactgcgaagtaattgctttgttacagaaacagcacacagagccataaagcaggttaaaaaacacttctgtgacttcctaaatcctctcttgaatacatctctgagttctggcctagggacagcagtttcatttctggctctaaaatttaggtatataacaaaacacaccagcacagaaaaacttcaagaatactatgaatgagtgccataaattcagaacaaacaaaataacttgcactctaaaaagtcttacaaggccaagtgcggtggctcacgcctgtaatcccagcactttgggaggccaaggagggtggatcacctgaggtcaggagtttgagaccagcctggccaacatggtgaaaccccatctctactaaaaacataaaaattagccaggcatggtggcaggtgcctgtaatcctagctactcgggaggctgaggtacaagaatcgcttgaacccaggaggtggaggttgcagtgagccaagactgcgccactgcactccagcctgggcgacagagcgagactttgtcaaaaaaaaaagaaaaaaaatttcctataatctgccagtttgttaaaacaccctctagcacatggttgttcaacagaattttgtttgatgatggaaagttctgtatcagcgttggctggtaaatacttgaaatatggctagtgcaactgaggaactgatttttacattaattaaattaatctaaatagccacctgtggctggtggctaccatattggacagtgcagatctagattctgaggaatatcaacactcattggtaccaccaaacctaccagtttcccagcatccatagttgccttcagcttttttcctagctctgagccagaagccaccatggccctcagcatgtccccagtagctaaatggcagacacagaagttttcagccaatctgggtgcctacagagaggaagacaaaaaccaagattcaattacattacaggctgtggagtcagactgcctaggtgtgaacctggccctgccacttactggctatgtaaacatgggcaaatgcctacttccttacctgtaatggggataaaagtaccttatattacattctaacatatactgattatagggttatggtaagaattacatgaaataatatatgtaaagcacttaaaacagtacaactagcacacaggaaggagtcataaatattaattatcactatttccactcaacacactagtgacacataagtttcagtttccccattataaatgggaagacttgctgggcatggtggctcacgcctataaccccagcactttgggaggctgaggtgggcggatcacgaggtcagaagttcgagaccagcctgaccaacatggggaaaccccgtctctactaaaaatacaaaaattagctgggtgtggtggcgcttgcctggaattgcagctactcaggaggctgaggtaggagaattatttgaatctggtaggcagaggctgcagtgagctgagattgcaccacagcactccagctccagcctgggtgacagtgagacttcgtctcaaaaaaaaaaaaaaaaaaaaaagagaataaaaatagtaccaacacttcacatggttgctgtgaggtttaaatgagatcatgtatataatgcacttggtacaacacctggcacataacatgtgctgaataaacatttgccaaagggatgaatgtacaattgtcatgtactacagctactgggtcagggaggcaactaggagcagtttgcccccaggcagaactgggttttcctccttccctgtcactaagtagctgtactatggtggccacctcacttttcagtttccttatctgtttaaaatgaaggcaaaaaaggctccatctcagaaggtagctgtgaggattagctgagatatatacaaagagcacttggcaaataataagcacttacatactagttttaggaggcattatagtgttttggtcaagagcacaggcttgagagttaaactgctggtttgcagactccaggtccactaaccattatgtaaaattgacttaagatgtcacttcacctttctaggtttcaaatttcctctaagtaaaatggagatggtaatagtatctgtatcactgggttgatgagaagattatacagaattcagtatatgcaggccctggcatatagtaagcgctcagtgggcactggctgttaccataacccctgtcctaatcctatattcattcatacaaaaagaaaacatttactaatgcctttcccaagaaccctgtcgggagcctgggaaacagatgaataaaaggcatagactatgtacttaaagagcttatatttggtgaattatacatgagaatgcagaattagaacaggaagagaccctagacagctcaacactggctttgcagtgggaaaaaaagaatgcagaatttacaaggaatataatcagttcaaggagctcaattttagctttttccgttcaattgttttataaactaagcaggtttagatcccgattccaacaaatcagttcactgggagttttcttttctttctttctttctttttttttgagacagagtctcactctatcacccaggctggagtgcagtggcacgatcacggctcactgcagccacgaactccctgggctcaggtgattctcctgcctcagcctcccagtagctgggattgcaggcacaagccacgtgcctggctaatttttatgtaattgggagttttcttaggtgcatgcttaggtgcacacaataaaaggtacatagatagggctggtttgtgattcatggaccaattcagttaaagcaaagaaatgacttcatagcaaaatggaatctagtgagaaggcattaaaaactgtacttggccgggtgcagtggctcacgcctgtaatcccagcactttgggaggccaaggcgggtggatcacaaggtcaggagattgagaccatcctggccaacatggtgaaaccccgtctctactaaaatataaaaaaattagccgggcatggtggcgcatgcctgtagtcccagctactcaggaggctgaggcaggggaatcgcttgaacccaggagttggaggttgcagtgagctgagactgcgccattgcactccagcctggagacagagcaagactccatctcacaaaaaaacagcaacaaaaaaaaactctgtactctgggttgggcgcagtggctcacacctgtaatcccagcactttgggaggccgaggcgggtggatcaccggaagtcaggagttcgagactagcctggccaacatggtgaaaccccatctctactaagaatacaaaaattagctgggcgtgctggcacgtgcctgtaatcccagctacttgggaggctgaggcaggagaattgcttgaacccagaaggtggaagttgcggcgagccgagatccagcccgggcgaagaagcaagactacgtctcaaacaaacaaacaaacccaaaaaaccaaaattctgtactttgcaaaatcagtgaatgtcaggagccctgacaatgaaaaaccaggctggcactgtggccgtacatctagagagtgctttctgccaatctttctcattgctgttgaaattaacctgggtaaacaatttggaggtcaggcttgctcaagtggaaaggctgaccaaaacaccacagagaagagctgttagcacagaacctgttctatttttatcactcccaaactgcaggactcttatgcactgttccaggtgattggattctacagctagatgaaagaacacacaccaatagggaagaaaactaattcctggctgggtatggtggctcacgcctgtaatcccagaactttgggaggctaaggcgggtggatcacgaggtcaggagttcaagacttcaagaccagcctggccaagatggtgaaaccccgtctctactaaaaatacaaaaattagccaggcgtggtggtgggtgcttgtaatcccagctactcaggaggctgtggcagagaactgcttgaacccgtgaggtggaggttgcagtgagcggagatcgcgccactgtactccagcctgggtgacagagcaagactcttgtctcaaaaaaaaaaaaaaaaagaaaaagaaaaaaagaaaacgaattccttcatttcctgctggctgcctgggagtcaatgtggtaggctgtaaagagcacgcatgggttttgaagtcagacagatttacacttgattcctagctaaggcactcagtagccgtgtgatcttgggctaagtacttaacttctcagagtgtcagtttcctcatcagtttaatggggataatgactacttcacagggttcttatgaggataaatgaaataaagtaccaaaaacatcagacacgcagcaggcattcaataaataaaaggcttccttccatggtctttcttctttgcattagtctttatttacaggctgcagaaacctaatgaaataactttattatagtcccctcacacttcaaacttatgctttagagcagccattcacagactctaaatcactggaggaatgctgttaaaatgcagattccggctgggcgcggtggctcacgcctgtaatcccagcactctaggaggccgaagcaggcggatcatctgaggtcgggagttcaagaccagcatgaccaacatggagaaaccccgtctctactgaaaatacaaaattagctgggcgtggtggcataatcccagttactagggaggcagaggcagaagaatcgcttaaaactgggaggcagaggttgtggtgagctgggattgagatcgtgccgctacactccagcctgggcaacaagagtgaaactccgtctcaagaaaaaaaaaaaaaaatgcagattctagttcaatagggtagggcctaagtacctgcattttaagcaagcttcccggcctggatgagtggctgggctctaaactacactttgaagagcaggggtctgaagcccacactcagtcatagtctgttgctgtcagccaaaaactgttgctgagcccaagaaacaggctcatcacctctatgaaaactctgtggggtggaggactctggggtaattatgggaatgctaaaaccactagagagacagcatggtgggctgagtggttctcaaatttcagtgtattatcaatcatctagggcatttcctaggcccacctttaaagtttatgattgagtggctctcaagcagcacctcaggttctgatgggtacagtatgtgaagccctgatgtagtggcagagactgggttttgtagtggtatagatctgggttaggaaacgggctctaccgtttattcactgtgtcatcctgaacaaattacattaccttttctaaggtctcgttttctttatccatagaacagaaaacagtgtctatctgctgaactgttgtggggatttaataagattacgtatgcaaagacatccagcatagggcctgacaactaggaaataaagggaaactatcagtcctagagatttggtttaatcccaaattcaccagtcttctcaccttgtaaccatcatcttcttcttatgtttttttagaaatgaggtcttgctatgttgcccagggtggagcacagtggcttcacaagtgttagcccactacacatcggcatgggaattttggcctgctctttttctgacctgggccgatttacctctccttaggcaacctagtggtctcctgctcctgggaggtcaccatattgatgttgaacttttttttttttttttttttttgagatagggtctcactctattgcccaggctggagtgcagtgacatgttcatagttcactgtggcctcaaactcccgggctcaagcaatcttcctgccttagtctcccaggtagctgggactcaggcatgcagtaccatgcccggctaattattgtattttttgtagagatggggtttcgtcatgttgcccaggctggtctccaactcctgagctcaagcgagctgcctacctcagcctctcaaagtgctggaattataggcacaagccacagtgcctggcctgatgctgaatttagtgcagacacctgatcagcatagcacactatagccccaaactcctgtgcccaagcaatcctcccaccacagcttccggagtagttgggactatgggcgcatatcactgtgcctggcacaattacctttgtgcctccagtctttgtcactcctgctgtcaatgttcctacacatgcagctagaatcatatcttaaaacactgttggatatgctacctaccctccaaaacatacacattccgaagccttcaacatctctgtggtacaatagaggaagagtccaaatatcttagcctggcactcagctgccctccacaatcaacttctaaaacctgccaagccctcccaacttacttccacaagtgccctgtgtttacgtcctgcaccactgcagacaaactgctcttacgcatggttcccaaatacgcggcataaatgcctctccaaggacctcaacacaagctcctcactccacaggaatgccctctctgctccaatattggtctaagccttttctgtagtatacttctgagtacatttctcccatcaaaagcctaactgggctggaagcagtggctcacatctgtaatcccagcactttgggaggatcacttgaggccaaaagtttgagaccagtccgggcaacacagcaagaccccatttctacatttttttttttaattagctgggcatggtggcaggtacttatagtccagctacttaggaggctgaggtgggaggaccatttgagcccaggagttcgaggcttcaatgaactatgaccgtgccattgcactccagcctgagtgacagagtgagaccctgtctcctaaaacaaaaacacctccccaactaccccttcttccgctgaggattcatattaacattagctaactttgagcatgtgcatcatgccaagcagttttccatgcattgttttacggtacttagtatgtataatacataataaacccatgaggtaggaactatttttaactgcattttacagatgaaactcaggggctaagttgcccaagatcacagagctagtaaaagaactggcaacaggccagattaccaagccctagctcttagccatgacactataaggctttaagacaaacaacccaaagagccttagtggctatcctcctggaagggagcacaaggaggatttcaaagtgctggcaatattctgtttcttgataatgggtgtaagctacacaaatctgttcacattgtaaaataaatcaagctgttcactttttctaggtatcttatagcttaagttgttttttttttaatcacagaaacctgtgtttgcatttcagatgtctcttaacttactgaggaaatcattaccaacctcactgggtggacaggaggatgaacaggagaacttcagcaaattgtagttcttgttctatccctgaactaacccaacattcaaagtcactcatctgatgcttcccacctggcaccctgcacttgtatgtatttttccattcatattcatttctgcctcttcatctagattacacagcaacaatgtaaattaatgactactcaagagtcagacagacatgagttcaaatcctacctttgctacttactacatgtgtgtcctgaggcaagataaagcctctgagctcagtttctctgtcagtaaaaaggacctatctcctagtgttataggattaaatcagatgatacatgtaaaatctttagcttgggggtctgtcacgtaactgagcaatgggtgactatgttgtaattattacaccctcctgacatgcacacggtaggagaaaaatctaacctggggcagtagatagcagcagaaagagcaggagctttggagtcattcagatgcaagctctgtaaattacttgctatgtagcctagagaacaagccattcaaacttcagtttctccaactgtaaaaggggaaataagagtgtgggtctcagagatgttgcaagtatcactgcaatgacataactgatgcatctgacccataagactgcctaagcgtgcctggcctcgaagaattgggcataagtttgacacatggaagaaatgaggaggggttggcaaaaaaaccaagaaacatacctttggttttgaccacaccgaaggagcatccaaccccaaaagggaggcaaggaaataaagttatttaaataaaataacaaacccaggtattatagatgttttaaaacattacattgatgcaaaagcgagtagttttgaaatatttaactactttagttaaaagtgaggagttttaaaaggaaacattatttcagtcatgcaacataaagcacataaaatactgagttacgcaggtataacaaagtatagcaggaagaaaacaaacattactgagcaggcactaggcactaaccccaggttagggattttacatgtaagattgcaaacatctgccagtgggagccaagcaggcaatgcaactgtatgaaatgagtcaaatgtaagcaatgggcagtgaagaggaccgtgcaggggacaggaagacacacagaccatccaaagcagcaatgccacacaactgcaagtgactgctgccacactggaatggaggcatcactgccaggtcttctggtttctcaagagaaactggagctctggatttttaagagaaattgcataaccgaaaacgctctgtggtcaacctactattttgaaagctgacaaagagaataaatcaagcatttatcctgacttttctataccaaccatatcacggggtaacgaaacagtagatgaggggaagtttctctttatagaaatatttcagctaataaatgaccagggaacaatataattagaataccaccatttcaccatccataacgaattactgaacctagacactgaacagcatgactataaacaccagagacaaggaaataccatgtgcctcctcagggagagcacagcacccaccacctgtgaagtagttgggccaaaaaattgaacctaaattgaattaagtatatactaattaagtataaaccaccaatttacaggaaatagagagggcagaggaagatgttaagtacaccaggggaatacaactgaaaattcccagagagtggtataatactcccaggaaaaataatccaatttctggggctggacatgatggctcacggctataatcccaacactttgggaggccaaggtgggcggatcatgaggtcaggagatcgagaccatcctggctaacacagtgaaaccccgtctctactaaagatacaaaaaattagccgggtgtggtggcaggcacctgtagtcccagctactcgggagactgaggcagaatggcgtgaatccgggaagcagagcttgcagtgagccaagatcacaccactgcactccagcctgggcaacagagcgagactctgtctcaaaaaaaaaaaaaagaaaagaaaaataatccaatttcttcggcaaaaccccaggaaaaaaagagaaggggaacttataaattaaaagaaaggatgggcacagtggcacatgcctgtagtcccagctacttgggtggctgagggaggagcccggtagttcaagaccagcctgagcaacatggcaggacccccatctttaaaacactagaaaagttagccaggcatggtggcatgcacctgtaatcccagctattcaggaagctgaggtgggaggactgaggctgccgtgagctatgattgggctactacactccagcttgggcaactgagcaagactttgtctgtaaaaaaataaataaataaaagaaacttaaaattatcacattggtaacacaaaagaaaatttgaataaaaattgttgattttttaaaggatattatgcttatgtttttaaaaattatcttttagcaatacatactaatattatttacaaatgaaatgttatgatgcctgggaggtgctttataataatttgtgaagggagaatggctagaggagcgaaggccaccagttaatggttggggctgggtaagggctcattatgccatcctgtcttcttttgtgtattcaaaattcttcataataaaaagttaaggtgtatgagatgtctctgcaggctaaatgttattgtaggctaccatttgtaaagtctgatttaagatcttttttttttgagacaaagtctcactctgttgcccaggctggggcgcaatggtgagatcccagctcactacaaactctgcctccaaggctcaagtgatcctcccacctcagcctcctgaatagctgggactacaggcacacaccaccatgcctggctaatttttgcatttttttgtagagatggggtttcgccatgttgcccaggcttgaacttttttttaaactccacaaaaatacatacaatcaccagtattcctattgttacaactctggaaagtgtacagaggttaaatgacttgtgtaaatcttatcctttcaactcccagctctaatcacatctcctctatttctacaaagccttctctgaccaactctcatcttcatgcacccttatcaatcaactcattagtataatgttcttctaaacttcctgaataaatcatgtcttacactgaaacatccaagttgaaggaggggaagggagatgtgttactaagataaaagggagtcaaaatttattgagtacctactatatagcaggctgtcatctaggttgtgggtgcttgatacacacacacacacacacacacacacacacacacacacatatatcataattttccagtatcattgtgaatgtttagttgatgagggcaagaactttatcagtcttgcccaatgctttatatccccaatgttaggtgctcatgaaatgctgaatgagcaaggtaggtattatccccatttttcaggtaagaacactgaggctcggaagttacatagctagctaaattataaaacccttgtcccagtactatactagtataggttgtccattccataattactgaaattattaacttcaatatgagttaagaaaaaaatctcagggcatagtggcttgtgcctataatccctgcactttgggaggtcaaggcaggatgatcgcctgtgtccaggagttcaataccagcctgggcaacatagcaagaccctgtctctacaaaaaattgtttaaaaattagctgggcatggtagcatgtgcctgtactcccagctacctgggagggtgaggtgggaggattgcttgagctcacaccactgcgctccaacctgggcaacagagtgagaccctgtctcaaaaaaaagaaaaagaaaaagaaaaacaatgaagcatttgagctactgtttatacttgatcactcacagcaaaagtctgcagagtctaagattaaacttccctaagctgcagattacccaataaatgagtgtggcagcaacaggaaagagatgtcaacaacgctgaggataaaggataaagggatcaggtacaggtaagctccaaagaagaatcatctcagtctgtggagagaaaagaaagctgtattttctgacttagtgcccaggtcacaggaatgaatggagtgttccagaacttctttctttatcacccacattaatctgtgacattcatccacttccactaaccccatcaagggccaagtaatgtgctaggtgccacaaggggtaccaagaatgagtaagatggtctgtttgccaagatttttaaaacttggcaagtgctaggaagagaaaagcgggcacagggcagtcctcagattccctttcatttgggagctcagacttccctctttgaagcctaacaacaggcaagagccagaggcttagggccccaggtgcaatgccagaccccaagcaagaaggggacatcaataatccaacctgcgggcttccaaatccgaaatgagatcatcgatcccaaccctaatctatggccccattatgtcccagatctagaaggggcccagatcccaagtgaggcccctgttgcctgctagggcagatggtaacttcagactctaactccatggttcctgaggtctcaggctcatgaaactcatttcactaatttgggaaagccacctgacctttctgggcctgttttttaacctgttgattgataaagttaaaatttcaagttccctataaacaacaacaaaataaaaaaaggaaaaaataaataaaaaccaaagggaaggaagatacaaacaaacaaaaataataaaaacaaaataaaaaaaaattcaagttccttttcatctaaaatcatttgcgtcatcccaagctgcttagccttcagtagcctcaggtcctaactccaagccaggtcccatgagcactcccaacccttattgtggacactactcaaaggttgcgactcatgggtctccaggctataaaccagttctacacattcacccccaactttcaaacagggagagccttaggtttcctcccatctcaattcaactggctcacacagcacatgtcacctctcactctgccccacgtgttggagatgcttctcctcccctccccctaagtcataaatcattatcaaaatctcccgacctccagtgcctggaatgtaaccctgattctggacaattcacctccaactcgcaggtaacctgggccataaagctaattgcctccattcagcctgtaatctagatgcctcggcccagggctcactctacccctcaaacctttccagtctctagacccttagtggaattaatcagccctcacattccctaacccaacacttcaacactgaatccctcgggcactccaatcctaactcagactgccccgacctccaatttggaccctctccgaaatgccccaccagaaccgagaccccggccagcgttccccgcaggccttagtccccggcccgctccgggcaggtccagggcttctagatctccggccgccttgaccttggagttcagcaggctccgccgccaagcccagtcctgccgctcacctgggtccctttaccggccccgggaggccccagcagcacggcccggatgcctttaggatactcgggttctgccgctggcacgctgggagccatgtccgccgaagtctctcactgccaccagttcgcacgcctcacaggtccagtgcttcccaggtcaacgcacgcacgccacgcac

SEQ ID NO: 1519 - DNA, 28972 bp, Homo sapiens; identical to SEQ ID NO: 1518
  source 1..28972: mol_type = genomic DNA

SEQ ID NO: 1520 - DNA, 25687 bp, Homo sapiens
  source 1..25687: mol_type = genomic DNA
ggggagctgattctaagattcatgatgccactgtcacccagagaaggatcccagaccaggcacacatagctgacagtttttgtttcactcctcttccttgcccattcccagaagtcatgtgcttcccagaaacacacaaagccagactgagtttccattaagagtgggtggagttggtttagagccaggaaaacaaggcaggacagaggcagcagacactcacttggaccaggcaaagagggaagcaaggtggccaggtactcatgcccagttgccatgtggacagcagataagacctctggtagtctcacagatggcaggagagctcaggtcaggaggctgggcactttagagtccactgaatcgagtcagcagcagattatgctgaggctggcgatattatttactggatctgccactgactttctaatggtttttccagaggctgccgtttttgtggtccttcatagcagtctgttacttcatctgtttgccacaaatcaaaccagagaccaaaagacagcagggaccttagaaaatgctcaatagttgggaagctaaggttatgaataaaagctggtaactgtcacaggtggtcttatttctgggtgatcttttcttggggaagtccatggctatagccatcataaaattaggggtgaagggttggatctagaaaggagagggtttgggcttaaaaagaacatatctgatttcagttttatgtcctggagagagactgggtttgaataaatactgatcaaaatgaatccaagaatagatcacacactgttttgttcacacttggaaacacaggcaaacattaaaaataaaagcaaataaacctaccctggtctctttttggggaagtagatttgactgctctcagatgatcagcctggatgttcagaagacaatctgaattcaaaaggacctttcacctggtttaattctctggcaacaattcagttttcaaacccaattcccaaataattgctattttcagcatcatgatgcagatcacaaaaatattccaatttggcctggctctttttatgacgatatcctctcccagtaatttctgtaacctgcaaagtaagtgcctttttccttccacctagggggaaaaaattaatgatccctgttcacacactgactcacgtgggttttcatcatgggttagaaaacaaaatggaattctctgtccataatgtgccatcaggaactgtgaccctgcctgacttcacatgatcctggacttctaatcagctgctggaaatggaagaaatactatgaggttctggaattgcggtccctggaagattacctgggttagttcattttggtcaaaaaataaaatcaaaagtatggttaaagaagtaaacagctgggctgggtgtagtggctcacgtctgtgatcctggcacttcaggaggccaaggtgggtggattgcttaagcctaggagttcaagaccagcctgggcaacttggcaaaatcctgtctctacaaaaaatacaaatatcagccaggtgttgtggcatgcacctgtagtcccagctgctcaggaggctgaggtgggataattgcttgagccccaggaggcagaggttgccgtgagccaagatcacgccactgcactccagccagggtggcagagcgaaaccttgtctcaaaacaacaacaaaaaagaagtaaacagctggtaaagcaacctagcctaaaacttacaaagtagcagagtgaacacatatgtgcatgcacacacacacacacacaacacacatacacacagatgagagtagcacacacgccaaagatacatcaagcaagtgcttttttaatcaatacatcaaatgatatttttgctagcctgaggaagcttctctttgcctgtcctatcattcccacccattgcctcacagggatggaaagaaattccttcttggacccaacattagataaacataaccaagtctttacatgtggctttggagaaggctgctaggatgcttgcgaacacgacatcgggggtctgggatgcatcgatggcggagtggatcccccgtttcctgtagtactctatgagtggggtggtttgagtgtggtaggcttgcaggcggattttcaaggccttttcattatcatctgatcgacggatcaagggttccccggtgatctgagaacaggaagacagcaatgaaaggctgggactgttagcaaggttttcttattccatgccagatgcagatttgagatgggaccattctgcccaggatgctgtctgttcccaaagcccatcagagacaaagacaggcaatccagaccctctccagtgaagaactttgctactcccaggagcagagcagctggtgaacagaagtcagagagtttgtcagaaacaccaactgtgaggaaaggggctcatgaggggaagataggcaatgactttctcatctttgtgctcaggcgattcagcttccaagataaacacttctagggtcaaaagtaaggaagtcaaaaaggcccctaagaccagaatacatcaaaatcaaagatacattagcaattgtaatcttagttgcttaaatatttagtgtatttactagagtgtcacccatcaacattctaaaagtggcaagtaaaataagaactttcaatggtagaattagcaactttgcaaaatgtgactaagttgccataacggctctggaacctgtatttatagaacctgaatgacctgatgaacttgtttcataggacaaaggtaaacccaggaaattcttactgttgcctgcatgctttaaaacaaaccatatagactctttatggcaaatggtgcagtgaccatgtatgaaaccccaggacacagtacagcagcaataactataaaaagaatatttttctggaggactggtcatcaaacttctcttcagtgccacactcttcccactctccaattgtaggcttttaagaaagcttctcctgattagctgatcacttaggtggccatgatgccagaaaaggggctgctcttgacagaagacaggtacaatctgggcactgcaaaaagctagcaccactggaagcaaccttgaggccaagcaataaaccacctgaggagacactgaatagatctgacacaggccatgtgatttacttgatagtgttatttttcatgactaagttagtaatattggtagaaataaaaggaagatggaaagaataaaggaaaaagaaaaacagtgaagaaaggggaaggaaagaaaaggaaattttttgtcctgagtttacatacgtcatctttcatgggctcttttggagggttgaactcctcgtggtaggaacggccactcttggggtgaatcagcctgaaagacagcaaatgaatatgagttaggttaactgacagtacgcgcctgcactccactctagggggctccagaatgacaagcagagatagggacgctggatgcaaggacccagcacccagcagaaaatccagctaaataactgggcttccaggagagcttatgccagcggcagagtatattttctattttgaccaaacattattatgagtatctggctgaagagcaaactgctggcataactacctaattcaggacttgagagaaggaactctggtgctggtctcacacagccatccattctgttcacccatttacttaacaaacattaataagtattccattcaagccttaagctgaattcagaagctacaaagcaatgagtaatgatccctgctcacaagtagtgcttagtgggagagacaaatgtggaaataaataacaaacgtgataatcctttaacagagatttgtacaaagtgctatgggggacagaggacaaagaaatgaactctattttctaacctagtttggttacaaaaccaggaaggtactaacaggaaaaataattcccatggatgcaaacactgccagataatggaacacatcttttcaatcacacagataaaagatagcctaacccttatggagcaatattcaagtaatcgggaaaaatgacttattaaacaagtcatggaatatagagctcaagaacaggcatttatttggcactgaatgtatagtgggcagctgcatctgtgctgagtccctacagacaacaagcccatgttcctgactgggaatggccacaccacaggagcctagaaacctaaggaaaggaggcaggccaagctctgctcagcagccaggccttgcttcacttctgtggtttctcaattctctgccaaccaagtgtttgtttgcttatttaactaatggttgcttttctcatgaaggtctattagactagagctccctaatatttttcaccatttggcaggcatagcaatatttgggccgggcccagcagcttatgcctgtgatcccaacactttgggaggctgaggggggcagatcacctgaggtcaggagttcgagaccagcctgaccaacgtggcgaaaccccgtttctactaaaaatatgaaaaatttagctgggtggcaggcacctgtaatcccagctacttgggaggctgaggcaggaggatcgcttgaacctgggggtggaggttgcagtgaaccgagatcataccactgcactccagcctgagtgacagagcaagactgtctcaaaaaaataaaataaataaaaattctattcaattctatttagactattgaagtagcacctctgtaaaatgtgctactttcttttttgttaatcacagcatattttggggggacaagatggtccatttggcataaagtggcactgggttatgggcaggagggaggtgacagtagagaaaataagctatagagtcatcccttggtatccatggggggattggttccaggagccccctctgtggataccaaaatccatagatgctcaagtccctgatataaaatggtacagcatttccatataacctatgcatatcctcctgtgtacttttatttttattttatttttgagacagagtctccctctgtcacccaggttggaatacagtggcgcggtctctgctcactgcaagctccgcctcctgggttcacgccattctcctgcctcagcctcccaagtagctgggactacaggcgcccaccaccaagcctggctaattttttgtatatttagtagaaacggggtttcaccgtgttagccaggatggtctcgatctcctgacctcgtgatccacctgcctcagccttccgaagtgctgggattacaggtgtgagccactgcgcctggtctatttattttattttttgagacatggtcttgctctgttgtccaggctggagtgcaatggcaatgaccatagttcactgtaaccacaaactactgggctcaagtgaccctcccgcctcagtctctggagtagctgactacaagcatgcgccaccatgcctggctaattcttttattttatttaattaatttattttattttattattattttttgagacagagtctcattctgttgcccaggctggagtgcagtgtcatggtctcggctcactgcaacctctgcctcccaggttcaagcaattctcctgcctcagcctcctgagtagctgggattacagatgcctgccaccacgcccggctaattttttgtatttttagtagagacggggtttcaccatgttggccaggctggtctcgaactcctgacctcgtgatccacccacctcggcctcccaaagtgttaggattacaggtgtgagccaccgcgcccggtctagttttttaattttttgtagagatgaggtctcactatgttgcccaggctggttgtcttgcatactttaaatcacctctagattatgtatacctaatacaatgtaaatgccatgtaaagaattgatatactgaattttaaaatttgtattattttttcttttcttcagctttcctgggttatatttattggtggttttgttctgaatatttttaatccacaaatgcttgaatccgtagatgagggaaccatggatatggaaggccaactggacagaggagtaaaggttcctgtgactgcagtcatgtactgtgaggttgcaccttccattatttgagtgcctggaaggattcctctgatgcattcattcagaaatggcatccactgggagacccagggaaaggagagagcaggctgctgggctcagctgcagcaactttgggaggggctaggggcatgagatacggaccaggatatttttttaccttctagagagcacagggcacatagcagccaggctgcaacaaatatgactcccacacactgctcttttgccattcacaaataccactttttaaaacaatacaaggctcattccacagaaggtaaatgaaagaaaccccactctccaagttctcaaaatgggattgctctcaagtaccaaccaaaatagctccatgagccactgagcgtggcttggaggtatcatcaggactgggaatctacaatcactgctaccgtgagtgtgatactttatttttatttttttgagatagggttttgctttgtcacccaggctggagtccagtggcctaatcatggctcagtgcagcctcgacctccctagctcaagcaggcctcccacctcagactcccaagtagctgggaccaccaccgcaggtgcacactgccacacctggctaactttttttttgctttatagtagagacgaggtcttgctatgttgctcaagctggtctgaaactcctggcctcaagtaatcctcctgtttaggtccctaccaaatgctgggatcacaggcatgaaccactgcgcccaacattcagtgcgacactttaaacacttgttttctcatccacaaaattgggatggtaccaggtattaagataataccggagagccaactggtaggataattaggatttgagagagccaatattgaataagttaaaaacaaaaaccacaaccaccaactattcatattcaagaaacagaacaatgactcaaaattactagaagtgaggtcagagctaattcagaagattgttacaatgggtccatatcatctcagacttgaaaaagatcctgtgtgaggtccggggtgcattccccagcatcttcaaacagccgacatctgtgaccaacctgggcaacagagtgagactctgtctcaaaaacaacaacaatgacaacaacaaaaaaaaacagaaaagaaaaagatccatattaaactgactggttcctgcctcattttcttctaaccatcaacattttggactacgaggcagaaagcaggcttccagggctaaccctgccactcatctgttgggtaaacttggaaaaacaccttcagcagtgacatgctctgtgaggacgggggtccttctctctgtgaggaagtcacactaaccacctacttccaaatggagggaatgaatcttctctctttcaccctttacagcaatcctgctgtttgttcttcagaatctctctgttctctcccacccaacctcagttagaaatctccaccacatcatgtggatcataaacaggctcctagatggtatccttatctgtttctccttgccgtaatttaccttgtacaccaggaccaagctaatgttcttagaatactgtttttgccacaatacccagtggctcaagactatctcatgagtcctgaactccgtcaagtctaccctctttggtttggcagatctccccagtaaagctcttctcaacagcattccttctaccttcctgccccccagaccactgggcagacacgtctgctactagcctcagcgaaagtccaacccataatcattccggcttctcctcccttctgggaaaggctctctgaaatactcttcatcgaggaagagtttaatgttatctctatcctaggcagcctttcttccctgtccccaggctttcttcttggacttcctactacactgaacagcccaagtttcatatatgactctctgaggtcagagatgggcatcactatatggttatcctagagcctctcgtggtcctctgctcccagggtctagtactgtgctatgcaggaagcaggtactcaggaagctgggcccatagaatcaaaggtctccagtatcacctgattctgctaatacgtgcttagtgcctaagagaccccaggcctagtgatgtctttactgttaaccctactgcttctcgacctacatcaactttgtctactctgtgcccagtggggatacaaagaaacagaagttcctgcattaaaggagcctatggaatagccggagacatgtaacctggacatttgaaaagaaaatgaatataaggtagagtccactgtatttcatatcgctttccaggataatagtgctaaccctgtgctgtctattcacatgtttgtctcttcttgaaggtatggactacaaacacatggaaaagatgttcaacctcattaggaaatcaaagtaataatgtctgaaataagaaaacattttttccctaatccaaaaatttacatgcattatgatggccatagtatcattttaacagtggctaactggaagaaacataaatgtacaacaataaggaaataagtaaacaatggttaacctactgtgaaatattacacagcaattaaaagtaatggtcatggatgtctggttcaagatggttggctgaccactttcctgagacaccattaaaatgacaaagacataaaaaagctacagcccacaataaagaagggaatggagggtccatttgcagttgaaagcttctgtcatacttctggaaggcacaaagcagatggcagtgattagtgaaacagggtagagacaactgtaggctaaagcagtgttggtctgtcagaacaaacgtgtccagaagcagaggcatttctgtgttcaatgctattacagagaaacaaacatgttaaaacacacacacacacacacacacacacacacacacacacacaaagtggctgtactatgagcaaattcttcctccattttctaaactttgtacagatggttatattatttttacaataaaaagtctacagcaaagtatggcaactccagctgaaatcagatttaaggagcactaaaatggaggagatacacatgtaaagacattaacatttcttaagcacctaatataggcaaggctttgaactatgcattttatgttacctaacacgtgaaatagcttctcaaagcaggtgttatcaacccccttctacatataaggaaacagcctcagagaggttaagaaatgtgcctagggtcacagttaaaaagtgacaagaggccaggcacagtggctcaagcctgtaatcccagcactttgggaggccaaggcaggtggattgcttgaggtcagaagtttgagaccagcatggccaacatggtgaagacctgtctctactaaaactacaaaaattagctgggcgtggtggtacatgcctgtagtccgagttactcgggaggctgagacaggagaattacttgaaccggggaggcagaggttgcagtgagccaagatcgcgccactgcactccagcctgggtgacagagtaagactctgtctcaaaaaaaaaaaagcaataagagccaggcacagtggctcaagcgtgtaatcctagcactttgggaggccgaggcaggcggatcacttgaggtcagttcaaaaccagccgggccaacatggtgaaactccatctctactaaaaatacaaaaaaattagccagccctggtggcagacacctataatcccagctacttgggaggttgaggtaggagaactgcttgaacccaggaagtggaggttgcagtgagccgagactgcgccactgcactccagcctgggcgacagagttagactcccatctaaaaaaaaaaagtgacaagaatgagatgctgtctgacttcaaatcccttgctcttctttccatatcccgatcccatctcaccacttcagcggatgtcaccaaataaaatcaatccatgttgaaatggcactaagcttcatggccgggattaggcaagagcaattctcagagtttgagaaagctctgagaagcatgaaaagggaccttcaagggacaaataccttcctgtgattcttcggatcagcagagagtctgggatgctgaattcaatcacagaatcaagcttctctttcctcttctccatgaggtcatcgagctgtaaaagaatgtgtggcccacctaagctaccagagcttggttagacccatctccttcaaaggaattaagaaagacaaaggacaagaatttggtttcatgcagtagtaatataaaaactaagctacccaccatttctgcctgcctcacagtccgagggaagccatccagaagaaaaccatttttgcacaagggggtctccaaattcttctcaatgagctccactaccatttcatcactcacctggaagttaggaacaaaatagccttgggtttaaatccattacctaggtgactgacattagcccaactccacagccaaaagtttgtgtatataaccttattactaaacagcaagttttcttggacccaaagaagcaaaaataaaagcaaacgtgaaatggctccatttggaagatccagtttcataattttatctctgtggttgccaaatacacactctcgtctcttgaaattctcctgtatcccaaaaatctgggtgagggaagacagattccattacttgttacttcaccaggagagctttgtatcttaggtcctgaaggtccctcctgccactagagtccagagtccaaactgtcagataacagcttatcagcaatcagtgatcctcaaggcacaggaaatgtgaggacaaatggctgacagaccacctgagagagtgccaggagagaatggggttgaccaaaacacaggcatcagctttccctgttccacagctgtcattaggctaacagtaacgtgactgatgtgtgtacttggttacacatctgggccatcctggacatgaggaaacagagaagttcactgaattggcaagattgggtcagaaccaaggaactgaagagccaagccaacactcttccctcacttttttttttttttttttttttttgagacagtctcattctgttgcccaggctggagtacagtggcacaatctcccctcactgcaacctccaccttccaggttcaggtgattcaagtgcctcagcctcccaaacagctgggactacaggcgcacacgaccatgcccagctaattttttgtatttttaatagagacggggtttcaccatgttggccaggctggtctcgaactggtgacctcaagtgatctgcctgtctcagcctcccaaagtgttagtattacaggagtgagccaccatgtccagccctaagccaatatacttctgagtctctctaaaaccccaataaggacttctcccagttttcagaaactggtttttctcttgggctgttatagaaagaaaagtctccagcctgtagtgaagcctgcccatcttggcagctaatgcttttatttcttggtgctaactgtgaacttggggacaaagtacacactctgcaactaagtgaaggttggagataagcaatctcattgccacatctcaattttttcttagtacagagtcttctgtcaaaactcaaagtccaaaatatctagctttctggtttgactcagagattcaattacatgaagggaaaactagatagaaatgggcaggcagaggtatcatttgatacagctacagaatctcaaagcctaacagaaggtaacttgaggattaaagcaaagtccagctccttccccaaccaacattctaagataaaaaaagaccagaagaccaagcacaaaatgacttctgaaggtgattctcagaggccaagttccagaataactcagttataattaatctagcaatctttgattagtgccagaaaataatagattgtatttgtccaatcaggtcaactggcctaaagaaggagaaaatgtggctgggcatggcagctcacacctgtaatcccagcacttagagaggctggggcaggaggactgctcctgggtttagctcagttcaaaaccagtgtgggcaacacagtgagactccatctctacaacaacaacaacaacaacaacaacaacaacaaaagtagcagggcatggaggtgtgtgcctgtaaccctagctactcatcaggccgaagtgggaggatcacttgagcccaggaggtcgaggctgtagtaagccatgattgcaccactgcacaccagcctgggtctcagaacaaaaaaaaagagagaaaatgcaattatcgtccccagataagaaggattacctttgtcacaactgcgaagtaattgctttgttacagaaacagcacacagagccataaagcaggttaaaaaacacttctgtgacttcctaaatcctctcttgaatacatctctgagttctggcctagggacagcagtttcatttctggctctaaaatttaggtatataacaaaacacaccagcacagaaaaacttcaagaatactatgaatgagtgccataaattcagaacaaacaaaataacttgcactctaaaaagtcttacaaggccaagtgcggtggctcacgcctgtaatcccagcactttgggaggccaaggagggtggatcacctgaggtcaggagtttgagaccagcctggccaacatggtgaaaccccatctctactaaaaacataaaaattagccaggcatggtggcaggtgcctgtaatcctagctactcgggaggctgaggtacaagaatcgcttgaacccaggaggtggaggttgcagtgagccaagactgcgccactgcactccagcctgggcgacagagcgagactttgtcaaaaaaaaaagaaaaaaaatttcctataatctgccagtttgttaaaacaccctctagcacatggttgttcaacagaattttgtttgatgatggaaagttctgtatcagcgttggctggtaaatacttgaaatatggctagtgcaactgaggaactgatttttacattaattaaattaatctaaatagccacctgtggctggtggctaccatattggacagtgcagatctagattctgaggaatatcaacactcattggtaccaccaaacctaccagtttcccagcatccatagttgccttcagcttttttcctagctctgagccagaagccaccatggccctcagcatgtccccagtagctaaatggcagacacagaagttttcagccaatctgggtgcctacagagaggaagacaaaaaccaagattcaattacattacaggctgtggagtcagactgcctaggtgtgaacctggccctgccacttactggctatgtaaacatgggcaaatgcctacttccttacctgtaatggggataaaagtaccttatattacattctaacatatactgattatagggttatggtaagaattacatgaaataatatatgtaaagcacttaaaacagtacaactagcacacaggaaggagtcataaatattaattatcactatttccactcaacacactagtgacacataagtttcagtttccccattataaatgggaagacttgctgggcatggtggctcacgcctataaccccagcactttgggaggctgaggtgggcggatcacgaggtcagaagttcgagaccagcctgaccaacatggggaaaccccgtctctactaaaaatacaaaaattagctgggtgtggtggcgcttgcctggaattgcagctactcaggaggctgaggtaggagaattatttgaatctggtaggcagaggctgcagtgagctgagattgcaccacagcactccagctccagcctgggtgacagtgagacttcgtctcaaaaaaaaaaaaaaaaaaaaaagagaataaaaatagtaccaacacttcacatggttgctgtgaggtttaaatgagatcatgtatataatgcacttggtacaacacctggcacataacatgtgctgaataaacatttgccaaagggatgaatgtacaattgtcatgtactacagctactgggtcagggaggcaactaggagcagtttgcccccaggcagaactgggttttcctccttccctgtcactaagtagctgtactatggtggccacctcacttttcagtttccttatctgtttaaaatgaaggcaaaaaaggctccatctcagaaggtagctgtgaggattagctgagatatatacaaagagcacttggcaaataataagcacttacatactagttttaggaggcattatagtgttttggtcaagagcacaggcttgagagttaaactgctggtttgcagactccaggtccactaaccattatgtaaaattgacttaagatgtcacttcacctttctaggtttcaaatttcctctaagtaaaatggagatggtaatagtatctgtatcactgggttgatgagaagattatacagaattcagtatatgcaggccctggcatatagtaagcgctcagtgggcactggctgttaccataacccctgtcctaatcctatattcattcatacaaaaagaaaacatttactaatgcctttcccaagaaccctgtcgggagcctgggaaacagatgaataaaaggcatagactatgtacttaaagagcttatatttggtgaattatacatgagaatgcagaattagaacaggaagagaccctagacagctcaacactggctttgcagtgggaaaaaaagaatgcagaatttacaaggaatataatcagttcaaggagctcaattttagctttttccgttcaattgttttataaactaagcaggtttagatcccgattccaacaaatcagttcactgggagttttcttttctttctttctttctttttttttgagacagagtctcactctatcacccaggctggagtgcagtggcacgatcacggctcactgcagccacgaactccctgggctcaggtgattctcctgcctcagcctcccagtagctgggattgcaggcacaagccacgtgcctggctaatttttatgtaattgggagttttcttaggtgcatgcttaggtgcacacaataaaaggtacatagatagggctggtttgtgattcatggaccaattcagttaaagcaaagaaatgacttcatagcaaaatggaatctagtgagaaggcattaaaaactgtacttggccgggtgcagtggctcacgcctgtaatcccagcactttgggaggccaaggcgggtggatcacaaggtcaggagattgagaccatcctggccaacatggtgaaaccccgtctctactaaaatataaaaaaattagccgggcatggtggcgcatgcctgtagtcccagctactcaggaggctgaggcaggggaatcgcttgaacccaggagttggaggttgcagtgagctgagactgcgccattgcactccagcctggagacagagcaagactccatctcacaaaaaaacagcaacaaaaaaaaactctgtactctgggttgggcgcagtggctcacacctgtaatcccagcactttgggaggccgaggcgggtggatcaccggaagtcaggagttcgagactagcctggccaacatggtgaaaccccatctctactaagaatacaaaaattagctgggcgtgctggcacgtgcctgtaatcccagctacttgggaggctgaggcaggagaattgcttgaacccagaaggtggaagttgcggcgagccgagatccagcccgggcgaagaagcaagactacgtctcaaacaaacaaacaaacccaaaaaaccaaaattctgtactttgcaaaatcagtgaatgtcaggagccctgacaatgaaaaaccaggctggcactgtggccgtacatctagagagtgctttctgccaatctttctcattgctgttgaaattaacctgggtaaacaatttggaggtcaggcttgctcaagtggaaaggctgaccaaaacaccacagagaagagctgttagcacagaacctgttctatttttatcactcccaaactgcaggactcttatgcactgttccaggtgattggattctacagctagatgaaagaacacacaccaatagggaagaaaactaattcctggctgggtatggtggctcacgcctgtaatcccagaactttgggaggctaaggcgggtggatcacgaggtcaggagttcaagacttcaagaccagcctggccaagatggtgaaaccccgtctctactaaaaatacaaaaattagccaggcgtggtggtgggtgcttgtaatcccagctactcaggaggctgtggcagagaactgcttgaacccgtgaggtggaggttgcagtgagcggagatcgcgccactgtactccagcctgggtgacagagcaagactcttgtctcaaaaaaaaaaaaaaaaagaaaaagaaaaaaagaaaacgaattccttcatttcctgctggctgcctgggagtcaatgtggtaggctgtaaagagcacgcatgggttttgaagtcagacagatttacacttgattcctagctaaggcactcagtagccgtgtgatcttgggctaagtacttaacttctcagagtgtcagtttcctcatcagtttaatggggataatgactacttcacagggttcttatgaggataaatgaaataaagtaccaaaaacatcagacacgcagcaggcattcaataaataaaaggcttccttccatggtctttcttctttgcattagtctttatttacaggctgcagaaacctaatgaaataactttattatagtcccctcacacttcaaacttatgctttagagcagccattcacagactctaaatcactggaggaatgctgttaaaatgcagattccggctgggcgcggtggctcacgcctgtaatcccagcactctaggaggccgaagcaggcggatcatctgaggtcgggagttcaagaccagcatgaccaacatggagaaaccccgtctctactgaaaatacaaaattagctgggcgtggtggcataatcccagttactagggaggcagaggcagaagaatcgcttaaaactgggaggcagaggttgtggtgagctgggattgagatcgtgccgctacactccagcctgggcaacaagagtgaaactccgtctcaagaaaaaaaaaaaaaaatgcagattctagttcaatagggtagggcctaagtacctgcattttaagcaagcttcccggcctggatgagtggctgggctctaaactacactttgaagagcaggggtctgaagcccacactcagtcatagtctgttgctgtcagccaaaaactgttgctgagcccaagaaacaggctcatcacctctatgaaaactctgtggggtggaggactctggggtaattatgggaatgctaaaaccactagagagacagcatggtgggctgagtggttctcaaatttcagtgtattatcaatcatctagggcatttcctaggcccacctttaaagtttatgattgagtggctctcaagcagcacctcaggttctgatgggtacagtatgtgaagccctgatgtagtggcagagactgggttttgtagtggtatagatctgggttaggaaacgggctctaccgtttattcactgtgtcatcctgaacaaattacattaccttttctaaggtctcgttttctttatccatagaacagaaaacagtgtctatctgctgaactgttgtggggatttaataagattacgtatgcaaagacatccagcatagggcctgacaactaggaaataaagggaaactatcagtcctagagatttggtttaatcccaaattcaccagtcttctcaccttgtaaccatcatcttcttcttatgtttttttagaaatgaggtcttgctatgttgcccagggtggagcacagtggcttcacaagtgttagcccactacacatcggcatgggaattttggcctgctctttttctgacctgggccgatttacctctccttaggcaacctagtggtctcctgctcctgggaggtcaccatattgatgttgaacttttttttttttttttttttttgagatagggtctcactctattgcccaggctggagtgcagtgacatgttcatagttcactgtggcctcaaactcccgggctcaagcaatcttcctgccttagtctcccaggtagctgggactcaggcatgcagtaccatgcccggctaattattgtattttttgtagagatggggtttcgtcatgttgcccaggctggtctccaactcctgagctcaagcgagctgcctacctcagcctctcaaagtgctggaattataggcacaagccacagtgcctggcctgatgctgaatttagtgcagacacctgatcagcatagcacactatagccccaaactcctgtgcccaagcaatcctcccaccacagcttccggagtagttgggactatgggcgcatatcactgtgcctggcacaattacctttgtgcctccagtctttgtcactcctgctgtcaatgttcctacacatgcagctagaatcatatcttaaaacactgttggatatgctacctaccctccaaaacatacacattccgaagccttcaacatctctgtggtacaatagaggaagagtccaaatatcttagcctggcactcagctgccctccacaatcaacttctaaaacctgccaagccctcccaacttacttccacaagtgccctgtgtttacgtcctgcaccactgcagacaaactgctcttacgcatggttcccaaatacgcggcataaatgcctctccaaggacctcaacacaagctcctcactccacaggaatgccctctctgctccaatattggtctaagccttttctgtagtatacttctgagtacatttctcccatcaaaagcctaactgggctggaagcagtggctcacatctgtaatcccagcactttgggaggatcacttgaggccaaaagtttgagaccagtccgggcaacacagcaagaccccatttctacatttttttttttaattagctgggcatggtggcaggtacttatagtccagctacttaggaggctgaggtgggaggaccatttgagcccaggagttcgaggcttcaatgaactatgaccgtgccattgcactccagcctgagtgacagagtgagaccctgtctcctaaaacaaaaacacctccccaactaccccttcttccgctgaggattcatattaacattagctaactttgagcatgtgcatcatgccaagcagttttccatgcattgttttacggtacttagtatgtataatacataataaacccatgaggtaggaactatttttaactgcattttacagatgaaactcaggggctaagttgcccaagatcacagagctagtaaaagaactggcaacaggccagattaccaagccctagctcttagccatgacactataaggctttaagacaaacaacccaaagagccttagtggctatcctcctggaagggagcacaaggaggatttcaaagtgctggcaatattctgtttcttgataatgggtgtaagctacacaaatctgttcacattgtaaaataaatcaagctgttcactttttctaggtatcttatagcttaagttgttttttttttaatcacagaaacctgtgtttgcatttcagatgtctcttaacttactgaggaaatcattaccaacctcactgggtggacaggaggatgaacaggagaacttcagcaaattgtagttcttgttctatccctgaactaacccaacattcaaagtcactcatctgatgcttcccacctggcaccctgcacttgtatgtatttttccattcatattcatttctgcctcttcatctagattacacagcaacaatgtaaattaatgactactcaagagtcagacagacatgagttcaaatcctacctttgctacttactacatgtgtgtcctgaggcaagataaagcctctgagctcagtttctctgtcagtaaaaaggacctatctcctagtgttataggattaaatcagatgatacatgtaaaatctttagcttgggggtctgtcacgtaactgagcaatgggtgactatgttgtaattattacaccctcctgacatgcacacggtaggagaaaaatctaacctggggcagtagatagcagcagaaagagcaggagctttggagtcattcagatgcaagctctgtaaattacttgctatgtagcctagagaacaagccattcaaacttcagtttctccaactgtaaaaggggaaataagagtgtgggtctcagagatgttgcaagtatcactgcaatgacataactgatgcatctgacccataagactgcctaagcgtgcctggcctcgaagaattgggcataagtttgacacatggaagaaatgaggaggggttggcaaaaaaaccaagaaacatacctttggttttgaccacaccgaaggagcatccaaccccaaaagggaggcaaggaaataaagttatttaaataaaataacaaacccaggtattatagatgttttaaaacattacattgatgcaaaagcgagtagttttgaaatatttaactactttagttaaaagtgaggagttttaaaaggaaacattatttcagtcatgcaacataaagcacataaaatactgagttacgcaggtataacaaagtatagcaggaagaaaacaaacattactgagcaggcactaggcactaaccccaggttagggattttacatgtaagattgcaaacatctgccagtgggagccaagcaggcaatgcaactgtatgaaatgagtcaaatgtaagcaatgggcagtgaagaggaccgtgcaggggacaggaagacacacagaccatccaaagcagcaatgccacacaactgcaagtgactgctgccacactggaatggaggcatcactgccaggtcttctggtttctcaagagaaactggagctctggatttttaagagaaattgcataaccgaaaacgctctgtggtcaacctactattttgaaagctgacaaagagaataaatcaagcatttatcctgacttttctataccaaccatatcacggggtaacgaaacagtagatgaggggaagtttctctttatagaaatatttcagctaataaatgaccagggaacaatataattagaataccaccatttcaccatccataacgaattactgaacctagacactgaacagcatgactataaacaccagagacaaggaaataccatgtgcctcctcagggagagcacagcacccaccacctgtgaagtagttgggccaaaaaattgaacctaaattgaattaagtatatactaattaagtataaaccaccaatttacaggaaatagagagggcagaggaagatgttaagtacaccaggggaatacaactgaaaattcccagagagtggtataatactcccaggaaaaataatccaatttctggggctggacatgatggctcacggctataatcccaacactttgggaggccaaggtgggcggatcatgaggtcaggagatcgagaccatcctggctaacacagtgaaaccccgtctctactaaagatacaaaaaattagccgggtgtggtggcaggcacctgtagtcccagctactcgggagactgaggcagaatggcgtgaatccgggaagcagagcttgcagtgagccaagatcacaccactgcactccagcctgggcaacagagcgagactctgtctcaaaaaaaaaaaaaagaaaagaaaaataatccaatttcttcggcaaaaccccaggaaaaaaagagaaggggaacttataaattaaaagaaaggatgggcacagtggcacatgcctgtagtcccagctacttgggtggctgagggaggagcccggtagttcaagaccagcctgagcaacatggcaggacccccatctttaaaacactagaaaagttagccaggcatggtggcatgcacctgtaatcccagctattcaggaagctgaggtgggaggactgaggctgccgtgagctatgattgggctactacactccagcttgggcaactgagcaagactttgtctgtaaaaaaataaataaataaaagaaacttaaaattatcacattggtaacacaaaagaaaatttgaataaaaattgttgattttttaaaggatattatgcttatgtttttaaaaattatcttttagcaatacatactaatattatttacaaatgaaatgttatgatgcctgggaggtgctttataataatttgtgaagggagaatggctagaggagcgaaggccaccagttaatggttggggctgggtaagggctcattatgccatcctgtcttcttttgtgtattcaaaattcttcataataaaaagttaaggtgtatgagatgtctctgcaggctaaatgttattgtaggctaccatttgtaaagtctgatttaagatcttttttttttgagacaaagtctcactctgttgcccaggctggggcgcaatggtgagatcccagctcactacaaactctgcctccaaggctcaagtgatcctcccacctcagcctcctgaatagctgggactacaggcacacaccaccatgcctggctaatttttgcatttttttgtagagatggggtttcgccatgttgcccaggcttgaacttttttttaaactccacaaaaatacatacaatcaccagtattcctattgttacaactctggaaagtgtacagaggttaaatgacttgtgtaaatcttatcctttcaactcccagctctaatcacatctcctctatttctacaaagccttctctgaccaactctcatcttcatgcacccttatcaatcaactcattagtataatgttcttctaaacttcctgaataaatcatgtcttacactgaaacatccaagttgaaggaggggaagggagatgtgttactaagataaaagggagtcaaaatttattgagtacctactatatagcaggctgtcatctaggttgtgggtgcttgatacacacacacacacacacacacacacacacacacacacatatatcataattttccagtatcattgtgaatgtttagttgatgagggcaagaactttatcagtcttgcccaatgctttatatccccaatgttaggtgctcatgaaatgctgaatgagcaaggtaggtattatccccatttttcaggtaagaacactgaggctcggaagttacatagctagctaaattataaaacccttgtcccagtactatactagtataggttgtccattccataattactgaaattattaacttcaatatgagttaagaaaaaaatctcagggcatagtggcttgtgcctataatccctgcactttgggaggtcaaggcaggatgatcgcctgtgtccaggagttcaataccagcctgggcaacatagcaagaccctgtctctacaaaaaattgtttaaaaattagctgggcatggtagcatgtgcctgtactcccagctacctgggagggtgaggtgggaggattgcttgagctcacaccactgcgctccaacctgggcaacagagtgagaccctgtctcaaaaaaaagaaaaagaaaaagaaaaacaatgaagcatttgagctactgtttatacttgatcactcacagcaaaagtctgcagagtctaagattaaacttccctaagctgcagattacccaataaatgagtgtggcagcaacaggaaagagatgtcaacaacgctgaggataaaggataaagggatcaggtacaggtaagctccaaagaagaatcatctcagtctgtggagagaaaagaaagctgtattttctgacttagtgcccaggtcacaggaatgaatggagtgttccagaacttctttctttatcacccacattaatctgtgacattcatccacttccactaaccccatcaagggccaagtaatgtgctaggtgccacaaggggtaccaagaatgagtaagatggtctgtttgccaagatttttaaaacttggcaagtgctaggaagagaaaagcgggcacagggcagtcctcagattccctttcatttgggagctcagacttccctctttgaagcctaacaacaggcaagagccagaggcttagggccccaggtgcaatgccagaccccaagcaagaaggggacatcaataatccaacctgcgggcttccaaatccgaaatgagatcatcgatcccaaccctaatctatggccccattatgtcccagatctagaaggggcccagatcccaagtgaggcccctgttgcctgctagggcagatggtaacttcagactctaactccatggttcctgaggtctcaggctcatgaaactcatttcactaatttgggaaagccacctgacctttctgggcctgttttttaacctgttgattgataaagttaaaatttcaagttccctataaacaacaacaaaataaaaaaaggaaaaaataaataaaaaccaaagggaaggaagatacaaacaaacaaaaataataaaaacaaaataaaaaaaaattcaagttccttttcatctaaaatcatttgcgtcatcccaagctgcttagccttcagtagcctcaggtcctaactccaagccaggtcccatgagcactcccaacccttattgtggacactactcaaaggttgcgactcatgggtctccaggctataaaccagttctacacattcacccccaactttcaaacagggagagccttaggtttcctcccatctcaattcaactggctcacacagcacatgtcacctctcactctgccccacgtgttggagatgcttctcctcccctccccctaagtcataaatcattatcaaaatctcccgacctccagtgcctggaatgtaaccctgattctggacaattcacctccaactcgcaggtaacctgggccataaagctaattgcctccattcagcctgtaatctagatgcctcggcccagggctcactctacccctcaaacctttccagtctctagacccttagtggaattaatcagccctcacattccctaacccaacacttcaacactgaatccctcgggcactccaatcctaactcagactgccccgacctccaatttggaccctctccgaaatgccccaccagaaccgagaccccggccagcgttccccgcaggccttagtccccggcccgctccgggcaggtccagggcttctagatctccggccgccttgaccttggagttcagcaggctccgccgccaagcccagtcctgccgctcacctgggtccctttaccggccccgggaggccccagcagcacggcccggatgcctttaggatactcgggttctgccgctggcacgctgggagccatgtccgccgaagtctctcactgccaccagttcgcacgcctcacaggtccagtgcttcccaggtcaacgcacgcacgccacgcac

SEQ ID NO: 1521 - DNA, 15254 bp, Homo sapiens
  source 1..15254: mol_type = genomic DNA
tttctgtaatcttgagaggttccaatcaacatttattgccttattctttttatctcattcctttttgaatgtgtttatctcctaagattttatctgtgatggagatgggatgcctgtgaatacaaaagttgcagtggtggcaccagggtgggggggtgcggccggggccaccatggtctcccctgagagggggtgctgtcttaggtgccccaagaggccctcgggcagcaagcgtggggtgctgccaaaatacagctccccctgggtgggcaggacacacgtggcctcctggcagacaggtgcctgggtgagcccgctgctcctgattagtcatgaatggcacctggtctgggcgacagtcacccgcaggaagccctgagctggccaccatcaccctgggcagtggctcccggggtgccaacaagacctgggcccctcgttctttggtgctgagagccccagctgaggctgtggaggaggccctggacctggtctggtgtctgtcagaggcaggtgcccagtcctttgacttgcttctctgaattgtcataattgtgctggaattgtgccagaaactggtagtgataacagctcctggaaggcctgtggctgctgagggctgcctggtccccctcaggacggccgggggagcctctccagaagcaccagctttgtctgcaggtggacgttgaaggggggcagttgggtcaggttcagactcacacctgtggtccccacgacgctggccaggacccggtgtgtgtccctgtagagggccaggagcccaggggccgcctccatgaggatgtgtgtgtatgccagcatgcctgtccccggctgcacatcctccctcttgtcgtacctgtgggatgagagctggtggtcctgcccagggcccccacatcgccctgtcccccgcccccaaggggccctcacatggcctctgggagggccgtgctgtgtgtggatcctacctccaggcgctgttgacttggagaaaccgagacacacctgtctgggcggctgccacgtcaatgtgcagaaggacgtctaggaaaaccaggcctgccgtcagagcccagccctgcagtcggagccacagcagtccccaggcagtgcccccagcacccacctgtctgggggggcaccagctggtgcagcctctgcattgcgacgccacctgggtagttgaaatgggacacatacagggccgtggctgagtaggcggcattcaccacgaggtgtccgatcacaagcagagaccccgctttgtacagccaagactttttatagttattcagcctgaaaaaagaatggttacacatcataggcagaacgtaatgacaataaaattaatctacctacaaaacatactaggagcataacctgctgttcaacttcaccaagtcataacaaagagttcaccaccaaataaaacagagtcagtaacccgtaaaagtggttaagatactgcctcaagaattgtctgtgaaattctacccaagatgccaatttaaaatttagatgagattttaaaatatatatatatttttgagacagagtctcgctgtgtcacccaggctggagtgcagtgccatgatctcggctcactgcaacctccgcctcctgggttcaagtgattctcctgcctcagcctcccaagtagctgggactacaggtgcacgccaccatgcccatctaatttctgtatttttagtagagacaggctttcactatgttggccaggctagtcttgaactcctgacctcgtgatctgcccgcctcagcctcccaaagtgctgagattacaggcatgagccactgcgcccagcctaaaaatatattttcaaacaatcccaagtgactgtgtaggtcagagtgccacccgcgcggccaagcccactcccagcaggtctgagtgaactctctgggacagggtgccgccggttctctcacaatcgactatgccaatctcaggatcctacggcagagttagcagctgccacagacagtgtggcccacgaagatgaggctctttattagctggtccttaacggaaaagcttgccaaccctggtctaaacgccctgaacccccgatcaagactcactctcttccaaacccaccaggctcctcggagccctcttctccacaggccctgccctttgctatggtttggatctgcgtccccaccaaatctcatgtccaactgtgatccccaatgctggaggtggggcctggtgggaggtgactgggtcatggaggtggagccctcaggaatggattagcgccatcccctccatgctgttctcctcataccgagtgagttctcgagaggtctgcttgtttgaaaatgggtgacacctcccccgtccctcttcgtcctgctttggccacataaaagcgtgcccgcttccctctcgccttccgccataatggaaagttttcccaggccagcctggaagctgagcagacaccagtaccacgcttcccgtacagcctgcggaaccgcgagccaatgaagcctcctctttataaattatccagtctcaggtgtttctttacatcagtgcgagagcagactagtgcacccttgaacaatctctggtgcggtttctgagctcgaggccccacctaggatgaccgcagcctcctaagtgcctgccccaaagagctcagcactgccagggcgttcgtcctttgttcccgcccaaacctggagtgggcagtcactgtggaaagctcgcaatcagaaaccttccacccccaggactgtctcaaggccctgggccctgacaccgtgggaaacggcctgctcttgctcccagggtggccgggctgaggacctgacttcggagggggccttgctctaccctgcaccccctcatttggactccccaagtttgtcctcctccggataaggccgactggcacagcaggggcccttgcatggagcagcccctcacgcccagcacaccaggcctcaaagacacagagctgggtccagttcccactggatcttcttccctgctggaaaagcctgtcaccgaatacaatccatccgcgccgctctccccgtctttcctaccctcttttccatgactctggctggggtctgctcctcctccagccctgagccgacccctgagacgagagggagccaaaggcacagaaaagcagaggcagagctcccaggagcccccactgaggcgcggctacagcagccagaggagcccccaacccaggcacggccacggcagccggaggaacccccagcgaggaacagtcacggcagccagaggagctcccaggcccgagggcagtgcggggcagtcggagctggggggcaccatcccctcccctgtaacaagtggcaccggaaagcacctgaccgctgcctgagatcagggaccgcattgtggggcttcctctccagccagagtgggcacctctcaatgccccaggccgcggccctcctggcctgtagccctgccgcccctcaatgcccagcgtggcctgagttggcctcctgttcccatcaaggcagcaaactctgaacgggcacagagctggccagcctcagccctgggttcttccgcagcacccacagggccagcagtgatggactctcctgggcctgagccccgggtccttccccagcacccacagggcccggcagtgatggactctcctggctccctgaggcttgcaacactgagtggcagccgcgctcagaccaccccaccctcagcccaggcagtgccctccccaggccctgccaggcccccagctccacctccatcacctgctgcctgcagtccctccccgcaggaagccccctgccctccacaggaccttgagcctgggccacgctgggccctctgcacccagccataggcacctccctcaccatccccctcttccagccagatgacccgccttgacaaacgccctcaagcccgaggccctgtcaggatggccacgaacgcccttcctctacctgacctgtcgccctcagagcctcccaggcctggctgcccctgccctctgccgctgctacctatgtgagtgtcactctcccatgacagagactgggaccgctggtgcatcaccatatgtggaccagtcaccaaattaacccaagacagagaccacctgagcaaagccctctgtcagcacaatgccaggccggtcccatcccatgcagccctcagggaggagagaggactggggtcaccctcctttgacataagcgcctagttcaacacaccctgtgtttatcttaaaaaacagccctggtggctcacacctgcaatcccagcacttccagaggaggaggcaggaggatggcttaaccccctaggagttgaggggtgcagtaagccccactccagctgggcgacagagcaagaccctgtttcaaaaattaaacacacacatacatccccccaacagtaaatcagtgaacctgtttccaatgaaactataaaaatgcatgtcacaaaaagagcactcacaggtaggagcagcctctggcagccgtgatgttgagcatggggaaggcatagatgatgaagcgtagctccttgtgtggcaggagggagtagagtgccatgaagcccagtgccagcaccgtcggcgcgtgcgtccttctgtctaccaagcccagggggatgaagagcaggctgcagcccaggccgcggggcagggctgagtagaagtaccacagcagcggggaggtctgcgggctgggttaaggaggccacgcacctgtccacgcatgagcccgtgggctaggtggcagggtcaaggtggagaagacgcttgaagacagttgtgctgagagatgcagcctggaccacggctcgtgtgcacagacaccactcaggcctcaggcccctcctaaaagacagagcccaggccacagctcgggtgcacacataccacttgggcgtcgggccccctccaggcaggaccaaggcagcaagggccacaggacgttcggtctctgtacccttttcttcactgttaaaaacagatggtcggccgggcgcagtggctcatgtctgtaatcccagcacttcgggaggccaaggtgggtagatcacgaggtaaagagatcgagaccatcctggccaacatggtgaaaccctgtctctactacaaatacaaaaattagctgggcatggtggcatgtgcctgtaatcccagctactcaggaggctgaggcaggagaatcacttgaaccagggagttggaggttgcagtgagccgagatcatgccactgtactccaacctggcgacagagtgagactctgtctcaaaaaaaaaaaaaaaaaaaaccaaaaaacaaaaaacagacggtcacgggtgacacacatgttgggattcgttatgctgttccatctatgcgtgtatgtttgacataattcctaagaaagcactttttaaatgcagattgtccgggccgggcgtggtggctcacacctgtaatcccagcactttgggaggccaaggcaggtggatcacctgagttcaagagttcaagatcagcctgaccaacatggtaaaaccccacctctactaaaaatacaaaaattagccaggtgtggtggcgtgcgcctatagtcccagctactcatgaggctgaggcaggagaattgcttgaaccagggaggtggaggttgcagtgagccaagatcataccactgtactccagcctgggcgacagagcgagactcagtctcaaaaaaaaaaaaaaaaaagcagattgtccgaggagcagaggagaggctggggtaatctggggcagggctgtttccagccctcaggctgtttcctggctgagagagggcagccaggacctcacctcccatggccagcatttcccaggagcaagtgggagggaggggctccatcctgaccctgcagccacgctgcagagaagggagaagcagctgcttccactgcccatggaggcccaggagatgtggctgcaggtcccacccatcgccctcctgcacggacactgaaggataccccccagttggagcttttgttcaggacagtgttgtaccaaagcacctttccttccggccaagtgagctgccgccaaaaataagagtccacagcaaccgtcagtcctgacaaaataaaatagagtttcttagtcgcaaacacagccatcagtaaacatcccgccacaatgcagcccccatcactacagaaactacaagctgctttcatataaaagaggttgggcagggtgggaagattgctggagcctaggagttcaaggttgcagtgggccatgatcatgccactgcactccatcctgggtgacagagcaagactatctctaaaacaaaaaaagaaaaaagacaccaactgtgtcgaggacaccactgcccagaaccaccgcctggcgcagggacaagccgccctccactcttgtggcctcccccagcccaaggacaagggacagaccagtgaacaggggctcctaaggcgcacggtgggtccccctggagatccccgggcagggggcttaggattgaaatgttttcaacactgctaaatttagggtcattttatttcatggggatgaaaacctcccaaatttctcttgacctttgtaaaacaaggcaaaacaaaatccagttagaagcatcccacagtgactgacttacctaaacagaggatccctgccgggacggcgtggcgaagggctctgactacagaaacctttcggttgcccaaggccagcagcagcaggaggcccaggaacaggcacagctccaccctgaacacgatgatggcgaaggctgacagccagatgaagcgggcccactcgtgccgcagccaggccgcgagggccagcaggactgcaagacagtgcgggagggtgctcgtcaagacacagggcccacccggcccagaaaacacccggggaagtgaagggtgattccttttcctattataaaagccacacaaatatcccagaaaagaaactgctcagagccgctccccgcacctatgctgttggccaggaagtgtgtcccaacccagcatggaaaacaaagagcctggtttcaggtcacagaccatcctgaggaacccagtggggaatggccattacgggggaggcactgccatcagctgcacagcccgactcaggggagcccctgcccggcaccatgggtgtgcaggcccggccggcagctacgtacctacaggcagggccagcacattgggcagtgtccgcgtgcagtagaacatcaggtggaactgcatggccgtcacccagcagaacatggtggccaccatggccccgaagtgccgtctcacttccttttgtaacgtccagagtccaaaaatcacgccgagtccaagcactcctctaactaaacaaagacagtgacagcacctgagcctgcagtggaggagtatccagtggggccccctacgtgggtccttctacacagatctttctatatggagttttctatgctgctgcaatgccagctgacggctacgtcaggcaaagcagccttgagggcatcgtctccatgttgaaaacagacgactggacccaggccccctgcgctcctgtcgggaactgaggacccttgcgggggctgctctctgaagcatgagggaggacacacaacttgggggtgccacgagctgagccctacactaaaccagagaccccaccgggctgtggcatctccaggggaaatgtttgcaaaggccgggctcagaccttgctctaaccagcagccatgaggaggtgggatgtggcaggaacacaggctcccaggcaggaagggggtcaggacccctctccccatttgacagcaggagccacctctgggctggtggtctgatgaggaggtggtgagggggcaggtgtgcccaggacagtacccagccgaccacacatcctcaccgtggaccggcctgtcagccgctggcaagagactgaaaacaggaagaaaaatgaacttctgggtggctcttgctacctttccagaaggccagaggaacttcgaagccatgtgagaagcaactgggtccaggcagctgtgggggccaatgggcagagatacccaggcactgccaagggggccacggatgtctgagggctggacctgctgttcccagaataccccatgtgcataccaggcattttcttttcactgattgctggattcggactgcaaatgtctttttttttttctttttaaggacagagtttccctctgttgctcaggctggagtgcagtggcataatctcggctcactgcaacctctgccttccgggttcaagcaattctcctacctcagcctccggagtagctgggattataggcgcatgccaacacgcccggctaatttttgtatttttagtagagacaaggtttcccatgttggccaggatggtctcaaactcctgacctcaggtgatccccccgcctcggcctcccaaagtgctgggattacaggcgtgagccaccatgcccagtctgaatgtcttaataggacatttttcactgatactcacaagtgggtctggctccagctgctgtatttttggtgctggaatttcccccgggcttttaaacaattcacagaccccagcaaagccccgcttccccttttccccatcaggtccatcccctgcgtctcttctcttggttttccatcttcccaaatgcccaacaatctcaaccccgtgcccaacaagggtagcctcggcctcacgatcagcctcggctgcgggatcaccctcggccccgggatcagcctcggccacgggatcaccctcggccccgggatcagcctcggccgcgggatcagcctggccccgggatcaccctcggccccgggatcaccctcggccccgggatcagcctggccccaggatcaccctcggccccgggatcaccctcggccccaggatgacatgctcttcatccagagaggaaggattttggcctgtggcaggggctggggggggcactagcaattccaggtcaccttagtgggatcaggaaggacacagggtgggctcccgttcaccagctgaagctgcagccctccaaggttctgtccagctggagtccacccagctctgcccaacctcccaacctcttgctgccaaccctggaataagcagaagcttccaagggaatgtggactcagccccggaattgcctgtggacttcctttccctggctcgtggccccccaactcctccccatttggggcttcctgatgcctctacaggacatgcacggcttgtccagctgtccccgtgccatggtgggtttccgttcccaatctgccccttcaagaagcagaactgctccttccccaggaacgtgctacttcttaaagctctccacacaagctggactgactcgctggaagcatgtctgggtattaaaagcaataaaagcgtactgaaataaaaaagtggtgattgctgacttcaaaaactcaggttgtgtgactgggcgtggtggctcatgcctgtaatcccagcactgtgggaggctgaggtgggacaatcacttgagcccaggagttcaaagctgtagtgagctatgattgcaccactgcacttcagcctaggtgacacagcaaggccctgtctcaaaaaagaaaaaaaaatcggtttttagaacaatatgtacaaaacgttctaattttttttttttaaagtcctcatgtgggcacagagaaagacccaggatttgcacacaggccctgcagtggtggcctctgggaatgtgaggtttctgtttgtaacattccccaaggcaaatggtgctgcttctgcaggaataaaggctgttgaccccatgggggcttgccaggtgaggcgggagcagcaggctcaggtggcgagagctgcctcacaggcagtcggcatttctcttgtacctgccgtcacccctaatttcacagtcaagagtgtggaggcacagaggggctgactcagacgtcttaggcctgacctgagcacctgctctgagccgccatgccacggtgatcgagggcaggcaagactaacagacagcgttcctgggcaggagggaccgcggcctcgctgaggtcacccgatgacaccacagtccctcactccctcctcctttgttgaagacccccttacctattagctgagagtaaaacttggacatttctaacagcgaaagcacgtaaaccgcggggctggagaacactgcgatcaccactggcccgaggaacgtcctggggacgactccggggaactcaagatggtcgtactgcgaggagaagggcaggtcagtgcaccggggccctgccagctggtaacatgaggttttccccaaagacagcaggggcccctcacctgctccaggtcttgccagtggtagagcaggtcatgtgtggcctgcaggttgaagctctcctccactttggtgtagggacagatgaccaggtggacagtggctacggccaccagcagccccagcagcaggggccgcctgcctgatgacccctttccagccattccaggctttcagcttcacgtaccttcacaggccaacagtgcgagacaccagccgttagcactgccactccacgcatgctggaaaagtggaaacagattcctgaggttcgaaagtcacgcttgcgctcacgtttgggagatccgggtaaagggttagcagaattctctgaactactgtcttagtcgcactactacaaatctgaaaacgcatcaagatggaaagtttggagaaaaaatcacacttgagaatctttcatactgtaaccagtgatctgacacttccagctctgtgaatgtttttctaggcagaaggatctcagtcgcagaaccctgagtctgaccaggcctgggccacgagggcaatggagggtggtaaatggcccctgccccccagtctaaatctggcaggagagtcagcaaaacccaggcttggccccgagggaaccggctgaagaagacggaatgggaggctgaggggtgccagttagctgggtgggaggcaccaagctggagagtggtggacaggggccccgggagggcaagaaactgaacgtagtacagctgctgggacacagggctcgagtggccagcaaagcccccgctcccaggaatggtgggatggggctgtggacgcctgcgccgaaccccaccctgggggctgggagaagccatggccggctttcccaaaggtggcaccacactggccatgagcctgcatgtgagcctgggaagactggcaatgggtcccccaaacactaacaggacaacctcaggggcccgtggcacggagcttcctgagaggccagcaacatgtccagctgctacacgtgagagaccaagggaggggagggggcaaactcttcacgtttctggcttcttttaaaacagatttgattttattcaatccaaaccagaagggccagaagcaaagggagagagaaccccagggcttaccatttattaaaactactttaaaaattttttttaagagacagcgtcttactctgtcacccaagctggagtgcagtggagtgatcatggctcactgcagcctcaaactcctgggatccttttgcctgagcctcctgagtagccgcagctacaggtgtgggtcaccacactcagctaagttttcttattttttgtaaagacagggtcttgctttgtagcccaggctggtatggaattcctggcttcaagccatcttcctaccttggcctcctgaagtattgggattacaggcgtgggccaccatgcccagccaaaactatcttttgatcaaacggagagttaagaagtatacaaagatggcaaccaaaggaaaatctgtagattagaaggaaggagaaccctatttgatatggtgggcagggggtggagagaaagaaaaaagaaagctttaataattttacgactgaaatggtatgcagttctctcctttgccaaatataaaaacctggggccgggcgcggtcgctcattcccgtaatcccagctctttgggaggctgagggccaggtgcggtggctcattcccataatcccagctcttcgggaggctgaggtgggtggatcacgaggtcagcagatcaagaccatcctggccaacatggtgaaaccctgtctctactaaaaatacaaaaattagctgggcatggtagtgcacgcctataatcccagctactcgggaggctaaggcaggagaatcgcttgagcccaggaggcagaggccgcagtgagccgagatcacaccactgaaatccagtctgggccacagagcgtgactccgtctcagaaataaataaatagataataaaaaaatttaaaaaaataaacttggtatcaaacaaagagaaaggtcgaaggactaggttaggaatcactaactgagggagggcccactcagctgtctcccacttgctaagacacaagctttttgacggtggggggtttttgatgctggatgatttttcccaccagcgcagcctcagcaccaaggacagaggccagccgctgtggcctgaaggctgcctcgctgccacctcccctgctggactcatcctgcgggcagggcttgcttggtggactcactgctgaatcagcaaagcctgccgcacagtaggcactcaacaaggctgccgaagaagaaatcggtaaaaactcctacatggggttctcatcacaccagctcacgtgcttattaaaaattccagcagccgggagcggtggctcattcctgtaatcccagcactttgggaggctgaggcgggtggatcacaaggtcaagagatcgagaccagcttggccaacatggtaaaaccccgtctctactaaaaatacaaaaaaattagctggagtggtggcgagtagtcccagctacttgggaggctgaggcaggagaatggtgtgaacccaggaggtggagcttgcagtgagccgagatcgcgccactgcactcctgcctgggcgacagagcaagactccatctcaaaaataaataaataaattaattaaattaaataaaaatatgttccaacggccgggcgtggtggctcatgcctgtaatcccagcactttgggaggctgaggtgggtggatcacaaggtcaggaattcaagaccagcctagccagcatggtgaaacctcatctctactaaaaatacaaaaattagctgggcatggtggtgtgcgcctgtaatcccaactacttggaaggcagaggaggagaattgcttgaactcgggaggcagaggttgcagcaagccaagatcgcaccactgtactccagcctggacaacagagccagactccgtctcaaaaaaaaagaaataggaagcaagccggatgtgttggctcacgcctgtaattccagctactcaggagttcaagaccaacctgggctacagagccagaccccatctccacaaaaataatcccagctactcaggaagctgacatggggggtactgcttgaggcccggagttcaagaccaacttgggctacatcatgagaccccatttctacaaaaataaaaaataaaacggaacggggagcatctacgtgccaagatgtgggaggtgcacacagcaagtgctgcttggcagtcccccacaaccccactccacacctctccacccaggggagttccccagcaaggaagagttcagctgtggggtgaaaacattacgtgctgactctgacactcctggcgggcccccagcacctcctcggacccaacaaggtgtgccttctgctgatgaccagcacagctcactttcgagggcatgagaagaccaagggtgagtctggattctctgccaggagcacgggaagaccaagtcaacaccagcaagcacgaaaaccacgacgaaccccccaccaggcgagggtgaacggacactgtcctgcactagcccactctgctgggcagctgggcagcagctgtggctaatctaagtgacgggtgcttcgagagcacccacaggttaaaacgggcccaggccatgacactttaaaatggtggtttacagaacaatggcatctcagattagggaatgacctgcaaagaccctcttgtccccatcaatccagattttaaggcctctaccgaaattgatcaaatcaggctaagcatggtggctcacgcctgtaaccctagcactttgggaggctgaggcaggcagatcgcttgaggtcaggacttcgagaccagcctggccaacatggtgaaaccccgtctctactaaaaatacaaaaattagccggacctggtggtgggtgcctgtaatcccaacttaggaggctgaggcagcagaatcacaggaacctggaaggcggagcttgcagtgagctgagatcgcgccactgcactccagcctgggcgacaaagtgagactccgtctcaaaaaaacagaaaagaaactggtcaaatcagatgttactttttttttttttaaatgtgcagtgttatctgcactccttccttccacaggcaggagttctctgaaatccagacgctgcacgttttatttcccctaatttaaaccaggggttcctgaacatgagcgagtgttcatcacctcaagcgcctgtagaaatgcagatccccagcccccagagaccctaagtggaccccagatccccagcccccaggtgaaaaacccatcccccaggtgggaggtccggccccaggtgaggagcccggccccaggtgagaggtccagccccaggtgagaggtcgggcccccggatgagaggtccggcccccgggtgagaggtctggcccccaggtgacaggtccagccccaggtgaggagcccggccccaagtgaggggtgcagccccaggtaaggagcacggggctgtgacgcgtggacatgcgcggtgaggcctcaggaatccagcgccagcgccagctcgggtcgcgccctcgcccgcctcctccctggtctcgccgcgcgcccgcctgaaggccccggtcgcggcagcgcgcactgacctccgcagctcccggcggcgtccttcgaagcgcggctgcctgggccagcctcggcaggaagcaggacggcggaaacagaacagagcccgaatctaaagtccttgcccaaatctaaagtggctaccgcagccccggccgctacggccgcagagaccctctgtgccctgagtaaagatggccgccgcgggctgcgcgc

SEQ ID NO: 1522 - DNA, 69048 bp, Homo sapiens
  source 1..69048: mol_type = genomic DNA
ccgggcctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggtaaggattcgacgctgccccgcgccctggttccccagggccccagcggacgtggtccatccccttctgcatcctccgctggccccgtggttgaactttaatggcagggccggggtctccagcgccacgccgcccacagcagcccattcgggacgccctgcaattggtcctgcccctgtcctcccgcgcatcccaagctcccggcgcgcgctctgggcgggacaggagattggacgtggcgcccgcggagccggcgaactcaggggaccgcgctcgggaccgccctgcagtcccagggtctcctacctcccgagccgctgcctgggaccctgcgctctgtctgggcacctgcccttggtgccccgtgactgagcccctcctggtgcctccttagccgtagctctagagacctgggctgccaaccccaaggcctcgtggcctggcgccctcccaggcgtcccacctgacccggtggggtctaaagcagtttggtttgggaggaggagagggcaggaggcgcttggaatggggggcgtggcgggaggagacagaggacacccgcgtgggtgtcaaagtgtgggcacccactgtgggcaccgcagctgtggggcaaagctctggagcccgcgaagccgaaggagcctgccgccccctttaggctttgcgaggtgggcctcccagggctgcttccctgcccagtcttggtaagaaagggttaaacgcaggtctcagcagaaaggcaggaggccgaggaaagcctcccccactccccattgtgccttatgactctttttcaacacataatggggtcgaaggcggggcctttacaaaggcctctgggtggagggtgaaattccttgagatcaaaagagggggcgattcttgggccaggaagggctttgggccctgggaaaaagtcagaccgctcaggtgggcccagctgcccagggaggcaggggttgggtcccagcctcagtgtagatactgcaactgttttttgaaggcctaccgtgcgtagagggacctgctctgacatctcatgtacatcatttcattttacaaatggggaaactgaggcttagacaatttaagtaagtggtgggaccagggtttgaatccagactccaaactctgcagccctagcgtcctgctcccactgtgttgcctaagagatagggggctgagccttggttttgtcttccggctcctcctgggctcagcccgctcttcctccactctccagtcttgctctttccaactgtttagtcctccccacctgtgggtgtccccacgctgtcctgccccagccatcccactccctggccccatgcatcttgttcctgtgtcacctttttctttctttaactgaatacctgtgaattccctcagaagaggcccctggacacagcttctcaacatcccaactggtgaagactaggctgagtgatgatcccggtccatgtgcccatttgtaaaaaggggtgtattcccctttcgggactattgtgaggaataaaactgaactgaggccagaacaagatgctatcttcattcagcaaatacttaagcatccgccgtgtgccaagctctgttctaggtgccgggaatgccacagtaaatcagccaaaagccctcttctggattggatgtttgcataacaaaattctttcaggctttgaaactgtcagaattcacagtgtagacttgaaatcaagctattcataaggaaggagattaagacgcaatcacctgtaaaatggattggccaacctttggccctcactttagcaaaggcagccttgctgtgggacctgggatcagttctgttccctctctgtgcctcggcctcctcccataagctgtggagatcaatagtgcctaccagtggtgaggtctagatatgatgaatgcttgcgaagggtttaagctggtacctgtgcttaagaaaatcctggctatcctcagctctcttctcagcagaaaatgcaatgcggagactggaagttgggttatgtgcctaccctgcctctgaacctgttacccacttctgcccaggcccttcccatcctgttgggctacacatgtggggtggcatggtgccctctttgctcacactcagatgccaccttctgtcgccatcctaaacacagcctgggctgggagcgcagagctccatgatgagatcagccctggagccatcatctctgcagcgcttcctgccctctgcctgttcttgtgcctcaccgtgtcctagctcaggaccaaactcagccctgttctgtcccatgacttacatacccaacattccctgcaagctggatatgatcttggaaaggggaagtgagttgcccagaggcacacagatgctacctgaggagctggggctggagcctgcgtatctagaattccaaatctagcaatctccatgctgtacccatctctgggcatatgaggccttttaatccagggagtaggatccagtagcagagcccgagttctcaccttgaaatcagtctgacttggctttttaatacaaaacccagagctctgagagaacattgctgggagagtgagcaagctgggctgagaaccagcactcagaaatctccatgtggccacaggaatgctgacttggcttcccagcaccatgtcgtcgtccttggcaggctggagctgggctttgtggtatgttagatttgttttttttcttctggagatgtcctcactttcagagggcagttaggggcagtagactgaaggttcattcccagcactgccatgcgaccctggacaagtcaccttccctttcgaagcctcagttttctcatctgcaatatgggttaaaattatatactttgcagggtcgcaagatcataaatggttttccaactttgggctgaaccagcattgatgttattaagacattcatatttcctgtggagcaatttcaaaagcagttaactttatccctaccaggtgatcctgagggcctgagggaagtccacgtttaggtcacaaaagcctacacagcagggaaaacactggtttgggggctggtgtcttggattccaatcgccagctgtgtgacctgaggcaagtcactttacctctctgagtgtcaagctcataggaggcccccaacatcaagatatgatgctcagtgtctgaagaacatagtctccgtatttttctgcctccttgtaccagctcccaacccccccgccaacacttcgttaattgctcccagaaaaactctatgcttaaagttttccatgcttaaattctcagcctcactgtggcatgaaatcaattgtttgcattgaatttgacttctcaaattaaggggtaaaatttgagatgagagtagggggttagggaggagatgaggacgaagttaaaccagatgtgcttttgtttaattgtaggatggtggttaagctgctcaagtattaccatcgttctttctgaattccagtaaccaggagtcaggtttcacaaaaagtcgtagtgttctttcctggctggtgtggactcgccctctctattattattattattattattattactattttgtattcatctgaggccacagagtactggccagagaggagacatagatccccagaatttcagttggaaggcctttagaagctggctcggtcaactgggctcttggtgcaccagggagactgaggcccagagaggagaagaggcttgcccagggtcacacaattgcttagggcagagtggactgggaattcagtctcctggccttaagctacatgatctttccaaaggcaaccactctcctgaatttggtgtgtttcatttctacagtatattcttagcatatctgttttttgaaaatcattgtttaagggaggatgcagatgatgtgggttggtggaaaaagatattaagctcaggagagctgagctgaagtccttgaatacctctgtgaccttgggcaagtcacttcccctgtctgagtctcagattcttcatctgtaaaccaatatatctgaggagtaggagtggagagatgagacttccctaagacttggaatgggtctaatgtattcaactggtcctcagatatttatagcctgctgtgtgctgggttatgggagatccatcacaaactgccttcctaaggctgcagggggtgggggattgttgacttttgcggtgattaaacaacttttatttagttgctggtgtttttaaaccaggcaatttcattttatataaagataaggatttctggcttctcttgaaagatcagaagatgtggccatatggggctatgtccctgcctggccacagtggctggagctgattagcagctgctccatccactttaccacagtctccaccacgccccactgcctcacacttgcccacctgcctccctgacattacctacctaccttctgagcttgcggtttctgggctagatgcagtgaggccatgtaagaggggctcaaattccacttgaatgattgtgtggggcttgggccagccctcagggggctcagggtgagaatatgggacacgtggacactagcccctcttccatagcctggcaacatctacaaaacatgtcagctaggcgaaggagcttttttcctgcttcggtggtcctcaggaagagtctgagggctctggaggtttgggggtgatagagcatctacctgtcaaggctcagcgagttgagcccagggtctagctggggacaggcatcgctgggtacttcattctaaagattgcacagcccctgcagggaagagactcccttgacagcttccaccttaccccttgctccccaagagccctgtgcattggtgcgccacttcaccctgtgctccctaacagccctgtgcatcagtgcataaccacttctcagacaggaaacacgatcttgcactctgaacccacagctctctgttccaccccctttgctgggagccagggcctggtgatgacaggcaggtaccatggtggctgcagcaagcatcttagaatcgccatgtctgagccagagggtagcacaggaggctgtgaagcctgatggttacatgcggggggctctggaggcagctgctgtgatgtgagattctaggtctccacgaatcaactgctccaggggttatgagatggacaagggagactgattgattgtcgattgctgatactaacctcacatcccctggtccttacacctgcagacgacttcagaaatgtgccctgtgtgggaagtggcattttgtgagcaccattgggtaccaggcactttcgcacattacctttgatactcacctaccccctactctccagcattttgcagttaaggagactgaggctcagagggcagacaccttaggattactcctcccctaggtctctatgcctctctgctttgacccagggaagggaggagaggacaggctggaaggtcatttctggaaataaggccgtggagaccctgtagtgaggccctgaccctccagactttctaagccaccccctcctcctccactccagcttgtttcagagatgcttcttcatccttccagagctcagtttgtcattcaggtgcatgaactttacctggccaggtctgcaaactgctgggcagagctcagcaaatattttatgttctttaaaaaagtttttaggtggctgaagcaaattgcttttactggaaaaaccagaagtgtgacctttattttatttttgcagagatggggccctgctatgttgctcagcctgggttcaagaagtctacccaccttggcccctgaaagtgctgagattataggcatgaaccattgtgcctggcccacaagtgcaccctttaaaaagatctaccaggtgacccttttttagactgagtatcgctctgttccccaggctggagtgcagtggcgtgatctcggctcactacaacctccgcctcccgggttccagagattctcctgcctcagcctcccatgtagctgggattacaggcacatgccaccacacccagctaatttttgtatttttagtagagacatggttttgccatgtcggccaggttgatcttgaactcctgacctcaggtgatccaccctcctcggcctcgcaaagtgctgggattacaggcatgggccaccacacctggccccagtgactttttgttgggtcaacctcttgccttctttagtgcacctttactaggtcagtaaagccacagggtgggtaccacttagctctcaggctgacgttctcaggcctcttgctggctgtcactgaagtgtctcaggcttgttgtttttttgtttgtttgtctgttttgtttgtttgttttgttgttgttgttttttgagacagggtctagtggctctgttgcccaggctggagtgcagtggcacgatcatggctcactacagtgcagccttgacttcctggactcaagcaatcctcctaccccaacctctcaagtagctgggaccacaggcattcgccaccacgccccgctaattttttttattacttgtagagatgaggtcttgcaatgttgcccaggctggtttcgaactcctgggctcaagtgatcctcccacctcatcctcccaaagtgctgggattacaggtgtgagccactgcatctggccagcctggccttttggaggatctcatccccctccacctgtctccacctgtctccaccttgacttacctgtctctcagcatacaggagttactaactgacccgtctgccgccattctggtgagaaaatgtctcatctgaggcccatttcccctcctccactccttctgagcccttctatagctcctcttctttctctgcctcattccgctggtccctgccatgccactactaactaaaagtccatagactataagcccaacatgcacgtactaggcatggtgctcagtgccttgcctgtaattactatttggtcctacagcagcgctgggtggcaggtgctattatccccacattacagatgaggaaacggaaacacaaactcccccagctgggaagtgagaagtagacatgtttgttccctgcggtgacccatccatccattcaaggctactgctttctccgtaatgcaaatgacataacccatcttcctagaagagtcagttccctatttatcttaaaaccatccaatatagaaattcatattctaggtctgttagcctatcaagatatcagagataagcaggtttcctctcaacagcttgtccaagcccttaatcacctaagtgatttttttgtgtgtgaaaatgctgtttttttgcttttccccatgacctaatccttatacagatgctccttgatttaccaaaggtttttgtcctggaattgtaagttgaaaaatatcataagtagaaaatggttataacacctaacctgtcaaacatggtagcttagcctgacttaccctaaatgtgttcagaacagttacattagcctatagttgggcaaatcatctaacacgaggcctatttcataataaagtgttgactatctcatgtcaatttcttggctatactgtattgaatgtgaaaaacagaatggctggttgggtactcgaggtgtggtttccactgaacactgtagcttttgcatcatcgtaaagaaaaaaatcttaagtgtaagttggggacagtctgtaatgaacatttaagggcttactctgtgtcagaaactgagctaatcactttgaatgaccttattgtattgagctcataattctttccattttgcaaacaaggaaacggaagctcagagagattgagtaatgttctcaaagtttggaaagtgcaggtgagactcaaatccagggttgcccaatcagattggcatctggattcaaatttgcatgtttggagaagagctctcagggcaccttgtggtacacatttgtttttcagtgagtgtttgcaaatgacatgggggtgggaggccccagggggaggagacagaacatagacacacctggtggggcaccagcgtctgttctcccagacagtgtttcttagcctgttcaccccctcataggaaatgacaagcctagaaggaagcatcctgagaaacccagaggggcctgggtttgaatcccagccctgccatttcaagctgtgtgaccttcgccaagtccctttccctctcttagcttctggctaccctccctaccacgcatggtttatttgaatgaggcaaggccttaggatttttcgatttgtggatggcgaatagccagcatgtctccttcctctctcctgccctgcacccacatcagacatcactagtcaaccactgcttgctttccttcccagattccttctaagtacagtgctccagacagccattagcaactaatatagagttggcacacaagataaaaggacatcccagaaccagattagatttggtcattgtgtgggtgggggtagggaagggataggcccaggtggcacccagttcagtgtcacggtgctccttggtcttcttttccttgtctttggaggaactaagctagactgtaccagggcccaccccaggtgtggggtaggaaccttttatgaggcacagagctgtgcccgtgttcagtcccaagggagaggcaggtttctgggcctcatcactgtctaggcttaaagtaagagtgacgagaaagaggctggtttcaggtcctcctggaaagagttaggcctgcccctctccaccctttgtaataacatccatagtagtaataagagttctcgacactgacggaccacttgttacgcaccaagccactctgcgaaatgctttgtatacatttacacatttaatccttataccagcccatttttcaggtgaggagaatgactcagagtaattagcctgggtttgcccagctggtaagtgtcggagctacgatttgaattcatatctgtcaaaccccgaataaataactcttattactacgatggatattattacaaaggatggggaggggccagcctaactctttccaggaggacctgaaactgagctctttcttttttttatggtattcagaacatcactttataaactgttgtcagattaccatttaaacattaatacccaaatacagaatttagacaattactttaaattgtaactgtaccatccccaagctctcagctatgaatttggtttggggagagggctccgtaataggccactgaagtcccccgtcccaccccttttttctcccctgaaaactagctgcctgactgctctgccagacttgggctagaacttggcttcactgtgacagtgggaccacctgggccctacagtgtggcaaaaccgacccgcccacaaactccatcccaggtgttgagatgctaacacactgaagctgaaagaccccacttggttttgccacagatcaagttgcatctgactagagagcctgtcctctaccctatttcctgcacaagtctttttctttgtaatgcaacaagcgctactcagctcagatccagtgggacacagggaaaggggctgtagtgtagcccagccttgctgagggagacccctgcctcgccaaagcacttcgctcacaaaggctgaaactggcctctttctcgtcactcttactttaagcctaggcagtgatgaggcccagaaacctgcctctcccttgggactgaacatgggcacagctctgtgcctcataaaaggttcctaccccacacctggggtgggccctggtacagtctagcttagttcctcctgctttcctccaccgcaggctcagtgcggggcccgcggcctctgcgtctttctctcagcttaccatgatcatttctcattgatgagtgcgatacgtctttgcccgtggaaagtgctttaccatcggcagagccttccacgtttacacatgcgcagcacagcaaagggcatctctttttaaaagggagaaaactgaagctcagaggctgggcacaagggctcacgcatgtaatcccagcactttgggaggccaaggcgggcagatcacttaaggtcaggagttcaagaacagcctggccaacatggtgaaaccctatctgtactaagaatacaaaaactagctgggcgtggtggtgtatgcctgtaattccagctatgtgggaggctgaggcatgagaatcacttgaatccgggaggcggaggttgcagtgagcagagatcgtgccactgcactccaacctgagtgacagagtgagactgcatttcaagaaaacaaaaagaagattgaggctcagggagggagggtggtgggccccggaccacacagcgaataaacggtaaaccctgcaccaaggaattaggtaccccacctgttccctaggccttctggaacaaattgcctaggggaacctgaggtcagtgctgggaacgcaggagtggtggctcagcagaggcaggggttgtgctgccccccgcatcccacccagatacaccctatcctgttttaatcagccattgaccttggacaagtcactttaacactgccaacctcagtttccaggcacttattctatttttcaggttttttttgttgttgttgtttgtttgttttttgagacaaggtcttgccctgtcacccaggctggagttcaggcacgatcatagttgactgcggccttgacttcctgggctcaagtgatctcctgcctcagcctcccgagtagctggaactgcaggcttgtgccaccatgcccagctaattttttttattttttattttgtgagatgaggtcttgcttatgttgatgaggctggtcttgaactcctgggctcaggcaatcctcccacctcagcttcccaaaatgttgggattaacaggcggtgagccaccaggcctggcatatttttcagtttttaaagccatttcttttttctctttttttttttttttttttgagacggagtctcgccctgtcgcccaggatggagtgcagtggcttgatcttggctcactgcagcctcccaggttcaagtgattctcctgcctcagcctctggagtagctgggactacaggggtgtgccaccacgcccggctaattttttgtacttatagtagacacggggtttcaccgtgttagccaggatgttctcgatctcctgaccttgtgatccgcccaccttagccttccaaagtgctgggagccacggtgcccggccgaaagccatttcttattcatgaactcaccgaaccatcaaagcaacccaataaagtattcacatcattttgcaaagtgggagactgaggcttggggaggcaagcaacttgcctgaggtaaaattgatggtaaaaccaggcctcaaactcaggtcaggatcccaggctgaaggtctttccccagctgtgtctccagtctctctcatcgttgcctttgtacctgccatcccctcccctgcagcaacctctccctgtttgtgttgccagttggcatcatggctgtttttctagagcttgctttggatatcttgaaccctttgtaatctgatcatccacatagcatctggctctgagtttcagttcctggagggtaggagccccatctgagtcactcgtgaattcccatgcctaataagatgcctgctttcagcaagcgtttaatgacttttttttttttgagacggagtctgctctgtcgcccaggctgtagtacaacggcgcgatctcggctcactgcaacctgcgcctcccgggttcaagcgattctcctgccttggcctcctgagtagctgggattacaggtgcctgacagcacgcctggctaatttttgtatttttaggagagacagggtttcatcatgttggccaggctggtctcaaactcctgacctcaggtgatccacttgccttggcctcccaaagtgctgggattacaacagcccatttaatgacttttgagttcatgaaaggctgccccactcggcaagggtttccacagctggcctggctttgttaccatggggaagcctgggagggatgccccactgggtgtgactcttgagccactcaatgcgaagcctggccaccctccccagaccttcactggtgtccttgcacgaatgccaccagctcataaatggttagtgattggcagcaggacaagccagtgtctctgggtccagttttcctgttggcagttcaggcctttagtctcactcaggtatgaggtgcccagtgtcatacctctggccaatgtctttgtccattttgttcacagatgtacccccaatcccaaacagccttaatttctttaataataataatagtcatagctgtaaatttgctgaatctgcatgtaccatgcttcctggtgcatagtaggcacttaatacatatttgttgaatgaatgaatactcgcagcgagttaacatttcttagagactgagagtccctaagtgaaaggtcacttgcatgacctctgtgcctcagtttcatgtgtcgactccgtgagaggtactcagaggagtaaccaatacatatgtccatttttttttttttttttgagatggagtctcgctctgtcgcccaggctggagtgcagtggcgcaatctcggctcactacaagctccacctcctgggttcacgccattctcctgcctcaacctccccagtagctgggactacaggcacacaccaccacgcccagctaatttttgttgtattttttagtagagacagggtttcaccatgttagccaggatggtctccatctcctgacttcatgatccgcccgccttggcctcccaaagtgctgggattacaggcgtgagccactgcacccggccaggtttgtttaaaatatatcatgaaccaggctgtgttctaagcagctcacatgtattttttcatttatccttgcacctgaggctcagagagattatgttcatgtctcctaggtcacctggttggtgtcacgtgcaaatattttaatatctcccaggacatgtgtgttccaaataacataatatgggaaccacctcccctaccagcctcctcccataacacacacctcacgccccagatcctaggcttagaacaaacgggaacagtagtaggcgagtcaagcggtcatgttgtccctgactataaaatgcctcatccagtgtcgggcacacaataggtcttctgatcaccatctgtgggataggcgccaatcatgatctgagcagaagctggcaggagggagccccgaatctgctggaggaaactcggtgctggggggactttagagaagaaatgacagcggtcataaatcattgtaacagtaacagctcatattaactgagtggcaggcactgttcaagcaagtcagatacattaatcatttaatcctcatatcagccctaggaggtagatattattgtcattgtccccactcacggatggggagccaggctcagaaataagctcatttgggctgggcgcagtggcccctgcctgtaatcccagcactttgggaggccgaggtgggtggatcacctgaggtcaggagtttgagaccagcatggccaacatgatgaaaccctatctttactaaaaatacaaaacattatagccagatgtggtggcaggtgcctgtaatccctcaagattacaggtactcaggaggatgagacaggagaatcacttgaacccgggaggcggaggttgcagccagctgagattgtcccactgtactccagactgggcgacagagcgagactccatctcaaaaacaaaaaacaaaaacaaaaatggggaataagctcatttgtccagtaaatggctagtaaatgatagctctggagtgtgaacaccagcactcaggctgtggcatcttgctgtcctgcctccttctgtaaagactcgtgaagcttcctgctgggtagttcctggtacctctgctccaggttggccactggcagcaggcctgtgccagggtgcatgctggcgctatatgatccgtggggcggaggggagtatccccatctcctcaggggcctcccctatgtcacaccctgaggctgggcccagaccggtattcaggaaaggaaactgatctgtcacctcacccctgcctggggcagcccagcatgtgtcagccccctaatccccgggtactgcccaggacaagcagtaacagggacaaccaccctccaacatggggaggcctgcaacagctctggggcagaaggaggctcagggaggtagcaacttaccacccagcagctcgtggagctagtgggtggttgagctgggatttggacccagggcttggctctggtgaggggggatgtgtctgccatggggttgtctggtccagagatccaggcctagctcttttatgaaaccttaatttgttcactgataatagcaagagttgtcatttcctgaatctaacctccccaaagggtagatactcaaatctctgcttttttttttttttttttttttgacatggagtctcgctctgtcgcccaggctggagtgcagtggcgtgatctcggctcactgccacctccacctcccaggttcaagcaattctcctgcctcagcctactgagtagctgggattacaggcgcgtgccaccacacctggctaatttttgtatttttagtagagacggggtttcaccatgttgctcaggctggtctcaaactcctgacctcatgatctgcccgcctcagcctcccaaagtgctggaattacaggcatgagctactgcgcccggcccaaatctctgcttttacaggtaaagaatggaagcacaggctgggagtggtggcacatgcctgtgtcctagctacttgggagactgaggcaggaggattgcttgagccaaggacttcaaggctgcagtgagatatcattgcacctgtgaatagctaccgcactccagcctgggcaacatagcaagatcccatctctaaaaataaaaaatataagaaaaaaaaatgaatagaagcacaaaggaagggaagggatcacccaaggtcctatagctcatacatgggttaatccagaattggaacccgggcagccttgctccagagtccggtctcacttaatgagtactagataattctctgcatgtcagatgggtacactcttcttgaacctgctagttcttttggagccagatctggggagggggagcaaggcaggagttgagcaaatagcaggaacagactgtgtgacacttgctgggaggctccgaggctccagctccctgagcttagaagtgcggagtttatctatcccctgcgcgattcctgggggaagggaaggacaggcgaaggggcatggcggggcagtcctggtgtctccaggaccagggtcagggggaggccagagcaattagcctggctgaggcctctgctaactcagaaacgtaagtgggggattggtccaggcctcactccagggctctggcctcgagcctgaccctcctgagtttctatctgaggcttccagagtcttcctggggcagtgaatctcagagtgctggtttgtgtgagaactttgttctgaaatttcccttttcaacaaccaaatccctgggctggcctgcctgccccacttccccctcttggaggaaacggatgctttcctcttgggcggccacatgatttgaataatcaagtgtttcccagctggcctctggccaaacggagctcagctgggcaaggcccccagttggggcactgaggcaagcctgccaacctcctcatcccgccacacgctccagccaccgagggtaaaatacaggaaaaatgcatggcccatagacttggctgggccaggccccagactattcctgtgatggaggcagcgcttgtcttgggctttgtcccatctacctggagaaagctgagtggaggaagaaaaaggctgcccctgctcaggaaattcctgatggagcggcctctcctggcgtgctcacctgggtgctggcgtcttggcacttgtcagggtggagagaggaggaagccagtcaagaaggggaaagacgggtgcgggaggacattcactgattcaacaaacatctcattagcccaactgcctgtgaggcccagggttaggtgctggaatcacagatggatctgccctggattttgccttcaaagagtgtgtgtaggctgggctccgcggctcacgcctgtagtcccagcactttgggaggccaaggccagtggatcacctgaggtcaggagttcgagaccagcctgaccaacatggtgaaacctcgtctctactaaaaatacaaaaattagccgggcatggtggcgcgtgcctgtaatcccagctactccggaggctgaggcaggagaattgcttgaacctgggaggcagaggtggcagtgagccaagatggcaccattgcactccagcctgggcaacaagagcaaaactctgtctcaaacaaacgaacaaaaagagtgtgtacagaaatggtcttgtaagcagactcccccacagagccctaggtggtagaggatgagggaaagcatgagaggccacctagctaagccttgggcagaatggccgcaaaggatttctggagacagcagatttcatttatttattttttttgagatggagtctctgtctcccaggctggagtgccatagcgccatctcggctcactgcaacctccgcctcccaggttcaagctattctcctgcatcagcctctggagtagctgggactacaggcatgtaccaccatacctggctaatttttgtatttttagtagaaatggggtttcaccatgttggccaggctggtctcaaactcctgacctcaggtgatctgcctgcctcggcctcccaaagtgctgggattacaggtgtgagctaccacgcccggcctactttattaatttttaaccttttttgctgcattatataatttttgatatgtggtgtttttaatcattcagttctaagtaattttaagtttctactatgacttttctttgatccttgaaatttttagggactttttttcatttctaagtgtaggggtaatgatttatacttgtaaacgcttagcttctcacttaattgatggtcacaggatgtggtctatgtgaaaacttattatttgaactgtgagacttactttttggcctggtaggtgatgaattatttaaatgtttgcatgttcctgaaaagaaagtgtgtttatgtattttgtttctaccatcctacatttttatttcaatttgttctgctttttctgttttatcactttaaaaaattatctgtggcttttccctacaaagacaagattagcattttctcatgtcccttgctcccctgcctctcttcagtttccacacccttcactgacatgctcccctcagcccccatgatgtcacatgaaaattgtctagatttttaaaaaattgtctaattctgagttacagatctatgttattcttgttcttttcttttcttttcttttcttttctttcttgagatggagtttcactcttgttgcccaggctggagtgcaatggtgcgatctcagctctccacaacctctgcctcccgggttcaagcgattctcctgtctcagcctcccgagtagctgggattacaggcatgcaccaccacacccagctaattttgtatttttagtagagacggggtttctccgtgttggtcaggctggtctcgaactcccgacctcaggtgatctgcctgcctcagccacccaaagtgctgggattacaggtgtgagccaccacgcccggcccttcttgttcttttctttgaacttgaatttgttttgaaaaactaaactttactaaattatttgctcagtcttcagatatcttgaatacaatctgtggaatttgctcctaattaaatcattcctttaaaattatttgattctttttttggagggggcgaggggctgtctttttgtacaaacctgagcccttgatgctgtaacttttattagcctttaactttttttttttttttttgaggtggagttttggctctgttgctcaggctcaagtgtggtggtgtgatcttggctcaccacaagctctgcctcctgggtttaggcgattctcctgcctcagcttcctgaatagctgggattagtggcacctgccaccacacctggctaatttttgtattttcagtagggacaaggttttaccttgttggctaggctggtctcaaactcccaacctgaagtgatccgtccacctcggcctcccaaagtgctaggattataggcatgaccaccacgcccggccagcctttaacatttgaatggctgtttagctggatagaaaattcccagctcaatctttttttccttctgtagtttggtcaattcgacatttattccatttgtaagtgttctgttttttgctaaacctttaggatgttttcattgtgtgtacgtgttttttttttttttgtttttttgtttttttgttttttttgagacagtcttgctctgtcacccaggctggagtgtagtggcacgatcactgctcatacagcctcaacctccccaaataaagtgatcctcccacctcagccccctaagtagctgggactgcaggtgcacaacaccacacccaggtaatttttgtattttttgtagagatggggtttccttatgttgcccaggctggtctcgaactcctgggcttaagcgatcctcctgccgtggcctcccaaggtgctgagatttacaggagtgacctattcaggcatgagattacatgcctgacctattcagtttttttttttttttttttttttgaggcggaatctcgctctgtcacccaggctggagtgcagtggtgtgatctcagctcaccgcaacctctgcctcctggattcaagcaattctcctgcctcagcctcccaagtagctgggattacgggcatgtgccaccatgcctggctaatttttttttgtatttttagtagagatgagatttcaccatattggccagactggtctcggactcctgaccttgtgatccacccaccttgacctcccaaaatgctgggattacagacgtgagcctccgctcccggccgacctattcagtttcttaatggtatgttttgataacaagaggttttcaattttgatgaagtccaatttaccttttttttcttttatggaattagtattctttgcctaacccaaagtcatgaaaatattatggagtcagggccgggcgtcgtggctcatacatgtaatcccagcactttgggaggccgaggtgggcggatcacctgaggtcaggagttcgagaccagcctggtcaacatggcgaaaccccgtctctactaaaagtacaaaaattagctgggtgtggtggtgggcgcctgtaatcccagctactcaggaggctgaggcagagaattgcttgaacccaggaggtggaggttgcagtgagccaagattatgccactgcactccagcctgggtgacaagagcgagactccatctcaaaaaaaaaaaaaagaaaatattatggagtcagtattctttgcctaccccaaagtcatgaagatatccttttatattttcttctagaagctttgtgattctgacttacaattaggtttatggttaatctcaaattaatgcagtaagattggggttaatgttcttttaacttttctttcaatgttctgtttctttttttttttctgagacagggtcttactttgtcacccaggctggagtgcagtggcatgaacatggctcacttcagtctcaacccctggccttaagcaacgctcccaccccagcctcccaaatagcagggaccacaggtgcacaccacacttggctaattaaaaaataattttttttgtagagatgaggttcttgccatgtttcctggaccttccaaagtgttggaattccagtcatgagccaccaagcctggccaattttctgtttcttaatccttccctgcttcctcctggaagcgtcctcaagctaataacttagctctctcctccatcgttcagcagctggatacactctgtaatttattctacttatgtgtttgttatttcaactggtttttcacatagagtgtttccactggggtcttttaaccattcctctttctgttttgctaacatctttgctcatttcttttgcatgtttctcacagtttatggagactttttgtttgcttcattttgtttcgtttttttgagacagggtctccactgttgcccaggctggagtgcagtggcgtgatctctgctcactgcagcctcgacctcccgagctcaagtgatcctcccacttcagcctcctgagtaactgggactatagttgtgcaccaccacggccagctaattttttttgtattttttgtagagatggagtttcattgtgttgcccaggctggtctcaaactcttgggctcaagtaatccacccgccttggcttcctagagtgctgggattacaggtgtgagccaccgcatctggtcctgttaatggtttttctttagaattcattgtgctatggctggtagtggcgtggggtgggattcggggagccatgcacttcttgcccttaaaactagcagccagggaaaacgtatggctcctggatcctccctctcaaatcagtcccaaatactgaaaagcaaaacatcactaaacctaggcaattacgatttttgcttattttaaattctcagtaaatctgatctaatacggatgattccagcggtatctctaatcagtttgggtttcttttgaagtcattgtgctccttggatactctgttctttaacttgtgagcttactccgtgggggatttcagctattctgtttgatgctgtgtctttggtaagagtctaaggctgaccctagtcgcccagttccaatgagtccaaggagacgacattgccaggacgggaatccctggacatcagaaccacttggtttctcactaggtgtgacatcaccattctccctcccccagtgactcactccacaggattgggcctctctttcagaccccagggagaaacagtgaggagaaggggctatatgcctaggtcagaattcttcagactggggtctggaaaggaaggggtggtggagtgactgtagaggccccctgtagtgactgtcggtcccctcccaattcctgcagttccacattgtttgctggcaagctttgaatttttttttttttttttttttgagacatggtctcactctgtcacccagactggagagcagtggcatgaacatggctcactggagcctcgacatcctgggttcaagcacacctcctgcctcagtctcctaagtagctgggaccacaggcgtgcaccaccacatccagatcatttttgatttttttttttttttttttttggagacagagtcttgctctgtcacccaggctggagtgcagtggtgcaatcttggctcaacctctgtctctcaggttcaagcaattctcgtgcctcagcctcccgagtagctgggattacaggcacccaccaccacacccggctaatttttgtatttttagtagagatgagatggggtttcaccatgttggccaggctggtctcgaactcctggtctcaagtgatccacccgccttggcctcccaaagtgcgggattacaggtgtgagccacggcgcccggccaattttttgatttttttgtaagagacagggtctcactttgttgcccaggctgtctcaaggtcctgggctcaagcgagcctcctgccttggctcccaaagtgctggaattatggcccagcccatgctttgactttatctcagtagacacttgtgccatcctcctgggctgctttatgcaagatactttttgtgggtttcatgaaaatgtgggcttagtgataagccataagttaattgaggggcagaacaaaggtgggttggacaatttggggctcacatgtcctgggatagagagccaaaggggctctgggaaagggaggaggattctgggaggacacggagtcagcagagaggaggatggagtttcaacaagcccagagctgaagttggagactgaggtctagggtagcagatgtgggctttgccaggaggcaggtccagagggtggctgtggggctgaactccaaccccacacccagctctgaccttagttgttccaggacagtgggtgtgtgtatgggggcctgggcttggaacagagaggcaagaggagaactcaaaccctgttttcttttctgtaatattctctccaccctaaagaccatgccctgccttttctcctggctgcagcaacccctccccgccaccctacacacactagtttaaactctcttccatctcccaggagattctgtttccccattgttgcctaggcttagtggtattttgttctgttgttacttgggattgatgttgagaaggaggacccaggagccatatgtcttctctctctgttggggcaaggagcgtgtggattccccaatcccctgtcccaccaccagccagagcacaatgaattcaaaagtaaaaccataaactgattagagacaacccagagtcagtggtattagaataaaaagaccaagattttttttttaattttttattttttgaaatggagtcttgctttgtcacccaggctggagtgcaatggtgtgatctcagcttgctgcaacctctgcctcccaggttcaagcgattctcccacctgagcctcccgagtagctgggattacaggcacctgccatcatgccctgctaatttttgtatttttgtagagatggggtttcaccatgttggccaggctgatctcgaactcctgacctcatgtgatccgcccgcctcagcctcctgaagtgctgggattacaggcgtgagctactgcgcccagcccaagaccaatattttaaataaacatcagaaacatgagaaataaggaaacaagagaaataaggaaaaacatttgcagcataaagtagaatgagagagtgtaaaaaataaaagagctgaaagcaaatattcaatatgagaaagcagcctcattctctgccccacccaaacctctgcgtgcaccttacagctccctgttctccaggaaagacgttcacggcttctggaccttggcatgggctgttccagcagcttagacttccttccctccacttctgctgaaacacttcagcacatcctcaagactccttccctgaccatgcctcatggtcaaggtgacactcagtgatggcatagggttctggagtcaggacaccagggtgcctgtcctgattcttcaactaattggctgtgtgactttgggcaggtcatgctacctctctggacctcaggcttctcttggagaaaaagatgaaggtgttgggttagagtattcctagagtccctttcagtttgttgtgataccatggtggggagcacaagctttggagtggggctgcccaccagcccttcctgggtcagcacttaacgctatgtatcatggagcagttctttcaacatggaaagccaccgtttacttaccctaatatatgggttaagagcttgtagtttggagttggacaatttgggctcagaatcccagctctgctgcaggtctgctgtgtgacctcaggcaagttacttaacctttctgtgcttttttcctcttcataaaatgtgaatgatactaagagtacctacctcaaagtgtaggagcacagtgaatgcagctgtcattctgctggtgacagttgtttcaccactatacagacatctcctttcagtttggtagattcttgatgattatctgccgggctctgctttccaaatacactctctgttgaattttaacttttaacggatgctctccactgcattttatctgtaaaacaaccctgcaaggtgaggatgaccaaccttgttttatggataaggaacctgaaaccccaaagttgctttcaaagctacacagccaggacttaaccccaggtccacttcccacaagaccaaggtctttccaccatgccacactattcagaagattagactgggtctgggcacggtggctcacgcctgtaatcccagcactttgggaggctgaggtgggtggattacctgaggtcaggagttcgagatcagcctggccaacatggtgaaaccgcccatctctactaataatacaaaaattagccaggtgtggtcgtgggcgcctgtaatcctggctactcgggaggctgaggcaggagaatcgcctgaacctcggaggtggagtttgcagtgagccgagatcgtgccatttcactctggcctgggtgacaagagtaaaactcttgtctcaaaaaaaaaaaaagaagaagaagaagaagaagaagaagattagactgggacttgggagattaccaaatacaggcagatgggaaagcacagtgagaagtctcccaggctggagtgcagtggcgcaatctcggatcactgcagcctagacctcctgggctgaagcgatcctccagtctcagcctcctgagtggctgggcctacaggtgtgtgccaccatgcctggctaatttttgtagagacaggatttcgccatgttccccaggctggtcttgaaatcctgggctcaagcagtcctcctgccttggcctcccaaagtgctgggattacacgtgtcagccaccacacctggatcctacatgtatattctgactgtccgcccttggccatatgcaagatgccttttgtagtttcatgcaaatgtgggcttagtgataagccagaagttaattgaggaggcagaacaaaggtgggttggacaatttggggctcataagacctgagatagagagccacaggggctctgggaaagggaggaggattctgggaggacacggagtcagcgaagaggaggattgagtttcaacaaacccagagctgaagcttcagactgaagcctagggtagtggatgtgggctttgccaagagataggcccagagggcagctctggggctgaactctagccccccaccgctgtccctcaccctggtgtactcttgagggtctgggtttgtggtttcagtttcttcctctgcaaaagggctgctagtaccccttggtagagttaggggagagggcacgagggagacaggaggccctgggcaagaatccagttgcgctggttgtattgacatgcatggacttgagagttatcctgaaaccctatccctccttatctgtgatttgggaatcacgttctggcctgtgtgggatcattgcaaggccacagtgaaatgatttcttggtgagaccttctctgatctttctatttaaaactgcaaacctccctgtcctcctccctgccttctttttccccgctgtacttaccgccacctggcgttctattgcttttacttacttccttgttgtctgcctgccacactgacagggatttgggctgttatgttcagcacctagaacagcccctggcatattgtggctgctcaataaacagtgttccagcgaatgttggttgaataacatatagggaaagccctaggcatagaaggtgtttagtcaagatcagctggatcttagagacatagggcagacgcctgagaaaggctgggacagctcacttggggtgacgaggtctcccatgaaagcatttggggtctggatttcagggcagtgctggtttcctctctggccacagcctgcaagcagcgagccatataggagaggaaagtttggctgggtgtggggcctcacccgggagtcccagcactttgggaggctgaggcaggaggattgctggagcttaggaggttgagagtctgggcaacatagcgagaccttgtctctactaaaaataaaatcaccagccgaacgtggtgctgtgcgccggtggtcccagctacttggtctcttgctgaggcaagaggatcgtttgagctcgggaggttgaggctgcagtgagctatgatcgtgtcactgcacttcagcctgaatgacagagcaagaccctgtctcaaaaaaaaaagaaaggagagtgaagctggatgggccaaatactggggcttctgaagaagtcaagaccttcaggcagacaggaagctcatgacacttagctttctcgttttctttagctttttaaaccactctgactgctcctgagtggaacaaactctcaaagaaatgatagcctcagcccactccactccaatgactaggagaaaaagcagtagcactgggcccaggcagatctggagacatggcttggccctgcccctgtttagcagagggacctagggcaagtcacttcaccttgctgagtctctactttctcctctgaaatgggtgtagtggtattctccctccgaggccttttgtgtaaaacctactagaaaggtgaattataaccagtcattaccaaactgaagggcctggaaggcagagcttgtacctgcaagtcctgtcacagggctggcacacaatagatgcatggaacctggtggtcaaagggttgtaaacttcaatggacaacaacctgtcagaaagtgaggatctgagtcctgcagggctattagacaagtccagccccaaaactttctgtaattctagaagtttatagattccaagtagaaagtgacttgtaggaagttggactcttacattaccacatacttgaaacttgtcagctttagcttgtttgcaagatttttcctctggcagaaacagctggcagaatatgaatgacctgatttggttgctcacaatctaaagcgctgagaaaaactggctgagctgcagttctgaggtcagactctgtgttccaagtaacagaaaagccaagacgcacaatggggaaattaattggctcatgtagccaggatgttcagaggaaggcttcaggcatggctgcatctaggagcccaagtgatgctatcaaagactcaaggtctctacctttctctagtccatctctgagaggttgcttcctcttcaggctatacaaagtgcccttccccaccacttcacaccctcataacccagcaagcagacagagtcttccagctggagccagtcagggtccacctggagctggaggcgggatcagtcccacccaaaccaggctgaaagggggagggtcacttcccaaggaaacttggtggtattgttaggaaggggaaacagactctgggtggccaaaaatgacagtagatgtccactccactcaccagagggagtgcagtggagagccgtagaaacttctgcattgtaccttttgatttgcaaggttccttccctttttttttttttttttttttttgagacggagtcttgctctgtcacccaggctggagtgcagtggcgcgatcttggctcactacaacctccacctcccaggttcaagcgattctcctgccttagcctcctgagtagctgggattattggcgcccgccaccacgcctggctaattttttgtatttttagtagagacagggtttcactgtgttagccaggatggtcttgatctcctgaccttgtgatctgcccgcctcggcctcccaaaatgctgggattaaaggcgtgagccaccgtgcccggccaggttccttcccttctaagacgctgatactggaggcagaatggagtttattatccctgctctacagccaaggaaacagcccttgaatattcagcgaggactctgacttgtaaccctgggctgcccccactgatctcagcctctctgtgcaaaattataagcccagaggagctgacccaggagggagaggccaacgtgactgaagcccctcactttgtggagcgggcactctgtctagatacaagaggcccccaggaagctgcgatcacgggaaagtacacagggagctgagagagcagcatgacatgaggaccagccacagggcagcagccaggcatggcttcctgcagctctcattgccagaaccaccccccccaccgccatccccctacaccccagcagagtgagctcatgcagccccactgaggcagggctccctgtgcctgggatggctgaggcacgagctctgccattggtgaccgaggttgtcctggcatgtgactgagatgggggtggcacgtacactggacatggagctggacggacctggcctgaatcccagcgctcccacgtggttgctttgtgaccctgaacctccctcctgttctgagccttggtttttcctcctgagccggagctgatcatttgcacttcactggaattcgaagactgggtgaaaagcccccggcgcgtagtagttgctccatagagtttctccctcttcctctttgggtcctgttagtagctatgtgaccttggcccagttccttgacttttctgtacactgggagcaatgagggcgttggtgtgaggaccagatggctttgcgtgtaaagtgcttagagcagtgcccggcacactcgtgatcactgttacttctggctaacacctattgtttaatgcgtaccaggccctgggtctttctctccttgtttattgtctcactgaattcttgttcctccagtgacgtaggctctcaccaggatggtccccatttgacgggtgaggtggtgtgcccaaggtcaatgggggcctgctgagctgcatgcccttgggtgggacctcacctccataggccccagtttcctgtctggggctctcggcgtcagccctgccctactatgtcccaaggtcgccgcggagatcaaacgcaaaagccaccggagccttctgtggccggctggagcgtcctctgggaatgcgaggaacgctgttatctggagcccagctgccctgagcactgtctctgggaacacccgcgtccttcctcctctgatctgagccctctgcgcccgccacccagggattcggcttgtgctggccgctgcccagcaagctacaagttcattgtcccttttcccacagcccggcgcctcctcagcctcctctcacagggcctgcgtggggccatctgcacaatggacacatcctctgctagggggaggggagtggggagagccgggattggccaatgccctgtcttgaggatgagttgaaggaggggattatgggtgggggtggccagggtgcgcccacctggccgggggcagagccaggtcttgaatgccaggtcttgaatctgggatcctcccctccctgccactgcaagccccaagtgagttgcactgcagggctggctacaagataccgtgcaaagatcagaagagacttggaccctagatgtgacattctcttgctgtgtgacctctggcaagtcacctcacctctcctgtaaagttatgattataggaagccctcccactgggaaccgtggtgcagatacaatgaaataacatttgggaacagagtgtagtgagtgtgaatcaaatagcagctgcacgcaatcccttcatctgcaaaagtataatgtgtctgtgtaatgtacatattgcagagagggcaaatggtggtttgtttccagtcttgcctcctgtttgaggagtttatgcttagtcctgggagacagaaacatccccaagtaaggctgaattctggctcgctcacttactggctgtgtgaccttgggcatgctccttaatctctctgtgcttctgttttgtcatctgtaaaatggggataataatagtgcttaccttgaaggttgttgtggggatcaagtgagttaatataggtaaagtgtttagaacaatgcctggcacataataaggtctatgaaaaggtttgttattattaatcttatgaatacgatgacaaaatatgtaaaataggatttttctaaaatagtctcagtttgaaatattttcatcagttgccgcaaatcactaatgtacggaagtccaagacattggcatccaagctgcgccttgaacactgccttgcctttccagtaattgccccccaaatcctcagctggttagtggggagacctatccctgcccctgatgtgctgtgtgacactggggaggttgtgtaccctctctgtgtcttccttttctttttccttttttttttttttttgagatggagtctcactctgtcacccaggctggagtgcagtggcacgatcacagctcattgcaagctccacctcccgagttcacaccattctcctgcctcagcctcccgagtagctgggactacaggtgcccgccacccagcccagctaattttttgtatatttttagtagagacagggtttcaccgtgttagtcaggatggtctcgatctcctgacctcgtgatctgcccacctctgcctcccaaagtgctgggattacaggcttgagccaccgcgcccggcctgtgccttccttttcttgttgtttgtgagagcaaggatgggccggccatgtctcctagtaccagggaggctccccctgcagagggctgagggaagtgctggaggaggtggttggcgaacaccgcagatgtagtgcgtgcgccaccctcccccaccgctttctgtacttggcatctaggcttggcacagagtgaggtggcctggggcagaacatgtcctttccatggcatggcagaaggctgtgtgcctgcaaagcagccatgctccgcccccgacccctgcctgggcactgcaggccccaggcatggtgtctctgggccctgctatctccctcccctgcgatctccctactgcgcctccctgctgcttctctcctgccactagtcctctggcttcagtcctctgcccacagagttggtttggggcatcatgaccgtcctggagcctcagggacccccagagaagctttggcttctctgaacccagaccctcagggtttctgattccagctctgctgtgtggccttgagtaagtgacagtcagagcctcaccctcctcacctgtaaaatggagctggcaatggggcatgtagtgagatgaggcatgcagagggcctgctctccaccaggccgtgcttggggagcagagccctttgtggtgggtccaggctgcccctctgtcctgaatgcaagccgcctgctcgtgcctttctccctgaaccccaaactccacacattcctgcctccttgcctttaaacactcaggtcctgttgggagtgtcctctctctctctctgctcatctcaaccccatcatccttccagcctggtgctcgacccacccccacggacacttctggcccataccctgtcctagactttctctctctccccttcaagatggaaaggaagtgtcaggctacctggcaggttactcctttcttcccaagtgagtgtgtgagggagagagagatctggttctctttggagatgggagccctttgactgtaagaataggacctctgccgcttaagaacaggccctttgaagggaaagtactcagcaggcaggtgagcttctgggttctagagtctcagagctggaaggactgtctgcagccatccaggtgaacaggtctctgggaaatcccaaagcatatggtggcttgatcgagtgggcggggaagggtccatccgttctctgctccagcccctcatctgccccacttgcccatctctgccccgcagtccatccacctcatttgctccccctccccataaccctagctcctgactgacattcactcagcacctaccacatcccagcctccgttttacacccttgtgtgtatgaaggcatccttacaacaacgcagtggcttctattaggtgtggaggggtgaggtcacctgctctgagctgcccagctggtgaggggcagaggcaggatcagaatccaggcagcctggctccagcatccatcttcactgctgctgagctgtctcttcagccacccaccctctgaccccatcatccttccacctagcgacattccctggccacccggcctgtgccggcctctgccagccacggggctgctgccatcagcagagcaggattccagctccctaggagctcaccacggtgagagggtgacaacctatgattctctaaggctctgattaatttcaccaagggcttcatggcactgggtgctgggagcttggggaggagccgaaactgctgtctgggctggggtagggtagggagagggcagggggagggattcattggttggacagcatgggacattctagtctgggaagcacagagtgcagaggtgttgaggctgggagcgctcaggggacagctgggttctcatcaaagccctaaagatgcagtggcttggcaccaggcctctggggtacttccacgtctgtttcctgccaggatggggtgctgtcaatggctagaagtctgagccttactataatccccagcactggcccactgccctctagggaagtccttccttggatctgacctgcagcccactctgaaaccaccacacattcctgcgcaagcacttcatccagctcttcatgacagccataaataacttcctccagtaatgaatacagtcctggccagcaaggcttgccagagatgctgggcttggcggagagaggaattccatgtcccttccctatgactctgcagctgaaatgttactgggctggtcttcagcagggctccctccctaggcagctatgcaggtgccccccagcccctgcctcattcctcatgcccaccagggacacaagggcaactcagcactcctctctagccacagctccttggaagagcccagaaggcccagctgacaggctaggggatgctggctccaagctgactcagttccctatgtgtgcctctggtggggagcagctgagagatgcagggtctgcttatagtggttcctctcaccgggcaaggctttcctcctctttaggcctcagtcttcccatttggacaatgggatgatctctaagacaaagtttcccaaatgaatctgctcagaaaatgacttgttaaaaatatagcttccagccaggcgcagtggctcacgcctgtaatcccggtgctttgggaggccgaggcgggcggatcacgtgaggccaggagttcaagatcagcctggccaacatggtgaaaccctgtctctactaaaaacaaaaattagccgggcatggtggtgggcctgcaatcccagctactagggaggctaaggcatgagaatcgcttgaactctgaaggcggaggttgcagtgagccgagattgcgctactgcactccagcttgggtgacagagcaagactccatccccccaatccccccaccaaaaaaatacagcttccagctgggcacagcggcttatacctgtaatccaagcattttgggaggctgaggcaggaggatcacttgaacccaggagttcgagactagcctgggcagcatagtgagaccccacctctattttaaaaatgtaaacattaaccaaatgtggtaatgtgtgcctgtagtcccagctacttgggaggctgaggcaggaggatcgcttaaggctgcagtgaactatgatcgtgccactgcactccagcctgggcgacagagtaagaccctgtctcaaaacaaaaaataaaaaaacagcttcccaggccctgacctgggagattctgaccgagtaggtctggaataggagaagtaggaatttatttagggggctgttatgtctttctaatctgtccttttaaacttgcatatagtcacatccctccactaaaccctttttttccccaacactccctttattgaaatctcatcagctcctccccaaaaacctcacgatatagacagggtagggacgattagcccctcgacaacttttcacaaatatacacacgtttaactacttctcaggtcatgataaagaccggccgggcagaaacactgtaatcccagctactcgggagcctgaggcatgagaatcacttgaacctgggaggtggaggttgccatgagccgagatcacgccattgcactacagccttggcgacaagagtgaaactccatctgaaaaaaaacaaaacaaaacatttccattgccccaggaagttccttcatgcaccgcctagtcaatcctcctcccaaggtaaccacttgggaataagactttttccataagcacctcaagtgatttttgtggctcggggcatttgggaaatcgcaaaagaccttcccagcctggacagtctggggctgcgtgctctagaccgggggctccctaagggcaaatacctgaccctgtgagtcctgccaggtacaagctggggcataccagctgatgctccctggaggcacatcagtttattaggctgcttggtagagccttggagggtgtccttggagcaggcctgggagctgggtgggcttggatggggaaggcccccggctgagctgaggtggagagagcttggcacaggggtgtccctgggtaggtcccacatggaggcctgtgcagggcctggcccagtacctgccatcgatgtgacctcttcaccatggccaagtggacctccattttctcacctgtaaagggggacagctctgtctcactctcagggttgttaatgaggacacagcaggtcaggtgtgtcacagtcagcacctggtgcaccgtagttcttgaatgggaaaccaatgttagacgccaaaggaaacagtttcggaggtgcagggactgacccagcaacacacacctgggaagtggtggagcttgggcttggatcagatttgctggctgtgtgacagctcacccagtgacttcattgctaggccttggtttcaaaatgtggtgactgagagtggtgctaaggccctaagtttgggtcacactctcacctaagtgagaacctgaccaaaaagggggaattttaaaacaaaattatgagctgggcgtggtagctcacacctgtaatcctagcactttgggaggccgaggcatgtggattgcctgagctcaggagttcaagaatagcctgggcaacatggtgaaaccccgtctctactaaaaaatacaaaaaaatcagctgggcatggtggcatgcgcctgtagtcccagctactcaggaggctgaggcacgagaattgcttgaacctggaaggcggaggttgcagtgagctaagaccgtgccactgcatgccagcctgggcgacaaagtgaaactgtctcaaaacaaaaacaaaattatgagaggctgttgttttggactaaatgcatacactaggccccaagagaccagacgaaacctaaatagagtcacttgtgctaaatgtgatatcatcaaactaaaactttaaaaagaacacataaatgctaaaaccaggttttgttttgtttttttttcttgtaaacaggacattccaacattaaaaaaaataccctctaacccttaaaaaaaataacctaaagtctttattcccaccttacaaaacccactgtcctactgtttcccagtgggtttcgagaccaaataagtacatttacaatggtgatagtgacatcagtgactcgttttggtcaatgtctcaaaatttaaaaaataactaaaagaagggaattattaaatcaaatctagcctaatgctgccttcttacatattttaagttcagcctagcagtttctctacattgtaaactataagaaatagaggtgtaaacagactatagcctacacttgtgccaatcaccaagttttgggggtttttttgtttttgtttttgtttttgtttttttttaagacagagtctcactctgtcgcccaggctggagtacagcattgtaatctcagctcactacaacctccgccacccgggttcaagcgattctcctgcctcagccacccaagtagctaggattacaggcgcctgccaccatgcccagctaatttttgtatttttagtagagacagggtttcatcatgttggccaggccggtctcgaactcctgacctcaggtgatccaccctcctcagcctcccaaagtgctgggattacaggagtgagccaccatgcccagccaccaattaccaagttttagccaatcaaatgtcgccaactgttcaaaccgtgttcaaatgacaagtgctaagctgtaaccaatctgactgcacctcactttccttttctgttcataaatcttcttctactaagtggctgcgctggttcctactccggctcaggaggctgcctaatttgcagatcgttcattgctcaattaaactcttttaaatttatttttttatattttattttattttattttgagacagagtctcgctctgttgccaggctggagtacagtggcacgatctcagctcactgcaacctctaactctctagttcaagcgattatcctgcctcagcctcccgagtagctgggattataggcacacaccaccatgcccagctaatttttgtatttttagtagacacggggtttcatcatgttggccaggatggtctcgatttcctgacctcgtgatccacccacctcagcctcccaaagtgctgggattgcaggcaattcttttaaatttaattcagctgaagtttttcttttatcaatagggctaataatccccaccctgccagtatcactaggatgttgtgaggatctgacgcaatttgagttacgggaatgttgagaaagaaaagggcgtaatggagtaacgagattagttttcctgttatggtgaggtcagtggcctttctggggtcaagaagaggggactttccttggcaccaagagggtaaaagtgtctcctcctgaccttgggtattttggaccatgggatctgaggtgtaccaggagacaggaagtgtgatcagaaaaggcctggtctaatggtgcacagctgtgcatatccaagtggcttgacctctctgggccgtttctgaatctgtgagatgggaatcataaccactctcctgacttcacaggatgttttaggagagattggatctgggttggggagacaattttggaagcagaaaaggcccctccgtgctggcaacagctcgtccacctccagcctgtgtgtgctgcctcctgggtgactgctggctttaggccagcgcctggcagggcttcactaaagcctccgtaggctgctgctatctcagttctgaggtacgggccgtggagacccccagatttgggcttaaatcccaactccaccattgcacctctgagcctctgtttctctgcaaatggggatactagtccctagcccagatggggcctggtacacagttggtgctcaataagagcagttcgtcttcttctgagcatgggtgcatccctctggctggggtaagcaccaactcagatttctaggcccatagatgggctggaacagctgctgctgttaggggaaaacctactgtgttactagccaaggggttcccttccatgtttttgccccacagggcacctggcacaatgtctagcatacagtaggtgctttgtccacactggctggtcagttacctccaagctgacagaaactctgtcccgttcccgactgtttccatagaacctagcacagagatactcagcaggtgctctgtaggtgtttgggagtgaggaatgaatgaacaaagttgaatgaacaagcatcgggccctcccccggggctcaaatgggagagaggagcttcgtagcctgctccccctcccaccccagcaccccgtttcatcccttctgactaatccacaaagattaacccagggataaagcgggtcacggccactgacccagggctttggagctagtgtgaccgagtgtgtgcagggcgtggtggctgctcccaggggccctctttgccccaagatggccctcctgtcccccatcctggatgtggtcctcacggtggccctcagcctcctcctcctggggctgatcctgggcctcctttgtttcttcacttgccgcctggccaggccgctcaggtaggggaactcagctggcctgactccccctgcatcccgccaaattccctgccctaagctcgttcagcttccatttgttctcgtgagatggagcaagcggggcactcatttctcttactcttcatggtggggaaaccaaggcccggagaggttgagccctggcgtcagcctgggcttaaatggcgcatagtcgaagactagccaaaccctctgttgggtttcctaagctacaaaacgggggctcttcatccatattgtgagatcagggatgtaaacagcatggggctgagtggaacatgagggcctaagaaatggtagtgacacgtttgtcccattcttctatcatttgccccagatcttctgagacccagcccaaggctggctttttgccccactccaggatgctcccgggccctctgcctgggttgctgaatcagtcctcagagctaaggcctgcctggctcctcagccccctgcactgaactgccaagtagctgctcctctggcgccacagcctagccggggcttctgcactggccatgcgtaatcaggctacggaggagccgggagcctggcagagaagggagggagggggtggcgatggggctgacacacacccggaggccccattttaagctggcagacattggcagagggtggtgggcagccggggcccccacagccccaaactgggcccctccgcttccagggctgccacagagcagccaggagcctctgcgagggggaggggtcctaggggtggggccagcagggaggctctgggttctgaaggctttcccaggtccccaccctctccttgtcctgagcggaggctatgggagaaggcacctgcctccaggccaagcctatctcaatgcctatccctggggccaaaattcagagcatcccagcctgaactggtggcacttatggaactgctaccatgtgcaagggctcgggatgcagagatgggtaagatgttggtctttacgttcacagagcttcaggctagcagggaggagagacagaccaataaccggaagaataatcatgtggggctggatgagcctttcagtgctcccgggtcactacacttttatttttctttattcgctcacctgttttggaccctcagtgcagagagagtgggatacgttatctcacttagcacatgacatacccaaataagctctcagttcttgttttgtttattcattttttcctttgtccctgctccctgcctccccactgccattcccacagctcaccgaagtccctatgctaatgtacttaatatggccttggagttgtaagtgtccttgtacgttacacagcattctgtccgtgggggtggtttgcacttacatacactgcgtttgattctttacattcatcactcagtcctctgcctttagaccccaccacgctgctgtttggacatctagttttaataccactgccacgcagacattgcctccaccactccttactaattcatttccctagttgtggacgagactgccccggctcctcaccatcataagccagtgttaaaaggagtttgccaaagctttctccagcgagtatgatggtttctgcaggttcttggcataaagcctttatcagattaaggaaattcttttcaatacctggtttgctgagggcttctgtcacatcgttttctgtgaccccattccctctccctaggtgagcacgtcaagtttgatcagggtgttaactgccacccctgtgcctatgattcccaaatttatactctaacccagacttctttttcaaatgccagagccaaatattcagctgcctccttagtgtctccacttctaaaagacatctccaactcaacatatccaaaaacaagttcctgattgtctccacctcacgcctcaaaagaccaccccaaacgccgaaaggctgaatgcttttttctttttcttttttttttttttctgagatggagtctcactctgttgcccaggctggactgcagtgatgcgatctcagctcactgcaaactctgcttcctgggttcaagtgattctcctgcctcagcctctcaggtagctgggactacaggtgcacaccaccatgcccagctaatttttgtagagagagtttcaccatgttggccaggctggtctcaaacacctgaccttaagggatccacccgcctcagcctctcaaagtgctgggattacaggtgtgagccatcgcacttggctcggtagtatatggctcagaaacattgccatttacaatagttccccaaaaagcaaaattcttaggtataaatctggattcagagtccagaatgctaaccattacacgatggaacccgtaggtataaatctaagaaaacatatccaagatctacaggctgaagactacagagtgctgataaaaccgaagaactctgactgaatgagtggagagacgtggtgtcttcatgactgggcaactccatgtggtatagacgtaaaccctcccacattgatctgtggatttaataccatacctatcaaaaacacagtggtggaggacagatcagggatcgccaggtttagggatggggggattgtgtaactataaagaacgcaagagagatttttggggtggcagagctgttctgggtcctgacggtggcggtggtggttacataaatctatccatgtgtcaaacgtcagaacactcattttacacttgggggcaacagaaatccctccctctggagggggtgactgatggtaacctgattgctaattctggaatcaggagccctgtggtcaggtttctgctctgcaacttcctgttggtaaccttgggcaagtctccgtccagagccttggttttctcatctgtaaaaggagatgataggtccttttctgtccactgcatagctgattagtgaaacatcatggtgaaattctttatgaactatggagtgcagcacatagacttgctttcattttgtcagtatcctttatagattgttcatgtaagctcccaaagagtagtatttattttattgaaataaaatgcacgtagagaaaaatgtgtgtatcatacattgacagctgaacccaccgtgtaaccagcacccacccacccagatcaatcataaaccgaaccgcaccagcaccccagcagcccgttcccgtttccgtaccctccacgtggagcctccgttctgtctcccaacgccctgggttagtttttatactttctgtcatcggaatcacactgtaagtgctcttgggtttagcttcctttgctcaagcttaccttgtgcgattcattcatgttgttgtgaggagctgtggatcatccattctccttgctgtctgtggtggtttctgtgttgtgaacacacacaatgtattatccagcctgccgtagatggaggcagttttgaagccattataaacagggctgatgtgcacattctgctggagagaaacgggtcccagggtacaggtaggatgatcagcttcggtagatcctgccggttttcccatgcgctgtgcctgtctgcactccaccaacggcgagcggaccttccggtagttaaacatcttcacgaactcttggactttcctgcacacacagagaagataattttggatggctcttcccttccccccacaaccttccttagggcactggctttcaactgatgtaaatatttactatgccaagcactaggagggcagagacaaacaagacaaagtcctcacacttagaaactcccggtgtggcagctgagatggcccaggaaagaactatattaccttcaaaaagagaggtacatgcgatgtttgaggtggcatgaagctcagtggtgttatattggaatgagtgagtgaccatcctggagccttcctgaaagaggtgacttcatttttaagtgattttaaataatagtttaatgaattagtatttcgtattcagttaataacatttttctgattttaggatttgctatagaaatatttggaaaccgtaaagtagaacaaaaaaaaaaatgtaggaatcatctgaaattccaaattctaccactcacagttaagtgttgttagatgttagatgtgggatattgccttttaatttccactctgcgccgctacccccagcccctaccccagagccgtcacttctggcactggagcgcagcttgcgtggttttttttttttttttttttttttttgagacagagtctcgctgtcgcccaggctggagtgcagtggcgcgatctcggctcactgcaagctccgcctcccgggttcacgccattctcctgcctcagcctcctgagtagctgggactacaggcgcccgctacctctcccggctaattttttgtatttttagtagagacggggtttcactgtgttagccaggatggtctcgatctcctgacttcgtgatccgcccgcctcggcctcccaaagtgctgggattacaggcgtgagccaccgcgcccggccatttgcgtgtttttaaggttgaatcaagatccttcttctggtggtagtggtttctttttctcccttcccttcccttccctttcctccccttccctttcctccctcccctcccctcccctccctccttccttttctccttttctttttctctatttttaaattaaaaaaaaaaatcttggatgggcgcggcagctcacacctgtaatcccagcactttgggaggccaaggtgggcagatcacctgaggtcgggagttcgagaccagcctgaccaacatggaccccatctctactaaaaatacaaaattggccgggcatggtggcgcaagcctgtaatcccagccactcgggaggctgaggcaggaaaattgcttgaacccggggggcggaggttgcagtgagccgaggttgtgccattgcactccagcctgggcaacaagaacaaaactccgtctcaaaaaaaaaaaaaagaaaaagaaaaaatctttttcctttgagctggagctgcaaagagaagaatttttaaaaagaaaagaaacttttaaaaaattaaaatacaaaaatttttcttagagacagggtctcgctgtgttgcccaggctggtctccaactccaggcctgaagcgaacttcctccagcctcagcttcccaagtagctgggattacaggcatgttaccaccatgcctggctttttttctttaaacaacttttaaaaaatgttttattttgtttttacttaacatataataattggactagagtggtgtcttatctgtcacaacacttttctaacggtagagtgtgtattactgctgtttcccacaacaaatggtgtcatatcttggttttggctgaagcaataacatttcccagtgaaactcttgccacttaaaattctttgtcttgtaactcatgtgcaacagggttagtacatttctcagctgccagtggggttgttctttgtgatttaacaggaagaccacagtgtaaaaacattcttatgccattaatacatgcttgttttaggctacttggaaaattcaaaaaaataaagaggaaataatcattcatagtcctaccacccagagaaaaccacagttaatgttttggtgtatttccttccagtttttttttccacctaaactcttcaattacatccgactttaaatatatatatattttttaaaaattgtaaagataatactgtatctcagcacaaaagaaaattttggaaatgcagaaaagacaatggaaaagaaaaatcagttgtctgtgatgtcaccacccagaaatggccacacttaccagccagttttttcacatatgtgactcctaccatttttatatctcttaccataaacgacaagctctagaagagaatgtagcaaatgtaggggtcctgaaagaaggggtgcactctgttttgtccctgatgttcctgggacacaggtaattaaaaggctgaagaccgagtgctgtagaacagggcttctcaaggtgtggtccgcaaagcagcaaagcagcagcttctcctgggagcttattagaaatacaatcggagcctcaccagtgggccgggaatctgttgtaacaagcccttgggggattcagatgcttgctctccttacagtttgagaaacactgcaccaaaagattggactctgggaggtagggggcttcagatgaattgaaagtggaaattcacttaggaaatgggacggaactgctttgcagcatggaactcattgacactgacacagctgtttgtgtggttaagcttcctgagacagggaccagctgggtttggcatcccaatgttgagccccatgcctggtctgtaataggtgctcaccgaatacttgttgaatgaatcaaggaatgaataagtgagtgaaaaaggatctctagagctgtgccccacatgcctctttttctctttttttaatttctaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccaggtatgcttggggacacaggtggaggcataaaaaggtggtgcagatggggtatgatgagggcagtgtctatgttttaaggtcccagaaccatccaaagtatttaagagctgaaaacagtgttcagagcaggaaacctcagccctgctacttgcatgtgttagttggataggtcactcttttcccatatatatatatatacacacatacacatatatgaaatatatatatacaaggaaaatatatatatacaaggaaatatatattttccacatatatatttttccatatatatatttcatatatatatttttccatatatatatttcatatatattatatatattctttcttaatttttttttttttgagacagggtttcgctctgttgcccaagctagagtgcagtggcgccatcttggctcactgcaagctctgcctcctgggttcacgccattctcctgcctcagcctcccaagtagctgggactacaggtgcccgccaccgcgccaggctaattttttgtatttttagtagagatggggtttcaccgtgttagccaggatggtctcgatctcctgacctcatgatccgcctgcctcggcctcccaaagtgctgggattacaggcgtgagccaccgcgcctggcctgtctgtctgtctgtctgtctgtctgtctttctttctttctttctttctttctttctttctttctttctttctttctttctttctctctttctttctttttctttctttctttctttctcttttctttctttctttctttcttttctttttctttcctttctttcctttcttttctctcgcatccgagtgaagagaccaccaaacaggctttgagtgagcaacaaggctgtttatttcacctgggtgcaggcgggctaagtccaaaaagagagtcagccaagggagatatgggtggggccgttttataagataggggtaggtaaaggaaaaattacagtcaaaggggggttctctggcgggcaggagtgggggtcacaaggtgctcagtgggggagctttttgagccaggatgagccaggagaaggaatttcacaaggtaatgtcgtcagttaaggcaaggaccggccattttcacttcttttgtggtggaatgtcatcagttaaggtaggaacagaccatttaaatttcacttcttttgtgattcttcagttacttcaggccgtctggatgtatatgtgcaggtcacaggggatatgatggcttagcttgggctcagacgcctgacactttctttttgagacagagacagactctcactctgtttgcccaggatggagtgcagtgacgtgatctcagctcactgcaaccttcgccacccaggttcaagtgatcctcctgcctcagcctcctgagtagctgggattacaggcgtgcgccgcaacacccggctaattttttgtattcttattagagacggggtttcatcatgttggccaggctgatctcgaactcctgacctcaagtgatccacccgccttggcctcccaaagtgctgggattacaggtgtgagccactgtgcccagcctttttcttgtcatttgtagttctcactagtgaactcatcttcaacaggagttttttgtttttcttttttttgagacagtgtctctctctgtcgcccaggctggagtgcagtggcgcaatcttggctcactgcaagctccatctcccgggttcacgccattctcctgcctcagcctcccaagtagctgggactacaggtgcccgccaccacgcgcagctaatttttttgtacttttagtagagacggggtttcaccatgttagccaggatggtctcgatctcctgacctcaggtgatccgcctgccttggcctcctaaagtgctgggattacaggcatgagccaccgcacccggccgagttttttgtttttctgttggagattcacgcggaagtgtttccacagcatggcatggtgttttcaggacactaggggttcaactaattctaggccagtttttatgttgatttcttggtttacaattcttatactataaattcagatccccacttagacctggctcagatttgacttgaattcacatttcttatgaatgactgtctttctctatcccttccatagctccaaggcaaaatgtgtaccttaaaacagcttcagcagacctggtgtggtggctttagcaggcctggtatggtggctcacgcctgtaatcccagtgcgttgggaggctgaggtgggaggatcgcttgagtccaggagtttgaggacagcctgggcaacatagtgagacctccatctctagaaacaaacaaacaattagctgggcatagtgctgcatgcttgtagtcctagctacttgggaggctaaggtgggagaatcacttgagcccaggatttcaagattacggtgagctataatcaaaccactccagtctgggtgacagagtaagactctgtctcataaaaagaaaccagcttctggccgggaatggtggctcacgcctgtaatcccagcactttgggaggccgaggtaggtggatcacttgaggtcaggagtttgagaccagcctatccaacatggcaaaaactcctctctactaaaaatacaaaaattagctgggcatggtggcgcactcctgtaatgccagctacttgggaggctgaggcaggagaatcacttgaacccaggaggcggaggttgcagtgagctgagattgcgccactgtacttcagcctgggcaacagagcaagactccatctcaaaaaagaaaagaaaccagcttcagcctgaacctgtacctggcttgccgtcgcaggcgttcctctctgcatcagctcctgtgggcccctctggttttagattccctcatcaatgctgcctcctgaggattttccttcccccttttcttcctttttcaagctatgtgctatttttttttccccagcatttctgtatctggagctggagaagagagccttcctcggctcagtccattatgtggctagaagtccccacttgccttccccacactccagtgtctccatctgtccagtggggatgagttcctcccgcttagggtcatcatgggaatcacatgggatagtcacagtgtctggcaaggagtggatgctcagtgaatgttggtctcttctcttaggacggctgtatttcagcagatgaggagatggggtgcagtggggcactgagcctgagctgctgagctctcaggccattgctgcgtctgagacctcgtggtgccatttgcatccctgggggaccaaggtcactctgggacggggtccctgccttctcagcacttacagcccacctgggtgaaagatgaactaatggatgaaaagggaaaaggtgaaaaagtgacaacatgaaaaatcttcaaacgttcagcagttcaactttttgtatctgctgttgccaggctggagtgcagtggcacaatcatggcttactgtagcctcaaactcctggcctcaagcagtcctcccaccatggcctccaaaagtgctgggattacaggatgagccacttcttcagccttcttttttttcttcaattagatataacttacagaaaagggcaccgatcttaaatacatagcctgaaaaaattttgacatatatttatacccatgtaaccgccacccagatcaagacagaacatttctggttgtgaggcatctgtgggcttccctgtgccaaccccctcccaaagccagaggagatgcccaggcttacattggccaccagagacttgctttgcctgttttgagcctcatataaatggaatcatatagtatgtaccgatcagtgccctttccctggcattctatcgtgagcattagcacatatcatttagtagtctccaaaaacaatagcctcttggaatccagttgtccagagccattgttgcttaaaccagactccaaacccttctcagggacaggccctgggtggctctggtgaaaaagacaaggactctgcccttgtgggactccagtctagagagaacaagcactcaacggagcaggggacccggtggcagaggctgggctgaacaagggcaacaggtgtggggcgggctgatgtcagcccagccctgggacctccaagctgttaagtcaggtacaggttgtagcgggtcagggtgggtagaaggtcttcaccacccagtggcacccaactggccaaagaggctctatgaccaacagcaccgtggtgtgttttgaggaaggcaggagggaggctggaaccagcctgggcctgggggacctctgaggaaaacctctggccccggccttgcccagactttatctcatgtcatcctagaactgcctgtggatagctacgggtgtcccatttcctggggcagaaactcttgtccaaaggcaccctgtcgggcagaagggccaaggtgctcccaattcccagtggggactgcgtggggacatctgaaattgatgccctcagcagacacttccagaagagagagggtggacctggggctgtcgggatgagggtagtgggctgagggattggggtggtggtgacgtaaggggaggcctcttggggaggggcgtggggtgtgcttgggtccaaagctagaggtgcactgcagcaccctggcggctcctcgcctgtgctctgcgcctatgctaggctggggcagagccacggcgacgcgtgagtttccggttctcccacttggggccctaatctcaggctctccatttcctaatgtggaggagacactggtgcccacctgccaaggcagttgagaggaataagagaagctgtgtggggggtccctggcatctcgcccagagccagtgcgtgtgtgaggaaggagggctgttctttacccacggccactccgagagccaggcacgcgtcggagctgggccaaaagatgagaattgtgtccccagcccacgaacatgctacacggccttggacaagaccctcccattcctgatctctcctcccgttctgtgcagtgggaggccttgaaagaggaaaccgctagggagcctcctctctaggcttctgagcagatctgatagggccctgggacagaggggagccccgcagactctgggagggactccagctcccatagccagggtcctggtccagccctggagacgggataatggggatgggaggcaacttttgagcctctcctgtgggtcaggtgtgtcacttgccttatccggcccagtccttagagcgaccctgaggggatgatgccagcaatgtcatttaacaggggaagagactgaggctgagggaggtgacagagctagtacttggagcagctgggggttttttgtttgtttgtttttgagacggagtctagctctgtcacccaggctggagtgcagtggtatgatctcagctcactgcaacctccgcctcccgggttcaagcagttctcctgcctcagcctcctgagtagctgggactacaggtgcacactgccacgcccagctaatttttcatatttcagtagagacgggatatcaccgtgttgcccaagttggtcgcgaactcctgagctcaggtgatctgcctgcctcggccttccaaagtgctgggattacaggcatgagccaccatgcccagcagctggggttttaattgaggtctgtctggcactaaagctgtggattggttgctggacacacacacacatgagaaagagggagagagaaagaagtgttcttagttctcattttatctcaaaaccataaagccccagccagaagtcactatcagccaagagggatggagggggcgatgagagatgcagaatgtcgtccttgataactaatcctaacaagagtgagatcacctggctcctttaaatttgacatattaagcaaaaggcaagcttcgctttccagcactgctattaaaccaagtcaggttcctgctgagcctactttaatgaataagctaagcagagttgataattgatggctggctatatcaggggaccccttctgctggaaggagtttgttgaataggttaaacattactctcttaattgtgctagcacaattcatttgctgccttagcagctcatctccctactgggtagaaggaatgagcatgggctttggagcgaaacccagccctgccagtgtctgcctgtgctgtgtggccttaggcaagttgctcgttgtctctgagccttggtttcttcattctgagatgtgaggagaagaccccagggtccacaggcttttctggaggatctggatggcacatatttataaaccacagatgtgttgtctgggtgggcaactattgcacccacctccaagttcaggcattccagcctgagcaatcagaagtggggggatctgtacgtctggagataggaggctatccttaccccgccaagtaactgcctctctctgtgtttagagaaagagaaagaccccaagtactggcgagaccaagcgcaagagacactgaaatatgccctggagcttcagaagctcaacaccaacgtggctaagaatgtcatcatgttcctgggagatggtgaggcccaggggcctgtgggaggggtggaacaggacacctagctaggagccccgggagccaggctgagttgaagggggctgtgttgaaggggctagggctctggaggaagggtgtttaaaaggatgaggggccaggctgtggattcaagaggcctgctctgccagacagccccctgaggatctgggggtgaagggagagaggggctgctcactgacatttacagagccatgcccagtgccaactgcccgagcctgccttggtaccgaactagagagcttctgggtacccaagcaggctgattggagaggcaggagcacgagagactgaggcccccactccccactgcagggatgggtgtctccacagtgacggctgcccgcatcctcaagggtcagctccaccacaaccctggggaggagaccaggctggagatggacaagttccccttcgtggccctctccaaggtgagccccatccccaagcccagttcaggtctgtatatccagtatccaggtcgagcatctgaacatgacagcagccagaggtcccctgaccccctgagccccctccatgcccaagcccactccccacctggagcagccactgccctgacttctgacaccatagcatcactgtacctgcttgcgggtgtgtgtttagagagagggtcttgctctgttgcccaggctgcagtgcagtggtgcagtcatagctcactgcagcctccaactcctgggctcaagccatcctcccacgttagcctcccgagtagctgggactacaggtgtgtaccaccacatatggataattagagacccccccaaggtctctaattcttgggcttaagcgatcctacagccttggcctcccagtcttgggattacaggcgtgagccaccatgcacggcctatatatgccttttttttttttttttttttgagacagtcttactctgtcttccaggctggagtacagtagcatgacatcagctcactgcaacctctgcctcccgagttcaagtgattcttctgcctcagcctcccaagtagctgggattacaggcatgcgccaccatgcccagctaatttttttatttttagtagagacaaggtttcaccctgttggccaggctggtctcgaactcctgaccccaggtgatctgcccaccttggcctcccaaagtgctaggattacaggcatgagccaccgtgcctggcctgtatacacttttgcatgaagttccagttcattcattctttcccgaggcagttcgtgaagttaattagactataggcatacctcagctatacttcgggtttggttccaggccactgtaataaagcaaatattgcaatgaagcaagtcacacattttttggtttcccagtgcatataaaagttatgtttgcaccctacagtagtcttttaagtgtgggatagcattatgtctaaaaaaatgtatataccttaatttaaaaatatgctattgctaaaaaacgctaatgaagtgagctcatgtttttggaaaaaatgatgctgatagacttgcttgacacagggttgccacagatcttcaatttgtaacaaacacagtgtctgtggagtacactaaaatgaggtgtgcctgtactgacctaggttgttcaaggcagtgtgcactgccgggtagctattgctattggtggtggtgatagtggtgttatgtaataacctccagaccctgggtcaggccccaggctcacttctgggggagtagtggggactatggtgccttctgtgccttcaaggtgctctcaggctggtggggaagggagacaggcaaatagttttggggtctctgctaaacatccggatgtagggcaaccctgtgatggtggccgcagggcaggtggcagagaagtcagcgctggtcttggccccacccttcccttccccagtccccttccccctcactttcactaccctatccccagaccccccactccttcaagaaggcccctccctctcccttctccaggactcccctgctccccaaccccttgctggctcctgcagccccaggcccggagagaggcctccgctgaccccacctgagccccaatcttccgccggacacttctctgtactttggagagctaaggtcctgccccagtgctgccagggtgcagggaatgatggcaggaagcaggcagctaggtagtcctgtggctctggggggcttcagtgggcagtgggcctggtcaaggctatggggtcctctctggtccctcacgccccagtccccatggtgtgagtgtaggcggggtgggtgccactggggcgaaggcctggccatctcctgaccctcctctcccacctgcagacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctggtgagtcgggggagcagtggggagcagggccagcttcgtggcctgtccaggcctcagtctttctgactgtgtcatgggaaggggctagaaaaggcttctctgtggggctcccagctctgatatgctgggagtctgtaatatccatgggattccttccgtgacaggggaagctgagggtttggggttcactcagtggtgggttctggtcccagttcatttctctgagtcgattcttcatttgactataaaacgggtgggaacgtagccccctcatagggttggtgtgaggagggagaagtcagcccagggctagcctgtggggtgcagtccatggccacgccccttccctcctcagaattgggaggcccagcctgtgcccccagaagctttagtcaggggccaaggccaaaacacaggtgacaaggccaacatacaggtgacagagccacagtccacttgagatccctcaggggtcctgtgggcgccttgatgaaggggaggactccagcccaggtgctcacatctcaagggccttcggggtgaggggagagggttccagaggcagtgttctggctgctcggctacttggaagccactgccagacacctgctgctgtggatggggagactgagacccgggcaatcctcagaactgaagcgggggcctgtctttagcggggagggggaagggagggaggaggcctctgggacaccccgatctgtggataaagccaaacccgcccctcctgcaccccagggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgagtgctcgggggcagccgggcagggacggggtgaggcggggcctctggtgggcaggaggcctcaggcccaggctggcccggagaaagcagcctggcctggctccccacacacctgggaggctcccagcccattaggggatttgcggttgggcaggcaggcactgtgggatttctctgcggtggggctgcggggtgaaccctcatgtgaccgccaccacaccccaagaaccaggcatccagggatgattccataaattgaaacctggtgctgtgccctcctctgccccccactacacgggaggtggtgatggccaagtgtcgtctgcctgccctgcgtattcacatggtcacagatgggtacatatctgtacactcaaccaccagcatgcccggcaaagagctggtgtgtacagtggttggctagtgccagctctcgtgtttaaacttccgagttccagaccttgccctgcgtgttgctagctgtgtgaccttgggtcagttacttaacctctctgaggcttccctttcacaactcctttgtgaactgtacctgcctcataagcttatgccaagaactgattaagataatccctgtggagctcagcacaggacccgaggcctagcgagtgcccagaaggtggtggcacttacgcaggagccacatgtccttgccctgaaacacacttcaacaaactgagctgactcatggagacagaagtcatccatgtgacgcttactctctgttcttaagtgagaatgcccggctcgttccttttcaggcttttattgcctactgtgggggactgctgaggcgatctggggacttctgccccttgagcctggaatggggattcggtgaggggcagagaaagcccccctgcccagctacacctcacctctttctctccaccaccagacaaactcacctgccttcagccctccatgcactgccccccacaaatttctgggggctacttggcccctccacagtagagacccacgtctgcccttttcccagcatggtggattaagtacccgctttcaggacacacagtgctgttggcccctttcactgaacagacatctgaggccaagccactcatcctggcttgccttcacccgacatgtggcctggggcgagttccttcccctccctatgcctcagtttccccacctgtgcagcagaaacagagagccacacttgcttgctcccagggccgtgggaggccgtgatgaggtcatggatgtgagaacatttgttgtacaggcacagggtataattacatggggactgctcctcagaggggtttgtcagggacagcctgagcaggggacaggaacttgaaggaaattcgaggggagggaagatgtttcaggtgagggggtgggagatgaggagggggggccgcaggggccacgtcaaggggcacaagccagggagtgagtgaggacggaggacctgtgtgaggatccctttctttcctcctcttcctttctctcccagccccacctgcctctccgtcaccacccccccaaaagcctcccagtccccagactgtacatgaaacaaaaatcctggtgtccaccctgaaaataaatactgttgcttaaaaaaaaaaaagaaagaagagaaagaaagaaagaaagacacaaacctaaaccccaaagccaaacagcaagtctgttatttgggagtttaatgagcccgtgtgaagtcgctgccgggctggaaacgatgaggctccctgcaggaagattgggggcttcgttttccactctgaagatgccaagaggtcaggttctgtgggaacagttgtggggggcggggcaagggacccgtgacctggggtccccttctccttcttctcccagcccaccctgccccctgagctcctggctgcagctgagagcaaggactctgcctctctgaaccacttgtttccccactccttctggcaatagaaatgccttccagtggcagccaccccctgggtgctggggacttccctgggtgactgcctttcctcctgtgatgggtctgtggatggatgttagttgcattttatttattattattattttgagacggagtctcattctgtctctaaggctggagtgtagtggtgcgatcttggctcactgcagccttcacctcccgggttcaagcgattgtcctgcctcagcctcctgagtagctgggattataggcgcacatcaccacgcccggctaattttttttttttaaatttttagtagagacggggtttcgccatgttggccaggctggtctcaaactctggacctcaggtgatccgcccgttttggcctcccaaagtgctggcattataggcgtgagccatcgcgcccggcctattttattttatttttgagacagggtctcactctgttgcccaggctggagtgcagtggcgtgatcatggctcacttcagtctcagcctcctgggctcaagtgctcctcctggctcagtcccttgaatagctaggagcacaagcctgtaccaccatgcccggctaagtttcgaaacaaattttatttgtatagacagggtcttgccatgttgtccaggctggtctcaaactcctggcatcaagtgatcctcccgcctcagcctcccaaagtgctgggattacaggcatgagccaccgcgcctggccagtcgcattttatggataggaaaactgggctcacagagtttaggtggcaggcccttggtcagtagtcgatagagtcagggttcaaacccaagtctgacttcaaagctcacggccatgaccatggcctggacccaggctggtcctggggcacctttcccacctctccagccatcctgtgttcctggccccctgtgcattccacaaaacctaggatctaaggtgggagacagagtggaggatagagcaagggacctatgagatgcaggcctggaatggtggatctggggccagtgtcagccaggctctgcactcccaaggtgtcagccaggggcagtggcccgggctggcacccgcggtgacaagagaacactagtgtggtggtcaccgcaggcggctgctgttatgctcttggccctactttaaaaatagtcagaacttcaaacatggactcccaaggaaaacaaacagtcccgcgtccgtctgcccgcacacaccagctggtgggtaaaattagcctggtggtgactacagagccgtgaggcccggccccgctgtttgcccaggctgcggtgggctggctcccagctgtgggctgccccaaagacctccctggctggagcctctccctgcacgcattcagccttccaccgtgggagaggaggctctgggagtccctgcccttagctgcacgaatacagcagggccctagtgccacagccggaaaagccctgggtttgaatcctgatgctgccacttcctggctctgtggccttcgggggaaaaaaccaatttctgtgcccatttttttagttggaaaacaggtggccagggtttattgcagccttggtatgaagttgagtcagaatgtatcttaaatgcttagtgcctgacacacagggaacgctctgtaaatggtctgattcttattcgagtgggagttctgtggattccgggaagccaagtaaggtaagttatcagctcctccaatatccctagaagcgccaaaccaccgtcccaatagactcgtgatttcatctccccacgctggacaagtaaggcccagagatgactgaggcctggctcaccaggctgggaaagtgtccacaccatctccagggactccaggagtccaggttccaagccgaggtcactggggcttctgggcatcttggaaccctgcagaagtgatggctcctgtctcttttaggtgatcatggggggtggccggaaatacatgtaccccaagaataaaactgatgtggagtatgagagtgacgagaaagccaggggcacgaggctggacggcctggacctcgttgacacctggaagagcttcaaaccgagatacaaggtagcctgtgctggggccatgtggctgcagaggtggcctgtgatggggagaggctgtgtgacccctgctctgaagttctgttgtcctctgtagaaagggcatcggaaatctttcctccatgggctcaaatggcctaagagatatacaagcagtagatagtcagtgactaatcatttccttcccttggaggggataccagagagaggcggatggtgaggaggaggctgggccagggaataacctgcgtggacattgagtcaccctgagcacctattgtatgtaggcacctggcggggcatgcgtgaggcacagaggctgagtcagatggccaaggaaacatggaatgctgtgtgcctgcatgggggacgcctggctctgcaggcgccctggggggacagatgacagggaggagccaagaagctctgggcaagtaggaggatggagggaggaggcagcgctggatggatcaggggaggacatggttggccccagtgtgcaagccatggagggagcggagaagccctccacagtgagtcccccttggctgggggatggaatagattggggaagggaggctggaggacggaatagattggggaagggaggctggagggacctctggaaggaccccaagctccagctccttggagtggcctctggccctttaaatctgagctgctggcctgcgggcctggggcagctggggtctggaaatgactgtggtcagggctgaagacagtggggagtagcctggcagccactttgatgtcactctggggttgggtttctgcaagttccaggactggcccctggggaggcctcgtgggatgaggctgggccaagaacgaggtgggggtagggactagggaagggcccccgtggggatggtgggggtgtggaactgagtggctttgaaccctttccatcccttctgagtcagctcaggctgggccagagccccctccaagctcaagccagagagacaccagcctcagtttctctacgtggcacatggggccagagcttcatcctccttgcccaggcagggtgcttacccaggaactcggtctagacctctaagacggggagagagcgtctacaccatggccccgagcctggccacattgggtatcaggtcccgtgtaggccccacatccctagaaaatcatgccttaagagtgggttttagagtcagtttcacctttaccattcagtggctacgtggtctgtgtgcctcggtgccctcatctgtaaagagggaataacaggaacaaccctggagggagagagcacaggagagccacctccaggaagcaggggctgggagggggggtgcggagccccactttctgagcctctctgccctcctccccacaacagcccctgaggcttgcaaagccactgatcccactgtcattgctaagagaaggcagggggtcttctaagggcacacagcagatccttggtagtgctgggacccctggtccaggcccacatggtgccctctccaggcctggcctagctggcttctttctgtggactttattccctggggaaacagccacgcctttatctcccctcccagatggggtccccaaagcagagctggggctttgcttcctccctggccctccacggcctccagaaaacagcccacacctgtcagcactcaaggcccctggagacctgtgcctggctcttctttgccccatgatccctcctccctggaatagccttcctgaccctaggctgttcaattcccacttgtcctccagggacccattagaacatcacctccaccaggaagccctccctggtcctgtgtctgggctcacggcctccctgggctctatcagaattctcatccccttgcattatacattataatgggctattgattcatcatttcttgaggtcagggatggtgggtcctcagggagagatttttaagtgagggaaggaaacaagtaaaggcctcagactctgatagctgctggggtcagtccttccgactctccctagcccccggcatgtgctgacacagcccttcctcctagcactcccacttcatctggaaccgcacggaactcctgacccttgacccccacaatgtggactacctattgggtaagtggagggggtggaggggaggatgcatggctcggagcctggtggccggagctgcgtgtggccagcacctggggacaaggccctagcctgacgcccacttaggggcctctgctcttgggcttcaggacctgggagaggcaaggaagggggttctggttcctggaattaggcctgaaatctgctggctgtgcagggggattagcctcattgggcacaagaagaaactgaagctcagagaggggagtggcccgcggcatgtggcacaagtgacagcggtacggcccaggcaagtttgagccctggctgggaactgggacttaacagctcctgggctatggagcctgggacctggagtcagctctactgtgtgcatggccagggcagaagccagccaagttatctctgcccatcctgacgattgccctcctccccaggcagtggggagcatgtggtgagggcccaggggcagcttcaggtctggtgggatgcagccctgagcaccaccatgcagctatccgggttttcttttccagctgtctgtagtgccaagcaagtggtggcaaaatctcctgcagacatttcccaaggaacacagctccgcgtcctgggtgtcattagaggttatgggctcagagctgtgcacctggtgggtcctccagacacatgcacacagcctcttgcttgcctgggtcacatggcacacacccagtaccacatgggctgtgcatgcacccgtgtatcatgctggttttgctcatggatcttagagccagagtgctgggttcaaatccagctctaccacctctaagctgtgtgaccttgggcaagtgatttctcctctttctgcctcagtttcctcttctataaagtagggataatgatgctcccataaaatggagatagtgatggggctggagacaacccctgggttgtcatgagcatgacatgaacttgtgttgtataagttatctgttgctgtataacaaattatctcaaaacttaggccaggtgcaggccgggtgcagtggctcatgcctgtaatcccagcactttgggaggccgaggtgggcggagcacaaggtcaggagattgagaccatcctggctaacgaggtgaaaccccatctctactaaaaatacaaaaaattagcctggcgtggtggcgggcgcctgtagtcccagctactcaggaggctgaggcaggagaatggtatgaacccgggaggcggaggttacagtgagccaagatcgcaccactgcactccagcctgggtgacagagcaagactccgtctaaaaacaaaaaacaaagaacaaacacgaaaaaacttaggccaggtgcaatggctcgcgcctgtaatcctagcactttgggaggccaaggcaggttgatcacttgagcccaggagtttgagaccagcctgggaaacatagcgagacctcaattctacaaaaattttttaaaaactggccaggtgtggtggcgcacacctttagtcccagctactcaggaggctgaggtaggaggatccacctgagcccaggaggttgaggctgcagtgagttgtgattatgccactgcactccagcctgggtgacagagcaagaccctatcttaaaaaaaagaaagaaagaaaacattagccaggtgtggtggtgccagccactcaggaagctgacgtgggaggcttgcttgagcccaagagtttgaggctgcagtgagctatgatcatgccactgcaccagtttgggcaacagagtgagaccctgtcacaaaacaaaacttaacagtttaaaacaagagtaaacatttattgcctcactcaatttctttgggtcaggaatctggggacagcttagctgggtctcccatgaggtcacagtcatctgaaggcttgactggggctggtgcttccaggatggttcactcacatggctggcgagttggtcttggctgttggcaggaggcctcagttccttggcacattgctctctatagagcagcttgagtgtcctcattacatggtggctggcttcccacagagatccaagagtatataaacagaagctacaacattttatgccccagccttcgaaatcacacaccatcatttcggtggcattctatggcatacaaaggctagtgtgggaggagaccacacaagcgcgtgaattccagggggcaggggttattgggcaccatcttggaggctggcttttgcctgcttccaaagcgctaacagcatgtggcaccaagtgaaccctgtgtgcatgggagctattgttcggctgtgtacccactcacagaggggcagggtgttctggaaggacaccagaattggaaggacaccagaatcagaagcaccagcatgggacacatggaactttgtgccatgggcaaggaatggatcattctccttatgtcacaagtgagaaaacggagcccagtgagcaggagggacaatgattccaaaccttctgctgtttcgctgcacaggccaccgtgcccttcaaatccaacatgtaaatgcacacacactctagcggccccatcgagtccaggctgtgaccctctgccttggggccacagtgctgtgtgctgagccctgcaggctggaggcagactgactgatggatttgaaccccagatctgccacttctcagctgacaatagcaagttatggaacacctctgggcctcagtgctcctcatctgtgaaacgggcatggtgatcccaccgcgccatagtggtgggaatgaaaatgaaaggaattggggctgggtgcggaggctcacgcctgtaatcccaacactttgggaggccgaggtgggcggatgacctgaggtcaggagttcgagaccagcctggctaacatggtgaaaccctgtctctacttaaaatacaacaaaaattagctgggtgtggtgatgcatgtctgtaatcccagctattcaggaggctaaggcaggagaatcacttgaacccgggaggcagaggttgcagggagccgagatcgcaccactgcactccagcctggacaacagagtgagactctgtctcaaaaaaaaaaaagaaaagaaaagaaaaagaaaaaagaaaaaaaaaggaattgggggcctaattctgggcccacaaaaatcacccagataaggatcctcccagccaccatactctaccccaagctggctgtggggagcctgcattccctgagacaccccagcttccttggagtcctcctagccgggtcacagcctctcagcatccacatcctcctggcgtcctcctcaggtctcttcgagccaggggacatgcagtacgagctgaacaggaacaacgtgacggacccgtcactctccgagatggtggtggtggccatccagatcctgcggaagaaccccaaaggcttcttcttgctggtggaaggtagggaccccgggtctgctgagagggggctgctggaaacacggccctggtgtcaggatggagaagtccagctcttaaagggaactgactggtttgggggtgaagggagaggtccctttaggagaataggttgtggaaggagacgggtggcactgtagacactcccagcccagcaagctgctctcctttgggcatggagatgcaagttaggttcagcaatccaggaaggcttcctgggagaggaggcagatttctcccctttggtagtctttcttggggacctggccctgaaggggcaagcagcccctcagcctcactgcccagaaaagcaaatccgcaggccccggctttcccacgctgtgtgctgatgttcccaggctctttcagcgccggccaggggccttgcagacagacctgaattcttggcctggcgctgccatctgctggcggtgtgacctctacctgtgcacttctgttatgtgaagccaaaaatagcatctgtctcctggagagtgattcgcctccattgtgttcagagacataaagtacttggaacggggcccagtaaagaataaaccgtgtttctattattagccttgttatggctacacaatagttaaggcgggaacaataggaagtgtgaggaagtgataaagattccagaaaccttccagtgctaacagcccttgcccaccgcagttcctcatgttgccctgctaacatcggtatgtatacacacacatgcacacacgtgaacatgtttgcacatatgctccccacgcatacacacatgctcagcgcctccgccttccagaggtgagcgtccgccagcccagcttggctgctttcttgccaaaccccggggttcccactcgagcacagcggtcttggcctggccccgaacaggcctctgacgccaaggagccagccagaaaccagcggtggtgagcacgggctcccccgggagcggtttcctttgtgagcaaggccaggatgggccgcccaggctagctgctcccagagccacaacaaagggaggacacgccctgccagcctgccgggccaccgcgaggctcagactggtgggaacagagggctgcctggcgcccaggaccctccaagctgggagtgtccaccaggcagcgccctcctgttagcaagggaagtgttcctttaaggtcacagagccctcggctgctgggccaagcctccagccaggcccctgcactcacccggaggtgggaagcgggggcggaggctgcgagggttcaggcttcggcagggctttgtggaacctgccacaggcactgcccaggcactggggactttcactacctctgggagctccgtgctttctttttagaggggatgatttgaggtagagatgaaaaacggggttaggacgagtcacacctgaattcacatcctggcaaatcccaccgtgggcttccccacactaggcctcagttgctccatctgtaaacaggactgatcatattcctctctgcccagcattgctgttcaggggaaaagagacatgggtgtgtcgtgcctggcacattgtagggattccagcgtgcccccttccctacctcccaaaggcttcagtgcctccttcaagcagctagagacagtgctgggaggggcggtgggaggagtacagcttcccggcctggtgaatttgattacacatctggactttgcagcccccatgcatgtgcctttggcaccggggctgtccctctctggcctccgtcaggttgaatggctgcgtaaaatgcctaggctgtggtgctagctcagagtggtgcccggcgaaggttcctgtccttccctagctaacaaaggttaatccagcagcagtgttgtggggctggggagcagatcttcctcccctcctccctcaccgaggcctttgccttggtgtcccaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtaggtgggccttctttggggtggacactcctggggtctcctgtctacccacctgggagcaggagtgggtgggagagccagcaagcccagagcatggtggggactcaatgacaactgggtggggaggaagagttactggggatggggagaaaatgcagggtgaggcaggggagtgagttgagtggtggtcgggtagacaggcaggtgggtggatggatggccacgttgaccatggctgggcgagaacgtggatagatgaatgagagaggatggctggctggatgatggatggatgatggatggatggatggatggatggatggatggatgatggatggatggatgggtggatggatggatgggtggatggatggatggatgggtggatggatgaatgggagggacatgggtacaatgaaaactggggaatggttagttggaaataataaggtttagaaggtggcttcttggaggcattgcagggcccttcaaagaagatcccaggggttaccaagccaccaaggagcctaatctgggggctggggactgtactcctggggccccagcatgacccctgaacaccccctccctgtgcaggtctggcccccatgctgagtgacacagacaagaagcccttcactgccatcctgtatggcaatgggcctggctacaaggtggtgggcggtgaacgagagaatgtctccatggtggactatggtgagacctccaggacccagggctgggaggggacagggcacccctcggggatgggcttgggaatagggtgtcagcttgtggtcaaggtcaggggtctcagaatgactggggcttgagtcccagtttgattgttgagtcccaggttgtttgattcaaacaacctcagtttgaatcgccttctacaatctagcagctctgagactttgggcatgtgacttcatctttctctgcttcagtttcctctctaaaagggttctacctttgacggttgtctgaatgaccaaatgggtctgatgagcttagcatagtgcctggcacaagtaggtgctcaatattttatactcatttttcttggccctataatattccagtatacgagactttgcagttagttcatcccatcccatatcattcattcgttcttgatactcccagtggttctagggggtctaaagatgcagcaatggtaagagtctccccgtcaactctccctgctaatccaagcagcccaaatgaggttaattttctctgttgggggttgagaatgcagactcctgtgtcagaacaggctcaggttcaaatcccgtggccttaggcaaaatgactttcccacattgagcctccttttcctcttctgtgaaatgggagcattcaagccagcctggaagggagatggaaaagctgcgtgcgcagcgccaggcccctggcaggctctcagcaggtgtttcccctggcccacagctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 1523 - DNA, 69048 bp, Homo sapiens; identical to SEQ ID NO: 1522
  source 1..69048: mol_type = genomic DNA

SEQ ID NO: 1524 - DNA, 69048 bp, Homo sapiens; identical to SEQ ID NO: 1522
  source 1..69048: mol_type = genomic DNA

SEQ ID NO: 1525 - DNA, 292430 bp, Homo sapiens
  source 1..292430: mol_type = genomic DNA
tatgattcatatgctagtttatttatcttattattgagagataatttcatgatgacagttatcaataatcaattacaatatcaagaaattcaaagaacaaaatcttgcagagactatgcttttgtatttggatttaaaaagtatgtgatctcattttcacataccaagctgagaggccatttagactatctctttgctaatttttgcttactgctgtagggaagaagatttccaatgaactttaaatatctcattcatgtctaccattgtcgaaaaagagaaggaaaacgaggaggccaaaagaagcagcaggacagagaaaacgccacatggattcaagagttgagacaactgacagtaaaatatatgctctttggttagcaaagcaaaaagggggaaagtattgcatacatgatagatacacactagcattctaaagcaggagacaagaatgtcaagagtgtattctacccccactgccagatggaagggctattattataaatgaaaggcagcagtagtggatgccaggcacttttgttgtgtgccagattctaaagtccagatgtaagcaggttacccctgagacaggacaggcttcagttcccgcagcagaacagagccaatcacagttttctcagtgtttatgataagctgggctgtagagccttccttcagttccactgtgactagcatcaatgacccactgtgcacagttttagctgcaaacctggaagagaaaaaagagagaccttttatcataagatggggagggtaaaggagatagcatacattcaaataggattaaaataactcttttttgtcaaatgaaataatttgctgcaggctccctattgccaaaaacccaaagccaagcattcttctgaaaaatcaataaactgtccagcccatgctaaccacaagcaggtaattttagtgcacatttaaaacagaacagaaaaaggaagtctattttacttattagtttaaacaatagatgcatgtgaataattctccattacaatatatttgagaaccattcatccacttggtatttaacatttcaccatgcatagggacattttaaataagccattgtatttttatttttaaaacatgttaagaaaaggtacctttctcaaagagcttcaaaatttaactcctcatatctgaaaatgattatgtaataagttagataattttacgtacattataaaattcttactaagtttcaatgaattcactcatgtaacaatattcaaattaaatctctaatgttaatgatgacatgaagcaaaatcacgtgacagctaagtgcaacctcacgcttccctttttctttgttttgaaatgtttaggacattagatctttctttctgtagagtgtaaacaaaaacatttccagaggaaactggaggtctaaagctctaactctaaattccaagacatgaagaacctactgattacacggaactaaaagcaaaactagccttttaagcactgcaattgactgaaaagccgttgcaggcataacgaacttctgtcaatcctgctaattcattctgcatgcacagttgagcctcagggtcatgaaggaagaggacaggaacctcccaagcctcccttttccacatgaagcatgttccacacactttttgggggagggggtttgattgcagggatgactggagaaaaacaaagttgctgcacatgagcttttgaaaacactaacaagtgtagagcaggtctgtgacctgctgtgaccccactttgcagggccaatccccttgcccctttctatatgacacgtgtctgaatctgagccatctgcctcaatttgcgcaacatcttcagccacaatggcacccagttagccctgacaacagctcacaatacataaaaataaaactgccgcgctaacagcacgctgcggactattcaagagcaaaccaactggtcagtgtctcatgtctgacaattagcatgggcctcgcacagagcccacggtgtccacagggatctgtttaattaccatcaacataaaagagggagtttatcaggagacactcagaaaaacttcactcccgacttaattaaaatattagccacttaagcaggaagcagattctctttaaatgaaaagtaatttcttttttgggttttttaaaaaataacatcaagatctcataacacattaatttttttaaaaccaaacaagccatttttggacaaataaaatcatgaactaggttgtccaacaataattagaataatgtatccaaaccaaaacagatatgctaattttactaaatttcaaatattataaacactttgaagttgtgttttaaaatgttagctaatgggctatcaacaaaatatgttagaaaatcttcctaggcatttgcttgtgcactctacaagcatgctgaaaacttgcaaggaatctgacagagcagtattcctactgagagaagcaattgtaagtaaccagtttaggaatataaatcataccaatgtttttaaagaggtttttataaacctcttaacacacacatccatctgcttttcagacgtacacatgagagattatgaactaggtacctcaatttcatctttgagaaacataaagatcaccagccctaaaatgatctctcttttctaaggctcctcacaggtttatgcatttcttttgtctaaatttttcaggctcttctgcttcataggagaatgctgtttctatattcctgtaaaaccacgtcaccaaaggatatgaggtggctctattttcccattcatttatgcaacttttcccacagattcggtcatcacgtgtgtaattcactcaacaaatatttcaacagaggtccctatttctgacagggttataattatgtaaacaatagtcttattagtccctttatttacttaacacttgtgccttgggaccatagagaaggagattatgcctgaataggaacacaaaagcactgttgtttgaatttcagggtggcacagccccaaggcacattttgtctcttttctattaaaaaacttagagttaatgttacaattaatataaagttggcagagacaaatgtcaattttggtgtcagtatgttgacagaaattagaattagtatcttggacatatttttgaaatcctattgccacaaaagtctcagtactataaagaataggggtatgaaagaaaagaggcatctgcttacgctgcaatggaaacacactaagcaaatcatcctagcaacataatctgctagctggtgtaaaagctactgcctttattaactaggtctctatgttctagtggacacaaatggtggaagcaatgttttaaagcggaagactagaagatcagatgttctgacattctcatttcacagttcagaaaggatatatttaattggaacacagcatgatcaaaattggtttgttttggccctcggaaggcaaaaaccactaccccagatttattcatcatttaactcctgcacaggctatgcttcaacatacatgcaaaaaatagttatggaaagagtactaattcataagtaataaatagctagctttgggatgtcagaaacattgattataaagtcagcgtgggtcagatatttacatactaaacttaatggctgacatcagaacctctgtgcttggccttgaactaagatcacactgtgacaaaattttttcaaaaggcatgagaaatttttgatcactataatgatgatagcagctatcatttgttaagcacttactgtgttctggcagtgggttctaagtgcttcactggaattatttcatttaatcctatgaggcaggtcactttatagatgaggcaagcgaggcccagagaagttgaagaacttcctcagggccacacaccaaatttctggttgagcagaaatctgaacccaagcattctgattccaggtcacacaaattatcttcatatatacaaaaatgcacccataataatttgtttttatcagtcaacagataaagtttttcccatttacctaatatacacataatctattattgttccaaaaacattaagaaggaagagtcctctcttcaaaaattgtttacttgattttgtagtaatgcgtaattcaaagcgtgcggacttgattcctcatatattttacatttctgcctttaaagatttaaaacattttaaatatcccctactctcctctccctaaagagacaccagcaatgaaaaatacaaagcctttttgaatggagctgtaacacagggagggactacggggagaccaatcaacctcgaaaagcagtaacaccacaaatgagaacaaataagtgcgatgacagttaaagatgtattgcctgtgtatgacgggctccatgttattaaaaggacaccatctagatatttttcatttcattctatcaccaaccacttgctgtttgtaatcaccaactgagaaggtaaaactgtttggctatatctgtatttcatcttattaaatgtctttgtctattatctccagcaattgacatttaatctttgaagcctataggaattcttaagatttacgaaaaagacagaataagctggttgtcaaagctaaataaaaaaaagtttcattcttcttaaaaagttattttgtcttaactatagtcataattataaaaacagaccaaatagcaacaacaaatttgaaaaaaatctaatatctataatacacagatttattctccatgcacttaaactatactttttaagatttgtaacaaactggctataaatcatacatgttctttgttagaaggaaaagaaatcctataattcaattgttctaacaattaacattaacggtacagcatgaatttaaaagtatttatctgagaggctgcgtcagtctccagggtagtcacaaacataacattttttacacagaatcagatttgctatacttaatgcaacagctctaagacatgctttttcttctcttggatagtcttcctggtttctgatttttctattctgagttcaattttcttgtgctttctgttctactggttaccagaagctgtgacaatgacccactcaggctaaaacttttttttttttgtactctgtacatgaagccttcaattactgcctgctgaagcagacagaatcctattagtaagaaagacgatcacaagatgcagtgccctgccctagctgtataaaaataattagtccaaagttgacaaatgtgtaatgaagtcgcacgatcattatatgtaagaaatactggttggaataagcctcctaaacatcaataccaaagtatagtgatttggagcgctatctgccaaaggatttaaaattataaatctttattaccttgagttattatagtagaacattttaaacaggcagagaatttgtaagttgtaaaaaattctattttgttgactataaaattgcattttaaagttaaaccattacactattgaattaatagtgaaggacaaaaaaagcatttacacgtgatttagttttagagaatttacacaaagcaatgtatttttcccagttatttaaaaaatcacctaacaatattgtagtattttcctctaacgttcaaatgagaaaagttaaaataaaaaataaacaaccaccataatttaggactctctagttcctactctaatcttcagagatggtataaaaaaattattccccacactatcaggccaatgatgcattctctttctttatataggaaagctaaaaaatctaagtgcccttgcttaaagaagacataaaacatcccagttatttcagagcatttctggtttgtctggtgggggtggggtgagatggggttaacaagggaaaactaatagtaaaacaaatacattcttaccccattctctttgattccttacaaaattgtcaaaccagaaggaaaagcatcaagaatacctttctttcatttttacgtgaaacagttacagattcccattagtaaaattgttgcattagaggacattaaatggtgaacttaaataaaacttaaatagagaatgttttaaagtaaaaatcagctgtgcagtttggttacttctgaaatatccaaatatgctttctgtgtgaaaattaactgaggtccgcatttgtttgtcaatgaactgatgctcagggcctgcagagttcaaagcagtcagataaaaatgcagtgctgtcctctagtggacagccaccaacctgagaaagaactgttttgattactaaagaggttctacaaatcttcagtcctgtttgagactcaaaatttgtcatattgtagaaaagacctgagcctgatagttttatacttaaaactatttatacaaaattttgtttctgtttatacaatgaagaaggttgacagtagtatcagggcttatacaattagggcaacaagatgtccaatgttatttgaaaagcaaaaattctttggagaattacaaattctccaaaattacccagaattcaaatcccatatagttaccaacagagaagaaaacaactaacaaacaaaaacagtaactcaaaagttaatcaaactaagaatagagaaagggaaatattagagaccccatcaagaagtgtctttgccatttgtgtttgcaaccctagcaccagcaaaatctgtcacaaaggtctccaaaaaaatactaagtgaaggagctacacattatagatctttttaggataccaaaaataatgtgtaccagtatttcccctattaacaaccttcaaacaggtatgcaataacagtgattaactgggtgagtttaaggcctagatatggaacaagttggccaggcacagtggcgcatgcttgtaatcccaacactttgggaaaccaaagtgggaggactgcttgagcccaggagttcaagaccagcctgggcaacatagggacaccctgtctctacaaaaaaaaaaaaaaaaaaattagctgggcatggtggcatgcacttgtagtcctagctactcaggaggctgagacaagacgattgcctgggcccagttcaaggttgcagtgagctacaactgtgccactgcactctagcctgggcaacagagtgagaccctgtcttaaaagaaaaaaaaaaagaaatgaaacaagttgttctttacctgtacttgaattaaataataagacttttattttaaacctgaaataaactgtctttatgtgtgttgataaattaaaaagttgactacttggttgccaatggatacactgtttcactcacagcaccagactttcctaatagttaaggacctagtgacaacagtaaaccaacatttattcgactaggattgtaattatccacaagttgcatatggtaaaagcttgcaaatttaaaaagtgacaggataaacaaaatccaaattactaattaagatatacgggggggtgggggagggggagaggggaaggaatatcagtagtgaatacaagttaataatgaaagttgctccagaatcttactgaataagctaagaactaaaatagaatcatggcagagacaggatgttctgtcttcaatcaaatatcaccttttctcctcagagggttaatttgcggttcatgaaaaggcaaaatgagtaggtaagtgtgacaactttttcaacaatattattgtatacaaatgtcaggatttctgactatgggtgaaaatgtgagatggctgagactgctgaaagacatacacagttatggtctaagactgttttatagacactgctctaatgtactcccgtaatggacaatacactgtcttgctggagcactctgggatatgtgtaagaaaaattaaaccaaacatctcatctactggcatcccttactgactaatcagtaaaaaataaaacatataaacataggaaaaaatattttgaaatgtgtcatgtggcattacagcttgataattccaggcagcctcaaactgtggacttcggaacatttgccttccaaccacttggagtgctgcctaaaatagagattcctgggctctttctcagatttactgaagctgagtttttggggtgggttccagaaatctgagttttacacaaactcacacatgatttttttgtacagaaaaaccttagcgatttcggagctacatgttttttgttttctgctttttggccactgcacttactcataagtgctgttatcagaggacatgcaatgtaacaaaagcaaggcacctcagtttccacgacattgaacacaaacctccttcctaaacccttcctggatatttcacagagaatcacatgaaagttttcctggccctgaatgaaactgggatccccacagctaacgcctctaatctcctaccttcgaacacatgaggtcttgccctttcacctttgcagtccattcatatactggtttaatgctgtccattttgcccttgggatacactttatttatgtattagtttactagtattgtcttaagtaatatgcattaagaccttcacaatgtatatctcattaaaataaatttgaatatcttacacaggaagtgaagatattcagctacatatttaataaatgctttttgatgatgatggaacttctcatttttgtaatactccttatcatgcgttaactgtaatttggaaaacagcagattgacgcaatgaccataattctgtatctctcttttttttttttttttttttgagatggagtctccctctgttgcccaggatggagtgcagtggaccatcttggctcactgcaacctctccctcctgggttcaagcaattctcctgtctcagcctcccaagtagctgggattacaggcgcctgccaccaagcctggctacttttttttgtatatttagtagagacggggtttcaccatgttggccaggctggtcttgaactcctgacctcaagtgatctgcctgccttggcctcccaaagtgctgggattacgggcatgagccaccatgcccggccactctgtatatctcaataagatgattttgttctccaagagcaggtttttcaagtaagtacgacagaaatgaagataaagttgagtctctcaatagtatactgtttggctctgatcctatcactcatttagaaaattacaactaaaaatcatataatctaacagtagagctgctttctcaattgatctttaaaagtgttaacgaaataaaaaatgtctctggtttttgaagtgtatttcataaaacctgtgcgcctttaattggcttttcttaatgagggccattttctgttgctgtgttaggaatcattttctattaagtgttcaattaaaatctgtactttataccattacatactactccacattaataaaggttcacttttccttagataattcttacactaagtatttctttacctggcatttaatgtaaaaatgtataaaatttgaagagtagtagaaataaagtattccaaaattaggcaatggaaactctattcattaaagggttagaacgaatacactaattcttattaaaagtcctctcagaaagaaaagatcctgaaaaattaaatagaacataagccagccaagagtaacttatcatattgaaaattttaatctcttaaaatactagtagtaaaaatgcttttcatacttggtgtttttaaaaataatcccaaactgattaccattaataaatattagagtggctttggtcctactctttataaactcaaaaacgtaactatcacaaaagaataagggaatcattcaaaatctcatagggatttcaattttatcattagcaattaaataatatataaacttagatatagaaatgtattaattccatggagtagggtaatataatatggaacactatagttaaaaacatttatttcaataaagtggtaaacagttaatttatattattataatgtaaacactaattcctatttcattttaaatgaaattaagaaaagcaaaaaaaaagtacaaaagtacgttttattaacaattgtttatttttgttttaattgctattagcaaaaagaatgagaaaaagtgttacatacacaggataataatttatgtcaatatctgtataaaaaataaaaataactttaggtgtttgttacctggaagctttctaaaatttagaacattattacagtcatactttagctataaaagcaaatatgaaatatttttcaattcagtatgatgggacttgagaagcaagttaagacagcacaggctattcttaagtatctacaggtattttattgacttttgaccctgtagtaacttgggccctcccccaggttacagagccaaacaccaggccactgatgatacggctagaacagaaaagcctcaagacactgtggatgagtatgaggaccacgaacattaagttttgggttcaatctctgcactccaaagtcaaatataaatggttcttagttgtgtgtctcctctgtattagcatggacaattgagaattgattgtaattttaatttaaatcatttgagcaggtattacaggtattacattccaaaccagcaagacaagttactggcaaactatctttaataagaattatacaactgtgctaagggtccctctaagtctatctcccaataggaagatagctttcattttatgtggctttgtaacttcacttttcttctttcttttctctttttttgagacagggtctcactctgtcacccaggctggagtgcaatggtgtgatcacagctcactacagccttgacctccatgggctcaggcgatcctcctacctcagcttcccaagtaactgggactacaggcatgtgccaccatgccggatttaattttatattttttgtagagacagggtctccctatgttgcccagtctggtcttgaactcctgggctcaagagatctacccactttagcctcccaaagtactgggatgacagatgtaagccaccttgcccagccttgacattttttcttctaagaaacaaaaatctagacagctgccattgctttcagaaaagttaacaaaaaaaagaaacccaaaacaacctatacacaaaacaaaactaaactagatgttccagcataaacagtggctactctatattaaaacaagactgcagtattgctggatactaggtgtttcaggtaaaatttcatactgaagaagttatacttgataatacagcattttggtgttttagtaaattcaataattccaaggacccataaataaaacaaaacagtttctgttagagaaaattacctaggaaagtgaaaagaagtatttaaagcagaataaaattaaaacaggaaaactcaaaatatttattttcactgaaaaggcttttgttactcttttccctattgaacaacattaactgataaataagttgtatttttgtggtggtctgtatcatgaccttacatccattttcttattttatcaccatcctatgtgagatagatagagcttgtcaaaaactaagaaatgaaagacaccgggcgcggtggctcatgcctgtaatcccagcactttgggaggccgagacgggtggatcatgaggtcaggagatcgagaccatcctggctaacacagtgaaaccccgtctctactaaaaatacaaaaaattagccgggcgtggtgccgggtgcctgtagtcccagccactcgggaggctgaggcaggagaatggcgtgaacccgggaggcggagcttgcagtgagccgagatcgcgccactgcgctccagcctgggtgacagagtaagactgtctcaacaacaacaaaaaagaaatgaaagcatgagacctcttgagcaacttaaaaaaaaaaaaaacagtacaaggtaaatctatttttcaactagtacatgcagtttttattccgccgtgattagtacagtgaagttaggcaactacggatacagtaatggcaggtcagctcttctgaagtcaaatctaatgttctttcatagctatcacagaatttcatttcaatcctacctcactttttcttcctgccacccatttccaaacacataaggaatgtaaagcacataagaagttataacttccccaagattaccaagcccattagtggcagagttagatctaaaacccaaatcacctgtagcatttttcatatggggcctctcttgctcctgtgttaacttaaaaaaatgttttttaaggtctgcaggccttccctttgatgctaaatttgttttctatgattgataattatataagaaagggcacactaaatatacagtgtgtagatatttttaatggcagaagtatgcctgccatgagatggtttgcaacgaattcccttaagctcacagaggactgtgcaatcaccaaatggataagagataattatttttatctttacattcatttaaagccactggaattcataaaaatacaagagggcaaacattaatcacattttctgctgcctttcaggacaaataacttggatctcatatttcagatgcttggtgatagaaaatattactggtctaagaaacagaagctgtatttacccccatgttggtcatctagcagctctttatttactggaagcagtctcaggggatggctatcaaaaggaaatctgtatgtagtacccaaacgtcctccctttcaattaaaaaagtccaactatactgctttatagaatagttcttcctggacatctactgaatctggtgaaataagataaactctcaaccacctcaaaaagggtaactttataaattaccaagctattataaaatgtgaatatgctctgtatatctttcaggaaagaccatgccagtatgataaggatgctctgagatgggaaagacagccttaatgcaaagcaatcaacaactataccatcagaaaaaaaagggagtgtgtgtatatatatatatgtttaggggttattatttccaaagaaaacaatgaatttaaaattatatatttatacatattcaagtcatcttcacctccacatcgtgtgttagtgaacctacctgtgtatattatcctggccagaagggactgcacctacattggctacatttacaaccttctgaaagatcacagagggagtgaaattctgtggtgcagcaatgattacagcagaagtttcattcattcctgttagcactcctgtaaaagcaaaagaaggctcccttttattaatttctttttgaaaattacatttacagaattttaagctcatggccaaaattttaactttttttcaacaaaagaaacactactttaggatgtaatttacaagataattataaaactaaaacaaaatgcaattgtttcgaagttttttaaaatcctcattgtataggaaaatgtgtaaaaattcagtaaaaaatcacttaaatctaattttaagtatgataggataaaaacttagaatcacacatatgaaatatcaatttcagtctctttaaagtatactcaatctggggtttatgtaaactagtaagcttttacttcttaataatatataaatgtatttgttactattgctatttttttctattcattcaaagatctctcattgccaaatgctgcttgagaacacatcaaagtaattccaggataactagcagcaatacctggtaaatggcctcagtatgacagatcgaagttatctcaacagtgactggaagtcactgaaaatgcacaagtatttaggctatacttagagctaaaagtacttgtctagtgaatggaaagtgttttgctgacaaaaacactaattgaaactcctgaagcaaaaactttgaaaatgaaagaaaaaatgagaatgaaaactcttaaatcccagggacatttcaaataatatttaggagagaaattaagttaagcaaaagcatgaaaaaaaccatacagagttaatgcaagacatgccattaatatccagacctcctgtaaaaatgttcagtgaacaaattcaacaacataccaaacacttggaacaaatactgaaatttagtgcccgggttaaaaaacaaattaattacaacaaatgccatctatttggatcggtgatataagtcatagacatctaatggttatctattagaaccaataactctttgagatatttgatatgtgcacagtagtttacaaaattgatgaaaatagtaaaaatctgatttcatgttttcaaaagactctgcaccgtctggcatatatatttaatttagttatttattgcaaatgaaaactaaaatttaaaagaatccctacgattaacagtatgaaaacactaaagcctaacattgtgaaaagacttttgccgtcagttagaaaatagaactatctagcttctaacaacaagcatttttcactaaccactttcaaactctgggaacactatgttctgtcttagaccgtttaacttcaatattaggcaaaagctttaaaaactatacaaacagtcaaacactgcttttaagtaaagcacagtggctgacataacactgctgagagatgtgtgtactcatttaggatttaaaccttctccattaagctctattgaagagcaactgctgaataaatgaatgcaactatgtttatgttaaaagcctgtttcccgcagcatgtaattaaaggaaatgttgtacaaagccagtacttttgtcaagctcctgtaaatggaaagatggatagcactcagagaagtgaatgcattgcttcatatttaaccttaacactcttgtcattaatggtttgtctaacttgttctataaaagacaaggtactgctccattgaagtaaaattaaaaaaatcaactaaaccatgcttttcagaacagaagattcattatcgtcagctaatgtattggcataaagcaaagtaacatcctatcaaggcacacattcaatctgccttcccacccccctttatttttaactcatgctgttttattgttataggcaatttgtaccactcagcatgacagtgtaaactgaatcaagattaatttacatgcaaaagaacacttaggagagcagcatggtaagcaaatgtattgtctcgattgctgaggtggaaaaagaacctggaaagaaaaaaaggtgctctaattaaggggcatcaaatatgattgcttatggtagttaagggccagaaaatagtaaatgtctgaccatttaaagaattagcatcttgctagctaggaactcataagatagatgcataaatcataataaaattaagtaaacattttaggtttcttaaaccagagatttttctaaatgaaactatatcaggtattctcaaattaacaggaaagaaaaataggcaaaggtttcattaaaagttcctcctaaaaaataatactttaaaacactgtagagcctgttcatatataataaaggtaaaatcactgggaaaatatttaaaaactgtaggctaaataatttgtggctttattagaatctatctaaattttggtgaaggcagtagatagcacttactttaggctaatcagctgtaattaactactaaaaggcaaaccaaataacataaaaaaattcagaaaaatttctaagttttagatttgtaatttaattcacaagaagaaaatgaataaaaattcaaaaaaaattctaagttttacatttgcaatttaattcacaagaagaaaatgaataagaggagttatctcggaacacgtactcttgaaattaaaactgcgtgaagaaaccaaattaaatatttttaagtaaaaaatagatcccatgttattttcttattgaaagcatctcacagctagatcattaactaattctgcaatgcttgaaactcatagcaatgaataaatcatgcttctgatggaggcttatatacataaccgtcaatacgtagaataatctaatctttcatttaccactttgactaccaatcttattatatatatataaaaaagtttagccatgaaaccctaaacacaactgagaaaaagtgatagatcatgttgcatattagaaataaaacttttgttttaaaaaatattaatctaaaatgtaatactctgttagaaccacttttatttaatactgtacacttttcagttacgtatatctttagaatgaaaatagaaccatattccccatgttccttatttataattttttcagttaaatttaattaacacatttaacatacttcttgagttttaaaatgtgtcatatgaaataagatattaattatgtaaatccactttattcaaggtagaaaaatcggttaaagctggtgtaacacacacacacacacacacacacacacaccccttaaatttacttgcattttaccttccagaattttgcattgataaaatctgaggaaacggatttttattctgatttaggcttttccgttagtgagagatttctaggtatcttttgtggaaataagctaagctcttactagagtagtataacaaatacatgtgtaaagttgaggattgagacctctattaccaaacctgctgaaatctataactaaaaagatgctattgaaaagactctttaaacctgtgctaaatttgccagcatcaagttccacatcaaagaatgaattcaggaagacagaaagaatgatacagaaatgccaagagacttgcaaggatttacaaatacttcatataaacaaattttcaaatagctttattcagagtagcctttctgctctattaaacatagcaaacagctgccagatttattcagacaaataatcaacaaccatagaagtaaaatggcagaagaaaaaggaattttggcaacaactccacagaggaccacagctattctccaagtgcacctctctcatgcacttaaggttctgtatggctagtcagcgaaaaatccctcagtcacagcagagcacaaaaaatttgatcgaaatattaagtattctaaccaaaagctgagggagtgaaagggtatataataatctgctgcttcagatatactttagctgcacttttcaaaaaaagaatatccccttaacaataaatgtgccaaagccttattcagtcaccgtgtgccactcaccttggtttgctgagcagatgtaaagcagagaggcaggctttagccagcaaagggtaagaatagcaaatataagaatcaattcaatttgtcaatagaaaaataaaatcacaaagataattttcctctatagcaataatcaactttccaagaaatgcaaatccaaagaaagatttcatcgttcttttttattgcttaaataatgcccagcaaaaatattactattaatttatggacttgtatgagattttctttttgacattgtgaattgcaaaggcttagagtaaaaacagtatcttcagcacaatagcagagtgccaggaagcgtgcccctcttcttaggtgtaggtatttgtgtgtgcctagtacgttctggaagtttgatgggtatgatttactacctcaaaatgaagggatctttgataacaccctccacaggaaaaaatggcttagattcacataaagttgtaaaaactgctgactatagcatttaaatatgccttaattttataaatgttatcgttaattaaacacataaaatcagacagttatctccccttattcacatacgaaaaaaaaccacctcgtttttattagaaggtatgtttgactctgggccaactacagatattaatacttgcattttgctgaaaatattttctttttaagtacttattttaaaaatgtttcagttctaataggttctgacaacacagcatttctttaatatagaattaggtcaaaagaaactagaagtattttaatgccataattaggagtttattttgaaggataaggtagtttaatgtgtgcagggacaaatacattagtaagacataaaaaaacagttctatagtgaaaaaatacagaaacataacaattatagtggtaggacatcggtaaagtccccaattcctggcactttgaataatacaaaacccattagtatatcatcaggttgacaagcaacaactctcagcattgaaaaggtgattaagaattaatgtatcatttaaagacatattaatcaattttcaagtatgccaggaatatagacaaacatctgtttttaaggttgtaagtgcaaagcattaacaaaaattggaagattgtgcactaatatctgttaatggctatgtacctatgaaaatttattttagagactgtacaggaataagcacatattatttggtatgtaaatttctagtaagttgtagacatctctcaccttgctctttcttaaaatctttctctgacatggccacaggtaaaagcagttctccaacaggtggctgaatattaacattgaagcaatcatccttggtactgaagaaaaacaatcaaagctgactaaatgcttcataaataaacattcttaatactaagtagttaaatcaatgcaatgaaagcctatgctagcatatacagtataagacctttttggtttaaacatcacagctaaaaaggtttaaacattttcccaaacaaacaacattacttgcagaaaaatacatctgttatctcaatcaagattttttaaaaaacaaaactacacaggtatagtaaattatcccatttgaaaaagaactttaaaaaattgcagtaattgtatataaccactaccaccaagagaaacacttcatgcagcttatagagaagtaatattttatctctagtttgcatacatcttaaagtatagaagatgaaatgctttagtctgaaacagttaagatatctttttaaaaatattagttttaaatgaagaagaaaatagagtgaccatattgtgtttagataggtgctaataaagtaatatctcatctgcaaacttgctttcctaaaataaaaaaaaagcccttatttgctagcagtgctattcattgacattattgaccaacatggtaaaagttattatttcaaatgacaggatatgaagaatttaagaaagccaaccttgtttgttctaatatcagatagaaaaacaataagtgcatttacctaagtctcatgatattatgatcaataaaaaatactaaaattgtctaaaaaattttttaaagttagatgtttaggggtaggttgatgagtgtatcctaaatgatagtagtgtgtttgatggcaaataagcagaaaatccgactaacagttttttgagaaaaaggcattgatcgtttataatacaagaagtcttagagttaccagtcacaggctcattcagtggcttaaaaaaccctttagaggcccagattcctctagctttccctctgccatccttactatgttggctttcatcctcatggttgccacatggctgctgtatctccaggtacctagtttacattccattgaaggaagggtggtgatgagagagtgttgagtaactatgtcaaccaaatctgttcctttttattacaaaagcaaaagctttcaggaagtcccatagagggacttctaccttcatgttagaactggatcccacagcctgtgagatggtagctagagaaacagggattgtggataagaaatactaaacattaggttaagaaacacttgaatttattcatgtgtgggtacagacaaatgacataatataaaaaaagaacataaaatcgacttttattttatgctattatgtattgtattcttgtaagtggccttatattttttccatatgtggattgttgaaggcaaaccaataaatccaatttatttatcaattcaataaacactgaatacaaccttgatcctatgtagtgtgtgaatatctggggatttaaagccaagtgagattggcccttgaagctcacaagtctagcgggagggaaagaaattacacttataatggaatggcaggcactaccttaggtatgtggaaagcattctgcaggaatgaaggctaagtttacttccaagaggagaaagagggcattctaggcctgtactttgggaatgatgagcagcctaatatgtcaacagaagaggttgggggaacattgcagagtatcatatatagtatgaccattcatcccagtcctcccaggaatagtcccagtttatggctgttgttgtggaatcctgtccagctggtgcctcctttcactctctaaagtgtcctgatatgtgtgataaagcatatggttactttacttatataactaagacaaaggtgtttcagtgtttcttgaagcaatgggaaactactagagatttttggcataggaaggtaaatggtcccatttatgttttagaaactccagtggcagtatgtaaggtggagtaagggagaaatcaaaggcagatacatcagttaggagtctaaattaatagtctaggcaggattttgattttttttaaggatttactgtgtgttttttacttaaataaagcctaaaaaggatcttaagagacagcttctgttatttcaaatttactgatgagaaaactgaaaagaagttgaacaatatgcccaaggtcacacagctagtaactgacagcactgggatttgaacccaggtgtatctaacttcaaagtccacatttattccactataatatacagcttccccagggtgggtagcactgggcaaggggaagatggaatattttatggatattctagaacagaagggacacacctggtgatgaatggagggaagaaacttcacaccttctaatgtgaacaactgggtgaatgacagtgtgctgaaggagtttagggacttaaagaaaaagatttggctttagccacattatattttgagtactgagttacccaggaagagatattcagcagataattggaaatacaaatcaagaatctggagagagactagctgggcatagtgacaggtgcttatagtcctagctacttgggagcgtgagctgggaggattgcttaagcccaggagtttgagactatagtgaactatgatcacgctactgcactccagcctaggtgatagagtgagaccccatcaagaaaagaaaagaaaagaaaagaaaagaaaaaagaaagggaatcaggagagaggacagggcagtatgtaggagtctggaagcagtaagaatggtgtaaatggtgtagggaagagctgaagccttatgagtagataaaaatcatataggaaaagaggataccacaaaaaggataaagcgcaaatctggtgaagacctgtatttaagtaaaaacagaagaaaagcaacttgcagaagagactggaggaagagtggtcaggaaaaaaggcgtgtgccaaatactgcagggaggcagaataagataagggataaaaagaagtataactgttaatcttagcaaggctgttcagattgcaggaagactacacaatgcagtgagttgaagggtgaagggaagattggcaatggaagaaggaacagaaagcagaagcttcctgagaatgaagaagcaaaggaataacacctaaagaaacctgagcatgcttagaggctgaggggaaagagccagtaaagaagaagaaacaaagaaataactggtagagcaaggtcttaggagaggtaaaagaggttgggatgaagagcacaagaatgaggtgagcgggttagctctagaaaggagtaggatacttctttggaaacagccgaaaaggagtgcttaagagagaaaggattgagggtaggctactcgaagaatgagaccaaacctgatggaggggaagacacagtcacattaagagaaacatgtaaacactggtgaaggactagaagaagatgtatgtatacatacatggaatacatatatataaattacaaatgaactcagtatgaaatttaaaatttcagcttcaagtcactgtatacaaagttctccaaagtcagaggcacaagacaatcaactgaggtataggcaaaaaccctattaattatatttattttttctcattccttttaaggttctgtttttctgggagacagggtctcagctctgtcacccaggctggagtgcagtggtgtgatgacagctcattgcagcctcgacctcctgggctcaagtgatgctcctatctcagcctcccaaatagctgggactacaggcacatgccaccatgcctagctaatttaatttttttttttttttttttttgagacagagtctcactctgtcgcccaggctggagtgcagtggtgcaatctcggctcactgcaacctccacctcttgggttcaagcaattctcctgcctcagcctccctagtagccgggattacaggtgcatgccacatgccgggctaatttttgtattttagtagagacgaggtttcaccatgttggccaggctagtctcgaactcctgacctcaagttatctacccgccttggcctcctaaagtgctgggattacaggtgtgagtcactgcgcctggcctttttttttttttttttgtaaagacagagtcttactatgttgcccaggctgatcttgaactcctggcctcaagtgatcctcctgccttggcctcccaaagttgtgggattataggcatgagccactgtgcctggcctctatttttgtatgttttagtaaaaatacatgttagcacagtaagaaatacagacacatacatatatatacacacacatatataattacaaataaacttctacagagtacatactcaaaatatttttactaatagaggtaaacaatttcaaaagttagggaaccactgagttacatcattatttacaacacttttgaattacttgtttattctttttaatagaaactcttcttcccaacactcctgaaggacaccacatactcctcgattaaaagtggcttgacagcaatgatgccaagggagaagggtggggtgttcagagagagaagaggcaggagatctgccttctaaggcatctatgaatgtctagctgcttgcagggggtagggaaagcgatcctgaaatgtccctcctcgcaacaagcaaggcgttagagagcccaactgaaacatatttttcggcctctcttgtagctaagagtgatcaagtgacccagttatgaccaatgaattataaacagaacttcagtagatatttctgagaaagttttgcttttctgacataaacctggcccctttctccatgtcatttctttccttttttctgtctggaatgcagatggaagcctggaggtggagcagccatcttgtgatcacgaagttgaccagcatttgctaacaaaattagcacatgaaacaaaaaggtggaagaccttactgtcctgaagacagtgggaagctactgcaccagctctgaactgccaacccctgcagttcttgttctaggaggataataaatccttatttggtcatgccactgcagttgggtttctgttacacacaaccaaatacaaaatccaatataaccagtacataactcactttgtaagccagtttcatcttgtaagcaaggcgtggcttataatagaactaagatggaacatttcctctttatttgggggaaaatttactttcatttacatgagtgttctaggatgtcctccagtttataagcatctccttttctaccattttgccttctttttgatttatttctctctccatgtagcttttcttttccttttttcttcacaacccctttgattaaacaggggagagacagattatctccatttctacacataactgcctcaacttggatagggaatgtgaaaatgactgatgatagatgtaaatttatcagaattaacagttaccagatcaatgaagcactattattagggtagctttaaatagccgagctacataggaccagatggcataaaagtttaatgtaaggcaagattctacttggtacacatttaactgtagcatatattcttgtagtacatgtaacctcagttcacggattcctttataggatccaaactggtaaagtttgtaggtaagagaaacgggcaagcagcctattctgagactcaagtttctcatctatgaatgagtgacatttaccttgcaggctagttttaactattaaaggaaataaaatgaaataatgcacaggaagtactcaaaacctacatatgtaatagggatatatcattatttcattattcccccacagattatcatttccaatttttctccattataaacaatgcttatacttggctagatctatttccgtacaagcacaaatacttctctaggcttgatacactataagtgaaattgctgaattgaaaagtatgaatattttacagatattgccaatttaagatcccacaaacagcatacaagagtacatgtttttctctaccttcctggtcaataccagacacaaaagttattctaaaactttgcctatctgatgggtaaaatgttttaatttttatttccctaaatattagtgatgttgaacatctttttcaaatgcaagttggccacttgcatttattttcttgtaaattgcctattcttagccttttccttacctttctactggattcccttttcattgattgtgagagctacacgttctggtttttaaacttttttctgccaaataagctgcactgctttctcattatcttgtttatggtgtctactttttctttacttgtagagaagttttaaatttttaatagaagaacctgttagttattttcctttatatctttctgagtactgtgtcttgcttaagacttttgtcctcagagtatgaaaatatttatctatactatatttaaatacttttatagttttttataattaaataataaatccacatggaacttgttttggtataatttgtgggaggaagctaccttgattttttccaaataatggtcctcacaccatttactgcatggtctgttctttccccacggatttgaaatgtcacctttatgacatacaaaatttctacatttctaaattctctggtttcattggttcttgtgtcaatatcaattacacagaataaaaatattcttgtggctttaaggaatatttttaaattattatagagaaagacttttttcactaaaaatgttgacttttcttgtgcatttttttttccagctgaatgttagaagtttgtcaagtttcttgaaaaagtcgactggcatttagcctagaatcacattgaatttgaagattaatttgaggtgcaatactgtctcccatttaaaaacacagtatatttattttttattttgcttatatttctttatatttaattatatcttcctttatgccctttaggaaagttccaggtttttttctctctacataagtatttgtaccacctttctaaactcattagtttaaataatagattttctgttgattccaactttatgggttaataattatgttgaataggccaggaacagtggctcaggcctgtaatcccagcactttgggaggccgaggcgggcagatcacctgaggtcaggagttcaagaccagcctggccaacatggtgaaaccccatctccactaaatatacaaaaattagctgggcctggtggcgcgtgcctgtaatccaagctacttgggaagctaaggaaggacagtcgcttgaacctgggaggcagaggttgcagtgagccaagatcgcaccactgcactccagcctggcgacagagtaagactctgtctcaaaacaacaaaaaaaaagaaaataattaaattgaataaaaattataattttggctgggtgctgtggctcacgcctgtaatgggattatagcactttggaggctgaggtgggcggatcgcaaggtcaggagtttgagactagcctggccaatatggtgaaaccctgtctctactgaaaatactacaattagtcgggcatggtggtgcgtgcctgtagtcccagctactcgggaggctgaggcaggcaagagaatcgcttgaaccaaggaggcggaggttgcagtgagctgagagcgcctgggcaacagagcgagactccatctcaaaaaaaaaaaaaaattataattttgtctcttcttttccaggatttatactgcaaatggcgtttacttgcctttctgtattggctggaacttccattataatgtggaatatagtgtggtgagcagacatccttgttttgcttttctgacttaaaagagattgtttctgatatttcatgtggctatgggtaacctgtacgggccagaagtcatttgaatttataactacaactgatgtccatcttcataggttatccttttgggctttaaaatcagggtgatgttagacttacagaatgacatggcatgatttccgtttcttttgttctagaaaaattctcttttttaaggttctgatacaatttaatcgtttttattcctaatttatatttttctaggaaataatttcatctaactactccaatttactggtgtagaactgtatggtattattttgtaacttaaaagatctctgtgctttgtcatctttctcctctctaatctttcttcgttgtcttttttctttaatcatattatcccatagttttccttttttttgtacatcctatatgttcttttaaaaaatgagtattttctgtacacaggaaacaaggaattctatgtaaacatatatatcttagatcaagcttgttaattaaatcattaaacctgtatgtatctatacctatttaaccttactctctgatttgtccatttctgatgtgcatgttaaaatatactatgattatggctttgacaatttctcctagtatttgtattgttttctgctttataaattacaaaagtgcatggtttaatggtttgtaacaattgtattttcttggaggattacaatgaacacaaaatattttattattactttttacctaaaatacttcttaatttttctagttttagcacatctatctgataaatgcatacacacacacacacacgctcacacacacacacttcatctatctaatctcaacttttctgtgccattctctcttagggaggtttctcataaatagcatatgttaaattttgttttttacctgtttagtaaaagtaggatttaatctctgacgtgaattgtgaaaactagtatgtgtggtgtgcatggcctctccagccacctttttttgttttatatttgccatgctttttcctcttcctcttggttaaactgaccaagttttaaacatttattttaaattattattatttttttgaatagagacaagttctcgctatgctggccaggctggtcttgaactcctggcctcgagggatcctcccaccttggccttccaaagagctgggataacaggtataagccaccacacgcagctctgatcaggttttaattactccctttcttcctacctttagctgtttagaagttataatacatcacatttctattattttagtggttatctttaataatttaaacaatatttaaactaatttttgccatcgatcaattctcttctcagacataacaagaaccctagtataccatcactcctccttgcacttgtctctgtggggattttggttccaatttattgttaatatttatttttcacattatgtcaacaattatttttatacgttgataaatttcgtagaatgctttgctcactactgttttattaattctatgtttttctctgtctctgatttttttttgaggtaaggtctcactatgttacccaggctggaaagcagcggctattcacaggtgcaatcatcgcgcactgcagcctctaattcctgggctcaagctatcctcccgcctcagcctcctgagtagctgggactacaggcatgcatcaccatgcctggttctgtctcagatttaagaaaatattctattacagcatatctttgagtaatcctttcagaaaagatgtgcaggtggtaaactgattgaatccttcgctgaaaaatgactatttggtatcttcaaaattttaaaggtcatttcctttaccttctggcttccagaactgataagagtactgatgtgaaatttgattccattctcattcttgtccatttttaggtaaactgcttttttctctgctttggaagataataggatattcttctccttatcaaaaattcaccaggacgtgatctttttcatagtttttcatattcaccctgtttggccctcttaatctgaaggcttgcgtgtttcttttgttggggcacatgttcattcattcactcattacgggcagggatacactctgtcgcctaggctggagtgtagtggtgcaatcatagctcactggagccttgaactcctgggttccagtgatcctcccacttcagtctcccaagtggctaggatgacaagtgtgtgccaccatacctggctaaccctttttgatttttggtagagacaaggtcttgctatgttacccaggctggtcttgaaactcctgggctcaaacaattctcccgctttggcctcccaacgtgctagggttatggatgtaagccaccacatccagcagaaaatgttcctctataatttattttctaaattatttcttcccttcattgtcttttctttcctgccagagctcctatgagatgaactgatccttctaactttccttattttctgtctctgcctttttgctttgtattctagttgatttccttgaccctttcttccagaacactcgatcagtattcagctgtgtccattccattattcacctactgagttagcaactatcattactatgggtctcctctcccctgggtgggctgactaaagttttattttttataagtggacgagatactaactggttatgtggacatgaagttggaggcaggcaggtaggaaatggcctttcctccccaccagcaaacgtgacactggctttaccctggtggtgaggatctgagaatattttggatactctcttggataaaactatatttcatctcatctctgaccatccttgcttccttcacacaaactcaaaccctgctctgttcttgtaggtccccacatccacaccaaaacgtctttcccaggcaagtggctcattctctttacagttttattcttaagtctcaaattaaatgtgtatgttgcctgctgtcaggggtaagattggggaactaaggggctggaagcagttaattccctgatgactgtcttaagacccctactcatgctgtgcttgatgttctgccagattggttcttaccattatggtagttttcccccacgagtgttttaccctgtgatttttattttctctgttattgtttatctgctcctatttgttttctgtcaataatgcctcataatttctggtcagctaatggcatctgttcttatattttcagtgttcattcactattaaagaatgtattttctttttaatggatctttggacaaaaacatgtgctcagttctctaactagcactaagctgtgtgacttcccacactggttaatgcatgcatgcctgtgggggatgaggatctgtttatgtactgcactaacttttagacagatatatttatgtatattgcgcacatatttgatctcaataaatttaatcaagaacttaatttgatgaccatttaaaatccaagcaaaaaagaggcaaaaatgcttatcagatatacatataactacatggcttaatttaacagttctgtctatatctatttatccatagatacaattataatgatatagaattaatccagaagctaaagtaggatcattttactctattctttttattctaactaataaaagagtatctgacaggcttttggtccatgttcccagcatttctgaaggcttcttatcaaatatgctgttattacccataattttatgtatcgatttgtataatgtatttcaaggaaaaaattcaatatcagccattcttgtttctttttttctttttattgaactaccaagactaatacagcacatcactaagcaaaaagtgctatttactatgcaaaaggcacagtcagtgattggcatctaagaccaattgatctacccattaccactatctccctacccccacaagcattactatgaagctattgatttaaacactgtcgatcggtttccattttctgattttgggcaggccaatcaagaaagtgagtaattgtgattacactgcttcaggatcaattacatttgatgcaagacaaagtgctctttttggaacacacacacaaaatttttgatctagcatgctgttgtgcttaacaaaatctaaaataaataatttgtatctttataataacaaaacatactaatgtaaatgcttttaatagtcaagaacattttctatgtgaaatacatgaattattttcctaatgttagtttgaaagaaatttagaaaaaatattattcacatacactccttggcataagataaaaatcaaatactacctgcatatatatccatccttaaagagacttagttaattatgaaagacaaaatgcaaatcctgttcaagagactataaaggaagtctttgtaaataaaattggggaaaaaaatccaattacataggaatcaaaaggttctttatacaaattgataagaaaaaggaatcttttttagttcttaattttggtctaacttggtacgtgagctttgtcattgggttcacattgtccaaatcattaaaatgaatatacctctggtgtcagaggcaaatctatttagagtgatgttactcatagcctgttgttcagtaatattgatctgtgttgtttgtctaatagaaaaataataaacaattactaggcaatgttgggaaaagtaatcagtttttatatatcactaatacagcagacctcccaaaacataaaggtgatgatctgcataaaatcaatgtgttatgctacattgcttatatttatcattgcaggttctcggcaataaaaggtataacattaggccagaattactggtaaactgaaaaggtatatgaaaatgaaaagttcactatgtttaatctatacatttattttaaaatgtctatttctaaaacttcaagacttttaaatcataacaaattctgttctaagctagctaaaatgtaggtaaaatgtctcaattctttttagaataaaaacaaagaaacttcaactcaaaatagccaattgggccttatatcagaaaaagaaaagagttcaaagataattctcaatgatgcatgaatacggctttgttctaatttgctaatagcctctgaatttcacaagaaatgtataaagcattatagaaaaacattaacaacaaaatccaatcctaaaaaagctcttctgaacagcattcagctatgaaacctttgccaactgcataaatgttctcttttgacttttatcaaagcagtttgtaaatggatgtaaaaaggaaaaaaaaaatgtgtgagttttaggtactgatggcatcaataatattccacttaagaatctcaagataacatgtatgtatatctcaaaagatatcttctctgagctatttaataatattattaatgcttttaatttctcctggattttcctcatgaattttctcataaattttctaaaactggagtgataagttaaaaattacttagtagtagcttctttctttaaccaacaaaccatggatttcaatcacatatggcaggttgtaatggctaggtgtgtaacgaatgctaaaaatacatatactacacacaatttgtacaactattccaaggcagtctaaacattatcaaagcaaaacatatttgtttaaatgttttgtctttcacacacacacaaaagctgttgaaagcttagtttttgatctgctatcctttacaggttatataaaaaatagaagaacaattgaacttaccacaactggaaactggcagtctgagtagaatcacaaaagtcaatacccattgaaactgtaatggatccctcaggctcaagagagtctaggaaataagataatttagacatgaaaacacagaggatgtgaaaaagaggcaaactaaacactgaaaatttaggtaatgtttgtagcttggttgaaactgtgaaatgtaatgatggcttaaaaatttcaaactaagaatattaaagcaaattacaaagtaacctaactattctgtttcaaggttttctttttcacaaattaattctgcgcatacaccaatgaacacattatacccatttgtttcagaaatacatatcttcctgagaaatgtcatgttttctaatattatctctataggtactgaaaatgagaaggaaataaatgtgttcttgtttcgcatacctgtaatggactttgggagttcataagaggttatgtacttaaaactatggcatgtttattctagatataaaaagtaaattttaaacaatgtccaaaattttcaatgaaaaaaatcctaaattaaaaaatgtaaatcaagttggaagaagaaattaagatgcactcagaaattaattaagagatctcacattgaaaccaaaatgttaagtctaattgcattaaatactcaaaaaaatttgtggcagattagattatctttataaaacaaaaaataaaatgacatttgatagatttggaatttcagaagcttcatctatcaactaaccaagtataggaaataactataccaatatacaatacagtattttttttcagttaacaatgacaaaacttaaggcaaacaagaacaaaattttattctgcttatgatttgaaagtttagctatatcttagaataattgaggggatcttaaataaatatgtatatatttgtttatatatagaaactgtccatttttgatttctactttgctcaaagtattctgtataattgcagctataccatacaatcactttatatttagctttatctattctctatacatcctatcacacgtagttatattttagcaagcacacttctaattcaatagactgtgactattctagggcttcttggtaagtatgatttgccattgaatgctaaccacgacagagatgatggtacagtcgggataaaataataattcaataagcttcatttattaagtattatgtttatatctcataggctcaatgaggagtaagcattacaagagagtatttgttcaatgctgattttaaaatgctatttgttaggcaaaggaagtatgttaaaaataaaaaaagtaataattaaaatgctatttgctcagtggtatgtatgttagtttgctgattctagtttgaatttcatttgtttacaaacctaacattttccaggatgccactcaaatactagaagacttgctccctaaatctctagcaaacaggctttactgtagggtaaataactataatgatacatatgtttttttcatttctcataaagctatgtgctgtcaacagtttagagctttgtcagtcacacgctgctccaggctattcttgagtgaattcttaatgccttctgtgccataactattttggggtttggtcttgtttttatctgacacattagtagcaaattccgtcatctccaaaacttgatggctttcatgatttagatctcccttcatcatgtatctttgcatgtcatttgacaaagtgacagctctcaagatgccttgttgatagcactctttgacactgtttgatactgtcttcagtcttaagataattaactgtgagcttagtgccatactaattctgggggacagtccatgatcaatggcatgttttattatatggatgcttcaggagcaaaatgatcagcataaactcattcaaataatggatttttataatacttggagccgactaaactgggaaagcttacccaattaggtgtctctgtttggacaccatttctagatttgctcctatatatttgagatggctatgtagaagtggctgaaaaacactggctctgttacgccacaacattaatatcaacacatgaaatcatataggatgccatttactttgatgtaacagttgtacagtaactggtaaaatcttagctgaactcaaatttgtcaaccactaacataaagccactgaatatagtaaagagagcttaacctattctttgtgtcttaaaaaaaaccctcttatatactgggtctctttggggaaaatggaatattattcctaatattcttgtaaggaatacagtttcatgccaaacacagagtgaaatccagaaaaaaaagtcattgcacattacagacaaaaccagattggtggcaaataagaaaactgcggactccttaatgtgtatacgttcttaaaaataaataaaacaaatagcttacctcccttattttactaaaacactaaaatacagtatttgttttctgttgcattcttaaaatgtttttggaggactaatttagacatattatattccttaaccctacaatctattgataatagtgtcatccaggtggtgttacatacaagtacatactgcagacaaaagaactctgtatcttgaaggcattcaataaatgccaaccaaatgaatgaaacatacagtcacaaaaatttgtctaagaatgacaaagaaaagcctacaaccaatactgaggcaatggtaaacattcatattttatttctctgttaaagtcatactatgaaatttattatatttatttcttctattctacataggccaactaaaggtcaactcatcaactcattatgccagctcaaagaaaaattaatactgttctactgctttaacctttggataacattctcaaccttcagacaattcatgtatcagctgcttgacacttcctaaactaattttttttaactaggtaaaaaaggttgaattacaagcaacaaaaataacacaataattccttggcaatatattaatgtcacacattatataataaaaattaggatactttgtgttctttaaatagtgtcttaattatcaaaatatttttaaaaattaagtggattttgaaatcagcttactttaactccactttctttgctctagttgcttataaaactttaccaggctttatcaaaaattattttattcctttgtgtaaaaatataacacacacacaaaatgactttctttaccgaaagattcatgaaaaccagaggagaaaattcagcaatgccaaagagctcagataaagaaaaatggaagagttatgtgaaacaatgagtaaagaaggtacaattacctaattttacttgatcctggtcaaaaggcattgtttatcttaagtattataaaaaggagctctctggagcattctggttataacatttggaagatacaatgacataaaccttttattacttttaattgaggttttgcctgaagcttctctcaactaaaccttagggttatctccacttacaaaaaccaaaaagaaagagatagacattctaaatattacactatttcaaatttcaaagtaagacacacaattgttacatttaatgtttaaagggtatatttttagcaaaatacttaaaaaatgcaaaggggatgaaaaatggccactgacactttgttggagagacaacaggatgcggtgggcacagaagcaacctggaaagtgcgagccaaagctgggggcagccgctgctcagcaacccactcattggttgctgcatgtggggataaagggccagtactgccatattttacgctctgctccaagaaaagtgagatttctcattttttaaaatgtaaaagcatcttcatttttaaatggtggcaacagattgaaaacatgtaaaaattggatgtggataaataccagtgatatcctctaggctactgtatattctatacatggagaggaagataagcagactagtctacatcgggggtgtgcaatcttttggcttccctgggccacattggaagaagaattgtcttgggccacacataaaatacactaaccctaatgatagctgatgagctaaagaaaaaataatcgcaaaaaaatctcataatgttttaagaaactttatgaatttgtgttaggctgcattcaaagctggcctgagccaggttggtcaagcttggtctatatcctctcagtcttcactcccttcactttcccataaattgaaaagtgaagggaaacaggaaaggatctcgagatacgagaagtattgtattcagaaatgcagagcgattttcttgcttttaatacacaataaaccacttaaaattatgcagggaatgaagctgaccaggaggagagatggggaaaggtgacacaggtaagtaaaacatgatggcaatcttgactctgcagacctagccttccatcactactggtattactattactgggacctgattcactaagagcaaagaaatgtatttatcttatatgataaattcagtttaacaagaaaaagcaaatataaactgaatatgctaattgtcaatacaatcatattctactttactattttactaaaaagtattctactttacttttaaaatgaacatatttagtgatcaaatatagttaaggttttaaatgagaattaatatttacctattggattaaaaacatgcattttcatgcctataggaagttttttttcccctatgtggatattttctatctttcgatcagtagtgttattcagtgttatttgtatagagaccatcttatcaccaaaaatgcaaggctgtcttggaaagaaataatgggcagctagtccttttccactcattcgatgaagcagcacgtgagttttcgttggtacaaatgcaggagtactgacctattacacacggcaaaaagaaaaaaagatgagttagtgaatataattattcttttagaaaatatgcaaacatttatgacatttaattcttggttcccctacagtattatatgaactacaataacaaacattagtaggatatcacacacatagatattagtcagaaatgatacaaagaagtaaatgccctcaaaactgtatgaaaatttttctgtaagcggctgggcgcggtggctcacgcctgtaatcccagcactttgggaggccgagacggggagatcacgaggtcaggagatccagaccatcctcgctaacacggtgaaactccgtctctactaaacaaaatagaaaaaattagccaggcatggtggcgggcgcctgtagtcccagctacttgggaggctgaggcaggagaatggcgtgaacccaggaggcggagcttgcagtgagccgagatcgcgccactgcactccagcctgggcgacagagcgagactccgtctcaaaaaaaaaaaaaaagaaaagaaaagaaaaaaaaaagaaatttttctgtaacctccaagcatatattaatattacaaacatactcattttttttttttttgctggggggcagggatttataaacttttttgttagtttttttccctagatcctctatatttggccatcttgctaactttcttattggttttaacagtttgtcaattgattttcttgggtgttttagccaactaccaaaatgaacgtctggaccttcatttccaatcctgactctttgaactgtttttttgtttttattttcttttactgtaaactgaagaccatggcccccaggataaggtggcttcttcctttgccttaatgatctctactttgagatcaagttaactattcacttatattttcttccagacctttgatggtttcaaattttaattcatatggaattgattttgatatattgactccatatttaattttctccagatactgaactaattgtccctacatgagctaatgaatagtcttttctcaatgattttaaatgcaaaaattctaattatttatgtactaggagatatttctgggccttgattgtcctgttaaaccagtcccatattgttttattttttgtagacctacaatataattcaattatttggtaaaacaaatatttccttatttccccctccgaatattttcttggtaaatcaccttttacccttctattgaacattagactcttaattaaattcttccctcaatctcattttcattgaaatcataggcagcatattaaataatgaaacactgtccattctaaaaccatgtgatagctttctttccattcaaaatatcagtattgcatactaggcttgacctgacatgggcaagcattaaaaaaaaaatcaatttgtaattaaacaggcttgattaagattttttcctgacaagtgttgtctcccaactagattctctattatagttctgagagtatatatcaacctattaaacattttcactatgccgtgtacacctgatgacattacaaacgtagcaattatagtaatgatttaaagttccacaaaaatccaagagttaaatatcatatatacaaaatgctacatcatgccttctaagcatcatcaaaacatagtattctttctctaaaagtgcaacaaaaaatgtgggcaatttaaaataatcatcacctctggccaggcgcggtggctcacgcctgtaattccaacactttgggaggccgaggtgggtggatcacctgaggtccggagtctgagaccagcctgatcaacatggagaaaccctgtctctactaaaaatacaaaattaaccgggtatggtggcgcatgcctgtaattccagctactctggaggctgaggcaggagaatggcttgaacctgggaggcggaggttgctgtgggctgagatcgcgccattgcactccagcctgggcaacaagagcaaaactccgtctcaaaaaaaaaaaaaaatcatcacctctaatctcagcacttcgagaggccgaggtaggaggatcacttgagcccaggagtttgagaaccagcctgggcaacatggtgagatcctgtctctagagaaaatgtaaaaaattagctgggtgtggtgcattgcgcctgtagtcccagctactcaggaggctgaggtgggaggattgcctgagctcaggaagttgaggctgcagtgagccatgattaggtcactgcactcccgcctgggtgacagagcaagaccctgtctcaaaaaaaaaataataataataaaataataatcataaaaatttatgggatagtttatttgtaaaatataataaacaattagctaaatttaaaattttggttatataaaataatagggctactggcctattcattctatttaagccttctgatgatgataacaatctagtattttaagttttcaaagcactttcacttctaaggttaggttcttttccttgaataaaaactattttcaaaactcttctgtttcctttctttcttttctttttttttgagacagagtctcgctctgtcgccaggctggagtgcagtggtgcgatctcagctcactcaggcagctgcagactctccttggtaactgagaccaggcttttcccatcaaactccttgagctgctgcacgcagtactcatcagtgggcttggctgtatatactaattcaaagccccacttctgcacttgctccacaaacacagagctggccacctgctctttgctctcaccagtgatgctatagatggatttctgtgcctctttcatgcaggagacatattttgacacagatgtcatctcatctccagactgggaagtgtgatactgcagcagctaggacatgcgtcactggctagtggagtctttgtggattccaagctttagattttaatttttgaaattctaaaattttatttattttttttttatagataggggtttcactctgtcatccaggctggagtgcagtggtgcaatcatagctcactgcagcctggaactcgtgggctcaagtgatcctcttgcctcaggtagcttggactacaggtgtgtaccaccatgctgggttaattttttttattttttgttgtgatggtgtcttgctttgcagcccaggctggtatcaaactcctggcttccagcaatcctcctgccttggcctcccaaagtgctgagattacagaggtgagataccacaactggcccaagctttagatttttagataaggcctcattgaatttcttgcaattctccttgtcttctgccacctcagagaacagctcaaggcacttcttaacaatgtttctgtgaatgactgttaagattctgctctgttggagcatttctcgagagatgttcaggggcagatcccaagtcaaccacaccaaggattaaagttgagatactcttatatcatcatggctgtccatgatgaacacatgatggacacagagtttgttgttctttttttcttctcattctcaaagaagtcaaagggagccaaacaagggatgaacagcaatgctctgaattccaaccaaccttctacagagaagtgcttgactgccaaatggtcttcctagtcactggtgaagctcttgtagaattctctatactcctcctgggtgaatgtcatcagagtttctgatccaaatgttcttgatcttgtttagttcttcccaatcaatgatttctccttgatcttgttggttttctttttcttatccttaccattgtcctcctcttcatctgaacccacccacatcttcttcaatcttggactttttctcatcatctctatctgcctttttttgtttgttttgagatggtgtaacactctgtcgtccaggctggagtgcggtggtgtgatatgagctcactgcaacctccacctcctggtggatcctcccacttcagccccacaagtagctgggacctaaggtgcgcaccaccatgaccgcctaattttttgtatcttttaaagagttggggtttcaccatgttggctaggctggtctcaaactcctgagttcaatcgatctgccacctcagcctcccaaagtcctgggattacaggcatgagccattgtgcctggcctatcttcctcttctttctcacctttctcttcctctgcctatcatcactgattttctcctctctttccttctccaaagaaagggtaatgggataggctatgaactgtaagtgctcttcactacttctttgaccttcctctcttctaagtactctgtctggtcttctttaaggtggagggtcactttggtacccctgccaatgggctctccatggtcagcacatacagtgaaggaacccccagcagagactcccaggcatactcttcatcattgttgtgctttgtgatcacaactactttctctgccacaaggtaggcagaaaaaaaggcagcaccaaactgcccaatcatggagatatctacactagcctgaagagcctccataaatcctttagtaccagggaatacaccctgactttggtagacacaggcattgacatgaccaaggctgatctcctaatttgggaaccattaccatgggttggggatgatgttaacttccagctctttaccattgtccaacttggaagggtttgtcaggctcttacaggaaatcttgtccaatgcatcagaaacattagatcaacccctgaaggaaaatctccttgttagaatagaaggtattgatgacgagagacatgagttgggcaatatctgcctgaaaggcaagtttccagctcctccgctccacgtgcactttctcaggcatctcgaaagaaaaaggctacaagtactagagagcaaggtgggctgggactctccgacatgcacatggcaccaaggctgtactgggatgactccagagctatatattttatatttatagatttatactcagcaaaagttttcttttttgccataaattcccatgctactaaggctatgataatcaaccttaaatataagctcttatctggctaattatatttttcagtgttacatgtttatttccttaatgataagcatattagagacagtgacaggtcttacttttattctacattgttccacaaacatatttgttatcaaatcattaaataaatgttgatgtagccagctttatctctgtggaaattcataaaaagttggcctacatataatatcggggaaagaaagctgaaactgtaatgtaaaagggaagactatttgaaagttggagaaaggcaagggtagaggagtgggactagagcagaacagaacaaaggtctggttcacagcggccaggaatcagtactgtagatatcatacaaggtggttagaagtatgcctttagtcatttaagagccatcaagccttggcagactcactgattccttctctcagtctaatcctaggatgcatggtccaaacatttattttgtgttttcaactttgtctcaaaattctacagctttattataattatcaaaaaatatgttaagggatgaataaagaaagaaaaacagtataattctctccactcattctttccacattcaaccaagttcaaggtaaaaagcattctctaatgaattcaccgtctaaaaaggccctcccttacaacctccaaaggttatctgtgataattcccagaggtctatgcactctttcacaataaacaggatcataaatgacacttcgtggtaataatatatacttgtttaactacagaaaggtagtaaatgaaaacatagccaggtgtggtggctcatgcctgtaatcccagcactttgggaggccaagatgggtggatcacttgaggtcaggagtctgaggccagcctggccaacatggtgaaaccccatctctactaaaaatggaaaaattagctgggcgtggtggcatgcacctgtaattccagatacttgggaggctgaggtgggaggactacttgaacccaggaagtggaggttgcagtgacctgagatagtgccactgtcctcaagtctgggtgatgaagcaaggctctgtctcaaaaaaaaaaaaaaaaaaaacacaaagaaaaagaaaatgtttgattacttttttaaccttgtttcctaagtttatacaagtcatattacgccaaacttctccagcatctagataaaatacataggtgatattttgttcaataaaccgagtgggttccataaatacttcgactacttccacatataatacatttaatccagtgttatattaatattaacatatatttagactttagttcaatattttgtacatcagaccagatacctatattccagaaatacatatgagatctgtggctgcttatattctaagatgctcaacattgcaaatggcgttcttgacttcatattttatagacaacaatgattttattagatgcaaaaaaagataaaacataattataaagtgatctagatttgggctgtgaaaatgagggtttaagaaaaagggaagatttaataagtctaaacacaatacatgtagggcagaggttgcaaactataacccacaagccaaatatggcctgctgcctatttttaaaaagtatcactggaacacaaccatattctttcatttacatactgtccttgactgcttttttactctacaatggcagaggtgagtagttgtaatacctaaaacatttactatctggtacctttacaaaaaaagtttgctgacccccgatctaagggcacaaatgttagatccttgccattccacttcccttcccttgttgttggaaacaattctctacagcagagggtccccagtccctgggctatggacctgtaccaggccatgggttgtcaggaatccggccgcacagcaggaggtgagtggctgatgagagcaagcattaccgcctgagctctgcctcccgtcagatcagcagtggcattagatcctcataggagtgcaaaccctattgtgaactgcgcatgcgagggatctaggcagcacgccccttatgagcatctaacgcctgcctgataatctgaggtggaacagtttcatcccagaaccatccccctattcccaacggtccatggaaaaactgtcttccacaaaacgggtccctggtgccaaaaagggctctacaggtctcacgtcttctgagcagaaacattagcaactttgcttctgaagctcttttcaaagatgtttccacagcaaacagcctttggaagacagaggtaatgcctccctctggggcaggtgatagatttgtttgttcattgtccaggattagaaagacaaaatctccctctggggcaaaggctgaatagatttgctaacagtccccttataaaagcctagaatctttttttttttaaaatactttaagttctgggatacatgtgcagaatgtgcaggtttgttacataggtatacacgtgccaaggtggttttgctacaccaatcaccctgtcatctatattaggtatttctcctaatgctagccctcccctactcccccaacccccaacaggccctggtgtgtgatgttcccctccctgtgtccatgtgttctcattcttcagctcccatttatgagtgagaacatgcggtgtttggttttctattcctgttagtttactgagaatgatggtttccagctttatccatgtccatgcaaagtacatgaactcatccttttttatggctgcatagtattccatggtgtatgtgtgccacattttctttatccagtctatcattgatggacatttgggttacttccaagtctttgttattgtaaatagtgctgcaataaacatacgtgcacatatgtctttatagtagaatgatttataatcctttgggtatatacccagtaatgggattgctgggtcaaatggtatttctggttctggatccttgaggaattgccgcactgtcttccacaatggttgaactaatttacactcccaccaacagtgtaaaagtgttcctatttctccacatcctctccagcatctgttgtttcctgactttttaatgatccccattctaactggtgtgagatggtatctcattgtggttttgatttgcatttctctaatgaccagtgatgatgagctttttttcatgtttattggccacataaatgtcttcttttgagaagtatctgttcatatcctttgcccactttttgatggggttgtttgattttttttcttgcaaatttgcttaagttccttgtagattctgggtattagacctttgtcagatggattgattgcaaaatttttctcccattctgtaggttgtctgtttactctgatcaggttcctctcctgtaaagcaacacaatgcatgtgcaggcttcacctagccttcagcatgtggggctcagagaagtgatgcaaatgatgctactctggctacttctattgctttaacaaactgtcctttgtctctgaccaggagtcttgtgtcttctaccagcattcatgaaattgttgcaaattaactagttagcttgtaagtagggtaacatctcagactcttcacagttcttgatgcttgatttaaaaaaaataatttaacaattcccagagccgcttatttcaaacagctaacacttagaccaccatatacatctgtgcagtggcaactgactgaaagggtgaataggagctaaaatccagcttacattcaagggaaactttttggaatctgcgcaatggtgccatacaggctagtggctttactaatcagaatacaactttacaaagtagaggttacttttttcttttggatttcctttatgaaaatccatgttatgactttaattattcctgtgggtttctgaagtatcagaaatgttctgatagccgacaacaaagtgttgagtaagtccaatgacaatgcagaataagaattcattgtttcagaattgcttttatttggttcaagactaagtgctggccttttgaggaagctttgcccccaatgcttctttaccctatagtggttatgtatgagactgtcagcccaacatgccctactattttctagaaacacattcagcccatgatggagctggcaagttcttatgcctccccatgactggctgcagttaactggttcagggatggacatttggcccaatgagttcctttcctaggatttttggatttggtacctagtaatttgagccagactctctcaagcagctaaaattctgagatttaaaactctaattttgtctgtggccacatttcctgccacattgttcagtgagaaaaaaaaataataaagcaaatttcaaagaaaagcatagatgagagacagagaaactagctggtaactttgagctggatggttcttgatgcccagacacattactgtccttgctgaagttgttttctctgaactgtagctgtaatttcctatttatttatttactacttaacctagttcaaattgggattctatcatctatctcccccactctactactggttgggattagtcagatttcaggacactaattagaaggggaaataagcttgtaatgggagaatgcccccttcccccactttctctaaagtcctggtagatatggagccaggagatcacagactcaggtaaggcttttgattagactgaaccatatgtatctgccatatctgtaggtcaaaaacagtcaaactatcaatttcatgtgactcaactaataatttgttttgcatcaaggctacttaattctacctttaatagaaaagaactttgagtccttgatgtgggccaacctaactcactggagttctgtattgcggttagagagcaaggcccacaataacaacaaagtacggctttgcctttctttgtcctctgaccctatgtctcccttgggcatcttggggagaaaggtggtaacgtgcaagaattaggtatttcacagctctctgtccaataagaacaccgttatttcaaacacaaagtaactacaaatcattaatcattactcaccattaatttattaattcattctttcatgtaaataacatttattcaatgagttgtaccagccctgtgctaaggagtatgatacagagacaaagccaaagtatcctagtcctcaagaagtttattgtttagcctgggaaaacagagtaaatcaactagtgtgataaatgtcatgacagaagcaggctcagtaggctagaagaacacaaaagtcatagctgacacctgagggagtcatcatggatgaaaacccagttattttaatgaaataatctggctatttctcactactgccactgtggccagcccggtctgagccaccaccacctatcatctggattattccaacagcctcctaattggtttccttgttcctacccctgcatcttattgaacatagactgaattgctatgttagtctatcctgaacacagcagctagaatgtatcagttaaagttacatcatgcactggggtgatgaaataatttgtacaccaaactccgtgatatgagtttacctgtataacaaacctgcacatgtacccctgaacctaaaataaaagttaaaagaaaaagaaaagttgtatcatgttacccctctgctcaaaacccgccaatggccaggatccttgttccatttccttgatcttgtttcctattactcttgaactcgttgtttattctactcatcgccatgacttccttgctattccttttgcatattagtaacagtcccactataggttattccctgggaccctctacctggaaggcactttctccagagacccacatggctcagctctagtatgtctgctcaaatattaccatcttagtaaggcttaacccattggcatccctcccttctgatttcctttttccttttttatagacacttaataccttctctaacacaatatataatttacttttttgttatgtttattacctgtcttcccatctacttcccacttttatgctcaatgtattaaacttaattttaccctttctcagaactcaaagcataattttactattttaaatgattatggaaatttgcaaataatatacctctagtgttggtcataactatacattatttaatgctgagtgctcaattataacagtgtccttaaaaatactacagccttataggaacacactgtggtgatatgtggagatcttctatattaatatttgttggttttatgatataacttgaattttctattacataaaattgtgaacaaataaagaagtacatttcttaaatgcacaaagaacagcttattgagggacttctataattcaaacactaattcttgaaatgtctacttataagtgtattattttattaaaacttatataaacaagagtatgaaagacaaagtttgaaaacattagttttgatttaattgtttaacgactaacattcaaagaattaaaaacttagatgcattataagcaaatgatataggtcatctttactatggctcgtgaggaagtaattagttcagtaactgcagtaactgtaaaataacaagcctcccccaagagttaacagaacaaaaagcatccagtaacaatgagataatcctctacaaatctttacacagcatatgtttaaataataaaagtcgtttgtgtacctttagatggtttatgaaaataagcaatcaattctgcagacacaacattatttctaaaggaaatctatgtgactcatgatgcctgtagatacacagagacaaaccacacatattttatcagtttattacagtaagcaaataagcgtggaatgagagtgcacataactgtctacttagcgcttactgaaacatttataagagctgttatctccctaataacagacagacagcgtgcaattttagagaggagaaaagcttcatattttttaacacttcactaaaaagtaactgaagagtgtaaaatgaaaaatactctgtgcagttagctggtaatggaccatattatcaactcaagttagatttataggatacaaactagtcactaatagttattttatgacatagcatgtctgcttttttttgagattattaagattaaagttgtaaaacttcttttgaacatagctgttcaaaatgattgaattataaaatttaaaatgagattcgaaaaataaaacatggaatagcaagtaagtgccttggaataagccttgttcagcatccacattactattcaaagatgacatttccacgtaaagctttatgaaaacaatgtttcccagccttttatgctttaatccacatttagttacccagtcattaagtattatcaatccattctgtttttgaatttcaaagatatgaaaatctgcagtatataaaatgctctttgtatctagttttgtttggcttactttacatcagtatctattttgatatataatttataaaaatgacgaggtaagaaaatagctataaacagaggcacagcttcatctttaaaattagtacttttaaaaccaatgtatgtctcaattgataagatttgtaatgcagaaagtcacagtattgtctcatttatcctataaactgtagaaagtgggtcttgattttaccttcaatccatttcattgaggctagcattaacctagtattgacctagaataggatttaaaaaagtaaacggcaaatttggttaactcttacatataagcacagactcgaagaaatatatttgaatcttccagcaaatattacttcaaataaatggtttttaatactaaagataacttcttccttatgtatataaattttgatatacaaatttatgataatttctcatattttattttagtaatcactatacattataaagcacacaagactttctcacctcttattttggtaataatatatattaaaaatatatttgtggaaatacgtgaacacataatgaacaaatatttaatgagcatcttatttcatgctcggtattaagcaggcaccagcaaaccatgcttagaggccaaatctggtccactgtctatttttgcaatgcctgttcactaataatgactttcacatttctaaatggttgaaaaatcaaaagtaatatgattgtaacattaaaatgatatgaaattcattttagtgtctataaatacagctttactggaacacagatgcactcatttatttatgtattatctgtggctgctgttgcattaaaatggcagggttgagtggttgtggcctgcaaagctgaacatctttactacctggccctttacaaaaaatgtttgccgatccctggtataggatatattcaatttacaatggttttgatataaggaaattaatatcccattctttctcctccccaaagacagatcaataaacttcactatcaatacacttactgcttttctatatatctgaaagccagaataatgtctatattgttttatatatcacgtacgtggtaaatagcaccagaaccatgaatactgatatgttatactattcatacatatgttctcctattctttttatatttcttttctgacttttggcttaagagtactaataaaaacagactgaatttgacttgtaaagtgttcagcatgaagttctcagtaactggttataacaaatttctttagaacccagagcattttacagaagcccaaaacaattatgcattgttaagctgtgatttgaaagatgtgataattacgtgatcttagcagttctactgctttttcattcacaagattaaaaacataatataaaaaagaaaatgctagtgtcttctcccattataaccaagctcagaaccttggcattatctttgacaccctcacattaattagaaacaaattcactgtctcctgcattcatttcctcttttctgtccctctaccaccagcttaattcaagtcttcattaacactgaaaatacttttaaatcttttttttcaaattacaacagcattatatatttattgaaaataatttaaatagtatgaaaatataagaaaagtcaagtcccagtcgggtgcagcggctcacgcctgtaatctcagcactttgggagaccgaggccggtggatcacgaggtcaggagttcgagaccagcctgaccaatatggtgaaaccccatctctactaaaaatacaaaaattagctgggcatggtggcgcatgcctgtaatcccagctactcaggaggctgagacaggagaatcacttgaacctgggaggcggaggttacagtgagccgagattgcaccattgtactccagcctggtgatagagcaagactccatctcaaaaaaaaaaaaaaaaaaagaaagaaaagaaaagtccccctcaggtaaccataacaatttggtgtcccttccgatcttttgctcccttatgacttctcttgcttatactatacgaggtctctctaatttgcccccgtcattaggttcgttttactctgagctgtaccacaagctgctacacaaaataattctcttggagttgtaactccttcatacactcagcagtgaggtgtggtgggaaacacagggctttgaaactatacagatttgagctgaaattggttttatacatagcacatgttttactagccttgtaacaccagaaaagttactgaagctgaagggatctcaattttcaagtctgtgaaatggggacactagcacctatctttcagggttgttttaatctaggctaaacataaacagctggaggcatgaagggcctgaggagcaggataggcacaagtaagggagtgagttaagatttcagaattgaaaggacgaaaaactgaagttcagtggaggtgaagttattagaattgaacagatcaagagactgtgaggttacatgttgcacaggttatgaatatgaacactgcagttccccaagatgatggtgggccagagagattatgtatgaaatactaagatcttcactgaatatggataagtgattaagagatccaaagataagaatgacaaggaggggaagaaggaataggaagatggaatgggccccataagaggaaggaaaatgaggatgaaaacagaatggcctaaaaggaacaggtgagcttcacacaaacaatcttggtagtaacaatgatttcgtcaagacagaattatcagccattatgaatggggccatgctgaacagatttacaacaggacttcaagatccaaatggagattcccagagaaaagctaggccatgaaccttacaaaattgtatgagggaaaccgtaagctgttctacatatttcagagatgggactgtggcctctaaaagctggctgtgttgccttgcatttaagtgaattgtgacttagggacatggattccccttgatgaaggatgcggatgtcacctagaagaggtcctggcgataaggaaagaagtatgtcttaggagatgtacaaattggaaagggaattttattatgggtatagtgattttaaactacagatgctttctttgaatctgacagaagggaaaaggatcctcatacatcctagatgccagttccaggtaccacaagttgctgaaaatttcctgatgcagggaaaggatggggaaatgggttccctgagaccataagacagacagacagacctacagacacacacacacacacacacacacacacacacacacacacacttacttatataaacattattccccttgatctgtgtgtaaatattttaaaattttcagtaaggaggtggggatggagagaacgtgatttactacataaggcctggttttcttcatggcaaaggcacctggctgcatggctgttccgggtcaagtcctgggattgagcctcactcctgcactgtggcactggccaggtcttctcaggctatacgtatttttaacatattaaacatttttcctcagaagtaagaatggttagtttccttctcatgaggcagaattacagctggcagtggtacgaaggaaaacactggattttaagttagaagaccttcaagctatttgatgagaagaaaatcatttaacttctctgtgcttgtatttgtatctaattgataggattcttttgaggagtcagtgtgacactgcatgtgacagtgtgttgctggtgaaagtctccttctttaattattattaaagacaatgtttattagcataagagaaaaaatagtggcagagctaagattgaaatgtaatattcttcagtgtcatttctgtcaagcaataagctataattcctttttcaataaacacaaaatggtccttatgataaaggaaagtaaaggtcagtcatgcaagctcatggggagatttttttctctccttcaaggagagaggtggaaagaactagcatggaaacttttttgaatgtgatcttaattataatcagtatccttaacaaataacttttaaaaacaaatccataaactgagattagaattgtctttaaaatatcagttatttaataaactgcatgtctgaaagtggatttcaagtgataatttcataagcatacatcataaggcaaaggaatctaaggggaagtctgaatgctacatcacaggggacaaccacaccttgagacaatattttacacttctttacttcctcaggattatttgttaataaaatttctactagatacctaccttcagtaccaaaatgacagaatcccacttttatactaattgtaaggaattaactcagtatttggacatgctgaaaagactaatgatgaataccacttttttaaaaaaagcaatgaaggtaccctcaggaaactgcatggggtatgagaccagatgtcaaatgatctgggttatagtttgaactcagccacatattaaatggtgagaccttagctaaaccacaacctcagagcttctgttttcctcttctgtaaaatggggctaatcatacatatcctgtctgtttcactgagttgtcttgaggatcaaatgagaccatatatgtgaaactgatttttaaactgcagaaagttcaataaaaggcattatttggattattagtaaattgagttttcagcccacgttaaaacaccaatctgtcagataacgcagggtcctgagattaaaagtacatgtcaaaaagctgaatcaccattggaaaaatgcttttataacaacattgctgtatttattgatagtaccatccaaaggcctttacaaaagtaatcccttcccccgcatctgtttttccctcctctgttagttgtgggtgaagagaactgttctctaaaaggtttctaaatgatgttgatgttaaaaaatatagtatcaccatttaacagccttttaaagagcagtccccagtatggtctttgttaacaactgagggaggaagggactattttttcaaaggcttttagaggatgttgttaaaagaatatatagtgacatcatttaaaagccttttaaataatagtcctctttccctcccaattgtaatgtccttggctttcatttattttgtactacaagccgaaaatggacaagccaacatattattggctatggcagcatttgttggatggagaatgatgcattgcttttaaaaaggtcggtgtccagaaataaatccaactcttctagaacatagtttcatttttatacaggatattgcccacccaccttatcatcaacttgtagtactttttgtttgttttccttaggagtttactgaaaaagacaccatgccaacaggaaagaagtcacggctaagtcattccgagatttcccacggcatgaatctagttccacaatcgactgaggtttgcttcagtgaactctccatccaatttatggcaaattctaacttttagctcctcttctgtagtctttattaatctatttcttcccactgttcctctcattttagtttagtccactaggagacagcagtggacccttagggttcctttccacacttagttcccagggaggggaaaaatgaagtcgcccgtttggtttaagacacaaagtctgatagacagtaatctttgaaaaaaagaactagccagggagataatcatatgatatgaaacaatttcccgtctcttcttgagctgggtattttcagaaaagtgtcccttcattttaagaacaggatttcatagatccataacactttgatgaaaaaataagcctttaaaacatctaaatgtacagccctctaaacacactgtattttaatcctaaattttagtgctccccttactttttgccaatcttgcacacagaactcacttgtttattctatgatttacttaaatcacagtaaatcattatttacttgtgatctactatcataaatcatatttagttaaatattactacccacaatgcaatgctcagttcaagtcccaatttatctattcaactcttcctggccctactccagcccattatgatcttaaccatattccatttgacatgttataatttaattttcacactaactttatgtgtaatcttgtatcccatgtaactaacaaagtgctaagcctagataagaataatttctttattacataataatttcataccaaacaaaaaagaattagccaggtaaataatcacagtatgcgaatcatgtttttgcatgatttttgaaaaatgtaaattactttttagttctctactaccttaatagcaccggttagttatctgtgcctgtaattatatttgatggtaaataaatattttaaaatattttaaaacatctcgataaaaattcatttcatttgagatttatatctccattatcttgagataaatgtttcactgagaagtgctattataggccggacgcagtggctcacgcctgtaatcccagcactttgggaggccgaggtgggcagatcgcgaggtcagcagtttgagaccagcctggccaacatggtgaaaccccatctctactaaaaatacaaaaattagccaggcgtggtggcaggcacctgtaaccccagctactccggaggctgaggcaggagaatcgcttgaacccgggaggcggaggttgcagtgagccgagaccgcgccattgcactgcagcctggacgacagagtgagactccatctcaaaaaaaaaaatgttattataattctgattctaaagtaaagtaagtaaaaatttttaaatataagtgttaaatttcctgacctgaagcatcaaagagacagtactaggaagatatgacactttatttaatatgactgatctgaaaatttcaaatttctcttaatttccttaactgtagttaagcagaactgcctcaaatacgaattgcttcattaggcagatggccataatctctacagcagggctgcatctgaactctatgactagtgagttatccccatggtacaatcaacatcatgaccagagaatacaagcctgggtgtggtgccgggttctgctcttcatggaaatggcctctatgagtgccatcaccctgccctcctgttcctctgcaatttgatagggttggggtgagacatgagtatctgagtcacctccttcttcccacaggttctataagtgaggtggtatacagaaaaacagccccttcaaagatgtctaggtcctaatccacagaaccaatgaatatgtaacattatgtggcaaaagggaattaatgttgccaataagttgactttgagattggaggtcattctggattttctgggagggcccaagtaatcacacagatcctgtaagtgaatgagagaggcaggagattcagtgtcagagtgatacagcatgaaaacaactcaattggccattgctggctttgaaggtggaaaagagccatgaaccaaggaatgtgggctgcctttacaaactggaaaagtcaaaaaacaaaaaccaaattggattttcccctagagctccagaaggaacatggtcatgctgacgccttgaaaaataataataaatttgcactgttttaagccactaagtttgtggtaatgtgttacatcagtgactggaaactaataaaggtaactgcggtgcctagttgaaaacccctgttctgaattcttatgttgtgaaacctatcttcagagtttatagtatagtttgtatgcatgcaactttttcaatggctgatctgtgatctgagaagcaacaaaactccgcagtattttctcattgaacttaaactccaactattatagacactaataaatttgagtggctctcaaattgtcagaatcagtttagacagctggtttaaaaaaactcccctcccctaacactccttctatgctttcaataagcgccatgggttggttttgatctatctgtagttgccagacaggtgctggcaacaaatgaaaaaaataaaaatgaactgccatcattaaattgaggcttcaatttaatgcactgcttattatctaagactccctctttaccccctttatttagtatgaatctttctggtaaaatacacataaagaagcattttgcatataagcaaaggggattattattagaagtagtagtgatagatatagacacttggttgaagaaatacaaacagacatgtttcaatggggaaaaggaaggaaaacaaaaacatgagggggtctgggtggggcagaacaagttcaggataataaaatacctaggttagaaaaatatcaatagtaagtaggtatcaaaaaagaatggaaatcctgaaaactctaaaatgtgctatttttgtctagagttacctctctctaaaataagcacaatacaaaaagtcagatgtttataaaagttataccgagtctctgaatgaggactcttaagcattctgcaaccatttgtgtcaagttaaggtgtctataacccattataaccgctggaataaatacaggtgcaccagtgaacgcttatgcaatcaggtctatgtgagaaaagtggaaccacaaaacatataagcaaatgctgctcagaaaaaatttaattcagtctgtatcggtctgatagaaacacacatgtagaaggacaaaatgtttctttgtggatattccatatgggtaaatcatattatagaaggcatgcacattataattcaagaatatattacaaatataaaagaatgttttctctgtgtatttggcagcattagtaattccttctgtcatgatcccaagacaccttatgtaaacgtccactgcagcccgactcatacgctactgaactcttgtgtttacatgatttctgtttccataagactataagataggactcaaaactgacatcatgacttatttttttatttgccacagctcataccaaagatcagaatgtagtagacattccatccatgcttattaacagaaatattcaggtttttgaaaaaaaaaaatctttcatcacaagtaccataatccctaaagttttactagaaagcaaaagagaatttgctctatccatggataaaagtctgcaaagaaaataaagggcattaacctatatccacgattctacccaaatttttcttggaggactaagaagagagaaatttcaaacaatcatgttatgtaatttttatgtttaatctgacacctgctcagatcatcacactacctcttgacatatagtggcaccctttggttgatacctttgaaaaaagaagtactgaaccacatatccataaacatacttccagaaagcacaccgctgggtctcagaatacaaataatctggtcaaacatagaaaaaaaaaaaaacacttctcttatgatttcccacatccctcattgatcaaaagactgatgaattgataaccttctctaggtatgtatcctttttaaaaatcagtgaaaaggtattgttttctaagagaaaaccagataaaaaaaagacagacattaatttctgatagtttcctttcaactgttttacctattccctgagcatttaaaactagcaaggcattcaaacttggtgagtggtatgtctacaggttctagtaaataaagctatgtaaaaatttcaaattcttatcaaggaatttgagaaaattctgacacacgacacacattaagtatggcagaaggtacaagactaagttgtcagtggctgacatgttttcaccatctatatgatgctggtatgatcaagcacttgatgtaatgcctagaagtaaaatgaacctgtgaacattttctggtataaaacatgtctctgccacaacacaatttcttaatttcaaactcatatttaggatcactgctttcagcagcactgtcagcgcgcaaggctggcatgaagcttccaactgcatattatcacccattgacaaactcgacattttatgaagagcccctctttcacactgacatcctctgtaccctgagtaaataacttacaattcatttcctaaccttgattttagagtccatccagcctttccacccttctttttcttctttccaaacaagtgacaaagaacaaggaagctgattgaaggggtccattatgtatcaacttaaagaaaggcaaagtgattgatgaaaccagcagtcaccttcactgctagctactgcacctgtatcctttttgtcaaatgacctgaaaatcctgctgacagtttaacactcactacaaggatacacagtatgagactacagttttcaatatttttatttgcagtgaaatctttagggatataatttgagaacaaaagtttagctttataatttttgaagctttgtattttcctcctacacagtctctgattgctatcaactttctctgcaaaaataccgtcatggtgtggacagggtagttagatgtggtatggtaggtaacctgaatgtttattttaaacttcatgtttttgtttttgttagtggagacaacattgttaactcagcaggattccttctgccaagtgatttgatgaatccaaattaattatattgctagaagaggtacttataatttctcattttatctctttggggtggccagtagctcaaaaagtaattaaaattaaaaagtaaaaatgaagtattctaaaattactaacactttatctaaaagacctaaagttgtctctcaactttcaataggtgaattcactaggtaaccaagcaactaagaatttcttctgtgaatagataaaagtttacttaaaaaactcatgacatttccgtatagcagtgaatttagtcataagcttactgtgttagaaataaaaatttcactaggcaacagggacacacttgagagccagcaaaatctcaaaagaagccacagttctctttgtggacatagcaccatttcctctgggcatttattacctgttaaaaaccaatcttttggtgagtggcagttcagggtttttgagagcaagctgcaatatttcttcaggtctgcagagtcataattaaagctgaactgagcggaattggagagggaaggtcagcgaggtgccgtatgagagatgaggctgggctgatgggcaccaaatgaacaaattatgatgggccccactcaatgtgatgaggtcaaatgcttgtttctacccactgacagttcaatttccctgaaatgtctctcggttctctatgagctaattatgaatgaaaagttatcaactgcccacaccaaagggggcttaaatactattttgtagagttcttaatgtcaaaatattgttcaaaacagcatgctgtcccactccaaatacaatgcttgggttaatgtaaataccagtgaaacactatcaattttcctcaggtttcccacaatgtatacataaagcaaattctccagcacttgtcagcttaacaacaaaataaagatcatttcatcaagtaaatctatattatacctacagctcatttccacagtaatagcagttcggtgcttatagttttgcatatcacaggctacataatcttcaaatagcactatatattttttcaggaacgatgctactggattattagcttctaggcatcaatactcagatttaccccagcatacagatttattatactaaatcagctcaacagcaattgacaaaatgtaaactccttttatggaacctcagtttttgaggaacaatttccacagcctgcattcatgatggacaattattttctttacatctataagcctaagtgcctacatcttcttttttgaatcctatgacacatggtaaatatttgattgaatgcaggatccaacaaattcttaaatagtatatggcctcaatcacagtaacacaaaaacagattgaagtgataacatttgctgaagccctactatgtgccattcactatgaaaagactttcacataggaatgtttaatataatacgtagtctagtagttttctagcaatctacgacacctataaaagcttggatcaatgaggttaaagtgtacatcaaataaaaaataaacaggatctgcataaaatatagtactgagcttaattttttttaaaaatgataaaatatgtaaacataataaagttgaaaatgacacttgtcaactttctaattaacactaggtggaaaaggagttttaggaatacgttctataagaaaaatggatttaaggtataaacataagaagtacttgcagggggggtcgggcaggaagagggaaagatcaattacaattcaggtaaacacagtggacattaaaaaaaaaaggagcatgaagtagggaaaaaattttgccatttaaaaagatcatgtacagatatatacaagtacatttttgggcaacttactaataatgaaagtttttagtgttaactgttgtttccacatttaacataatatgcttagatatacagtatcaatttatatgattccttaagaagcattaccttatatacgcatgtttagagatcacaatttaattcattcattaaaagaccctttctggaagttgattttttctaattcttattgtaattgcattgttctaatcttgtattataaaggcagctgcttgcctatcatttgtactttccttgttaatcctgactcagtgaattaacctttaattacagccgttaaaattgaaatgagcctcttgtctggctggggctgccccctttcagtgcatgattctgatgaaaatttttagggtcaatgaatatgtcccatgtcatgtctgatagctgctaaagatgtgaggaggtaaatgttaccttagaaagatgtgctttaaatttttagatctgctctattgacagaaaaataaaatcaaaatgttatttttcatttttcagcttaccatgctgtatttttagagagagcatttaagaaatataaagaatggaatattaagctacgtttagtcaaataatttaaagcaataacttaatccccattttactgtcttaaatattacatgctaagtaataaaaggaatgtgtaagtagcacaaccactttctagatatgggcttgatgggaataattctctcagtaatgtaataaactaacatattaaccagtggggaggggccaagatgactgactagaaacagctgtggtcagaggctttcaccaagaagaatgaaaatggtgagtgaatcctgcaccggcaactgaggtatctctcactgggactgactaggtggttggcacgacccacggagagtgaggagtagcagggtggagcaacagcccacacaggagccacatggggcaagaggagcttccacccccagccaagggaggtggtgagtgattgtactatcccgcccaggaaaccacgccttttccatggatctgtgcaagacgcagatcagaagatcccctcgtgagcccatgccaccagggccttgggtcccaagcacagctgtgcagactctcagtggcccctcggctggagactccctgagactcgtgagttcaagaggggcagccatcatcatacagctgcctgctgcctaagatgactgagctttggcaggggaaggggggcagctgccatcactgtggctgcctgctgcctaagaccaccgagctcccgggcaaggggcagcagccatcactgcagctccaggctgccgttttcccctgccagtgccggggagactgggcggtttggaccccggaggaattttccacagcgcagcacagtggctgtggcagatcatggccagactgcttctttagagtgaacatggacccattcctcctcactgagctgggcctccctgcaggaatttcagcaactccagccaggggtttagggacagaactctgatctccctggaacaaagccactctggggaagggcagccatggtcttggtggatcagtgcacttagtccttcccctcgctagctctgaggaatccgggcagtctggatgagtgggattcccgcccccgcacagagcaacccctccaccaagggttagccagagtgcttccttaagcaggtccctgatcctgtgctccctgactgggtgagatcttccaacaggggtcgctagacaccttacacaggagcattcctgctggcatcagattggtgcccctttgggatgaagctcccagaggaaagagaaggcagccatctttgctgttctgtagcctccactggtgacacctccaggtataggagggagcaaggacaatagggtctggagtgggccccagcaaactgcagcagctctacagaagaggggcccgactgttaaaagaaaaacaaacatcaagcaacaacagcatcaacaaaaaagtccccacaaaaactccatccaaaggtcagcagcctcaaagattggaggtaaagtcacaaagatgagaaagaatcaatgaaaaactgctggaaactcaaaaagccagagtgcctcttctcctcccaattaccacaacacctctccagcaagggtacagaactgggctgaggctgagatggatgaactgacagaagtaggctttagacggtgggtaataacgaactttgctgagctaaaggagcatgttctaacccaatgcaaagaagctaagaaccgtgataaaacactacaggagctgttaaccagaataaccagtttaggcaggaatataaatgacctgaaggaactgaaaaacacaacatgagaacttcacaatgcaacccacaagtatcaatagccaaacagaccaaccggaggaaagaatttctgagcttgaagactatcttgctgaaataagacaggcagacaaaattagagaaaaatgaatgaaaaggaacaaacaaaacctccaagaattatgggattatgtaaaaagacctaacctatgaatgattggggtacctaaaagagatggggagaatggaagaagttggaaaacatacttcaggatatcatccaggaaaacttccccagcctagcaagacaggccaacatgcaaattcagaaaatccagagaaccccagtaagatactccgtgagaagatcgaccccaagacactaatcgtcagatttaccaatgtcgaaatgaaagaaaaagtgtaagcgcagccagagagaaaggccagatcacctacaaagggaagcccatcagactgacagcagacctctcacagaaaccctacaagccagaagagaatggaggccaatattcaacattcttaaagaaaagaatttccaacccagaatttcatatctggccaaactaagcttcaaaaatctaccaaacaaatgaaaagcagaaaaaagcaggggttgaaatcctactttctgacaaaacagattttaaaccaacaaagatcaaaaaagacaaagaagggcattacataatggtaaaaggctcaattcaacaagaagagctaattaacctaaatatacacgtacctaatataggagcacccagattcataaaacaagctctcagaacctacaaagagacttaagactcccatatgataatagtgggtgactttaatatcccactgtcaatattagacagatcatcgagacacaaaatttaagaagataattcagaacttgaactcagctccggatcaagtggatctgatggatatctacagaactctccaccccaaaacaacagaatatacattcttctcagtgccacatggcacttactctaaaatcgatcacatcatcggaagtaaaacactcctcagcaaatgcaaaataagtgaaatcttaacagtctctcagactatagcgcaatcaaattggaattcaaggttaagaaattcactcgaaaccacacaactacatggaaattgaacaacctgctactgattgactcctgggtaaaaaattaaggcagaaatcaagaagttctttgaaaccaatgagaacaaagagaaaatgtaacagaatctctgggatgcagccaaagcagtgttaagagggaaatttatagcactaaatgcccacatcaaaaagctagaaagctctcaaattgacatcctaacatcataactaaaagaactagagaaccaagagcaaacaaaccccaaacctagcagaagacaagaaataaccaagatcagagcagaattgaaggagacagacacatgaaaaacccttcgaaaaaaaaaaaatcaatgaatccaggagctggttgtttgaaaaaaattaataaaagagaccactagctagactaataaagaagaaaagaggcctggtgtggtggctcacacctgtaatcccagcactttgggaggccaaagtgggcagattacctgacgtcaggagttggagaccagcctgaccaacatggagaaaccccatctctactaaaaatacaaaattagctgggcatggtggcacatgcctgcaatcccagctatcgggacgctaaggcaagagaatcgcttgaaccccggaggtggaggttgcagtgggtcaagatcatgccattgcactccagcctgggcaacaagggcaaaattccatctaaaagaagaagaagaagaaagcagaaagaagaagaaagaaggagaaggagaaggagaagaaggaagaggaggaggagcaggaggaagaatcaaatagatataataaaaaataatgaaggggatattaccactgaccccacagaaatacaaccatcagagactactataagcacctctatgcaaataaactagaaaatctagaagaaatgggtaaataccaagactgaaccaggaagaagttgaatccctgaacagatcaacaagttctgaaattgaggcagtaataaatagcctaccaaccccaaaaagcccaggaccagatggatttacagctgaattctaccagaaatataaagaggagatgataacctttcttctgaaactattccaaacaattgaaaaggagggattcctcactaattcattttatgaagacagcatcatcctgataccaaaacctgtcagagataacaacaaaaaaaaaagcaaacttcaggccaatatccctgatgaacatcaatgcaaaaatcctcaattaaatactggcaaatcaaatccagcagcacgtcagaaagcttacccaccatgattaagtcagcttcatccccagcatgcaaggcttgttcaacctatgcaaatcaataaacataattcatcacataaatagaactaaagacaaaaaccacaggattatctcaatagatgcagaaaaggcctttgacaaaattcaatattccttcctgttaaaaactctcaataaactaggtattgatggaacatacctcaaaataattaagagccatttatggcaaacccactgccaattatcatactgaatgggcaaaagctggaagcattcccattgaaaaccagcacaagacaaggatgctctctctcaccactcctattcaacatagtattggaagttctggtcaatcaggcaagagaaagaaatagagtattcaaataggaagagaggaagtcaaactgcctctgtttgcagatgacatgatcttatatctagaaaacccatcatctcagcccaaaagcttcttaagctgataaccaactttagcaaagtctcagtatacaaaatcaatgtgcaagaatcacaagcattcctatacaccaacaacagaaaagcagagggccaaataatgaatgaactcccattcacaattgctacaaagagagtaaaatacctatgaatatagctaacaagggaagtgaaggatctcttcaaggagaactacaaaccactgctcaaggaaatcagagaggacacaaacaaatggaaaaacattccatgctcatggataggaagaatcaatatcatgaaaatggccatactgcctaaagtaattcatggattcaatgctattcccattaaactaccattgacattcttcacaaaattagtaaaaactactttaaaattcatatggaaccaaaaagagcccgtatagccaagacaatcctaagcaaaaagaacaaagctggcggtatcactctacctgacttcaaactatactacaaggctacagtaacccaaatagactggtactggtacaaaaacagacacatagaccaatggaacaaaatggagaactcagaaataagaccataaatctacaaccatctgatctttgacaaaacggacaaaaacaagcaatagggaaagattccctatttaataaaaggtgctgggaaaactggctagccatatccagaaaattgatactagaccccttccttacaccttatacaaaaattaactcaagatggaataaaaacttaaatgtgattgggcaccgtggctcacacctgcaatcccagcactttgggaggctgaggcaggcggatcacctgaggtcaggagttcaagaacagcctggccaacatggtgaaaccccgtatctactaaaaatacaaaaattagccaggtatcgtggtgcacacctgtaatcccagatacttgggaggctgaggcaggagaattgcttgaacccaggaggcagaggatgcagtgagcagagatcacgctactgcactccagcctgggcaacagagtaagactccatctcaagaaaaaaaaaaaaaaaactaaaatgtaaaacccaaaactgtaaacaccctagaagaaaatctaggcaatatcatttaggacataggcacaggcaaagattttatgatgaaaacgtcaaaagcaactacaacaaaagcaaaaattgacaaatgggatttaattaaactaaagagcttctgcacagcaaaagaaactatcatcagggtgaacaagcaacctacagagtgggagaagatttttgcaatctatccatttgacaaaggtctgatatccagaatctaaaaggaaattaaacaaattaacaagaaaaaaacaaaaaaaaaaacattaaaaagtgggcaaaggacatgaacagacacttctcaaaagaagatatttatgtggccaacaaacatgaaagaaagctccatatcactgatcgttagagaaatgcaaagcaaaaccacaatgagataccatctcatgccagtcagaatggcgattaaaaagtcaagaaacgacagatgctggcgaagctatgaagaaataggaatgcttttacactgttggtggaaatgtaaactagttcaactattgtggaagacaatgaggttattcctcaaagatctagaggcagaaataccatttgacccaccaatcccattactgggtatatacccaaaggaatacaaataattctattataaagatccatgcacacatatgttcattgcagcactattcacaacaacaaagacatggaatcaacccaaatgcccatctatgatagactggataaagaaaatatggtacatatattccatgaaatactatgcagccataaaaaggaacaagatcatgtccttcacagggacatggctggagctggaagttattatcctcagcaaactaacacaggaacagaaaaccaaacaccgcatgttctcacttataagtgggagctgaacaatgagaacacatggacacagggaatggaacaacacccactggggcctgtcagggggcacgggaggagggggagtatcaggataaatagctaatgcatgctgggcttaatacctaggtgatgggttgatactgcagcaaaccaccacagcacatgtttacctatgtaacaaacctgcacatcttgcacatgtatcctggaacttaaaataaataaaataaaaataaataaacactcaaacaccaatggagttctttaaactgacagcagtgttaatgggttctatactgatgactctggaaaataggaagggttaattcattccaaacacatttgatgagcacctattatgtattaagcactgggaataaaaaaaggtcctgttctatcttccagaaacccagactccaatattattacatctatatttctaatgtaaaagacaaggcaacccttcccctatgctgatgatgtttactgaagccatttgaagtctctccacttactttctttagatttctagaaattttagagctggaagggactctagaatcctgttccctaatttcatagctaacagcctgaactgaatgtaaactttgatgtactagtttatatttacaagatattttgtcaggtcacatattctatgaagcatgaatgtcaaatcttcagtgaaaatatgtaaatgaatgagtttctgaaattacgcacttaaaaacgcattatgaaaaattttcaaatgtatacaggagcagggacactgatatgatgaacaactagatactgagcactaaatttcaaaattaccaacattagccaatcttgtttaatctaatcttttactcaacttctgaattattgaaaagcaaattccatgtattatttcatcagtaaatactttggtttgtatatgtaacagataaagattttgaaagaaaacatacaatattatcacatctaaaaatgatataaaacaaaaattcctctaatttcacctaaaatacagtattcacatttccttggccatttcacgcatatcattttagagataatcacaattcaagcaagatgaacacatttggctggtatcgcttttaaatctctcttaatctaaaggtatatgccttctgaattggaatttgctgaaattttctgttttgttttttggggggagtattatttgtacagaggtgtaaagcagattttccatattaacatttggaggggaaaagtcataaattcagtaatgaaaaacagctgcaaatttaaggaaaaacacttactgataggcttataaaagctgtatataattatattccctgaatgatttgagtaacaatgtgtctgatatattctttttttttttttttttttttttttttgagatggagtcccactgtgtcacccaggctggagtgcaatggtgcaatctccgctcattgcaacctccacctcccaggttcaggcaattctcctgcctcagcctcctgagtagctgggattaaaggcacaagccaccatgcccggcaaatttttgtatttttagtagagacagggtttcaccatgttgttcaggctggtcttgaactcctgacctcgtgatctgcctgcctcggcctcccaaagtgctgggattacaggcgtgagccaccacgcccagcccacgtctgatatattctaagttaagtggtttttacttttctttgatattagggttatatactgtacttgtttttactccatactctcttgtcagtggtaatcaattcttagtgttcattggacatgtattctacagctaaattcgtttctcttccttcgaagagaaataaaggttttgtaaatatcataacatcttccatgtttaggtcaggtttctcatgttaagagatttaatactattagaataagaattattaatttccataccatgccctgccctgtgttcagaaaaaaatttggcactgtttttaaggggaacagtggtaacagaagttaacttggctgacatgtaattaaataatatttgctatatgattgaccaatgcataatctaagataccataatgcttaaaaactatatttttcatttcaataccacaattcaacagtagcaacaaaatttgaaatatagcaattcatagtcacacaaaattccatcaaatttgtgtgactatgaactgccttttttaaatgcataatttcagactatgaactgttttttaaaagatagaatttcagaaactcatttatttacatattttcaccgaagatgacaaaactgccataaaagatgaatcttttaaaaacatattacatttttaaataaattatattttaaaaatcatcttatttcctactgtggtatatttaataataataattaaaagctaaaaatcataatcttagggaaaagtggatagatgttcagtgaactctcagctctgaaacaagtgaactcacagccagcagaactacttaccacaaaggaggaggaagggaagtcgaaaggcctaaggctttctttatcacaacctctttaatccttcaatttcttgcagatctgtgtgcatgtttcctttgtttttttgggtgacctgggttttttgccacaaataattgctagttcattaataactataattagcatctgattcagcggatttgtcactgtggggaattttactaaaatactaacaactaacattatgagtactatccgccagttaggacaaactggcacatatttgcttaagccaattaaaaatattttgcaataaaaaaattccaactaaaaattaataacaatctctttttaaaaagtagctccttttagtaatctaggaaaaggagagatgaaaatggtctgttatgagtacctcagaagtagcatagaaatagaaagatcaagcagcaggatgacataccttaaggtttaatttaagaattaaagcaacctcatacccagagaattgaataaaagaataagatggggcatggctaggcaatggaagcacaaaatactgtcacactttaatttaaaaatgttttcaattgaagcagacccaggccagtgatttttcattatttttaccacagttccatgactactgacattttcatcagaacaaataaaggatttttcctaaatttaaaatgacaaaattatttttaattttgacttacaatttctccctcttccaaactcaaaggaatttgatcttagctggacttgtctcttagcctggggcctgaatataccttaactttataaaatggaaaaaaaaaatttttttaaagatagttcttcaccgggcacggtggctcatgcctgtaatcccaccactttgggaggctgagacaggtggatcacctgaggttaggagttcgagaccagcctgaccaacatggagaaaccccatctctactaaaaatacaaaactagccgggcgtggtggcacatgcctcaggaggctgaggcaggagaactgcttgaacctgggaggcggaggttgcggtgagctgagattgcgccactgcactgcagcctgggcaacaaaagcaaaaccctgtctcaaaaaaaaaagatgattcttctactatattagaaaaactttatcatataattttttgaatgagatcacatattcatgaaatgtctggcatataacttagtaaacgtacatattcaacaaagacgtccctcaaagcaatctctccttgcagaccaacttgaaaaaagtctagcactctgccaatataagagattggaaaacaaaactaaaataccctagtagcaattaaaagagagtgaggagaactggtaggggggtggttggggaggatatatctaagataagactactcaagagaaactgaaatcctaaatacaatgcaactaacttcaatcacaatagttactattataatgcacaattatcctaataattccaaatactgttttagtagatttcagatggagtgaatcagatacttcttcatgaattatggtttgtttttttcttattattgttttaaaaccaacagagtgacttccataccaaaacaaaggaaaggcctgataagagtcttctgtttcccagttgagttcctacaacacaaactgggtcagggacttatccctaactcacggaagagttgtaactccactggctgccaattttcgacaatagcaaaaatccgtaagactacttgctagccaatttcccatattcctttgataaggaacctgataggacaaatgataaaaactgcagaagctacatttgctttgtggcttttctttgtaccactctgggtgcccaaattcaagtggattacaaatggggttgcttcttcctatccttcggcctataaatccatggggagctgaggggcatgagtacagggcttcttggtcatgctgccaaacttaacgtcatctttttgctggtcataggaaattccatgctagctactgatattccatgctagcttcaccctggcatggtcatcaagtgacaaagtgatggtcctcaatggtaattcaaggaaagcaaacggcgaagagtacggactatgaaaatcatccttctacttcttgctaaaggagaagagtagttcaggtatctaaatcttaagctgtgtcaaatattgaaagtaactcttttaggttttaagttataatggtacagaggaaaaaaggtggaaatgtggaatttagcaaatatcaaataatagtgtttatgttcataaccagagaaataatgacaaataaagacaacttgtatctacggatacttccaaatgggcaaaactgttacaaaaaggagagcacttggtatactgtaattacatactttgaggcaatttttctttattttcccagtcaactataaactttctcagggcaagaagctttcccatcttgtttaccactatatccatggcttcatattctggtctgaataaatacatgttggatgaataaaacacttaattggcatatgtgtagtaaggaatttgacctaacctaaagaggcttaggactttctcttagctcttgaggggcgacctctaaacccttggaatttccccagtgataaaagtgtctttgttattcatggtgggccctttgggaccacacctgataatttatgccactgaggtgactcatgacaggtccctcagatagcttatgctaaggagataactcaggataaggctggccaagatagaaagaccaaccatgtgattagagggttggggcgttgagctacttaatatcagcctgacctctagagacaggggagggctggagactgagttcaactatgtggctagagttcaaccatgtggcaatatttcaaacaatcaaggctatatgatgaagcctcaataaagactctggatgtcaaggttcagtgagcttccctggctggcaatagtccatgcatattgccagattttcatgccagtagggtaacccaaaagtttcacatttggaaccctcctagaatctgccctaggtgtgtcttcgtttggctggttctaatttgaatcattttgctaaaattgtaatcctaagcacagtgcttttctgagttctctgagttgttctagaaaattactgaactagagagtggttttgggaaatccgtaaagttacagctggtgtcagaaatcttgggccaacttagtctggaggactgtgcctttaaccttgagtttggctacctccaagaggcatacaacaacaaattaggcctttttgtttgtttcatggattgttcttgaaattccttactattcctcagtgtaccacttttgcattttgaaatgatcacttttcttaatgagccttcctgtactgtccaaaattaaattccacttagggtttgtgatccacaaggatcaaatctgttatctttatggtagctaagtcagagctccctcactaatttgccacaaatgggtcagaggtgtgctgcgatactgccccccatgaatccccaaggccaactggggtctgtggtagctggagctcctagactgggtgcctccaacctccttcagcattgtttaccctagaatgcattacaggtattgccacttttctacatgtaccggcacacaaaaagattggaaaacaagttaaggaatcattactacaattttcccatgacagtgcgtcaccaacatacttctcaagtatcagatctggttacacatgttatacttaaaccctacattgaaatactgtttcagcaatactccagttcttccacaccccaagccttcaggtatactagttcctcttctaggagcgtcattcttctactccagccacctaggcaaactcatcttccagactcagttccaaggttacatatgtatatcttctctaagagatctttgtcacccaggagaacttggtggatttgtctctagttcagcacttactacattaatgatttgactatttccctcagtaacctgtgagtttcctcataacacgctgctctatgactcacctccttctttcactgcttttatttggcttttttctttgttgtcttctaaagcatgatgttccctaggattccatcttcagttgtctcttctcacccacaaggtttcccttctgttcccctaccttaaaccattacccataacctgatggctttaggatgtgtgtgtatgcacacacatgtgcacatgcttgtattctaattagttggccctaatttttcactaaaatccagaatggattttaccttcttactggacatctctaacttgatgttccaaaagcacctcagagtaacatgttccaaagaaaatttcaatgtcattgtcctttcctcttccttattttctatcttggttaactgggtaccactatccagataatcattccggtgcaaatctcagttatctacctaaaagttaccaaattcttcctttgttctcttcctatccaattaatctttcacacaactttataaaacaaagatctgatcactatcaataacctgctctaaaatcttcagaactcctttcaactgtttcacaatatggctttcaaccagtagctacttctctctcccccaaaacatacattttgtacactagctatatctagctacagaatttggcaaaaacataatatacattttatcttctctctttcatctggccattccctgggctgaaatacgcatctcctcttcttccctgttggtaaactcaatcattctccaagacccaacacaaatatcgctatccaagtccatattgataggcactctttgcagaattacttgctcccttgtctgtactcctataatgaagttttctagtctttttcattcactaaactgtgagctcccttaggaagggactatgttttattaacctgttatctgtaattcctagcatagtgatttagtcatactgtgttcaataaagcttttaagtaaatgaaattaagctataataaagcctttcagtctgcatgtatgttagaatgcaaatatctagagaatctcactggtatctatgaacaacataaacattaggggaacatgtgttgttacctgccttacagatttcagatatgaaagctcttaggtattgcaaatttttattgactatattcatgaatacattgcaaaatgcaagccttaagtaatacagctagtattccaccatctgaaagtcagaccatctgtgtctggctttgccaaaggcaaatcctgctttaaactcatgttagaatactgtcaattcttcttactgaatgttttttaaaaaggtaccatccacaatcaactacatggctaacataagttaacatttttttttgaaataaaatctaaagggttgaaatatttctatttcattacaattttcttatataattccttggaacaggaatcttaagacattttcttttttacaaaagaattttacagaaataaaaccctcattaatctgaactctaattgagaatttaagaaaattaagcatggaatgaaggatggactaagtttgcaccatctaagaagcaaaagacctaccatggagcaaataagattttacaggacatataaatgcagttcattaattaaataattctaaggagtttaccacatacggtatatacaaagattgatttagtatataattctaaaggaaagcagaaagatatggaagaaaaggaatagaatttggaagcacaaaacccggactcaagtattaagtgtactattgatagttttattttagttatactttggattttagtatatatttaatgtagctcacatttataaaaacctgtatataaaataattcaggcaaagaagtataaagaatagattaaaacaaaaacaaaatccaacatccctcccccatcgagcatcatgagtaaaactttaaaaatctgaatgacaatcacaagtatacccatcccagattgctttcctttttgcttctggcatcagaggtaaccagaatttggatttggtgttcgccagttgcaagtatggttttaaacattttccacatatgtatgcatccatcaattaaataattctaaatacttttatactttctacaaatggcttcctatgtattcttttgtaattttcctatttatttatttatttgacaggtctcactctgtcacccaggctggagtgcagtggtgcgatcctggctcttgacaatctcagcctcctaggctcaagtgatcctcccacctcagcctcccgagtagctggaaccacaggtgtgtgccaccatgccctgctaatttttgtattttttatagagatggggttttgtcatgttgaccaggctggtctggaactcctgggctcaagcaatccgcctgcctcagcctcccaaagtgctgggattacaggtgtgagccactgtgcccagcctgtgatgtttcttactattgtttttgagatttgtctaacaggtatttccagttcattcattttaacaactggcacagtattccattgtatatgcatgccacaatttatgtatctattctagtgatagatgtagtttccaattttcttttttttttttctttttcttttttttttgctcttacaatgtgtcggtgaacattcttgcatgttttcatgtgtagccacatcgattagtgagtcatggagaatacattattcaactagagtgaatatttccaaattactctctgaaatacccactgggtatgcctccaatttttttttttttttttttttttttgcaaacacactgttaaaactaatttttagagaagcctacttttcaccactttaaaaattttaaaaataagcttcctgttttacaaaacccaacaaccctcacatgcaaccattcaataattgtaataagcacacatattttagatttgatttaaactaggttaatacaatcaatggtatgaaaatatgatcggtggaaaaacttttgattggctggtaactggatgaagtgaaaaccagctaaacaatggtttcaccaaaggtaccgtctctctttgatacacctgtgagcagacctgatgaagtatcaggtaagtaagttttcagctggagtaaaggatagcttgatcatttcaaaatacaaatggatggccctaagatcagggtttagggaaaagccatagatgttgattcagggtactcttgagttattattggccagacttgggagcattatccaataaccaattccctagtcttaaagaagagaaggcaaagaacaagatgagagatggcttaacccactgatatttggcttcagttcatggcatgctaatgttttcttcagcacagaatacgacacaaggaagagacatacttggatgcaagacgtgcaaattcctgccgagcctatttttcacagcattacttcatttttttttttttttttttttttttgagacggagtcttgctctgtcgcccaggctggagtgcagtggcgcgatctcggctcactgctagctccgcctcccgggttcacgccattctcctgcctcagcctcccgagtagctgggactacaggcgcccgccactgcgcccggctaattttttttgtatttttagtagagacggggtttcaccatggtctcgatctcctgacctcgtgatccgcccgcctcggccttccaaagtgccaggattacaggcgtgagccaccgcacccggcatacttcattattttatagaacgtgtgaattactgtaacactatccttggttgtattaaagaggtatataggaaacaaaaaaagtttgttattaaggaatagcatgtaccactcactgctccttttacattactttaggaatataactatctgtagttttttccttaactcggtaagacactgaaggtactcaagaaatttaactttcttttcccttttaagttctgaggaacagaaaaattatgaaatcaatcccaaacattttagagcaaactgatatttacttttagtatgaattctttgcaataaaaaaaaaaaacagttataatcccatcacaagctttcaggtttggcgtgcagtgacttctgcctgatttagatatgcccagtacaaaaatggccaactttgctgggcagactaagcaataatcctttctgtacaataagggtttttcagtccctgattctgcagatcctggtgcttcctgaggaccttatgttttttgtttcactgagtcgcttttcctgcatagttctagtatccaatttgagggcgggaggaagggaaagaaatggaataggtgacatcaaccctatgttattactgaacataaaggccttggagcctctctaccctgtcaatcccaattttgactgaatccttcctcctatagtctacatccaggccaagatcctcaaatctgaatctattatctgttgccaaatcactattccacttgttccacggccattggactagatttcagggtttacagctacagaatagaattcaaacattttcaggatcattatttcattttgccattggactagatttcagggtttacagctacagaatagaattcaaacattttcgggatcattatttcatttgattttcataacaaaaaaagtgtttgggaaaagtattatctccattttgtaaattaaaaaacggaagtttacgcaagtcaaagaactgctcaaagtcacaatgataataaacacagctcaggcaagggtgaaaaccaggtctttgggctccagattcaatgcatttcacaaatgtcactctgtctttctaaatgagttcttagcattttaaggtggaactctaaaagtgtatttccacagaaaacctctgacttgttattaggtgttaaagaatcacagatagtatatctccattatggtattatgacatttggggattgccttgggaacccttttttttttttagacggagtttcgctcttgttgctcaagctggagtgcagtggcgcgatcttggctcactgcaacctccgccttccgggtttaagcaattctcctgtctcagcctcccaagtagctgggattacaggcacacgccaccaccccaggctaattttttatatttttagtagaaacggggtttcaccatgttagccaggctggtctcgaactcctgacctcagctgacccacctgcctcggcctcccaaagtgttgggattacaggtgtgagccaccgcgcccggccacgttgagaacctattaacctaggaaggtcagactctgatttttccataaaaacataatcttaaatagtgagtaaataaatatattttcttacacaactagtttgataagaaacaaaaaacgcaaaggatgagtcaaggtttcatgttgatgtttaccagttaaagcagaacatacactaaaatagttaactttaactgttttattcacttaaaatttttgtgacccaaatatacaaagtaatttaaagcacaacagatcaaagtttcactcaacatttctaataccagaggtgaacaagttattcttatttcacatttattcttacacacaaaattgtcttttttccccctattcttttttcatccctgcaagaagcatacattttaaggattgatgtttatgtgtttgcaggtcttgatttaaactcaggaccaaataataatccattaaaaaaaatttactaagttaaccggtttgttcactcagatactacagcaggaaataaaatgttccctcaatagagctatctgttggccaatggccagtctctggcaagactaaaacatgctgtgtttataaataatatttattatagagttattaaaaaaactaaagcctttccttataatgataataatgtttgtcaggcattattttttaaaatctctgtgttctgaatatataattaaaaggataggaacaaatagtgacttttttaattagaaaaatatttgctgtgaaaaagcaattgttctttgggtttcactgtaaatattttgttaattgaaaaaatctaatatacataaggaaaacaaataacatttactagaataaataaaaattatagatggactagaaagtcatcatttaaactaaaaaagtttcatctctttattttaacaaacttattcaaattatcccagtgaaattattttcattaatttgaaattccatcttaggttcatacacacatagaatatcagagttaaaaggaaacatggaaatctgccttgctatcatttcatagttgaaaaaaaaccaagtgatttgctcaatatcacccaattaattagtagtggtgatctagaaagacagatatcagatgggtcaataaaaaggaatctggttgagtgtggtggctcacttgagcccaggagtttgagaccagcctgggcaacatggtgaaaccctagctctaccaacaaaaattaaaaaattagccaataaattagccatatctaccaacaaaaatataaaaattagggtgtggtggcaggtggctgtagtcccagctactcaggaggctgaggtagaaggatggcttgaacccaggaagcagaggttgcagtgagccaagatcacaccaatgtactccaacctgggcgacagagccagaccctgtcaaaaaaaaaaaaaaaaaaaaaaaaagaaaagaagagaaaaggaagaggaaaaggaaaaggaaaggaaaaagacccaaacaaataaaaaggaatcctcgtcattcatatatgtgctttccatttctattttacaagtattgctttttgggtaatagatgtattacatcttgattagagaaaatctggaaaatatttaaaaatatgcagaagaaaattaaatataaaacatccataatctcatcattcagaaaagctgttaaaattatgatgcagtttcttctactctttcaatttccttgtatttgaaaacagtacaattgtacaattttacaaaatttagattatatatataacattttgtatccttttttccatctgacattataccatattttatcttattaaaatatgtaataaaaacatcttaataattgtacaaaattccttaaattgtttttgcatactttttgtaaccatcactactatcactagacatttaggtttgaacaaccatgcacataaatctgtgtaattctaattatttccttagaagaagaatctagacatgagattacctggtcaaaaggtatacatattttgatggctttttatacagatggcccaactgccatccagaatgatgtcataatttatacttttaccagtggagcagtgtataatgcctgcttcattgcatacctcagcaacaacagatgttggtttttgtaatttttgctaatgttacaggcaagatggttctttaattctacattttttcattactaccactgaacctttttcgcatattatcatctatatttcctcctctatgaataatgtgtttatatcatttgtccacttttaaaaatattttattgaagtagaatatacataaagtacacatatcttaagtgcaaagctcaatgatatttttcataaactgaatacacccatgtaacagcccccagatcaaaagacagaacattatcagcaccccagaagctactcttgtatttccttataagcactaattctcctacgagtaagcactattctgatttgttataccataaattaatttttccagttctagtccttttgctcatttttatagtaataatttgttttaaaaagttatcattatattattataaaacatttaaacattacagaaaagaaccaaaacaatcaacaagtcattctgaaaccattccatctaaagtaactgttaaccatggtgaacgtgacatttctgtaaccactgacagatacacagagaaacagacaaattatcccttagaatgggactataatcttactttgaagaaaaagaaatggaattaaaaccaaaaaataaaaaaccctccaaaacatcagatagatgttctttgagtatatacaaatcattaagaggtttgcatttcattaaaaacaaaaacaaaagcggtttcaattttgcatattacggagtgttttcctacctacatcgaaaaaataattaccatgcatcctgtcatctttccccaccttctagttttggtttcttatttttatcatttatactcaatcacatgatcacaatttttatagctactgattctattactttgaatcaccctttccttggtttcaacaatcagcagtatccccactcttttttctttaaagtagaatccatagtaattttcatgtttcagcatatctatgtacagccttaatagtaagaagaaaacacagttttcttgggtcacacttcatttcctttataaagctgcactaatgatgtacgtgtaatgaaaatgataacaggaaatatttagttattagtacatatcaggtactgtcataaacatttcatgtttgttaatcatttaataccaacaacaatcctatgaggtaggtagcatgatcattttacagatgaaaataatggaggcactgggaggtaaactggcttgcccgaagtctctaatttgtaaagcgcagaactctgacttgaacacaggtggtctgaatcaagagcctgtggttttcactgctacataatgctttgacgtttacaactagaacacaaccggagggagggacagtaaaagatgccactagctttaaggagtgaaggccaggaatgctagatgttcgtagtaatgaatagggcagatcctgacgatacagactgtaccatgtccctcacaaaagctctgtttcctactatgagaaaatgaaactattaacattcaactgtctcattagacacgttaaacacgttggacaacgtgcttaaaattactcaatcctagaacatttcatataaaatacgaagttttttttttctttggcaagattttaacaggctcaattttccagggatgcaagtactttggtgcagaaaaactgttcagtgtttggaaaattatgtcactgatggaaataccacaacccgtagcatttgcgttgccgaataacacacctatatcaatctgcacatatagttctcacattcatgagttctatatacgagtgccagcatcatttaactacttctagtgtagtcatggtcaaacagttacatatcattgaaaatattagtttattatatattacttttattttttctattcaactaggacaacatgttgactttaaaattatagatgtactctatcatctatgaacttcatttcaggatccaaaaaagctcctagacttgttgagatctcacagcattatatgggagttgtaattcttgaggggttttctttattttcctctgatgtcttctgtccacttctttccaaattcagacacataatgaggaagcttaaactctggttgattcatcttcttttctcagtactgttctgagggctggatgtgctattaggagccatgacattctgcagtagaatattcagtttatttctacacgttccatttttcagagttctagcattttctttgtttaaagttctattcctgtccatattttattgttgctggtgaacttctggttgtcattctttttagcgctacttgtttgatcattttgttagcttttggggagtgagtgttgtggtcctgcttcactcagccgtgtcaactggcggtcattttttgcccaactttagatggagtgcttttctttcctttgaagagaccatctcaataaatactttccttagtataaaagggtgagtctgtcaattactttgtgatgaatgaaaatttactacaagcttttctaatctcaactgctttcttcttattattaataaagtagaagagtctacactcagagtccattatcacatatcgtatcactttggagaatattcgttaatatttactgagtaatgacaatgtgtcagtcactgttctaagagctttgcatatattatttcattaatctcataacaatcctatgcggtagatagtattctcttaggaaaatgaggtgtaaaagtaccaatttgcccacagtcacatagctattaagtggcaaagcaggggtttgcaccctggacatctgatatcagggcccaagttattatttattcactaccttactgccaaccaaggttttagggacctcctgttccattcaaggaactaactgcttcactattgattttttgattaacactttttctttagagactaccacaaatgctcaataaatatttattacctgaataaataaaagacttaactgcttattttcaatgcttctccctcatatcttttaatgtgtcttttccttttagaaacaagggcaaattaaaatcacaaataccattcttactcatttctgggtggttaagagataatctcattctatgcttaaggagaacattgtagcttaaaacttttcacctgtactttctgagcgaggtgaccaatgttgaacagaaatgcagatagctttttttagtatttcattgcatagccctgatagcatatttgctttaaaggaggaattttttccataataacacacaagaattaaacacttcttttctcccacttttggcagaagcagctctatgctcccaggcagctcagatgatcagttatatgccatgtagtaccctgccagccctgagaaccagatctattgaagctacctatgcccatcaaagcttactattctgtctcttagtctgtcagatttctgacaacaaattaacaggaggtcaagcatatcaacagattatacatcttaggcgcagcgtgcttgatttacagtgaaaagttagtggatataatatgctaacacaataaacagttgttgcagcttcaaataccatgatatgttgacggtttttgcattattttgtgacaggtaggttctagcctcacttcacatcacattctataaataacattaaagaataattttaaagacaccaacacatgtaaataaatgtacaaaaataagacagaaaaaaaaatcttgaacttttaaataaaaacagtcatgaatttttaatagtctatgaaaaaatagtgtggtaggaataaaacgattacggaaatgaaagtctgttaatgtagacaactttttgtggcacagttcaggtatatgtactgcgtcaatgtggtgaagaacctttgtatgttacagatatataacaataccagagaaaaacatacagatgataattaagtgtggacaacaagggaaaaaaattgagaagataatggtttgagtaaattatttaaaaaattaaaaggtcttagctaaattgggcttgttcttagagaagaatctgttcaaaactaagaatccacttcaagtatttacattttaataaaaaagatacaatggcaacataagaaaaccgagctggtggattttaaaaataacttacactgatgactgaagaggaagttgacaagtgtaaaccttcaagatcagccatcaaacttggagaaagagctggtgtgggaagtgcaactggagtggatactgggttaactgtaagaaaaggcccaaattagtaaatgtgcatgaacgtttaattcaaattattaaaagcaacatttttattttgttagtaaatctaattaaattactttgattaataaatgtatgacaattctatttaacatcttgatttagtcaacttattatcaagtcatggcagttattagtcttagctttcaaaacataatggcaaatcctataacaaaataaggatataaatatcttgagtaatagtttgtgaaaatttttatcacataacattatcactaacatttatcacccagtaatctccctaaaaaagtaaagaaacattttttttccagactatcataagaataacaaccgcttccaagagaatgctgcagtggaattagaagtcttgaaagatgttcaaatcctatatctattttattctccactctaatcaggctacctaattcccttgtaattatactttttcagcaaaagctatgtgctagatagaaatgtttgactgattctaaaactgctatatacttgagaactgatacctgtaagtttggaaatcttctaaaaatgcaagtctggtcatgttactcccctgcttaagactcttcaaaggctcataactgcctacaagataaaagcccaactcctcaattaagttcacaaagtcctctatggtctgccccagcccaaacagcccttcctatgctaatggaaatgttctacatttgataaagtggacactagccacatatgcctaacatactcttgatatgtggctagtatgactaaataaatgcattttaaactttgcataatttaagtaattacatgtggcttgtggccgccatactggactattcaggtccagcttatctccaatttcagcattgttatgcactagctctatgggataatagttcccaagatcttgttctacgtcttggagccttttatattctactctgtttgcctacttctctgccttgctcatcttgcaacttcgatctggcaagctaccctttaaaaggaaaacactctctggctcacctgcaaacagcttatatgtgccttctttgttccacagatatacttgaacaaacttctataactgtacttctcatgtaatacaaatttgtgtctttacatgtttgcatttctgctagtctgtgtgaacagacaataacattaatttttggtgtttctaaaccatttgaataaaatacattacaatgtggtcaagttttagcttccaacaaattctcattccaagataataccctaaagggaataacatttagttaatttgacatttctttttttatttttatttttggagatagggtcttgctctgttgcccaggctggagtaaagcggtgcaatcccttcctgggcccaagcaatctcagcctcctgagtaagtgcatgccaccatacccagccttttttttttattttttattttatttttttttagagatgggatctccccatgttgtccaggctggtcgctaactcctaggctcaggcaatcttcctaccttggcctcccaaactgctgggattacaggcgtgtgccacaacacccagctgtgacattacttttcaaagcatctttttctcatttcagtctcacaatatccagtgaacaaggcagaacaaatattaatccgtaaagttaacaacaaatatttattctgaaaggtagcaagtgagagacaaaaaagttcaagatcctcaagtaacaaaacctaattaagaaaaagagatacatgtatttgacaaaaaaaaaaaaaaaaaagtaacaatacagtccataaatgatacggccaaagaagaaaaatttcaaaggaaacactaaacaaaatctcaacatatataatagagaaagcagcctggaggttggatggggagggagtggagctcttggtcttccctacgctcacttagtacggctgaagcacagcttcaaacccccaggcttccttagacccacactgaaaaccccggtacagtttagcaagtgtcacagagtcaggggcaaaacaaggatcactggagaaggagtggaagaggaggcttcatgaacaggagggaatgaagtccaatttttaagtaagagtgagatttgaataagaggaaagaaagaagccagttaattgttggataacagaatgctataaacaaaggctgagaggtaggaaattgaaaaactaaggggactggatttatcctatagaccaaggggaacagtcaaaaatcgatcaaacagaggaatgacaatgaatatggtcctgcaggatggttaatcagatggcagtacaatgcacagactgaaggcagggttgggagtagggaagaatttacaatagtttaggaatgaagtgaaaaagactaaagtaagccaatggcaatgagaaggcttaaaaagagcatttaatattgaagacactggaaactgagccacagggagattaatattgacaaggtcataaaaagtgaatggtagaaccactatagaattagaaactgcttcttctaacttggatcataatatgttgccttcccatgcaacacgtaacttttcaggtaagttctaaatgcatgtttattcattcctttgtacatctatctacccacccgtccaccatctgtcctttcaaaatattagaatgcccatgtaacgaataaaaaactgaataagaaacagcctctgatttcaactgtggcttggctaaataccatcaagagacaagagaagaaacttcacaccacaagcaagttctgctgttttttaaaaaaggatgggttttaatataatttcagaagatgtgtgctctggtattaaagagatgattatgcatctgtttgcaggtatggcaagatgaaagttggcattgaaagcttaccctaaagtgaattctgaggctaggtgactgtgctgaagtatttaattagtaatgtgtaaaaacaaagtgactctatggggtttttaaaaaaaatgtcatagtatacaagttaaaatgaaatatcatgcccacctggcaaattagaaaaggtaattttaaaatacaaaatctagcattggtgaaggtacaaggaatatagcaccctcatattaatactgtgtaagctggtacaagctttctgaaaggcaattttatttacttatttttgaggagtttctctgtcactcaggctggagtggagtggcataatcacagctcagtgcagccttgaatttctggactcaagcaatcctcccgcctcagcctcctgagtagctagtattacaggtgtatgccaccatgccccgctaatttttctatctttttgtagagacaggagtctcactttgttgtccaggctggtctcgaactcccaacttcaagcagtcctcctgtctcagcctcccaagtagctgggattacaggcatgagccaccatgccaagcctaaaaggcaattttggacaaacaaattcttcaaagtctttgttccagcaatactacttctggaaatttatcttaaggaaacagttacagagatattgaaaaatatatttacaatgatgaatgttacttcactaattatgatagcaaaaaatggaaaacagctaaattcccaacaacagtaaatctgttaaacagaatttgttctaacaggataaaggacaaccatacagttataaagaacgtaggttttgttttgtttttggaaatagggtcttgctctgtcactcaggctggagtgcaatggcacaattgcagctcactacagccttgacctcctggggcttaagcaatcctcccgccttggcctccaaagtgctagattatagacatgagccaccacaccaactaagaacatgtactttaaacagaggagaaagcaagtgataaaacagtttctcagtagaatccaatttggaaggggggatttgcatatgaagagaatctaaactgatatgtcagaatgttaacctggggtgtttggattacaggttaattttattttcttctttttattttaaaaactttctataaaacttttttcttttctaaaagtagatctaatacagtaattattcaattattcttctgatcaaagctttgccttaagatttaagaataagaaaaactgaatacataatggcttaatatgttgttatttaatttgtaatttgctgcatcatctgcatcattggcatcatcagcaccagcatcatcactaaacccagtaatgcctatcatgtgttaggcacagttctaaatgcttttacgtatatcaagtcatttcatcctttgagaattaaatgactcccaaaagtatttgtaccatcccaattttatagacaaagcagctaaagcatggagagattaagtaaattgcccaagatgtcacaactagtgagtaacagagctgggattgaaactcagacagcttgctccactgtcctcttagtgactccactctactgccttgaccaaaattcactcaacaatgtgatatcacatatcataaggcttatttgaagtatgattattgttggctgacagagattttttaaatatttcactgtcagttgtactaacaatgtaatgacataggtttacatttcctataaaagaacactagaatatgatcactgatttgtgatcgtcctactgagagcacatggtatggggtcctaaaatatattgtttaatttccaggaatataaaatatgcctgaaacatagaaagcatattgatatctctaagtctaacaaaagactgttaggtcatatattatcctagaacaaatgttttcttatgtattgttaactgacccccatgaaaaagagtcatataacttaatgatctaaagaaactgtggaagttttatagtctttaaaaaaattacaaatgaataaaatgagacacaaagaaaccactaaaccgattaaaagcataggactaatacctgtgctcatgataacattccctcaacagatataatagagaaatagtaagagaaataaccaaattgttttgtagtagagtcagtctattgctagggttgctgccttagagacagacaatcattatttctggtagtagcaagctctttccctcctccataactttattctgcctagtataccctcccctcatgcctctaacagcttgactgactctttttttctttcttttttctttttttgtagtggaatatcactctgtcacccaggctggagtgcagtggtgtgatcttggctcactggaacctccgcctcccaggtttaagcaattctcctgctgcagcctcccgagtaactgggattacaggtgtgcaccaccacgcctggctaatttttctatttttagtagagacagggtttcaccatgttggccaggctggtatcaatctcttggcctcaggtgatctgcccgcctcggcctcccaaagtgctggtattacaagtgtgagccaccaggcctggccaactgatgctttcttaaactcaactcaaaagttaaattttgataccgctaggtggattaggaaccttgatactgaacagtattttgtgcatttctcctcatttcatctataatgcggcaatctaattgccagtttatctgtttttcccattacactttgagagttccttgggtagggacaatattttattcatttagaatctccagtatgtagcagattacaaagatcacagcaagtattaaattaacatttcctgaatgaagaaatgaagaaattcagtacttgcagtcttcctggtatgcactgtgtacctagcaaacaacctgtgtggattatgatgtgcctcttagataaaccacagggaatgtgtctggccttctttcaagattaatctaattctcacagttgagaactaaagccactggagagtaacattttagtatctgagcaacaaactgcatgccatgggcaatggagaaccattgcaggctaataggaggcatacagtgaagttggcactctgcttgtctttatctctaagctcagatcatggttccttcacaaggtttttgtagttttttaatttggggttaatgaaaaccctgaagaggggttttcatctccctctctgtttcttcactatactttgcatctctattttctctcgtatgcaatagttatttgtcctgttatctgtgtctctgactagattttagtttttggaagggaatgactaaattctatttatctattacagcacctactaaagtaccttgcacttagcagacaatccagaaaacacaggctgaactgacttgttaacaagagagtttcaagtgtcgtttctgacaaaagcaggactatgaaagatttttaaagaaatagcacttgggtattaaaaacaaagagaaacactatatcctatattgagttaaaaaatgtaggttgggatcaaagttcccttaaaattcaaaaaaactttcatttcaattcttaaaaacttgatttttttaaaaagcttgtgtccctgtccctctccctttccctctccctctccccacggtctccctctgatgccgagctgaagctggactgtactgctgccatctcggctcactgcaacctccctgcctgattctcctgcctcagcctgccgagtgcctgcgatggcaggcgcgcgccgccatgcctggctggttttcgtatttttttggtggagacggggtttcgctgtgttggccgggctgatctccagctcctaaccgcgagtgatccgccagccttggcctccagaggtgccgggattgcagacagtgtctggttcacttagtgctcaatggtgcccaggctggagtgcagtggcatgatcttggctcgctacaacctccacctcccagccacctgccttggcctcccaaagcgtccagagtgcagcctctgcccggccgccaccccgtctaggaagtgaggagcgtctctgcctggccgcccatcgtctgggatgtgaggagcccctctgcctggctgcccagtctggaaagtgaggagcgtctctgcccggccaccatcccatctaggaagtgaggagcgtctctgcccggccgcccatcgtctgagatgtggggagcgcctttgccccgccgccccatctgggatgtgaggagcgcctctgcccggccgcgactccgtctgggaggtgaggagcgtctctgcccagccgccccatctgagaagggaggagaccctccacccggcaactgccccgtctgagaagtgaggagcccctccgcccggcagccgccccgtctgggaagtgaggagcgtctccgcccggcagccgccccgtccgggagggagggggggctcagcccccgccaggccagccgccccgtccgggagggaggtagggggtcagccccccgcccggccagccgccctgtccgggaggtgaggggcgcctctgcccagccgcccctactgggaagtgaggagtccctctgcccggccagccgccctgtccgggagggaggtgggggggtcagccccccgcccggccagccgccccgtccgggagggaggttggggggtcagccccccgcccggccagccgccccgtccgggagggaggtagggggtcagccccccacccggccagccgccccgtccgggaggtgaggggcgcctctgcccagctgcccctactgggaagtgaggagcccctctgcccggccagccaccccgtccgggagggaggtgggggggtcagccccccgcccggccagccaccccgtccgggagggaggtgggggggtcagccccccgcccggccagcagccccgtccgggagggaggtgggggggtcagccccctgcccggccagccgccctgtccgggagggaggtagggggtcagccccccgcccggccagccgcctcgtccgggaggtgaggggtgcctctgcccggccgcccctactgggaagtgaggagcccctctgcccggccagccgccccgtccgggagggaggtgggggggtcagccccccgcccggccagccgccccgtccgggagggaggtagggggtcagccccccgcccggccagccgccccgtccgggagggaggtgggggggtcagccccctgcccggccagccgccccgtccgggagggaggtgggggggtcagccccccgcccggccagccgcctcgtccaggaggtgaggggcgcctctgccaggccgcccctactgggaagtgaggagcccctctgcccggccaccaccccgtctgggaggtgtgcccaacagctcattgagaacgggccatgatgacaatggtggttttgtggaatagaaagcggggaaaggtggggaaaagattgagaaatcggatggttgcggtgtctgtgtagaaagaggtagacatgggagacttttcattttgttctgtactaagaaaaattcttctgccttgggatcctgttgatcctgtgaccttaccccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccggggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaataaaaataaataaataaaaaataaaaaaaaaaagcttgtatctcaacatataaaaatatacttttttatagaatggaactataacaattatgtcattttataggtttttctttttttaccgtagttgccaggaaatccagagttgaatataagaagaaaaagttgtaattagtacactctagtaccttgtaacatttactcttagttcccttttaaatgtactttactgttattcttttacaattttaaactttgtaaattatgaaggttacaaacatacatatgtaagatattcaaatgtcacagaaagatacaaaatataaaatgaaagtcttattcttgtctgttcccaggttagtcctacatcacaaggaggccagagctaaccactgaacaatgctgcaatgaaatttttgtatatgcccttatatgttttattaattcaagcaatatttactgggtgcccactaactgccaggagccactctgtacactaggaatagcagtgagcaacacagagaccctgtcctcatggaacttacatcttagttgggagaaagagacaataatcaagtaccaaaattttaaggtaatttcagatagtgaaaaatgccatgaagacaagaatgacaagaataacaagaataacaagaaggtttgtgctatggtctgaacatttatgtccctccaaaattcgtgttgaaacctaatccagactatggtggggcctttagtaggtaattaggttataggggttctaccctcatgaatgggattattgcccttataaaagtggtatgagggatggtgtttcctccttctgtcacatgaggaaacagaagtcactatctctgaagcagagctagccctcacctatcatcaaatacgctggcaccttgatcttggacttcccagcctccagaactacgaacaactaatttctgctgtttataaattacccagtctaacgtattctgttatgccagctcaaagggactaggacagtgtgtaagagtaggtgacttctgagttggggaagtaaggatcagtcaattgttctcagcaggggaacagcagtagaaaggcccttggcagaaatgagcctggtatgtgtgacaaatgcataaaaacagagtaggatgaaatgtggataacaagaagacaggggtcagatcatctacagtctgagaaacctgggaaaggagtatgggctttcatctaaatgcaaaattaagccattaaattcaagggtttaaaacaagaaagaaataagatctgattttatcagtagtttatcagtaggataaatttctggaaaagaactgctaggtcagtggggcgtggtggctcacacctgtaatcccagcacgttgggaagccgaggtgggtggatcacgaggtcaggaaatcaagatcatcctggctaacacagtgaaacccgcctctactaaaaaaaaatacaaaaaattagctgggcgtgatggtagtcccagctactcaggaggctgaggcaggagaactgctcgaacccagaaggtggaggttgcagtgagccgaggtagtgccactacactccagcctgggcaacaaagtgagattccgtctcggggggcggggaagaactgctaggtgaaagggtatgtgcaatttaagttttgatagatattgctaaaatgactccaaagagctgtacctatttatattcctatcaaaaacatgtacttctgtttctccaaatcttagcaacactggatgataccaaacctcaaaatcttagccaatgtgtaaaacatgattcaaatttaactccaattttatttttagtttctctgttatttctctctattatatattttaatttctctatattaagtatatgccatggctactggggacagggcaggtaacagtataaacagaacagatctatgacagaatgagataacctaaaacataactcactctcagcatagaaaaactctatcaaaaatgatagtagtttaatattcatgaaatctcacttcttgttactcttctcctagtgcaacaaagtaccactatctctctctcactatgcaggaggatttaaggggaggtggtaaatacatatatctttgtacacttgggtgaatatatttgtaggattctgaattcttagatttgctgggacaaagattttttgcagttaaaagactgagaggtatagccaaactggcctccaaaggctttgtaacccatttccattcctactgaaattgtgccaagtggaagatggtgatgtcctttccatttttatttacattccttaatcctctacctccttaagttacatgtgtcaatccccataatccacatttcacaatgtagaagttataaggtatggatgactatttagcaaacaagtataaattactaaagcaaaagattttaaaatgaattttgtgtacttgtatttggccatctatatttgttcatgtgataatgaagtgatatgctgaatagatgaaagaaacaaataccactgatttccaaaactttcttgccttattcatctataagtctttcacaataaatattgatatattttgggacatgtaaatgaaaggtactataaaaataaaaaatactcttactaaacacagaagaaatattttaaattacaatacttacaatcatccagatctagaagtgaaacatctttggtaagaggagttctatcttgctttgttttcttttctttctcctataaaataacaaatatttcatttatcacacgttctgttttaaaaatctgtggagtagtccttaatattccaaaacaaacttttttttcctctgcttagtggtaccaacaaattaaacttctgtatggttatataaaatgttttcctgaatcaacatttgtctcaattagcatatagtatttcttacccactatgcaaactcttaaactattttgtgtttaaaaattataaatgtcagaacaaaatttaaaggtatgtaattattctacaatcggacaacttcttgctaacataaaaacgtaaagtggctctttggtagaaagtccacaaatattcttgaaaataacttttaaacaggtttacttaagaaaaagaaataacatatgcatagctcagatatttttgatgggcttgtgataggtcagccttttctgatatagtttgtgacaggcattgtactagatattttatgtttctatactgggttgtatcaaacttctttgccaaagatattcattaaaatctataaatgacattcccaggctctttctttttagagttgaaaggactcactcacttgatctactgttttgttgagaaaataaatatttcaaaaacatatctgcatataactagggcttcccccagcagagatttgcttattcggtctactgtacttacaaaatgtatatatccatgaactagaatacagtgcccctaagcctgaactgttcacagtttggttagatattcagaaaaaatttgtaaatcttttaaaaagaaaacagtattaagtgcattacaaacaactaaaggccaacaaagagtagggcgttaaatataattgagtcaaagtttatctttctaatctatactattttttacattaaattttctcaatcacagaccaaaactaaagtttctactaaaatgtttttgtttatttaatcattcattcattcaataggtatgtatagaattttaaatatatattagattctgtgccaagcaatggaaataacagccaagatagatatagtcctgccttcaaataacttataatttaccaaaagtctatagcttattgctaatgtgctaataaatatttttgaagtattcctctagccacgagacggtaccactaaagcaaaatatattttatcactatttaaagtttacacagtgttagagctcctacaacagtgcacatacatgaacaaaagcattacgtaaaattatacataggtaacattttaaaataatttaaatttcacttgttttttcccttgtcctgatactcagaaacttcaaggaccacataataatatacattattaatacacttaaaaaggcactaattttattcttcaaagtaattatttttatcactgaacactccacatcatctagttgttttaattttcattccttatttaaaaatgaacgaaacagtatttgtccctctctccatttctcaaatgagtaaacaatgtctaagatggtgaaaaaaatagaagaaacattagttttgaagctaaaatttaaaagttgcaagtaaatgaaaacaagtgcagaatgaaaatgctgtctcaactagaatatcattcctgtgaagaaagaacatataacaaaaagagcataccatcatgtgacttatcaaaatgctatgctgagcacaatgggtgtagcttcctataagctacaatggtgcatgactgtctttatggaactgtaacctccccacctgaaaaattagaaacctatcaaatcaagataaagttaaagctgaaggcaagtctataccttaatttctacttcacagccaagagtgtgtaacaatatctattaaatacatatcaggtcacatataacacagaacagagctgcatgtgaaattggcataatctcttattagaagcctagaacagagagaaaaaaggctttcaaaaggacagaatttcattgactttctgagaacagcaaataaccagtgactgaaatataacattagcaatagataatggtcatttctactgaattggaaaacccttgcattctgaatcaacgctataaaatgcttcatgatgtgtttggtattcctcttatatttcatttttcattttaaaaaatccatagtaagttcaaaacattttcatacttaaaggatctactataaaaataaaattctgaattctaaacgaagaagttaagagctctattccatcaaacatttctccatttgcaattcatcttggtaatagagacagaacctgggtaaatgcatataggacttgaggcaggagatttttcttgctcaatgcataattcatgtgctccgcctgcaaagtgtgtaaaatgagaatttcacaccgcagcatgagccatggagctgcagagaaaaggcagatgaaatcatattttactgtgcgattttatttcttaccctcccaatatttatacaaaaccatcatcgacaaaccaaacacattgacagatcacccactgtttccattgtgttagtacttgagaagagatcaggcagaaagatagacaatttgtttttgtatatttttttaaatagaggattaggcttttaacagctgagtgactgtattagacttttataaggacaacagtaactgatcttagaatctcaccacaaaaaatacctagttatcaattcatcatcctcaaatctccattttgtttctatggtattcaattatacacctcaacacatcaacattttcaaaatgcaatacaaagtcacagggtcaaaaaaactgatttctatttaatgtatttcacttcaaataataaataaaagatcctggaaatacttattaacctccaaataatacaaacaaaaatatgttacaatacacctgaaaagatttgttaatgtattatgcatgttcattttcatgctgattaaaaaaaaggcaaatagcaaaaaagatctgacatgacaagcatcaaatatgcattctaagaggaaaccattgtaaagaggtttgaaatttgaaactataaaataggataagcagtatgtaaagtctgtcaaagccatactgtgctttgaaatcaacaagaagtcaaagctaatttctagcctcacaggacaagatatttgcatgaaatattttcaattagaattatcaaccaaagataatttaatgacttttttccttcaagttaactgacaaatatgattttaaaaatctgaggctaacacttaaacttgtgctttaaaacaaaagtacactgctagtaaattgagacttctttataagttaaaaagaagtctaacccactaaaacagatcttttcctattagagtacgcctacttcaataagaaagcctgcttaatggcattcacttcctttcaaaggtctcaactgcaattgaataatatttttattttagagaacttaaaatataaatgaaatcaggaaagacataaactgagaggcaaggctttgcattataacagtaaaacccaatattcttcaatatttataaaagttatataattgcaacatacaaaaatagttgtaaaaacataactaaaacttgcttacttttcaaatagaacataaaaccaatcaaaaaattgttcctttcactcttatccatgatttatttcacaccacatgccaaatttactttatccccaagaatctttcaaataaaagatctttattgccaaaatcttttattaaggcaaatcttaacatttactgacattcagacaccagtcaaatcctagtgactgatcgttagagcacctaagagattcactcagtttctttgcacctcccaaaaggaattagcaaagttttgagacacaaatataacctgagataaaaacaactgacaagagcaactcaaacactgctacgtatatacagttggtactattttcttcatagctagtatgtaccttaatcttagttttaattcaaatactgaaatgcttttaatattaagtattattaagtgcaagtacattaaatacttaatatttatttcacattggtagattattatgctttatatagtttatgtaattaaaatgttcatataaggaaaatacataaaatttactcacaataaattacaatcataatttaaagtttttatcattttaatcatagagtatctaaatcttcagccattagtacacagacactacagatataactagaatattgcatcatgaataaggtgcgaatagtggactaacaacgtagctgaaataactatggtgtggaggagcactctaatatactgggtagttgtaagaacactgaagcctaggtttcatgaaggataaaaatcctggaaactttaaaagcattattttaaataaattttttcaccatctgttcacataattttaactacaagcagaatataacttaattatattggtcaaaaacaggataaagtgatataaatgtgaatctcttcctgacacaatgtggtctacatcactgaattttctctccactgtttcatataaaaaaaaatttcccctttacattgtgtaaagtatgtgaaatcacttaaaataaggaattactaaaagtaattttgttataggtgttatttggaacaaaagaattacttcattgaaaggactatactaaaaatatttctcaattaaatatatctcagaaaataacacctacacataaaatacgcttatcaatcaacataattataactaaaacaaggaaattttctatggtcattactaacaacatctgacctcaaatgaggacatattccaatcaataacacaaacaaacaaacatggcacctgaatgtgtgactatagttttgtgcctcgtgaatatgctggggcattttaagaacataaataatccacctgtggttctcacccttttgactatcccattcacatgagtgataccccatcatcagtaacatttttcattccctgcagccattcccaactaggagaagtggagggtcacagtgatatgaggccactttctccctagcttttattttgtgtagtaaatgatgcaaaaagaaagaacaaaggcatagaaataggaaagaatacagagtgttaatagaaccacaaatattccactgggattagaatttagtgtgtgtggctgggcacggttgcccatgcctgtaatcccagcactttgggaggctgaggtgggtggatcgcttgagcccaggaggtcgagaccagcctgggcaacatggagaaacccctctctattaaaaatacaaaaaattagccaagcatggtagtgcatgcctatagtcccagctacccaggaggctgaggtgggaggatcacctgagacttggaggtcgaagctgcagagagctgggatcatgccactgcattccagcttgggtgacagagcaagactctgtctcaaaaaaaagaaagaaagaaagaaagaaagaacacaaggtgggtagggttaagacaaggtaggtttgggcaagctagcctgagtttactgaactcaaatggcagtgggccatcaggacaggtgaatttaatatccatctggcagttgtatagaaggacttggggttgggaaagcattggtcagaggatgaccaatggcaatggtctatgcaggtaatgaagagctaatctagaatagtggcagtagggaaagaagaaacagacatgagaaataacgcacagaacatataggagttggtaactatctaaacatacagaatgacagagtagtcagagataattctggggcttcagatctgggagaatgaaaagaatgctggtgacaaatggtagagcatgtcttttgattgtattaggtttggaaaaccagtagcctcagagaggtctaaaaatttggtatgaatttgggaagaaaagctgaaacttaatgtaaagactgaaagatgttaccatggaagtaattaatataaatgttttagctgaagctataggagtgaatgaggtctcacaacaggaaaaatttagagggaaaaaagaagattaaagaaaaattcattcacatcaattaatatctcaaaagactaatgtgtactaagtactaatttggggtcaacattcacacttgggtgtcagaggcgtgtaaaaagtgaagcaaccaaaagaatgaaaggtcaaaaaagtaagaacaaaagggatgcagagacttttaagtagtaggggaatagtcataaaaaaagatcaagattaagagaaggctactgggtttggggaaggatcatagctgccttttcagagagcagtatgtgtaggatagagttggaaataactgggttaagaagtacaagatggaggatatgtagaatatttttctaaactcactctcactcatgtacacacactctgtttttttcactccatgctccctctctctctctttaaatgctgaaaaaacctgaatgccacagttggcagaaaaggaatgaatggagaaagagattaaaggtgcaaaggagacagatgattattaacaaaacaagaccaaaaggaagtaggagttacccttggggaagtggatgcgagtcttacacagagctgcgttcaaaggaaaagtagggtaaatggagattgtgagttagagagcagaaacactgaccgtggatggcagctgtcttctaaggaaagtggctaagctcagaggctgtaggtaagggaacagaattaaatgttgccttacaacttgaatagtgtaaaaagagtgaaaaaaaaagagcaggatacttaagagttaccaaaaaatttaggttacttttagcatttgatgttctccaatactgttgatcttttatggaatttttaaaaatgttaaaactgttgttttatagttacatagtgtgttacattgatctttcatattttatttttaacataacacttgaaagaagtaaggtaggtactagcatgtctgctttacagatgaggaaactgaaacaaagatattctctcccaacaagtagaacactatgcttatctcataggactaccataaaaattaactgttttgaaagccatatattcaaggtaactcctaggtcgcattttcatgctcagtgccctcaaaacacattgtctggatgaaaaaaaagaaaagaaagagtaaaaatatagatttagttaggctgcagatataaggcatatgaattttcagcactaacatattgtcatgctaaattaaagtaaagtacccaccatctgccttcattactcataatttagggcagaagccacaacacttggtgcaaggaggacttttccacaattatagtcacctattattagaaaataggtatattctgtaattgcatggtatacaccaaatcattcagaaagaaacagaaataaataagtagttatggtagctccaaggtggagagtacttattccagttgctaaactaaagcaaaaaactccacagtcctgtatgcctattatagatgggaaaaggcattctaatataaagaaaataagccacctaagggaaacacatgaacacaaaactatcaacaatgtgagcgaaacccgaatttctcaaaggccttggttcactgcaatagtttgaggttttttatactgacgttctataggaaaatatttttaactatcaagagatttaatctgatcactgaaagtctttgacaaagaagaaacaaacagaatcactgacctggagtgcccctgtggtttttatcttcttttgtttttttcagggggaggaaggggtacaacacaacatgatgttcaaccactgtggctttttaatgggatcctaaagctctgcttctaatactacagaggcactgaagtctataatttttcaactgttacaaaatttcctaagaataacttctaccacttgacactcactgatttcttgttctgtcatttttaaaaaatacttcttactctgggttgtatttactgtcgatttgtaactctctttattttcaataacattttaaactttctggtaatttgatgtaagtatgaaatgagagtacatcagactcactaagtgataagtttttatatgaggccagattaataaaccataaaatctcttaagattttatgtgaattttttaaaaataaaaatctcaggttattttatatacagacacaagttttaaatataaattcaagtttaagataggttttaatatatgcaagaaaatgtgaaataaggcaagacaaatactagccaatttttaaaacattctttaacaataaatctctggatgggggagggcaattgtctacttcaataaattaattttcatccttgcctactcagataacatattgaagagattccagttaacagaacaaataaacgaaaacaatattggattaagaagaaattgaactgaatcaaaggcagagtttggccatattttcaacaaacagaataacacagttgtatataaaaatactatacttgaagtctagcatgaacatggtccagttataggaagggggtgattattaaagaccaaaaagataattatcgttaggtctgaattctatatttttattcttttaactagacttgaaatcagatagaatacattttatattaataactatatttttgcaatttatactttatttttttcctgctaagcaggcaaaattcagtgttaaaaatgttattaccaaaaagcattattattttattatataagtggttccatttgtttttaaataaatggctacgcaaattcttactaactaaagaatgtatactctttaattgaagccttaaaacacactctattatgcaaaatgcccaatatttttaaaaagtgaatagtctcaatttcttatgatgtatgtacacttataattctttgctcaatactatttttgtgacttcctttcacttccccttcagcaaaaccccccccttgtcacaacctagccaagaacaaaaaaggtcatatgcgtaagagttccttgatttcagtggcaagggatgagattttttaaagtttctagcatttctgcagagttgggttataagggaaaggcttatctagaaaaaataaaatcacaggagtagatgaggatggtgttgtctattttagttgctataagaatatttaccttcaattacaacaaatgtataatctcttaccttagtgactcttctggattcagattcactttcaggttctgactctgattcagaatcggaagaactgtcttctattgaactagattcgtcatttgaagaatctgaagttttagatttttcattttccttctccccatcttcagaatcactacacataatagtaaattttgaaatatgaactttaactcctttatataagcagtttataaaaaaattgtttttaaattccagaatacattaatgaggtaataaaaaaggtattacccataaccaaataaattagaacccattcaaattcaattctatcctgtcatacaaatttcaaatgcaaaaagtcataaaatgacactaaacaatataatcaaaagcaatgtagaaaacattaaatgtttgatttaccaagaattaagtactaccagtaacaacgttaaagatatttaggctgattttttaaaacgctatctcaaaatactgtgcctgtgtgtgtgtgtgtgtgtgtgtgtgtgtgtatgtatgtatacatacatgtatatatatacgtatatacatatatattcatgtatatatacgtatatatatacgtatatgagacagggtctcattgtacagtggtgcaatcacggctcactgcagccttgacctcccgggctcaagcgatgctcccatttcagcctcccaagtagttgggactacaggcatgcaccaccacatccagctaattttatattttttgtagagacagggtctcactaggttgcctaggctggtctggaacttctgggctcgagtagtcctcccaacttgacctcccaaaatattgggattataggcttgagccaccacacctggtttagtaatatatttaaatatttatatatctacttctgctaaaatagacttgtattttatacattttctacccaagaaaattacttacacaagttcccaaatgtgaccttaaacacattctatgagaaaatgttaaccagttcaaaggaaattcttctaaagtactatcttgctaaaaatttaagctaatcaaatataaacttttaaaatatcaaatgatcatacctaagtgcttaacaccattcatttgttcacctgctcaacaaatatttattaattattgactacatgttggcattatgctaggtgctaaggataacgatggttagtaagacacagaggatctctgtgtgtctaccctacagggtctacggtccactggaggatacagataaggttgcagtgataatacagtataataagtaataagtaataaattatagcgtgtcaggagaacatgtggagagacacctaaaaaaacttgatccaattaggaatgcttcctggagaaagagacatataagccaagatataggagtaaggctggcagatgggcagggaaacagttctccaaggagaaggaataacatgtgagatgaccaaacacccttctctcaggggatgacaaatgccttgtggtgctttatattttcctggaaactaaaggtctagttctctctaccacatgtgtgtgtatttttttaagaatctactgtgggccagaaagggctaggcacttcataccaatcatactaattatctaatttaaatgcactcttcctgggtacattattatcccatttacaataatgaaattaatatttagaaaggttaaataacctgctcaagggcacataacaagaggggcagaactagaatctgaactcaagcctgtctcattccaaagtccgtattttttccactatgtcatactatctcccttcaaatgaaaataccttggagtgtaaaatttaaatttggtcataaatatttatgattactaaagggtggtttttgaagatgtttaaagcttattaggagctttaaaaaattatcatactggcaaagttaaaaaaaattctgagacagaaaaatacagggggagggagaggagtgagacaaggaaagaatcaatatttcctagaattgatttttgtggaggaaatatgattgctatttattaaaaatggagccatggtaacatctcagagcacatgtaattatatttgaagactgaaaaatatgttgttgtttttccctggcaaaaaaatggcaatttattatccccaattcactggttaaaatgtgtacttaaaaatataaggtttagaatgtatttgtggttctctttgtaataaacaattcttttaaattcaaacatgggtaaagagaaaaatccatttctgaagaaaagaataataaacctaatacatgactacaaattttgagtatactgacttttgccatctgaaaggacatttcatgcactgaacaaaactttccctttctagaaacaggacatgttttataactcgtatcatcatagacatgctgatattaaagcagaagtacaggatttctctcaaagacaaggctattataaaccaagtagctcctttgctgcaacaagtgaatgattctaaatatattcaacttctagcttttaagataagattttaaaagtaaaagtgttattttattatgcatcactcaattttgatggtaattattgtttaccttactgcttagagtttcagatgttaatctaatgaaaagaatttactggtaactaggtttttaactttgcaatgatgaaaagcctgtattaatttaacctacagatttcatttgttctgaacaggaaaaacaatataaatcacttttaaaatcattaaatcctgacttaaattaataaagtcataattagggcattatgctgtgtttgttatggaagtggcagggagagctgctttaattactgtctgtaataaaaggagcagagagcgtactgcgccccaatcagtgctgtcagccacgactgagccgggctgcaagctcatcaagtgagcgggcagcaggctcccggggaaaggaccatcatgtcggcagaggccactcgctgacagcagcggggaaaacagagttgcacaatccaagatattagacccaattactcaaaattttaatgacactttaatacatgataatgttattgataatgggagatcttaaaaagtgctaacacttaaagatcttatgaccgtcttccttcacagcccttgactctaatatttggatcataatctttttaatataacattatttagaaaaatcaattgtcttggttacataatggcaaagtgttgaaggatttaattttagccctcagcaaaatcgctacaaaaggtaattaagtgtttcatacctattgcttgatcacttaactcagccttccaaggttataccaattttcaaaatgtaaccccaagatatgttcaagttcaaaatgaaagctaagcattacaagtaggaaaataatgtgaacaactagcactttaattttaaaaagatttaatatctggaaaaaaatacacactttttttctctcaccattttttgattaataagaaacatctctgcctggggcaaactttcacagaatattttttgaaggaaattctgacaaaataagttacctttttcctttggcttttgagttcctcttggctgttcttttgttttctaggcctgactcccgtccactctcactgtcctgctcactggaggagtcctcactgctgtcctcattgctgtctccttcctccccactttcgccttgttctccactttcacttccagattcactctctgaaaaacagaaccagatgttcttagatttatagtcatttaattagacacacggacacctgtaactgtcaatattcatcacaaatgaaaccagatgttgaattttagttcagtggacaccacttgtttaacattttattcccacaccccattctttcagctctatggattcctttagcactgtgagcttggagggaggcagacagaggatgctctgacaacgaggagagaaaagctaagcaaaggtgaaccaagtaaaccaaatttgagggaatctcacttcaaaccccaaagtatatagctatgtcaaaaactttcttttaaagaattacgtaaggattgatgtaaggctaaagaaataattttgaattcttctgcttgtaatgggaaattctatttagagtaaaagaaggcaacagttgaatcttcttaggaacaaattttgagaggaaaatgagccattcaaatcacttggaaagacctccaaattcaaagacaataggcaaaatgactaattaaagagttattacttattcgagctagtaaacgagttttccataggtcaaagagatgatcaagttacactgaggaattatacttttaaatgttttatgtgtaaattatggtatgctaggactgttcgcagaagagaatacatgaagaatatatgtgtattttttaagtgaagcataatttttactatttaaaatgactataactacagagttgtgtcccagacaaaaggacaaactgttgccctgcctgtgatctatgtaacgaagccctcttaggcaggaacataacctttaattaaacattctaatggttaaataataccaacatcaggaaggtccatcacagtgaaaacctaggactgcctgtattgttttaagacggcttacaaggggtacaagcatgggttctcaagttagtgttcggattcagatcctggctcttctacttgccagttgtaaaactgaacaagttattcaacttctctgggttttggtttccttttcagcaaatggggataacactagttacttttcagagctgttgtgaagattaaatgatttgaaacatacaaaggagattagaacacaacagggtctgccacagggtaaggcactcatcattatcatcatttacaaacaggaaagtttattttactaaaataaagctactaaataaggacattttagatttgtggtaatatccaagttacacgcacatacatattaagtcagataactggcttatgctataaacaatgaaagaaattacaggtaatgtatcacagattaatttatcagatactaaaaacaaagatttttgataaggaagacagagaaaagaagagtgaattaccttacagtagggtagcagataaccatgtaagagtgacaggccctggttctccaaggaataaagattttagagaaagttgggtgtcgtttggtcttgggtcagatttgcctattagcttaagtgttaataagagcatcagaaagtgactacaatctatttttcattatgcaaatcactcacagaattttagcaatgaagggactttaagaaatatttaactgtaccccttcatttatctgatatagagaaaagtaggtgccttattcaatttgcataggtaaaagccagggcctctaaatccttcctattaagcattcttttcactgcatatagttaccctcaacctttagtttgatttttttatagtatatagagacttaataattttagctttatctctatagaggttcacagaaagagataagtataaaatgaaagagaaaaagactcttcaaggtataaaataaactttacgtttttgtaaaagaaagttacttttaaagaccccactaaaagttcatcaagtgtaaaattatgtttttcaatagatatattaggcattgtggtttagaattcagaaaagtatgagttcctgtttcagctataccaatgtatcagctactatccaagagatattgtaaagtaaaaagagaatttagtaattaaaaattactttgaaaactaaagagtgatatataaatgaaagggattattttgataatacaaacttcacttaaaactacctgctgaatattatggattaggccttgtttctgagatatagaatgtaatctactatgtaaataatatatgccaataaattataaaacccaccactgtcactgctactatcagaagagtcctcctcttcctcagattcagaataaaacttcttagcagaattctcttgctttgcttttcctgctggggtccattcttttgcctgtttaaacaaataaagtaaatataaatgaattctcattcagagatttagagttctggcaaacttaatcattaacaacataactgaattcaaaagcaagcttaaggcctccacagggaatgcaactgttagaagtcctggcattaaggctgattcactttactcctaaatacaacaacacaaactctcactcagaggccctatgttaaaccaacaatcttattttaaatatacaatttttaaaacttttgtgttttttggcccacagaagatttaaacaaaagtaatatatcctaaaataggtgagcgaaactagaagcagatacaataacagcaataacaaacacaagttgatagcttgacactgagggaaaagagagaaaaaaaaaaagaaagaaaagaaaatatttagtgtaggcaataaattgccctaaccatctcaacagcctaaatcctggagtaatccttgacttctctttttttctcatatcctaaacatctaagccatcaagaaatcctgtagctaccctggtctgacccacccttctctcctggactactcgttaccttgcttctactgcccctccaccctgcccccagcaaacaaactttgcaaaacacagcatctagaatgattatattaaaacctaaatgagagcaagctcctttttggcctgaaaccctgcagtggctccccattttactcagagaaaaagccgaagtccctacaacagtctgcacagcccaatacaaccatcctttcatgactgcccctccacaactgtccccgtcgcctgcctctctcacctcttgctgctcaccctcttgcctgatctgctctggccatgccttactgttcctccaaacgtcccaggcatgctcccagtttagggccttcaccctagctcttggcacttccaacaccattccccaccaccttttttttttttttttttttaatcacagcatgtattacttgttaacatactatacaatctacttgtttttttaactgttggtctatccctggtagaatgtaagtttctggagagcagggaatttaaaatattttgtgcaatttttttttttttttgagacggagtctcgctccgtcgcccaggctggagtatggtgacaggatctcggctcactgcaaactctgcctcctaggttcaagcgattgtcctgcctcatcctcccaagtagctgggatcacaggcacccaccaccacgcccagctaatttttgtatttttagtagagacaggatttcactatgttgcccaggctggtctctaactcctgacctcaggtgatccacctgcctcgacctcccaaagtgctgggattacaggtgtgagccaccacgtccagcctattttgttcaattttaagtgtggctgacacaataaatactaattatatttattagcctcttaaagacttcaatattaaattcagaaacatgcttaagaaaaatactgactttagtgtttactaaatattgtattagtaacagcatttactaatatgagcccctttaaccactttaatacagagtattagtttgcttttatagtcatggccttgatttgtcaagaagaaattaaatcatgcttcatatatgattttttaaaaagcagggaaatgtatacttctgaaaagataaaatagttgagactcatttattgattgtacctttgagtttttcctatgtgcaagtctttgctagagtacctattttattgtaaaggagtctacagcatgacagaatttcttattcaagaatgtttctcagcactgaatgtacaatagaatcacctgagaatagtttttaaacgctaatataaacaatacaaatattaatactaaaaaaacaaatacctagattcacctcctaaaattctgatttaattagtctggtgcacatttgacctagttttgttttatttaaaaaatctccaggagggtggagccaagatggccgaataggaacagctccggtctacagctcccagcgtgagcgacgcagaagacgggtgatttctgcatttccatctgaggtaccaccaggttcatctcactagagagtgccagacagtgggtgcagcgcactgtgcgcaagccggagcaggatgaggcattgcctcactcaggaagcgcaaggggtcagggagttccctttcctagtcaaagaaaggggtgacagacggcacctggaaaatcgggtcactcccaccctaatactgcgcttttccaacgggcttcaaaaacggcacaccaggagattatatcccacacctggctcagagggtcctacacccacggagtcttgctgattgctagcacagcagtctgagaccaaactgcaaggcggcagtgaggctgggggaggggcgcctgccattgcccaggcttgattaggtaaacaaagcagccaggaagctcgaactggatggagcccaccacagctcaaggaggcctgcctgcctctgtaggctccacctctggggccagggcacagacaaacaaaaagacagcagtaacctctgcagacttaaatgtccctgtctgacagctttgaagagaggagtggttttcccagcacgcagctggagatctgagaacgggcagactgcctcctcaagtgggtccctgacccccaagcagcctaactgggaggcaccccccagtaggggtagactgacacctcacacggccgggtactcccctgagacaaaacttccagaggaacgatcaggcagcagcatttgcagttcaccaatatccgctgttctatagccactgctgttctgcacccaccgctgctgatacccaggcaacagggtctggagttgacctctagcaaactccaacagaccttcagctgagggtcctgtctgttagaaggaaaactaacaaacagaaaggacatccacaccaaaaacccatctgtacatcaccatcatcaaagatcaaaagtagataaaaccacaaagatggggaaaaaacagagcagagaaactggaaactctaaaaagcagagtgcctctcctcctccaaaggaacgcagctcctcaccagcaacagaacaaagctggacggagaatgacgttgacgagctgagagaagaaggcttcagatgatcaaactactccaagctacaggaggaaatacaaaccaatggcaaataagttaaaaactttaaaaaaaaattagacgaatggatacctagaataaccaatgcagagaagtccttaaaggagctgatggagctgaaagccaaggctcgagaactatgtgaagaacgcagaagcctcaggagccgacgcgatcaactggaagaaagggtatcagtgatggaagacgaaatgaatgaaatgaagtgagaagggaagtttagagaaaaaagaacaaaaagaaacgaacaaagcctccaagaaatgtgggactatgtgaaaagaccaaatctacgtctcattggtgtacctgaaagtgacgggtagaatggaaccaagtgggaaaacactctgcaggatattatccaggagaacttccccaatctagcaagaaaggccaacattcggattcaggaaatacagagaacgccacaaagatactccttgagaagagcaactccaagacacataattgtcagattcaccaaacttgaaatgaaggaaaaaacgttaagggcagccagagagaaaggtcgggttacctacaaagggaagcccatcagactaacagctgatctcttggcagaaactctacaagccagaggagagtgggggccaatattccacatgcttaaagaaaagaattttcaacccagaatttcatatccagccaaactaagcttcctaagtgaaggagaaataaaatactttacagacaagcaaatgctgagagagttttgtcaccacccggcctgccctaaaagagctcctaaaggaagcactaaatatggaaaagaacaaccagtaccagccactgcaaaaaacatgccaaaatgtaaagaccatcaaggctaggaagaaactgcatcaactaacgagcaaaataaccagctaacatcataatgacaggaccaaattcacacataacaatattaactttaaatgtaaatgggctaaatgctccaattaaaagacacagactggcaaattggataaagagtcaagacccatcagtgtgttgtattcaggaaacccatctcacgtggagagtcacacataaactcaaaataaagggatggaggaagatctaccaagcaaatggaaaacaaaaaaaggcaggggttgcaatcctagtctcagataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccctactgtcaacattaaacagatcaacgagacagaaatttaacaaggatacccagtaattgaactcagctctgcaccaagcagacctaatagacatctacagaactctccaccccaaatcaacagaatatacattcttctcagcaccacaccacacctattccaaaattgaccacatagttggaagtaaagcactcctcagcaaatgtaatagaacagaaattataacgaactgtctctcagaccacagtgcaatcaaactagaactcaggattaagaaactcactcaaaaccgctcaactgcatggaaactgaacaacctgctcctgaatgactactgggtacataacaaaatgagggcagaaataaagatgttctttgaaaccaacgagaacaaagacaccacataccagaatctctgggacacattcaaagcagtgtgtagagggaaatttatagcactgaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacagaaaaaacccttcaaaaaaatcaatgaatccaggagctgcttttttgaaaagatcaacaaaattgatagactgctagcaagactaataaagaagaaaagagagaagaatcaaatagatgcaataaaaaatgataaaagggatatcaccactgatcccacagaaatacaaactaccatcagagaacactacaaacatctctacgcaaataaactagaaaatctagaagaaatggataaattccttgatacatacaccctcccaagactaaaccaggaagaagttgaatctctgaatagaccgataacaggctctgaaattgtgacaataatcagtagcttaccaaccaaaaaaagtccaggaccagatggattcacagccgaattctaccagaggtacaaggaggagctggtaccattccttctgaaactattccaatcaatagaaaaagagggaagcctccctaactcattttaggaggccagcatcatcctgataccaaagcctggcagagacacaaaccaaaaaagagaattttagaccaatatccttgatgaacattgatgcaaaaatactcaataaaatactggcaaaccgaatccagcagcacatcaaaaagcttatccaccatgatcaagtgggcttcatccctgggatgcaaggctggttcaacatacacaaatcaataaatgtaatccagcatataaacagaaccaaagacaaaaaccacatgattatctcaatagatgcagaaacggcctttgacaaaattcaacaacccttcatgctaaaaactctcaataaattaggtattgatgggatgtatctcaaaataataagagctatctatgacaaacccacagccaatatcatacagcatgggcaaaaactggaagcattccctttgaaaactggcacaagacagggatgccctctctcaccactcctattcaacatagggttggaagttctggccagggcagttaggcaggagaaggaaataaagggcattcaattaggaaaagatgaagtcaaattgtccctgtttgcacatgacatgattgtttatctagaaaacccatcgtctcagcccaaaatctccttaagctgataagcaacttcagcaaagtctcaggatacaaaatcaatgtgcaaaaatcacaagcattcttatacaccaataacggacaaacagagagccaaatcatgagtgaactcccattcacaattgcttcaaagagaataaaatacctaggaatccaacttacaagggatgggaaggacctcttcaaggagaactacaaaccactgctcaatgaaataaaagaggatacaaacaaatggaggaacattccatgctcatgggtaggaagaatcaataccgtgaaaatggccatactgcccaaggtaatttatagattcaatgccatccccatcaagctaccaatgactttcttcacagaattggaaaaaactactttaaagttcatatggaaccaagaaagagtccgcatcgccaagtcaatcctaagccaaaagaacaaagctggaggcatcatgccatctgacttcaaactatactacaagtctacagtaaccaaaacagcatggtactggtaccaaaacagagatatagatcaatggaacagaacagagccctcagaaataatgccgcatatctacaaccatctgatctttgacaaacctgagaaaaacaagcaacggggaaaggattccctatttaataaatggtgctgggaaaactggctagccagatgtagaaagctgaaactggatcccttccttacaccttatacaaaaattaattcaagatggattaaagacttaaatgttagatctaaaaccataaaaaccctagaagaaaacctaggcaataccattcaggacagaggcatgggcaaggacttcatgtctaaaacaccaaaagcaatggtaacaaaagccaaaattgacaaatgggacgtaattaaactaaagagcttctgcacagcaaaagaaactaccatcagagtgaacaggcaatctacagaatgggagaaaatttttgcaacctactcatctgacaaagggctaatatccagaatctacaatgaactcaaacaaatttacaagaaaaaaacaaacaaccccatcaaaaagtgggcgaaggatgtgaacagacacttctcaaaagaagacatttatgcagccaaaaaacacatgaaaaaatgctcgtcatcactgaccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacaggcacatgtatgtttattgcggcactattcacaatagcaaagacttggaaccaacacaaatgtccaacaacgacagactggattaagaaaatgtggtacatatacaccatagaatactatgcagccataaaaaatgatgagttcatgtcctttgtagggacatggatgaaactggaaaccatcattctcagcaaactatcacaaggacaaaaaaccaaacaccacatgttctcactcataggtgggaaatgaacaatgagaacacatggacacaggaaggggaacatcacactccagggactgttgtggggtggggcgagtggggagggatagcatttggagatatacctaatgctaaatgacgagttaatgggtgcagcacaccaacatggcacatgtatacatatgtaacaaacctgcacattgtgcacatgtaccctaaaagtataataataaaataaaaattaaacacacacacacacacaaaatctccatatgattataatgcgcagctacatttaaaaaccactagtctaaggctgggtgatgtagctcatacctgtactctcagcactttgggagctgaggcaggaggatggcttgagcccaggagtttgaggctgcagtgagctatgatcgcaccactgcactccagcctgggtgacagagcaaaatcatgtctcaaaaaaataaataaaagcaaataaaaataaaaccactgatctagagggtttaaggtatgttgcttaaaaagagaagcttgaatatatttgaataagatgcttatataagatcagcagtatggctttcttttatatttatttaaaatgcttctgtctacaaagatagtattctataaacaaagctctcttatatttggtaaactctgaagtccatatttttcttaaatccaaacatatttctctgaggtctgataaaacgtttgttggattaatttaataacactaaatcaacaatttcggaaaaccagacttctatgctcaaacgtgcattttttcttgacatggccatgaattctatggagtttcaggttttaaaaggccaaagacgaacaataaaagtatcttaatttgtattgtggtcctttatgactaaaagaccacattatcattgtaaggaaaaggaataatagggaaaagaaaagaaaagaaaagaagagaacatagacgctaatttgaaagtttctgtaaaggataaaatattgacagatgtgtttatgaagcaaaatacccttcatatgcagaaggcggtctttctgtcagtagagaagaaaggactttctagaactaagcaaataaattattaactaaggatcttcaaaacttactgggatcataatataaatatatattatatcctatatcctagaaatggtggtgtgtaattcaaagtgacttctactgtcaatctgactaggttcccagtcattttgattaaaatatcagattatctaaacctaggtcatttttcttactaagttatatttcacagttacaggacttgaccatgtaagatcactttacaggaaaactagaataacatagtatattatatgcatgaaatacagtgacatgacttggaagggagatgaagtagagtgagagacaagaaagataatacggacattattttttgtattgtagctgcatttaaaaagaaaactatctacgttatttttatatttaattgtgtccctcatagtataattttaagccaattgtctcagagtccaatagactgaagctgttttctgcatggcatcaacagacagtgacagttttatcaaaccatgttcaatcagttataatgattctctctaagttaccaattattaatttcataaatataatcagcaaaatgaaaaagaaattaatttgtctctgttgaattggacaggtgaaacgaacataatatgttatatttaagtactgtccctataaggtagttaatgcttagaagagcacatgaaaatggaagaagccagccaacaaaccaatctatcagccaataaagaatactgctgagaccaaattaaattgcatagcattgctatcaactctgagaagataatgctttttggtgggtgggggcagcaaggagggagagataaggcggaagcaggggaaggttaaaaggatggttctacttgggctaaaacatcatgtaccccataatgaaaaaaaaaaacgaaccataaaaacaacaaacaagcataataagaaattaggagagaaagtatgtccgtaggaggaaccataacaaagaacactctctttatattctagtatctgatcaaaagttgcacaaataggctgggcacggtgactcacacctgtaatcccagcactttggtaggctgaggcgggcagatcacttgaggtcacgagtttgagaccagcctggccaacatggcgaaaccccatctctactaaaaatacaaaaattagccaagcatggtggcatgtggctgtaatcccagctacttgggaagctaacgcaggagaatcgcttgaacctgggaggcagagcttgcaatgagccaagatcatgcccctgcactgcagcctgggtgacagagcaagactctgtctcaaaaaaaaaaaaaaaaaaaaaaaaaaaaattgcacaaataaggcaactcttttgaagagtacttaagagtatgcagatttgagtaaaaatcaacaaactcagctgcaaggagggatagacatgtaattgcttctcatatttttacatattactactgttacaaatttttggctgtctctaagtacagatcatttgtcaaaacataaagataatggtgctaagtactaaggataatacagatttgtgaacaagctcaaggttcctcttctcatattacataataaaatacagtaacagcatggacagtgaactcagacctgggttggaatatggttctatcacttacttgccatgtgaacttaggcgatttactttaagttatctaagacttggcttcctcatctgcaatgtgggaataacaataaccatcccttacaatcattattaggtttaaacaagatagtttttataaaacattatcatcgtacactgtcaggggttcctaaatagtgctattattaattccggccatgcttcaaagccaggataagttggagtggttaagagaaacatttaataatttctcagaggaatcaaattacatggccatgatcattatagaaattctatttattaaagtaataaaggttttcttccactgtatacagaaaaattgagagcaaggaggttaactcactttcccacaggaattagtaaagaaccccagttatctgaatcctaattcaatgtatcttttccaccagaaaagtatccagaatacaattcttaactgctttttttgttaactccacattttaaagtattaaatatattttgcataattgctaaatacaattagaaggcctctctcactttttcttgtatatatgagaaagaaacagataatattagaaaagaatgttaattcttttatctcaatggccagcattttttttaaagattgagaaaaagagtatttatatagcaaatttgtttttgatgagaaagcaccatattattcactttgtgaccttgtcaaaggacatttttggtacacaatgctccctatttatgttcaggcttcacttaaaaatggttcatcaaaaaatctagaacactttgtgtggtttttctgaaagagaacagcagaaattattcagaaggatattgtcaggaagcttacaaatctctaaacaaagtagaaaaaacttcatccaatgaaactaaataccttagaaattgaatctacgcggctacaaatgcaatagcacaaatgtgggtggcactgatgcagagaattcagttctctatttccttgaagaaaaggaacagtacatgtacaatggcataggaatactataatatttagttgctataaaggcaaggtatatctaacacattacatttagaaatactagaacaattttcaattttcaactctccaaaaaagcttttatataaaacaatagctatcctagagtcttccactgctttggcaaaattaatttcagaaaggtcaacttaccaactctattacttctacatttcgaactgatgggtcgggcgccacctctggccaattagataattccaggtacccagtagctttaatgttgagagtatgagataaggtgccaagctggaaatgatctctatctattaaaaatagggaaaaatataaaataaacaatatgagctgtatataacagagaacaatcataatcagagctcaaggtaattggcatattacctcaaatgtcaaggaataaatatagactaggaagctcttcataggtcaaaaaactgatttcagtccatagattacaataatctcccccataatggtcaataaaaaagctaatcagtcagtgtgtttagaggtgttgctctgaaatgtagcttctctaaaaattactttactgtgaatattaagaatgacagcacagttaaacaatccatatacatgtcttggcacaaacacatccagaattttaatagtttttctacaaaactgaattgctttttatcgctttaaaataagaacattaaataagaaacaatatgaaaaccaaggtatgtaactatttgattccaactggaatggctacttgtaaggtggtaaaatacttaattactccttttaaaaagctgggacacgtaagtcaacttccctctttgaaaaaccagtttaaatatagagggatactttttataaaataattcctcctagaaaaactgatattagtgtacacagaatatttacttaataactcactattaaaaggaattatatttcttataaaactatttaaaagagaaatgaagtcattatttataagaataagacagttttcatctattgcccagtttaaatgttagaataaagtcagaacgcttaaaattatttagtaaataaggtctacaaaaatataaactttaatataaaacttgcttttgagagcagatgaatgagtagaaagcatgctgttcttatatatttatatatgcgaatcatttatatttcctaagagataaattttaagcacattagaaatggcaacatcttgtcataattttttagataacatatattttggagttatattctgataatacctttaaaaggagactcaagcagtggtgcaggcttttgtgctaggaatatttttttggcatatttacttaaagctccactctttacattcggaacaataagctgcctaataaatcttgtacggtctctgatgtcgtagttttgatcatacttgccgagatttaatatgtactgggtaagcaattttgtctgttggaaaaaaacagatcaagatgagaatacagttatttatgattatcgataactctggataaacatatttaaagaggtaataaaaatgaatggttatgtcaaacaaatgttgttccatagggaatacacatttctaatgctgcaaatggaattttgaagccaaagcacatgtcctcttctgtactgggtaggtgaatgctgagtattgagaagcagccatgtgctagattattaaactgctgaagtggaaagaaaggcatcattaaaaaaataatcatatatggcaaacccgctgaaggggtctacgtgagaataatgaatgtggaaatacaactaaaaacatggcactcaaaacttaatcggaaaaatatgcaggacatcaaaacatcagaaagtattagggggctggcaaactgcttctcctgaggtgtgttttatgaagagatactgtccctggcataagcagtgtctgcactctgactgcactcagttactttaccctgaattatgacccattaaagcagacacatgaatcactgaactggattactgcaaattatttgcagtgcatttagctgttactttttcataaaagcaagctgctgatgccctctgaaaactaggataaaagacttcttccatttttcccccaagctgcttatagcctctagtaatattggtcatttatttatttatgtaagggaacaacttattatagtagcttttacaccataataagacttcctaagtcaatttttgaatgtactacattaacatatattgaaataattttaataattaaaccaaaattgaaatgttaacaaaacaggtttgtattttaaactacagttattttattgaaaaagcatagttttaacaagaaggctacatgtgtacaattttaactataagccaaatagaattcataatatatgggaaaaataaaccgagaaacactaaatcatttactttagattagaagattttatgcacattagaagcagataaaaaataaaatcaatcaagttaggcagagctaaagacaattctagaacaataagtcaaagtacagaaatggtgtggtaaactcttttacaataattgcttaagataattgatttgatagaaagcaaccttatttcagtagcagagtagttaaaaaggattaacccagttttattaaagtagaattataaaaaatacaagtgaaaatgttaatagagctattctgaatttggttaccaacaattgctattcactaattgctagaccatgctggttcaagtacaggtaagaaaatttctatgattcattttttaagacaatttgcaaagtattcaccaaatgaggaatacaattcaaaaccaacttaaaagaaaatgtggtacactaaaccatgtaattaatttgctggaaaaacctgggaaatccacttaatcattagttttctcaaatgtggagttagaatttacaacttggttaactctaaagtccatttgagtgctgagattttaaatctgcaactaaaataaagaaagagtctcttaattgcaatgatttttttgagctagcagaatgatacatttggcttatatttcttagcccaaaattaatttttaggaaattaaacattttcaatatgttaacaattttgaaagttaggtagggcatttaaagtaattaaaattatataatttaaaaatttttattgactgtaaaatgtattatattataagcttataaataagttttattaaaatgtattttcaaaaataacattctttctaaaagataaaaacaaatttgtgtacaatgatgcactaaaaccataagcagaatagttattcaccacacatttacatacattaatcagtttcttcagtgtatgtatctagtaacaaggcattagtatttctctggagaatacatttttatatggcctaagtttttttaaaaaaataaaattgcaatctttttccaaattaaattctgcagtgagtaattataaaattgttgacattttcaactttcttctctgtagaccatatttgggtataatggagaaaataccctctttacagtatttctggacaatcatgtaatctcagagaaaatcctactgaatgaagaatagtaccaatccttgcttttatgttaaaaactgtcaatatttcaaacccaaatatttagcttttcccccatgtagtcaataaaaagtttttacaatattgacaacattttcaaataattattttatttatccttttaaaaatatgtcatcaatttagatactacaaaaccaactgccttctcaatttcatttcattctacacaatataaatttttctaattaaaaacaggtgctccatcaaaagagtcttcacgataggtgagatagtgcaaatgacaacctcttgattaaatcttgagctctcaccatttaacctgttcagttcttcccttgcctgtacagggaaaactttcaaagtctttctgtttgcaagacttgtttctaatgattgctatttgctaaaatttttcaaaaggtaaaattttttggcatttactagtgacactttaaataatccaaacaatttgtgaaccaaaacttaaccaatatacagaagactcaattatcaataaaaaatgtttaagccaatataagaaacttaatttacaaagcagttcttcacaaaatcatgtatctaaaattctgttgctaatatgcattaaagacagtgtgtactgttatgctatagaatggtttttcaacatcagtttcatcacaagaattttatagttcggtcaaactgtgtatactaatatcagtaaatgtgacaactacggttttatttcaactggctgaataagcagtttgttcgcatgcacaacaaccaattcctaaaacatttctcttccatagttttcttaattaaataagaacattgatttttaccatgacaacgtcctttcatcaaaaacagttttatcttcaaagttgagctttttaatttacaacagcatttgcaatatttttgacagaataaacttccaaaagctttactttgttcccatttgcagccctgaccaaacaaatatacaaatacattgaatgaaaaaagtctatttttggaattaactgattttctgtttgaaaaccagcagtgttgggccttttttctactaatggagccaccacattaacagctattgtttcatttttcatatgtgcataagaaaacatagaataaaagtaaaaaactaattttcaaaaagttatttgatctaaatgaggtcatgtttcacacagaattatataaacatcttctgcacctgtacgtattaaattaccttaatgcataatcttaaaataactactagctttttaaatggatgttgatctttttgtagcagattgttgtgtcttctggttgttgtgtggtcaatgagatcaccagcactctcatgatggttggtaaatgtcgacaaatattttatgcatgttaagtactaagtggaaatttagcactttattgtttgttaaatgtacacttccactttaaaaaatatattgctgatgattttataacaagataaaaaaagaactgccaaataataaaacaaactttagacttacactatacaataaatgacaaaactactgtagcaagagtgctttcaccactctctttaatgacctaggacaggactattcagtctttactcctgcacatatttcacctataaccaacctctaacttcccatgttttcctttaattccacccactggcagcctggagcttcatgcatctcataggccatggcaacacttgctggtatatcaagttgctggcaaatgaagcattgttaaatactcatctctccacctccagcaaagcaaaagacagcttttcccacctgctttgtcagagtatacttcatttatcagcacaaatcctgcctgctgttctaaaaggaagaagttagttatgttacatctagaaagggtgggaaaaagatacagtctttcagatttaaatggctcacatattaaaatgaaatctctgttcactgcacttgtgtcttaacatgccactagacaaaattatggcagaagatagaagacctcaaagcggaggtctacaaattaactgtgctattttaaggcaaatattagtgatattacttcattaaaaatttgggacaaatcctaaactagatggcatggagacaacaggcataaattagatctgtccagggaagctgttaggaagaaaacagacaacatttaagtacaatcatgacattttaatatcaccagaggctcaatccaaaaccagatgggatattaattaaatagtacttttaaatttgttttattcacaaattacacaagataagcaatgacagtataatgtattatcattaacaaaaatattcaatatcatatatacagctatttattaaattttgttttcagactaattttcctgcttagatttaaggaaccattattggtaccaactaatggctaatgctatccagacactaattatatcaattacattttcttcagattgactctaagtcactgtgacacaggaaaaatgaatttgaagaactgttacataaaaattaagaaattcattattacacagtgaaaccccatctctactaaaaatacaaaaaattagccgggcatggtggcgggcacccgtagtcccagctactcaggaggctcaggcaggagaatggcgtgaacctgggaggcggagcttgcagtgagccgagatcgcgccactgcactgcagcccgggcgacacagcaagactcgcctcaaaaaaaaaaaaaaaaagaaatacattatttaaaagacttctcaaaatactctgacaataaactgggaaatatttattcaaacaatagctttcttctaatagattataagtcagtacaaataactaaaaaggtctcttaaaatatagtcctaatatatattttactattaatactatagttctaataatatctttactattacataaaaaggacacagaagtctgcattcggcatagtaaagatttatattggttctacattgctgttattttttaacaggatgatacaaacaaatatgtttggtaaatgaagtaaactctacatagaattcttaacttacaccagaggcaaacctaagcagtaccgttgttccatctaattagtttctttctttctttctttcttttgagatggagtttcgctctggttgcccaggctggagtgcaatggcgcgatctcagctcactgcaacctctgccaaccaggttcaagtgattctcctgcctcagcctcccaagtagctaggattacaggcatgtgccaccacacccggctaatttttttgtatttttagtagagacggggtttaaccacgttggtcaggctggtctcaaactcctgacctcaggtgatctgcccgtctcggcctcccaaagtgctgggattacaggcgtgagccactgtgcccagccctaattagtttcttaatttcatgactaaacaggattctttatgtgacttagatgtaatttctgaatttaatagtatctacctttttgtcaacttgaaaagttttctgtaaggtcttcctttctgtattatatttacttgagtttttcaatgccaggaaaacatatcaaagaaaggatagagatgtcacttcagagtgtccaagtctccttttgttaaatcacattaaagaggctttgggggaaggagatttctccaaagacctgaatcacgggcaagagagaatctgcttttaactttaggaggaatccctaaaacatcagtgtgatttacaaaatctctcactaagagtaaaaaagaactcaaggaagcactttcttttttaatagcagaaaagtagaaacttaaatgtctgacagagatagtaattaaattatatctacacatatccatatttcaaaaacatgatattaagcaaaaaaagttgcaaacatatacataaagtagaatatctacttatgtaaaatttgaaaactcacaaaaacaaccatacattgcttatggatgcatattcatataataaaaatataaaacagggatgattgaatgaaacacaccaacaaggtggcagtggttaccaatggggaagaaacgaacgtgtgaacagaagcttgaggttctagttctatacatcttacattaaataaataaataaataaataaataaaggcaaatgtgaatatcaacttaatcctagtggtagatatacacatatgtatttatgctattatgtacttttccataggtttgcaatatttcataactaaaaatcaaaatgagctaagaaaaacattaacttatagcacttatcactacatttaaaagatgacatactattagagtttaaaatcaaaagcatcttttattcattaacttttaaattgttattaatttgtttaattaaatcctttcttcctcaaacttcagtagactatttcaacgaactcatgctaaatctttatactgccttaacagttctagatttcagcaacttcaactggtttcagtctttcaactttttccccacataaaagtgaaattactcctgtgtgagagtattctaagagtgttttctactcttgatacttatttctaaccatttttttcttcacagactgaaaaaaaagaggggcggggagatttcagcatcctacttagaaaatctcagtaggataaacccaaatcagtagttttttttcctaataagaatacactttttgtcagtaactagactagtttctttactgtaaatcatcatattccctaagaagaatacagcagttgctcgctagggttacaaaagaaggataactaaaatgaactaggcactattatgtgcaaggaaatctaagcattttacatgaactgtttcatgttatcctcataataactttgtgaggtaggtacagtcagttctgctctaatgcttgttttgaaaatgtgcatttgttccaactcagttggcatattagggaacaatttgggcataacatgaattttgtggtgatttcttctgcaagaaatactaggtgaaggcataaaaatgcacccagctaaacagagatgtgtaggaatacacaaaacatacatacctcaaacatgtacttcagaggttaacatctacatgtgttatgcgccatattcatgctcattaggaggcacaactttccatccaatttcagattaaccctctttctaccgctgaacaagtatagcctttcttccataagcaaacctcaagtctttttcaatataaagagcagtatcattgtagtatttatttgttaaccatttaacacgtgtaaaattgtacttctggtttttttttttaggttcctttttaaaaaatatgtcaccaatatagtttttgagtgttgccactctaactgcatttttctaataatccctatggtttttattgtgtgattttgtatagcacaatgattttagaagcatacatgttgcaatatagcaaaattgactatattataataattcccattttacagatgagaaaatgaaatcttggataggttatatgatttgtccaaaatcatgtaagtggcacaacatgatttgaagccaggcagtctatttaccatattatgcaaccactaccaccatccatctctagaatttttcatcttcccaaatagaaactctgtactcattaaacaataactccccatcctggttcttcttatgttgagtaattttggatatacaagatacatttggacattaagaatgccatgtattttagagactctggacatagttaaactctttgaatgagtacaggattttcatttgttttagcaggtaattaactttgttggggttcaaggtacaaactcagtctcttgggtacacctcaaatttcagcttggttctttaattcctagctgtgtttctctgaatccaccctgcataagtatggttcagatgccagccaaaaacttaggtacaattactcccagattttgagattctcccacactgactctctcctttctactatttttccttaactttccaatgtctgtagctttcctgaactctcttctctacttcctcaagccagaaggactttgaatttccttttggaggtctagccactgtgcacagtgccaactgcaaactgtcctcaggataaaagccataaaaacagggaaaataactctgtgccatttccttcttctaagtatgaatttccctccagattctcttgcttttctttactattctgtgtcttcagaaagtcgtttgtttcttgtatttttctggagtttacagctgttttctatggtagggtcagtctaggatatactcaaaacagactgctaactaatttttaaattattttttatattaggtcaaaaatagtttgaggcagataaagaaatttactatttgattattcttcaaacatacaaataaatacaatatgctaaatcttataaaaatcaatttagacattctctataaccctaaataattcaataaaaattatagaaatgctcactgaggtatttaggccaccgggaattcagatctacaaataaatatcaagacttcacggcaaaccagctactcatcactgtaatcgactctccctagcttagttttaaagatggctaaaataaataagtagagaaaacaattcttagtatttcagtcaaaacaattattttagtctgtcttatatctaatggattacacaaattttaaaaattctatcaagttgatagtgcttaaaaccattctttaaaactaattttcaggctgggtgcagtggctcacgcctgtaatcccagcactttgggaggctgaggcaagcggatcacttgaggtcatgagttcaagaccagcctggccaacatggtgaaaccccatctctactaaaatacaaaaaaaaattagccaggtgtggtggcagacacccataataagctactcagggggctgaggcaggagaattgcttgaacacgggaggcagaggttgcagtgagtcgagatcacgccactgtactccagcctgggcgatagagggagactctgctccaaaacaaaacaaaaaacaactaattttcagttgctaattctctcaatctcctcttcttgagaaatattcaaaaacagagaacaactcttcaagacactattaatctattttcatatttaatcacttaaaaacaatgagctacataaaaatttgtgattaaaaaaaatcactgtgttttcaccattaggtggtgaggcctattgtagtttcctagaagtatcattctaaaatataaaatatcacgtctgtaatcccagcactttgggaggccgaggtgagcagatcacttgaggtcagaagttcgagatcagcctggccaacacggtgaaacctgtctctactaaaaatacagaattagccaggcatggtggcacatgcctgtaatcccagctactcagtgggctgaggcatgagaattgcttgaacctgggaggtagaggttgcagtgagccaagatcatgccactgaactctagactgtgtgacagagggaaactctgtctcaaaaaaaaaaaaaaaaaaaaacacttcagaaactgagctccaaaactgccattaataatagagatcaagaaaaaaaaaaaaaaaacctgagtgcaaactagttgtcttcaaattcactgggtaaaaagacatgaaacatgctctacaataaacagtactacatttcattattggttattcacagctacaaagaaaagagccaaagaaagaagctttacttagtttgattaagtcttgattgacatttgattttggtattactttaacaataatccataagctagatatatttagagtggccaaaccagacagaaaaaaatcctaagagtctaggtatcatattgacttttgccataccacagggatttagtgaacaccatggagtttcaggctaaaactccctctattttatcaagaaacatgaaactcaacagcaaacataggtctttctttactcagtttttagaaagcatctcaatgtatgaagaaatctacagacacttggaaaggattaactgattccttttaaagatgacttaaaatgtaaagacaaaatctaaataatggaaatatgctccattatttgcaattatctggttacaaatcttgtagatgaatcagcaaaagctataataagataactcatatcacgattagggatgaagataatcccaaagcatatagaaatgaatttgaggaatcgacctaaggattctgaaaggcaaacattagtttactagaaaataagtgtggtctatggggaagcaggaaaggcagacagagagggagacacatatagagagatacacagcaaatacaaaaagagagaaacaaacagggatggaagagaaaggagacaatgacaaacacactggactgtagtacgggggcggggcacgaagggatgaaggatgtcagagagatatctaggcagaaagagttttggggaaggggacaaaaacaaagagaggggaggtggagaaaaaaaatcacaaaggcaaaagtaagagtcagaggaaaagtgaaaattagagaaaaatagataggacacagagcataaagcttcccaagaagcctagctgcaaatgagcaagaatctttttccaatttactaaacaggtaagtccactcacagagaatagcaattcagatataggaaaagtccctatttcgtacatggaagcaaaaatgattcctcttattaacagctgctcaaaaagtcaatggacttaaaaaatgaatattctaaactgcaaatctggtaaattatactactattaaaagtggtttccctttcctctgcaggacaaggtccatactacttagcagagcatacaagccactccatgcgttcaaactgcaaaatgtcttagtccatttgggctactgttagaaaataccataaactgggaagcctattaataatataattaataataaaaatttatttctcacagttctggaggctgggaaatccaagatcaaggtacccacagttctggtgtctagtgagcacccattttctaatttacagatagcaccttctcactgtgtcctcacatggcagaagcagcaagctagctctcagggatctcttttctaagagcataaagttcatttataaaggctccacccttatgacctaatcacctcccaaaggtcctacctcctaataccatcacatgggtgatcaggtttcaccacatgaactttgggggatataaactttcagaccattgtacctgccattctggactcaccttcaaaaagtttcccagaaacaccaagctgtttcttgactctgaccctgtgctttcctctttctgtacagtaaaccactcttacaagcccttagtcaagagtttcatcctttataaaattttctctgacctcacatcgacttcagactttataattcgtctagaattccactgtatgtcaatacttctgctacagcattaacacacactatttcattttttaatctgttttctctcttactagactagaatgtcatctgtttgcactagtatcatctaacatagaacctgaaacaaacaggcacctagaaattgttgaatggtcagactaatgaaggcacagacccccgctgtttgatcagagtgaagaggaaagtacgtattagataggttgactaacatttgcctctcacctgtttggagttggttaaatacaattttgctcccagatttaatatctgcagttttaccagatcatcttcactagtgaagcttttagccatcttcctcaaaacatcaggggcaattttaggaactcgttcacagttttctccaattagccaaagaatacttgctctagcaacaggaacctaatatgagaagcagattacatagttagaagtaagttaatcatactctaatattaacatagaaaaggttttaactattacaaaagttttacagctattaattaatttaatgtatatctaggaattaatcctgtatttatgaattttcgtcagttatcaaaaaataaacacataggaaatctcattaaaattgatttcgaagagaatatcttagaaaatattcatacagcaaaaaccgatggtctagaatctagattctatcagagacgaacaaattctagaagccagtctagctgcccatacctatttgtttctccattatctgttgctgcttttgtgctataatggcagaaatagttacagtgaagaccatatggtcctcaaagccaaaaatattgactgtctagcaatttatagaaatggtttgctgacccctgctctagaacagcagttcccaaacctcaatgcccacaaaaatcatccagggttcttactaaaaagacaggtcctgggatcagctccaaaatagtatttctgtggtggggcccagaaatctatgttttaatttaaaaagcatcacagatgactcctgagacaggtggtccacaaagcccatttgagaacccacagataatacagaaaaagaaacagatcaattaggtactatgattccaaatcaaaactgtttttgctctttatgtattagcatctacaacactggaaatatatcaaactgataagatcatcaaggtctgcttataaaatcatgaatcccagtctattatttggtcaacaaaagaaacagggataaatttgtccaatattgcattttggcactatatttttaaataaactgcatttcaatataatttatgttcttaaaagtcactgctttgtgacaaattggaaaccttccatcagtaccattaagaccaacaatttagagtatgcaaattagttttattactatttgcttatttgcatcctcccctattccaaaaggaatttgagagggtgtgtaaattcatttcagtgaacattttcacctcgcacagaaaatttgttttttataataagtgaaaaggctgacagctatcattaaaaggtggcatcacgaggaaagataatgttctttttatgaagtccttttacaatttctcaaagtcctaatattttctgtagtttcatggctatacatagtaggattgttaaagaaaaaagtgagaataaggacctttccatagctaaaattttatcacaatatctaccattgcaaaatctttcaaaacacccacattatgaaattatataaaaatattaagttacaatattgagtccttcactagaatcagaatgagatgatcaaaaaagcttttaaataaaaaggtatatattttaaaacagtgtaacagcatgtctttaaattattatttagcatgtttggtgagacacaagaaatccatatacttgtgcaattagaaaaaggtctaagtgctattaaaaatctattcatgcagtgtgataaaactgatgcccttactgcatactgatttctggaaagaaaagaggttatttctaacgttccaaaggttacactgcattaagaccttactcccaatctattattttaaattgggctaaagaatagtaattgagtggtacattaaattttccagtatagaggaattcaagttgcctgccataatgaaaggtagttctaaataagaatatatgtgcaacttcaaatttcagttatgctagatttatttttcttaaatattttattatatattgctagtataaaaatcagaattctatgacataccataatctattatcccattttaagtaattttcttctggtaacaatcttttgcaattaaaaagacgatcccaaaaacaagtaatgtttaaagagattgtttatattcatgaatatactaaaattaaaattaaaatattggaatactgtaaacactcacgatacatatatttaaaatacaactctttgaaaaaattaaaaatcaataaatcacaatgctcacaataaaaatctcaagatggtggtgagaataagatttgtagttttctagaactgagctaataaaatccccaagaatttttaaaacttagaaaacttcaccacaagaaataatatcaatataaatataccaaacttttggtgatggcattgtattacaaagcttaggaaactgacaaagacaacatttttgagcaggtggatgggatcagaatactaagatttttggattccagctttccctttctcttcccattaagcaacaggactctcatttatacaccattgacactatgaattcacagccactactttcaaagatttgaagcacctgaaaaaaaggcaagtaagaaaattagtcactttttagaggccaggcacagtggctcatgcctaaaatcccagcactttgggaggctgaggcgggtggatcacttgaggacaggagtttgagaccagcctggccaacatggtgataccctgtctctactaaatatacaaaattagcctggcacactcctgtaattccagctacttgggaggctaaggtaaaagaatcacttgaactcaggaggcagaggttgcagtgagctaagattgtgccactgcactccagcctgggtgacagagcgagactctgtctcaaaaaaaaaagaaaagtaaattagtcactttttgttccccatggtctttttaaccacaaaataaataggaacactgaaataaaaccaaactaataatacacacacagacacagacacaggtacagacacacacacagagtcatacatatgatataatactttcattatgaagctctgcttttcaatattctcaaagacaaattggattgtaaatgactttgcctgattctttattctaaatgccctgagaaagtgattaaatgcacttttcaaaccttgtactagaaggcagtttccacggccaccacaacccattaatttgccagcaaaaacaaataatgattcctagctcaccacagcagctatagaaagacatctagaaagattttgcagatcactctgtaagcagttcaatttaaaagctattgtgtttcaacaccagcccactgcacagtgcaacagtccaaagtaaaccctacaaaaacatcaatttcatttatttaaatttgtcaaaggcaaaatcagtagacatctaagcaaactgcataccaacagcaaatcagatctaatactctgtatctggactcaatatgcattaaagcctaagcctgaattacaatggggtgccagagaaagggtgggtaacttgtgaaatggcaggcatcctgtgaggcatctgggcaacaaggatacaaagtgctatttcaatattactcagtttttacagaataacatctttcagttgttaagatatgaaatcccatctgtcccattaaacattatgtgaaatcctgtcagagcaatccacaggtagtatgggttgttttgttgttgttgttgttttttaaagacagggtcttactctgtcatccaggctggagtgcggtggtgcaatcattgctcactacaacctcaaactcctgggctcaagcaatcctcccgcctcagcctcccaaagttctgggattacaggcatgagccaccatgccagctgatagtatgcattttattctagaagaactccaaaaccagtatttatcataaatgaaggatacgccaaaggacagaatactcacaatcagaacatgtaagttgactgtattacagacataaatctatttgatttgaccgaattcaaaatgtaaaatacatttaaactttagtttttatattttcaattattactaaataaccaattaaaacaaagccctcaatatgataaaatctatgttctctttttaaaacaaattacatagctaatatctattgagctcttaccatgtgccatgcactgtttttgagagctttacgtattttctcagtcattcatcgccaaagccctatgaagtatgctctactatgatctgcactagacatatgaggaaactaggtaacaaatgagttaagaaacttgcccacatctcacagctggttagtggtggaactaggatcagaactccaaatctgaatccaaaattcatactggatcactgggtagcgacaaaatgagtgtggtaaactaggaagaatactggtcagcaagctgttgagaccggttctgatcccacactgatggtgttacatcaaggaggcaattaacttcacctcactggggtcatatttacttattaatcagatgaaggattattccttcatcctctgtttgtctgccacattgtgcaatggctcccttagtgcctcctgccatttccccaagagccagattttcagggcagacccaggccatcctcttgcctgttcccacacccgtgtatagtgggacattttcccacttctttcacctcttcttttaaggataggtaaggtggccaggtgggaagaggtcttgctatcacttctgttctctctccttccagaagaaagatggacccaggattctgccctaataaagtggctcaggcactgaaggaaaacatgctcaatattgacccattgtccttagatattggacagactggcttttcctaaaattgcagtgttttagaatgacactcctgggtttgatggtgaaataggtagagattcaggaggacagaagtctcatttaaggctcttattttaaggctcacattttaaaatcacttgcctacgtttaggagttatcaggtacttggtcggattaataaaacactgcttttatttccacatggccattgttcttgtataaacagctctcctgactggaacagagagattctggggattcaatcattcttctttcctgactttgaagttatgtctgctacatccctcatcaccttctcctggggtaacttgtggttgaccattttgagggttctgcacaacaaattgttttgattcttccttgcttgtcccaccttcaagcacttcagtttcctcagatacgttagatgagcagtaacaactaattatcagcttttcattctccttaagttcaaatgtgtgctgtagaattccatacagctttcttgtattttaatttcttttattatcatattccagatttgtctacttttgttacctctctctgcttcataataattagaagggaattttgttttattttctttccaaaagaccagatttaacatgtacttttcaactcatatatattttttgtattctattttacaaaatcagcattgatccctcttctgttttgattcgtttttcttttattttatatccctatactttaaaaatggtgatctttataactttagccatgtcctacatgttttgaaataaagcattttatttcctgggttttagaaaaaagtttgcatttcttctttaaatgcattctttaatctgaaagtacatttcttactttacaactggtctggtacccttttaaattatttaagtctcatttcattgcttaaggtcaaagaatgcaaaatctttaagcttcctttatgcctaaatacattcttgattttttgaaaatattcactggatatactcctaaaagtgggtattatctgttcaagagatataaggttttagctatatttactaaataagtttttgattacttaattttcttacttatatctgtctactagaaatatctaatatgagagaaatacattacagtcacacattgtaactattttatcaatttctcctcacattttgaatagatttttcctttacatatttatttggttgccatattttttgtgcaaataggtttgtgcttattactttctttacaaattacccttttttcattttataatgttcctttttatcttgttaaatgcttttaattaactgtaaatctcactttcttgttcatatttgcttaatatctctttccttaccttcttattttcaacttttatcacttgattaaggtgctttaactataaatggcctgtagctagtttttgtttttattccaatttgtaagtctgtcttttgatgagaaaattcagtccattcatattcaagatgagaaatatttgattttatttcttccatctttattacttttaaatacttattatttattttacatttgttttctttctttcttattttttttctggctttgtaaaactgctatttgttcctttattttcctttgtgaatactgaattctcaccatatttttgtatctattaatggttatcttctgagaaaaacaaaagctgaaaaaaataagctttgctatatagagctgtaagactgtacttatttggcttatagtccagcaactgttgagaaagttgatgcatcagccaggtgccatggctcacgcctgtaatcccagcacttcgggaggctggggtgagatcacctgaggtcaggagtttgagaccagcgtggtcaacatggggaaaccccatctctactaaaaacacaaaaattatccaggcacggtggcgcatgcctgtaatcccaactactcagaggctgaggcaggagaatcacttgaacctgggaggtggaggttgcagtgagatgagattgcgccactgcactccagccagggtgacagagcaagactccattaaaaaaaaaaagggaaagagagagaatgagcgagaaaaagaaagtttacacatcaaaagtatcttctgtatccctggacatgaatatactcaaatagaagaaagttttcttccaagaaagcctagggtttgccagatacaggcctcatacactgttacaggttttatgtatagcagctgcactctcctgaagccctagtacttataattgcctcttcctttctaaacaggaccagaacgagtttactagcacaagttttaactaaattttgcacaagaagtctggggagatacagaactcctagttccttctcataatcagatacatacttctctaccattacctgtaaacaaggtattaactatttccctcactaaaacccatggttttcacctcaagataattatttttaccttactactttttgaacaccagatgagactaccataataatttcacttctctccactctcttcctcccacaaaacctttaacattcttttattctgacctccatttaatctcattcctcagttttcctgaatattcaatgtttttagttctaggttaatagaattttccttatattatgcccccttctttatcaagagttcaaatttagcactttggttagacattcctagtctattgctatacatttattaggttggtgcaaaggaattgaggtttttgccattgtggtaaaaaccacaattatttttgcaccaacctcataatcatgtgtaaatatacagtcacctatatatctctcttctttgtcttcttccatctagagttctctgtgctagttcattagctattggttagacaagtggttcttcctgggggctgtatcacttcgtaggaagtaactaaatatgagcagtgttacaatgactagagacacgactgaattttgatgcttggtggataggaatgctagatgtccatttcggcggctttgagaaaaaaagcttaacctctcatttcccatcaaagtaatgtcaaacatctgttctacactgcggtagacattgatcatgtcactctaattcccaatttgtcaatgacttgagggaagcaaaaggaaataataaaaaaaaccttggctaggtcactgagtaggtatgtgaactgaatacagaaaaaggaccggtgacaatttaaatatttgttaaataaagtgaaatttttaaacagatagattataaatggaagtgagatacaacataatgcactggttaagaaagcagacctgctgctatgtgaccttgggcaagttacataacctctttgtgcctcagttttctcaaatataaaataggaatattaagagaactttccttgaagtgttgctattaaaaattaataatttatatttttaaggtacttagaatagtgcctggcaaatgatatgctctataggagttattttaaataagtaaaatataaaagaggcaataagaaagcttacaaaattaaaaccttaccatagtctgtcttcttcaaaaaacactcaatattcccttaataacagcttacaccgagcactgttctaagtgcttcacatgcattgactcattcattccacccaacagagctctaaggttgtcagtactatgatccccattgtacagatgagaaaactggagcatagtgaagtcaagtaacttgcttaagttcatgaagctagtaaaaggtacagaccaactgtgaatccaagtcatccggttttcaaattactctcttaacccctacatctctcatacacaatctctatgagaagtcttggctttgatcattagaatcaacagtaagaacagatatgaatacaaagtaactctccgctgagagatggggtggaagttcagatgctaaatgactcctgtaagccatacttttttttttttttagctttaagataaatgtgtaactgccttgcaagctttactaacaccctaagggaaagacaattttgccaccagagatatttaaaattggtcttgactggcaggttctaaatcttgtgatccattacccttgactacacaaaaatgatccctctgaagagaatgagaatacagattaacccatcttcaaaaaaggaaataatatactcctccctaaactacatctgcatttattatagaacatcacttggcaaaacattaaccagcactcaagaaaaaggcatagtaaaaagcaaacacaatggagaagaaatagctgaagagtttgaagaaaaaccagaagagaaaaatcacagaagccatgaggagactatttcaaaaaggacgaagtagttagcgtagtccaatgctaagaaaagatcaaggaagatagggacagaaaagtatccactggatttagaaaggagatagtaaccttggaaaaggcatagttaatgaagtgctggagaaccaaaatccaactgtgacggggagggagtttgacgtaaaggaataaaacttgttgcagatagttctttcaaaaactttggttttaaagggaagaagagcatgaagatagaatgacaaacacataatgcagcactactatgtgccagccagcgttccaagggcattaccatattaactaagctaatacctataataatactatattgtaggtccttttacgatcatcatttgacacatgggaaaagtgaggcataaagactttaacataaggacggagctggtaagtgatggagttggaactaatatttattgctttatttatttattttttttttacataatttcagacttacaagaagagtaaaaaaaattctggataccctgcacttagattccccaaatgttaacattttactgcatttgtgttagctatctctccaggtaaacatataattttattttttatttttatttatttatttttttgagacagagtctcgctctgtcacccagactggagtgcagtggcacaatctcagttcactgtagcctccacctcccatgttccaccgattctcctgcttcagcctcccaggtagctgggattacaggcacacaccaccacgcccagctaatttttgtatttttagaagaaacgaggttttaccatgttggccaggctggtctcaaactcctgacctcaggtgatccacccgccttggcctcccaaagtgttagttaggattacaggcgtgagccaccacacctggtcacattttgttttcttaaccaataaaggtaagttgtaggaatgctcttataccccaaaatacctccaaatataagataatatcatctgcaaacaaggataatttgacttcttcctttccaatgtggatgcctttataactttctcttgtctgaacgcttgaggtaggacttccagtactgtgttgaataacagtggacatccttgttatgtttcagagcttggatgaaaggctaagattttccccattcagtatgatactaactgtgggtctgtcacatatggcttttattatattgaggtatgttccttctatccccagttttgagggtttttatcaggaaaggacgctgaattttatcaaatgctatttcagcatcaattgaaatcatcatatgttttttgtccctcattctgttgatatgatgaatcacactgattgatttatgaatgttgaaccatcctggtaaccctgggataaatcccattggtcatgacgaatgattttttaaatgttgttgaattcagtttagcagtattttgttgaggatttttacattgatattcaacagatgctagactctagttttatttccttccttccttccttccctcccctcccccttcccctcccccttcccctccccctcctctccccatccctcctctcccccttcccctccccctcccgtccccatccctcctctcccccttcccctccccctcccctccccatcccttccctccccctccccctcccatcccctcccccttccctcccttctcctgccccttccctcccctcccccttctcttccctcccccttccccttcccttcccttttccttcccttccctctcccttcctttcccttccctctcctttcccttccctctccttctccctctcccttcccttcctttctttttgatgtgtctttgtttggtttcggtatcagggtaacaatgaccttgtagaatgaatttggaagtattccttcttctgttttttggaatagtttcagtagacttggtattagttcttctttaaatgtttggtagaattcagcagtgaagccatcggatcctgggcttttcttcactgggagaacttttattatggtttcaatcttgttacttgtttttggtctgttcagatactggatttcttcacagttcaatcttgggaggttgtgtgtgtctaggaagttttccatttcctctagattatccaacttactggcatatagttgcttatagtagccactaatgatcctttgaatttctgcagtatcagttataatatctcctttttcatctctgatttcatttctgctctgatttttatttcttctactaattatgggtttggtttgttcttgcttttctagttaagatacatcattaagttatttattatttatttgaagtttttcttcttttttgatgtaggctcttaaagctataaacctccccttgagtactgcttttgttatatcccttaggttttagtatgttgtgtttccatcatcacatgtttcaagaaatttttcaatgtccttcttaatttcttcattgacccattggtcattcaggagcatattgtttaatttccatatgtttatattgtttgaaaattcctcttgttttagatttctagttttattccactctggtcagagaagatacttggtattatttttttcaatgttttaagacttgttttgtgacctaacatatgctctatccttaagaatgatccatgtgctgataaaaagaatgtgtattctgcagctcttggatgacattttctgtatatatctattagatccatttggtgcatagcacaaattaagtccaatgtttctttgttggtattctgtctggaagatctgtccaatgctgaaagtggagtgttgaaatctccagctattattgtattgaggtctacctttgtctttagctctagtaacatttgctttatatatctgggtgctccagtgttgagtgcatatatatttaaagtcattatatcctcttgctgaattgactctttatcattaaataatgaccttgtctcttcctacactttttgtcttttataagtgtaggaagagacagacattttgtctgatgtaagtatagcaacacctgctcttttttggtttctaccagcatggaatgtctttttccatcccttttttttttcagtctatgtctatcattataggtgaagtgtgcttcttgtaggcaccagatcattaggtcttgattttttatacatgcagtaactctgtcttttgattggagagtttagtccatttacattcaatgttattattgataagtaaggactcactcctgccattttgttatttgttttctggttgtttcacattcttctcttccttccatcctttcttcctgttttccttttaatgcaggtggttttctctagtggtaggatttaatttcttgttttttatattttgtgtatccactttacgtttttagattagaggttacaatgaagcttgcaaatactatcttattaatataatccattattttaaactgatgacaacactgattgcatacacaatcaagcaaaaaggaaactaataaaagttctaccctgctttttcactttttgttgtttctacttatatcatattgtactgtccatgtcttgaaaagttgtcatagttatgtttaatcagttcacgttttagtctttctattcaagacatgagtacttcatacaccacaattctagtgttacaatattctgcttttctgtgtacatactattaccagtgaattttgtgcctttgaatgatttcttcctgcttactaccatccttttctttcagattgaagagctccttttagcatttcttacaagaaaagacaggtctgttgctgacaaaatccctccctcagcttttgtttgtctgggaaagtctttatttctccttcatatttgaaggatattttcactggatatactattctagggtaaaagttgttttcttttggcactttatgtcatgccactctcccctggcctgtaaagtttccactgaaaagtctgctgccacaggtatcagacttcaattgcatgttgtttcttttctcttgccgcttttaggatcctttcccatccttgacctttgggagtctgattattaaatgtctcgaggtaggcttctttgggttaaatctgcttgaagttctataaccttcttgtacttcaatgctgacatctttctctaggtttgggagttctctgatattatttctctgaataaactttccatccctgcccctttctctacttcctctgtaacaccaatatctcttagatttgcccttttgagactattttctagatcttatagctgtgcttcattcttttatattcttttttcttttgtctcctctgactgtgtattttcaaagagcctgtcttcaagctcactaattcttcttcttgatcaattctgccactaagagactctgatgcaatcttcagtatatcaattgcatttttcaactctagaatttctgcttgattcttttttactatttcaatatctgttaaatttatcagatagaattctaaattccttctctgtgttatcttgaatttctttgagttttctcaagacagctattttgaattctctgtctgaagggtcacgtatctctctgtttctctagtattggcccctgacgccttatgtagtttgtttggtgaggccatattttcctggatggtcttgatgcttacagatgttcatcagtctctgggcattgaagttaggtatttattgtagtcttcacagtctgggcttgtttgtgcttattgtatttgggaaggctttccaggttattcaaagggacttgggcctcaagcccaataatgatgtggttcttgcagactggtagaggtactgccttggataaatctgggagaactctctagattaccaggcagagactcttgttctcttgttctcttcccaatccctgtgctctccctccccctagtgcagagattctccatgccacactgctgctgccaggggatgagaaagcggtgacaccggcaattcaagactgtctttcctaccctcttcagtgcctctttcagcaatatgaagttaaaaccagatactgtgagtgcccacctgatttttggttatgatggtgcttttttgtgtgtaattagttgctaaaatttcgtgttcttgcaggggtgacaatcattgcagccctctatttggccatcttgctccactcttcaagatttgtgtttaaaaactaagatctaccatataaaggaatgaagtactatattcgaaaacatacacaaaccttgaaaacatgctaagtgaaagatgccagaaacaaaaggctacatattgtccagaaaaggcaaatccataaagataaaaaaaagtagattagtagtggccagggtatagagtgaagggagactgggcagtctcagttatggatttttttttaaggggtgatgaaaatgtcctgcaattacatactggtgattgcacaacttataagtgatcaaaaaccaatgatacacttcaaaagagtaaattttatagtataaaataatatctcaattaaaaaaacaaaatctgtgcacaaagtgtgctcaatggtattgtttctaactcctctcaaaggacagctctgggaaacagatgtttgtatattcatttcatgtatgacacatgaacatgcatatatactcacccaacatctagctgttgatatataaaactcacactgctatctccaattccaatctaataccacgaggctcattctatcctttcccctattcagatttgtaattccctcctataacagcaagaaatcttagaatctcagaattggaatccagacacttcagctctcctaaccattaccctttaggctgaccatttattttaacaaaattacaacttactgaataaaattcagcaaacatctcttaattgatactcacagtgatactgtccaggagtttggccatatgtttaataatttcaccatgttgtgcaggttgcatttgcagtaatttctttataacaaccacactttcagcaacaactatttctgaaaaagatagaaattattcatactaaatatgtataattcaattcaaatgcaatatgcttcgtaaaatgtaaacttaaattagaaaaacattctatttaatacaagccttaaaagactatgtgaaagcataaccatgagtgcgcttccaaatttgaggtgtgaacaactgtcttaactaggagagttaactttaatttctaacctctgttgctgtctcctagcttctgtagttcctttcttatctctgcatctttagattaagaaagcaaaagacgttggattatgctgctcaccatagtgttctatgtctttggcttttaaccagagtcctcaaatattgctctttgattcctataaattatatagtggaaatcaattatctacaatctaaacaacattttccctattctgcagaaaacagcaaactaaaaaaaaaatttttccttaagtgaaatgcccagaaaagtgagtagtaaagatgagtggtagtagtaaagaagtcactgtagaaatagcatggagtgcaaagccggaaagaatgggattgtgagagtgagatggattttctctatttgttctataaagtccactctacctttctctccccagcactgtgccctaagaggcccacctgtagtctgcctcaaccagactcccttggtcctggcttatagctgtgtttagtcaatagaaagcttcagcaggagatggtggggggagggcggggatatttgttatcctggatccctactctgccagcctcctctccctggtattacatgcaatcccctactgaaggtactgcaagtggctcactcctgcagggtctggtaactgctcctgctcctcacaccccttcccttcaatctgaggcatggtaaaggcctcccactgttgatagcctgttagctccagggtgttacatcatatcttgttggtttcccttaatcctgaccacagtttacaaacagttcattcacttaattcacttcaatcatcccttttaagtgtgccatctgtttcttgccagagccttaactaatacagtaactactactggaggtggataggaagtagatcctcaaactgggattacgggatttagttatcatactaaactggccaatcactggtccagtctctttttggtggtactggtaaagaaacgtaacataactcacctgagaacctgaccttatgaaatgaatcttatataatgtgttattaatgctaatgatgccaaagaaataaatcaacattgcctttacttattattttgatatttttattaatagggcttcatggctattaggaattcccctggcatacactacaaaggtttattttaatattatattagaaataccataatttgtgtcctattactctttttttttgagacagagtcttgttctgtggcccaggctggagtaccatggcgcaatctcagctcactgcaacttccacctcccagattcaagcagttctcctgccacagcctcctgagtagctgggatttacaggcgcgcgccaccacgcctggctaatttttgtatttttagtagagacggggtttgaccatattggtcaggctggtctcaaactcctaacctcatgatccacccgccttggcctcccaaagtgctgggattaccggtgtgagccaccatgcccggcctactctttttcactgaaatgtattttttataaagctccgtttaagaatataaacaaaattcatcattctaatcattagtaaatatatgtatttcaaactgtttacctgcttatccataagaataagaaattaactaatattgactgggcacagtggctcagcactttcggaggccgaggcaggaggatggcttgatcccaggagtttgagaccagcctgggcaacatggaaaaccccaggtctacaaaaaatccaaaaattagccaggagttgtggcacgtgcctatagtaccagctattcaggaggctgaagcaggagaatcacctgggccaaggaaggttgaggcttcagtgagccgtgatcacaacactatactccagcctgggtgacagagtgagaaaagaaaaaacaaaaaaaaacctagtatgatttaactaaaagctaactaatattaatgcttcagtttacaaaacaacatcacatttcatttccttctcacaataatgtaaagtaggtaccttattattattattttaaagatgaagaaagggagatgcactggaattgtataactttacccagaattcaaactcagaactaggatgtacattctatctatatacgttctatgttacgataggcaggtattacttctttttttttttttgagatgttttgctcttgtcgctgaggctggagtgcagtggcgcaatctcggctcactgcaacctccacttccggggttcaagcgattctcctgcctcagcctcccaagcagctgggattacaggtgcccgccaccacgcccagctaattttttgtatttttagtagagatggggtttcgccatgttgggcaggctggtcttgaactcctgacctcaggtgatccacccgccttggcctcccaaatgctgggactacaggcgtgagccaccgcgcccacccataggcaagtattacttctataaagactacctcttggtgctatgaggaaagcaaaggtaaatcagaatgagattctgccctcatcaaacttacactctagcagaaaaataaatggttatgtgattactatgcaaagcaaaatttggtaagtgtggttttaaagaatgcatagtataacaaatttatatttttaaaatacattattgcaaaactagcctaagtaagagaaaaaaatgttgcataatttaattatctacaagcagacgcaggattggctacagttgaaatatgcgtttggcatcatttatctttaggaactacattagtttcctattgttgctgtcacagattactaaaaacatagtggcttaaaacaatgcaaatttatcattgtacagttctaaagtcagaagtctaacataggtcttatgggactaacatcaagctctcaacagggctgcgttccctctggaagttctaggggaaatcttttccttccccctcccaacttctcaagcatgcccacattccttggttcaaagacctcttccaacaatcacatcaccctgaccttctgacatcttctgactgacctgcgtctctctttcccttataaagacccacatgataacattaggtctaaccacataatctccccatctatagaaacttgacttaatcaatctgcgaagtctctttttccacgtaaggtaacatattcacaggttctgggcatctttggaacgcaataattctgcctaccacaagtgccttctcattcccctcaggtaattccactctacttctcctttatggtacctcttggtttccaaagacctcagcactttggtgctactctatcagaagcacaaaatgatcctatgttctagatatttcctaacttcctccttgtcctcaacaaatcttaatggacctaactttaaaaagtacagtctactatcatactcattttacaaatgaagaatctggtgcacaggtagactgggtaatttactcaggatagctgtaacattctacataggtggtatagtcctacatgtaagcaaatagctggcaagagagtaagtggtcactatatgggaagactataatatatttgtcttatattactatctccctccaatggactattagctctataaagataggaaccttttataagttaaataaatatcctattaatatattcaacatttattaaacatctcaactgatttaagtcttcaataaatgcttactgaattgtttaaaactaaacaaaacaaagtcttctgccccaatccttttagtttagagtagatggcaataaggttattcaaaaaagtaaatttcgctaatatgttacctaaaataaattacctaagtcaactgaaatgtagatttctcttactaaaggtctataagaaattggcttatcaaattaatcttagagagtaataataggctgttttagggcaagcttcaagtctgcttagaaaggctcttaacaacacacacacaaaactagaggtccaagagaaatatattaaacatatttaaaaacaattgagcctaaatgtccctgaggtttaaagattcattatttgaacagatgatgaggtattcatttcaatataaaatcaaataattacagattcctagagccttaaaagatcttaacagattttaaagaaactgagtcttcattcacagtatttattcctaaaagtagatcttttaatacaaagaggaaggggctctattgtcagggtggctatgttaaagttaaaaatactatgactttcttttatgttactaattttgatataaatattctccttatttgttttacctctcacttttactgagccagacttccaaactacaaaaaatagtgtagcatatgtgatacagacataattaatcaggtattatgggctaatgatgattatgcaaatataatctgacaatacaatttaagtttgttaatattcacactgcaggaaaaaaaaaaccatgattaagagttgtatcaaaaaacaaaagcctaaccattaaaatatcaaaatttaaagtagttaaactaaatccttctacttttagagaggaagtatgtattagtctttcattttctaattgtaaaacaatctagtcttcccttaaaagtgatgtaggggtagaatatttatcttttaaagtcaataaaaatattttttgagaaattaaatctgaagcagaaataactgctttaaaatccaaagcttgaaattttccattagaaaaaaaaagtcaaaaaataaaattgagaaaatttgaatatattttgtatttgaatgaactaatcagtgttctaactaatttccggtgctttctgtatgtaactaaaatgtaaaagaacaattgccctggtaagccttggttcataatctttaatggtacaaagttattttcccaaggtgtgtattttatttggttgaatagaaagtcattattaaaggcacaggaaaatttctttaaaacacatttttaatgtcacattttaaaatgtgacatagaaacagagataaaaggattagttattattaaaagtagaaagagatagaatggatgacgtttatcatcctatctccactagctactttgtagagataaaaaaaaattttaaacctatcgtcttgataattttggttggcatttatttggagttttaatactacatgtagaaaaatcttcagtcatagtatcttgagtttacaggtacaagtttaaaattttatgctcacaacaaaaatcaatgttatctgggaataaattttgttccaatttttttcatcagaaatactctcaacaatgttacagttttctaaagatatctacatgtgggaaaaaataattagagattataggattcttgtactaaaaagttatttttcaaataaaatgtaatcaattttgttgttttacctcatgggctgctatatcatatatgcccatatctagacatgacatagacattagtatattttaaattccacaaaataatttcaatgattttacaaagaaaattatgcttttcttaaaaaagtctcattttaatacataattataataaaagttctttaaacaaaattattttaaaggtaaagttggcttttctttctttctctaaatggctccatttatttcaaagccttacccatagaaataactgacgctttgccacagaacaatatgggatctagcttacatattttactggatattacctatccagttttaccgaacacttagatattgtttggcttaaaaacacaaagctgctccaagtttatggcttttaaatctagttaattttgaatataattaggtgaatttctgaggaaaaagaatgttgaaggtatacagttaacatattttttgatctagccacttctccatgttatagtcatttgcctgcttttagcaccctctgcaggtgaaccaatattatgcatgacttacatgccattaaaatgcagtaaaaaggtggaaaagatacaatcaaggtgattaaattgtaaagaagtaaaacaaattttcttagatctgttgcggtaaaacaaatactacctgctagttaatggcctattttactaaaaaaaaaagaacccagaatatgcatatttatgtgcattcaaggataaaatgctacttattgtgaccatactactgatataactggaaaagctaaaatgcaaagttagaaaaggttacaacttggaaataataccaagaatattcaaatttaaatcacctgaaaataaaatgaaactgtaaacttaccatccctgttggacagcagacagaccaagccattgaggcacgtgtcagtgacttccaagatgttggttgcacatctgcctatagtctgaatagtggctgctgcaaattgtttatcctggcttttcacataggtctaaaagatattatttcaattagtttacacactggtattattgagttaaccaaaactccgattatattaaactttgtcaatatataagaattccagaatacataaacttctcataagcacaatatgaggaccaagtgatgatgtagattaatttcattttgttttgatttttttacttaaagaatgtgcctatggacgaagcacattttcaagccaggctcattcacctgtggccatagtggcttgagactccaaaacagatagtaggagcagtcacccaaagacagcaattagtttaagtgcaaggttgaaagagatgatgagagctctctctttggaggtttcagttcatttaccagcagcatctgtgaatctatgaaaaaaagggtcactttttcagagacactaaatctaaaaactgggagaaaaggaagaaagggaccagtaggctatttacaaacattttaatttcaaaatctatcacaatggttgtaaaagaataatagttacggtgaacagtatttcaataaatacttcaaatactcagtttataataaaataaaataccatacttttgaaatagattttctttaaaagtatgctttaaaaatatactgtaaagggtatatgtgtgtgtgtgtatatatatatatgtgtgtgtgtgtatatatagtatatatatagtatacatatatatatatacacacacacacatatatatatacacacacacaaatttaaaaataaagaaataaatcactgatttaacaacaggaagttaaaatatctttataaattttataatggccctagagaatttcactttgcttagaaccttcctaatttttaaatgaggaaagcttctattgtttacagaaatatacacactttgtatcatatacatgaaatttgaaaggtcatttacaatcgaaatttttaagaaagattcccaacctcaaataagaagtatacaatgtagacttaacactatgaaaaatgcaatacatttaagtggtgtctaaatgacaaatggaggagaaaacctaaagatgtctaaaaaaatacaaatttgctaaaaatggtaccaaccaggtgattaaacattgaacaaataaattaaattaattaaactctcctagttccatgaaggcaagaccaattatatttaaaagtgttcccaaataaattatttaatttccttaaagaaaaatatgaacttatgagtctttagaaacattccctattttacccaaaaagttactaaaagcgtaactatgagcataacacaaacatagacagaaggtacaaatttagacagtgataaaaatgaatacatgaaaaaaatacttaaaagtttgactgaaaaatggaccttattaaacatcctgatattaaatgaaaagactagatgaccaatattttgaaacaggtctagtatgtgccctctatacaacccattccataacattacctaagtctcctttcctacaatcccaggagacttgatataagcaaaaactggacagtgagaggacacccaaagagactagataggacaacaggaaaggaacaagaaaaaacacaaagaccaatactttaaataaataaaattataggaatgaagtgaaaatcagattcaagcaatgatctgcagctataagattactgaataataacataaaatagtatattttctagaacatcttaattttttaagaaatttgtctagaaagatacacaacataaaagtggagtaatccaggtatgaaaatataaattatggacatgccatattattctactattcctgtaaaaagtttaaaaatcacatagctaaaaagaaatcgtgtatacagtgtcttataaccaagaagaaatttaatattggcatataggagaactatggcaaaaaatacatctctaaaagttggaagctgataaaagaaaaactctgtgattagtgcatagtatgtggtatatttttgttaagaaaacagatagtggaatataaaagtcataatactgatgtaaagttttctattgctgtgctctacaactaaggcttcagagatgacctttccatcataaagggtatcatgtccatgaagtaatttttgaataatattttggggggaaatgcagctaggaagagtctcataaggcataaaaatacaactaaacaaatcaaaataaaaaacagcaatttaaaaaatcgtagtggggcaattatgaaacaaatttttttgagctatatatgaggctaagggggcagtgtcaaaaatagtcataggtcaataaaatgggaacaaccaggtaagaaatgaaaccgttttcatgaccacagaatatagaaaggactattgatgctggcagcacaaaaagatgaaattcttaccagaaatacaatttcaaacaaagacagagttataaaccaaagtccttcaaagtctatgaaaatatgaaagagaatactatgttttccttaaattataaattgtaattagtttattcttgcaaatttatgaatttcttagttgtcagtcttgtcccaatcactattttatgtacataattacatatttctagatagaaaaagatgcatatttaagactgaacatatgttttagaagttttttataattagcactgtacacaaacctgaaattctcgaagaagagttgatatgttggcttcatttgccaagtttgtcaaaatttcaagctatagtagagaaaagagaaagtaaacattttaaaacaaaggtagcaagatgaatttaatagagtacagacatttaattgaaagtttatttctacttttaaaaatcacattgtcagccgggcacagtggctcatgcctgtaatcccagcactttgggaagccgaggcgggcggatcacctgaggctgggagtgcaagaccagcctgaccaacatggagaaaccctgtctctactaaaaatacaaaattagccgggcatggtggtgcatggtggtgcatgcctgtaattccagctacttgggaggctgaggcaggagaattgctggaacccaggaggcagaggttgcagtgagcaggagaattgctggaacccaggaggcagaggttgcagtgagccgagatcgcgccattgcactccagcctgggaaacaagactgaaactctgtcacacacacacacacacacacacacacacacacacacacacacacacacacacacaaatcatattgtcgccaatgtggtaaggcattatacccttcaggtcaacttagtctaccttcttatgtccacaaacagatattagacaattactagttctttgaaaacaattcggaaaaggagaattctacatcttcactaattgtctgcccaatacaaacttataatttatatctaattaacctaaacaattctgctagtttggctttttgtcttttagtaaagttagaaaacaatttgccctccatgttaatacatctgctttccagataccaattaattcttttgatttgttctcctatagtctaccatcccaaatactcagacattttaattctctcttctggatttatagatataaacaatgtgtaatctccaatgggcttgtgaaaaaaaatttttactaataaaaaatatttagtcttaagaaaatcacaaaaaaatagaagagacaaacagaagcaaatcaagatgtgaacataaatacattcatatcaataaactacattaaataaagccaaatacttagagccaactgatctttgacaaggcaaacagaaacacaaaatagggaaaggataccctattcaacaaatggtgccaggataattggcaagccacatgtagtagaatgaaactggatcctcatctctcatcttacacaaaattcaactcaagatggatcaaagacttaaatctaagacctgaaaccataaagattctagaagataacatcggaaaaacccttctagacgctggcttaggcaaagacttcatgacccaaacccaataacaaatgcaacaaaaacaaagataaatagatgggacttaattaaactagaaagcttctgcacagcataagaaataatcagcagagttaacagacaacccacagagtgggagaaaatcttcacagtctatacatctgacaaaggactaatatccagaatctacaaagaacacaaacaaatcagcaagaaaaaaacaatcccaccaaaaagtgggcaaaggatatgaatagacaattctcaaagatacacaaacggccaagaagcacatggaaaaatgctcaacatcactacttattagggaaatgcaaatcaaaaccacagtgtgaaaccacctcactccaccaagaatggtcataatcaaaaaatcaaaaaataatagatgttagcatggatgtggtgaaagggaacacttttacactgttggtgggaacgtaaactagtacaaccactaaagaaaacagtgtggagattccttaaaaaagtaaaagtagaactactgtttgatccagcaatcccaccagtaggtatctacccagaggaaaagaagacattatacaaaaaagatacttgcacacacgtttatagcagcacaatttgcaatggcaaaaatatggaaccagcccaaatgcccatcaatcaacatgtggataaagaacatgttatatatatacacacacacacacacacacacacacatacacaccatggaatactgctcagctataaaaaaggaacaaaataatggcattcacagaaactagatagaattggagactattattctaagtgaagtaactcaggaatggaaaaccaaacatcgtatgttctcactcataagtgggagctaagctatgaggatgcacagacataagaataatacactggactttgggggctcaggggaaagggtggggggtggtgaggaataaaagactacacattgggtacagtgtacactgcttgggtgacgggtgcaccgaaatctcagaaatcaccactaaagaacttatgcatgtaaccaaacaccacctgttcaccaaaaacctactgaaaaaaaaaaaaaaacaaaaaaaataaaacagcaaatgatctaaacgctccaattagaaggcaaagactgtaggaggagttctttacatattctgagtacaaatcatttattcagacacatgtattagaaatatttttcccagataatcttttaatttttaattttattttgataactatattttaacttttagacaacttttttcttttttctttttttttttttttgagacaaggtcttactctgtcaccgagggtggagtgcagtggtatgatcatggctcactgcagcctcaacctctggggctcaaacaatcctcccacctcagcctcccaagtagctgggactacaggtgcataccaccaagctcagcttattttaaatttttttgtagggacggagtctcgttgtgttgctcaggctggtctcaaactcctaggctcaagcgatcctcctgcctcagcctcccaaagtcctaggattataggcatgaaccactgcatccagctggacaacttctaaaaaacaatctcaaacataggaaaaagctacacgtatagtacaaagaactgttgctgttgtttttctgaacgatttgagacgatagatgccaatctgatgctacattatccccaaaaacttctatgtatatttcctataaacaaggacatgttccacagactacagtacaacgaagaaaatcaggtcattaaactgatgcattactttcacacaattgtcactatgcacgtaagtttcaataactgtctcaatgatgtataataaaaggatccagttcaatatcacatactgtattaagttgtctcctttggtctgaaacagtttcttagtctttcttttaacttatatgaccttgacattttcgctaattataaaccaggtttttttgataaaatatccttgaatttgggtataatttagattttattattaaactcagttttcatatgaataatacatcattctaatattgaacagtcttgaatagtccatagtccatcctttcctcattggtttgtaatatctcctctactatatggtacatttttgcgtgtatgggcacatttctaggctttctactctttccacttacttttctgtctaaatatcacactattttaatcactatagatttatattcctaactgcactctatgccatacttattacttcctgaaaacaatgctctttcataatcccttgtgttagcatgaattatgtttttcacctactctaacccttcgacctcccaatcaacctgccaaccaagaaaaaaattcacaatattattcttttaagatccacccaaacatcatcttttctaaacctctcatagaattagctccacctttctgttcttcacaacactcaattcaaatatctgtattacttaaaacacacagtactaaaataagttagttagagacagggtctcaggctggagtgcagtggcatgatcaatggctcactgcagcctcaactttctgggatcaagcaatctgcccacctcagcctcccaagtagctaagattacagacatcggccaccacgcctggctaattttgatttttttaaagagacagagtctcactatgttgccgaagctggtgtcgaactcctggcctcaagcaatcctcccaccttagcctcccaaagtgctagcaatacaggcatgagccactgtgccaagccctgaagtttatttatttatttatttatttatttatttatattattatacattaagttttagggtatatgtgcacaacgtgcaggtttgatacataggtatacatgtgccatgttggtttgctgcacccaacaactcgtcatttactttagatatttctcctcatgttatccctcccacagcccacaaacccctgacaggccccggtgtgtgatgttcccggccctgtgtccaagtgttctcattgttcacttcccacctatgagtgaaaacatgcaatatttggttttctgtccttgtgacagtttgctgagaatgacggttgccagcttcatccatgtccctgcaaaagacatgaactcatcctttctaatggctgcatagtattccatggtgtatatgtgccacattttcttaattcagtctatcattgatggacatctgggttgcttccaagtctttgctattgtgaatagtgccgcaataaacatacgtgtgcatgtgtctttatagtagcatgatttataatcctttgggtatatactcagtaatgggatcactgggtcaaatgatatttttagttctagattcttgaggaatcaccacactgtcttccacaatggttgaactagtttacagtcccaccaacagtgtaaaagtgtttctatttctccacatcctctccagcatctgttgtttcctgactttttaatgatcgccatactaactggtgtgagatggtatttcattgtggttttgatttgcatttctctgatgaccaatgaggatgagcattttttcatgtgtctgttgactgcacagatgtcttcttttgagaagtgtctgttcatatactttgcccattttctgatggggttgctcttttcttgttttttctggatattagccctttgtcagatgggtagattgcaaaatttttctcccattctgtaggtggcctgttcactctgaaggaagtttcttttgccatgcagaagctctttagtttaattagatcccatttgtctattttggcttttgttaccattgcttttggtgttttagtcatgaagtccttgcccatgcctatgtcctcaatggtattctctagattttcttctagggtttttatggttttagctctaacatttaagtctttaatccatcttgaattaattttttgtataaagtgtaaggaagggatccagtttcagctttttatatatggctagccagttttcccagcaccatttattaaatagggaatcctttccctattgcttgcttttatcaggtttgtcaaagatcagatagttgtagatatgtggtgttatttctgagacttctgttctgttccattggtctatatatctgttttggtaccagtaccatgctgttttggttactgtagcctcgtagtatagtttgaagtcaggcagcgtgatgcctccagctttgttctttttgcttaggattgtcttggcaatgtgagcttttttttggttccatatgaactttaaagtagttttttccaattctgtgaaggaagtcattggtagcttgatggggagggcattgaatatataaattaccttgggcagtatggccattaccactatactaattcttcctatccatgagcgtgaaatgttcttccacttgtttgtgtcctttttttatttcactgagcagtggtttgtagttctccttgaagaggtcctttacatcccttgtaagttggattcctaggtattttattctcttcatagcaattgtgaatgggagttcactcattaatttggctttctgtttgtctgttcttggtctataggaatgcttctgatttttgcacattgagtttttatcctgagacactttgctgaagttgtttatcaacttaaggagattttgggctgagacgatggggttttctaaatgtacaatcatgtcatctgcaaacagggacaatttgacttcctcttttcctaattgaatacccgttatttctttctcttgcctgattgccctggccagaactgccaacaccacgttgagtaggagtggtgagagagggcataattgtcttgtgccagttttcaaagggaatgtttccagtttttgcccattcagtatgatattggcagtgggtttgtcataaatagctcttattattttgagatacattccatcaatacctagtttattgcgtgtttttagcatgaagggctgttgaattttgccaaaggccttttctgcatctattgagataatcatgtggtttttgtcgttggttctgtttatgtgatagattacatttattgatttgcatatgttgaaccagccttgcatcccagggaagaatccatcttgactgtggtggataagctgtttgatgtgctgctgaattcggtttgccattattttattgaggattttcgcatctatgttcatcaaggatactggtctaaaatcctctttttttgtgtgtgtctctgccaggctttagtatcaggatgatgctggcctcataaaatgagttagggaggattctctctttttctattgattggaatagtttcagaaggaatggcaccagctcctctttgtacctctggtagaattcggcagtgaatccgtctggtcctggactttattggttggtaggctattattatctcaatttcagagcctgttattggtctcttcagagattcaacttcttcctcgtttagtcttgggagtgtgtacgtgtccaggaatttatccatttcttctagattttctagttgatttgcatagaggtatttatagtattctctgatggtagtttatatttctgtgggattggtggtgatatctcctttatcattttttaatgcatctatttgattcttctctcttttctccattagtcttgctagcagtctatcaattctgttgatcttttcaaaaaaccagctcctggattcattgatttttcgaagggtttttcgttattgggtatttcgtttttgaagggtatttcgttattattgaagggtatttcgttatcttaattatttcttgccttctgctagctgttgaatgtgtttgctctcatttctctagttcttttaactgtgatgttagggtgtcgattttagatctttactgctttctcttgtgagcatttagtgctataaatttccctctacacactgctttaaatgtgtcccagagattctggtatgttgtgtctttgttctcattggtttcaaagaacagctttatttctgccttcatttcgttatttacccagtagtcattcaggaacaggttgttcagtttccacgcagttgtgcagttttgagtgagtttcttagcctgagttctaaatttgattgcactgtgctgtgagagtttgttgtgatttctgttcttttacatttgctgaggagtgctttacttccaactatgtggtcaattttagaataagtgtgatgtggtcctgagaagaatgtatattctgttgatttgggatggagggttctgtagatgtctattaggtctgcttggtgcagagctgagttcaaggcctggatatccttgttaaccttctgtctcgttgatttgtctaatattgacagtggggtgttaaagtctcccattatttttgtgtgggagtctaagtctctttgtaggtctctaagggcttgctttatgaatctgggtgctcctggattgggtgcatatatatttaggatagttagctcttcttgttgaattgatccctttaccattatgtaatggccttctgatctttgttggtttgaagtctattttatcagagactaggattgcaactcctgctttttttttgctttgcatttgtttggtacatcttcctccatccctttattttgagcctatgtgtgtccctgcaggtgagatgtgtcttggggttgctcttctcgaggagtatctttggggtgttctctgtatttcttgaatttgaatgttggcctgccttggtaggttggggaagttctcctggatgatatcctgcagagtgttttccaacttggttccattctccccgtcactttcaggtacaccaatcaaatgcagatttggtcttttcccacagtctgttatttcttggaggctttgttcatttcttttaagtcttttttctataacctcgtcttctcacttttttcattaatttgatcttcaatcatggatacactttcttccacttgatcgaatcggctattgaagcttgtgcatgtgtcacaaagctctcgtgccacagttttcagttccaacaggtcatttaaggtgttctctacactgtttattctagttagccatttgtctaaccttttttcaaggtttttaccttccttgagatgggtttgaacatgctcctttcgctcggagaagtttgttactaccgaccttctgaagcctacttccgtcaactcatcaaagtcattctccatccagcgttgttctgttgctggtgaggagctgcaatcctttgtaggagaagaggtcctctggtctttagaattttcagcttttctgctctggtttctccctatctttgtggttttatactacctttggtctttgatgttggtgacctagagatggggttttggtgtggatatccttttagttgatgttgatgctattcctttctgtttgttagttttccttgtaacagtcaggttcgtcagctgcaggtctgttggagtttgctggaggtccactccagaccctgtttgcctggttatcaccagcggaggctgcagcacagcaaatgctgcagcacagcaaatactgtagaacagcaaatattgctgcctggtccttcctctggaagcttcgtcccagaggggcaaccacctatatgaggtgtctgtcggcccctagtgggaggtgtctcccagttaggctacacgggggtcagggactcacttgaggaggccatctgtctgttctcagagctcaaacaccaagctgggagaaccactgctctcttcagagctgtcagacaggtacactgatgtctgcagttgtctgctgccttgtgttcagctatgccttgcccagagtggagtctatagaggcagtaggccttgctgagctgtggtgggctccgcccaattcaagcttcccagccgctttgtttacctactcaagcctcagcaatggtggatgcccctccccaagccaggctgctgcctcgcaattcaatctaaggctgctgcgctagcagtgagcaaggctctgtgggcgttggacctgctgagccaggcatgggagagaatccccttgtctgccggttgctaagaccttgggaaagcgcagtttttgggtgagagtgtcccgtttttccaggtacagtctgtcccggcttcccgtggctaggaaagggaaatcacccgacctcttgtgcttcctgggtgaggcaacgccccactctgctttagctcaccctctggggctgcacccactgtccaaccagtcccagtgagatgaaccaggtatctcagttggaaatgcagaaatcacccatcttctgtgtcaatcatggtgggagctgcagactggagctgttcctatttggccatcttggaacaaatctccaaagttatttatttaaatgcctgtctccttcagtaatctgtgagttattcaagttgtaggtagcatggcttaactttacattatcagaatgtagtacagtaattagtatataataatatagattgaaaagtataaagaaaaaccattaactttatcaatgtgttttgaaaagcaggactgcatcccacaggtgctaaaagctatagaaatatctcttcaaaacaaatgtgttaaaagcctctgaaaaatgaaagcatacataccttcagtgtcttgatcatagttggatcagttgacctaacatagaaactcttcagataaggttcaaacatcccctggattacaaaaataaatacaaaaatacattatggtactaatgtgttcatgtgtctcttaaattacgtgttcagaacatacatacctttctttgaattgacatagttgctatattttgtaggacaatatactgcacctccctagaaatcaaaagataatttttactgggtatatgttccaatgaaacatctttgagtaagcactacaataatgacaaagaattagcaataatttcaagtgaatgagactcttaaatgtaataatgaaaagtttttagtaaatcttagatgtgtgtctttttaacgcacttttcctataaaataccaataaattagacgtgattcatcatgaagaatagttaaaacaaattttataataaagtgctcctaaaatatgaagttaacattgtacctgctttgaacacatccaaggaaggtattcttagggttaataggggtagataggaccacactgttattataaactcattaaataactcattcttcccagggcaaaggccagattttaaaagtagtcatgttatttttagacccaaatatctaataaatgaactgaatctggtataaggcttcatgtgaaagaccaattccaggtctttctgatatcttttgaactagccataggaaaaaaaaaaaaagtattgaactagcaaaagagaaaaataatagctggatatacagatagggagaataggaacacaaaggaaatggcatctcatttgttactaagccagtcaagagctacaattgtggactaagttccagttaagggcaaaaataaatacatagttttttccttccaacgcaattagtggaaacaagcactcaatgaaaaacattgtttcaaattaaaacaactaattactgaaaaatagctaaggtatgtcaaatagctgaaatgaaggtattcttaaacacagaaacaaatgtctgaattaaacctgaaatcatgattctcatgttatatgtcatggaaactcaataaattgttttgaatcgttaacctaaaccactaaattataaagaggtaaaatcaaagaaggtggcatgctctttctgtctgtctatctgaaactaagagtatgcaatctttaaaatgagtagctattaaaaacacagctctctttttagagtggagcaaagcatagtaattaaatattccagctttataggaagcacaattctggcataaactacattacttagcatacacattgctctatataaaaccatgtattaatacattgagtaagtcaatctgatagtacttcagtatagtttttcagtgattccagatttaccaaaactcccaaacatcattattgccatacctaaaaatttcaaacactaatactaggctactagtgacactctagtgttatgccacaaaatattttcaatatctttgggcttgaggttaaaaagtttcagtatttatcattaagtttgagataaatgcataaagacttttataataatccccttaagtatgaaatcttactgatcgattgattaaaatatagtcagagttatatattaaatgcctgaaagattacatttgttcaaacattacttttgaaggaatacaaaagaaaaaatatatataaaatcatgacctacctattgctacgaagtaaacgcactagtgatttagaaattatgccagcttcagattttggtgatatgtgccaatacagctgagcaactgccataaccacctacaagataaagcataaaaataacagaactatgaacactagagcactctacaacctcaaaatccattcctacacattatttcctctaagtcctacaaattcctgtgacgtaaaatggaatgttactcttcgtagtgagttgaagaagtgtcccccactcccagtgcccaatactatcctcagaatctgatcttatttggaagtgggatctctgcagaaattattaatataagaattgaaatgacatcatgctggttaagagccctaaatcgaatgaacgtgtccttataagagaaaaaaaaaggacaaaaagagacaccgtgaaggccatgtgaagatggagataattagtgtgatacacccataagccaagcaatgccacggattgctggcaatcaccagaagccaggaaagagaaggtttctccctcagagcgtacagaagtaaccaatactgattataccttgatttcagacttctggcttcctgaaatgtgacagaataaatttctgttgttttaatccactcagtttgtggcaatatgtatggcagtgctatgaaaagaatacatcctcagaaaaaaaaagagacactgaatgaactgctcaaggtgtaacagctagtacgtggcaaagctcaagacactcgaaattccatgctcctcagctgctgctctgagactggggctttttaagaattataagcatgcctttctaaatgaagccaggataacagtaactagtaggctgaaataaagaaaactcagcacatttaagttacaattaaagaaactccattaaaacaaatacatctacagcagtagcatttaaaataatcttgtttttaaaaacacagaaccttaaaaatggcttctggttcaaagccattataagggtgattcaaagactgggcacagtggctcacgcctgtactcccacccctttgggaggccgaggcaggtgggtcacttgcagtcaggtgtgagagcatcctggccaacatggtaaaaccccatctctactaaaaatacaaaaattaggttaagcgtggtggtgcacacctgtaatctcagctacttgggaggttgggacacgagaatcattgaacccaggaggtagaggttgcagtgagccgagatcatgccactgcactccagcctgtgcaatggagtgagactctgtctcaacaaaacaaaacaaacaaagggtgactggaatttctttgtctcaaaacagaagagtactgtttcccctaagtgcctctacactcagattcagagtgacaactgcagagacatagctacagatgttaccaatgctgcctttggctcaaaggacacactaatattaatttaattctgcctggtctatgaagtttgaacaaatatatagcaaaaattctattaatatatatgcctaaatagtatacagcacagaagaatgtttgaggttaaaaaaaaaagtttcttctgaaactaaagaaccgtttttaaaaatacagtatacagggtcctaaatttactgtttgccatttcttgtactttcttacaagtttgatttatagctttaagatattagttgagaatttaaaaaatgcaagaatatctcatttcttcacttgtgaactgcaaatataagttggttacaaaataaactctcctgaattttaaatcttataaaataaaagaatctcaattaatgattgacctaatccaagatcagtcatttaaaaaaatattaacgcatatacctggctaataagtattagtaaatgatagaaaagaaagctgaatcttaattttaatctatcttacagatagtaaatccttttcccttacaaataaaagtccaatcctactggcaagaaagcaaactgtacttcctatacatgtcaatgtctttaaaattctagctgccatttggcatgccatctgttctaatatattagggtactccaaaatccaaaaggactaaatgagcctctttttcctcggtatttagaaatccaacagttgaaagtcgctttgatacccagatttgaaatgtataggctaatttgtaaacgccatgaaaaaagttcccaaaacttcaaaatccaaaaagactaaaaatatacaaccttatagaccttctacagttacatcatgcctgttcataataaagcgcatcctataaacacttttctactcttaaccattcatgccgctgtcaccttatttagactgttagaatagcctcctaacattccgctttcagtatctatctccagtacaaactacatagcaatgatgtattatgtttcctgaaagaaattctcaaagtctctccataaacttaagtacgaggttaaaaaaaaatctatccacaattcttcaaaagttagcctttactcatatttagcagcatcccaaaacaaggtaccaaaatacactgacacaaaaagtaaaccacctctattacagcatcaagtaagcagggaacccaaacaaaatgggaccagaagtacaaactgccactatttgtttcactatttgaaaacgtttttgatccataagtatttgaactataaaatcaatttctaagacctagttaaatgaacagtgagtcactcataaagtacagcttaagatggcaaattacagctacctaactagcatctggctaagctgagtacattaaaatataagcatattttacaacagccatgaaataatattttcattatgactaggcatgattactgaataatgatttggaaactaaaccattaggtattagacaaaaattgttgttgataacttggatatacaaagctgtaagctctaaattctcaagaatcaattcattaagaattgttctgaacagaacaattcattaagaatactttctcaattaaaatctttaagaacatgtttaacctaaatccgtcaagcctttggatataactgccagttaacaggaaacacagaatataaaagaattaaatgacactataaaagatgcaaccatcccattccagtaggtatagcaaacaaaataacaaaataaaaagaagcagcagcaatcagacaaacccagaaggacattctgcaagacttgacaggctttaaaagatgcaatgcattagataatggtttggataaatcatccaaaaagaataatttaagatcaattggtattaaatgaaatgaaattttattaaaataaaaagtagagaggactgactagagaaaaaaaggttagaaaatgctatgtacagtatgatttttatcttggttaaaaaatatatatatatgtatgtgtaaccatgaatatatgtacacttatgcagattagaaagatctggaagaaaatacactaagacataagtgatttctgagtgttgagaatgtgatgttttaattttctttttagttttgctagcctgtaatttctaattttgtattgtgcacatgtattcttctaaaatataaatggttatataaacaaaaaggtgtcgaacaaacaaaaaaaaccttatgacccaaataaagatgatttttaattactattactgccaatttacatttataatatgtgaggcattacctttgttagtctcttaaaaattctatcagacagatacaaacagtatggactaataccagatcaagtacccccaatcacaatggaataactgataaatatacatagttcttatataagagctaatataatccaaccaattgagaaacaacttagaaatatcttaagaaaagccaattaacaaaaccattaaaacgtaaatgaagtccaataggccaaaccaggtattgtcatcaaaacctaactctgtatacctggaaacatggaaggctgaaatatatttaggtattacttctcagacattaggtctctaaatctatagcttacattccacactgtacttccaactatccattacatgtcatttggtgtgtaaacaaacaaatgctccattagcacacacagactcacttactaaattgagatatttttaattgctgttttttaaaaaccagtgaattatttcttataaggattttaacataccgcagcattcctgctctgaagcaaaggctttgtatttctaattaagagtctatgatctggatccatagtatacggcttcttctttttgtcagtcttttccttctgatcatcatcagattcgtagaaattctttccattgtcttctaattcatcaccctacaatgaaagaaatccaacccaagattactttagaccttgagcaatctgcatattatatagtcaaagaaaactttcctttaaacatctataacaacattttaccgtagaatacttctgtttgggcaatttaaaaatattacacaacctatatcgaataaaggtctattgatttttctcatattttataacaagttactgtgctatagatgatgtgcttctattgtattacaaagtaaatttttgactattaaatccccatagaaatacctatagtccttcaaaaggaacacatgaccgttagattttaacaaggcctataatactacctaaaacctgaaaactatttccataaattgtcagccactctgtaactagatcaaagagtcaaaaaaagaggagcattgtttgaatagtaacataaaagaaatcacagtaaagtgtgacacgaaaaaactagtgttgttaagtaggtccctgagttgtcaagaaaacgtctcagtttgagatttataaatatccagaggagctgattctaggtttttgttttgaattctttatctctgccaataaaatatgcctacaggcatttagtgctcaaaacaaacaaacaaaaaaccaaacaaacacagtaatagccacatacatccaattcaacttctgtttagaggtaacttccgttaccaagtatctgaaacatactttctgcttccaggaagatggagtagatgtacttttccccatctctctcactaagtagagatctagaaaagcagaacactacatgtaaaacatatataaaacaaacataagaagactttgaaaggcaaaaaggaggagcactggataggaacctcaagatccaaagaaagacagaccagtgagttccctgggttttctttttatttcatatatccacaactcggtgcagaagctggcaacaaatgcagatgaaagaaaccaccagaaccgctctctctagccaaaggaccaggaaaggggcagtctagcaagatataaaacttttagaagtaactactcaagtgcagcccaacaccagataaaaaattatggccctacccccatccccaccagtagaggctgagatggtgatcctagacttctacccttattaggctgtaatgagatgccccaaccacctcactaggtggtttcagaaaaggccaagatgggattgagagtttcatctctaccaagaggtaacaaggcattctgatattgtcagtgaagaccaagtgaggagcttggacttctaagcccatccattagtgtcaaggtgaccttattcctcctcactgtgatgatgtcagaggaggcctagtgcatagtcaggacttgcagcaccacacctagtagtaaccaaagtcagccccgcccacaccctggtggttgtcagggaaggacacacatagaacagtaccttgtatccctcctagcagacagctatcagagaaagacggttggggagccagaaatcccacattcacctatggtaacaatgagtaaaatccctctgaagtgtcagtggaggataagcagggaatccggactcctgctatgacctggcagtgatgagacagcacccctctctctttccaccacccttccctgctagagtggtatcaaacaaagccagttaacctgaaggtttaaaaatatccagtctcaaagtatccaaaatgtccaagtttcaattaaaaaatcactcatcattccaagagaaaggaagatctcaaactgaataaaaatagataactagcagatgccaataccaagataatagagatattggaatgatctgattattttttaaaaatcattaaaaaatgcttcgatgagcaattgagaacatcctggtaaaaaatacagaaatagaaggttttagcaaagaattataaagtctagactgggtgcagtgacccatgcctgtcatcccagcactctgggaggccgaggtgggcagatcacctgaggtcaggagttcaagaccagcctggccaacatggcgaaaccctgtctcactaaaaatacaaaattagcctggctggtggggcacacctgtaatcccagctactcgagaggctgaggcaggagaattgcttgagctcatgaggcggaggttgcagtgagccaagatcgcgccattgccctccagcctgggcaacaagagcaaaattccatcttaaaaaaaaaaaaaaaaaaaaggccaggcacagtggctcacgcctgtaatcccagcattttgggaagccgaggtgggtggatcacgagatcaggagttagagaccagcctggccaacatggtgaaactccatctctactaaaaatacaaaaattagccaggcatggtggtggacgcctgtaatcccagctactcaggaagctgaggcaggagactcacttgaaccctgggaggcggaggttgcagtgagtggagattgcgccactgcactccagcctgggtgacagagtgagactccatctcaaaaaaaaaaaaattataaagtttaaagaaagaaatagaagatataaagaccaaataaaaactgttaacgactggcaaatacaagaaccaaaactaaaaacctaatgaatgggatcaaaagcagaggagggggacaaaagaaataatcagtaaactggaacacagaacaacaagatttacccaatctgaacaaagataaaatagactagggacaaaaaaaatcaaaactaaaaaacaggccgggtgcggtggctcatgcctgtaatcccagcactttgggaggcgaggcgggtggatcacgaggtcaggagattgagaccatcctggctaacacggtgaaaccccgcctctactaaaaaaatacaaaaaagtagccaggcatggtggtgggtgcctgtagtcccagctactcgggaggctgaggcaggagaatggcgtgaacctgggaggcagagattgcagtaagccgagattggccactgcactccagcctgggtgacacagcgagacactgtctcaaaaaaaaaaaaacagagtctcagggaccagtgaaaatgcaacaaaagacctaacattcctttcatctattaatcaatcctggaaggagaagagacagaggcaagagttgaaagagaactcaaagaaataatgactgcaaactttttaaatttggcaaataaaactacaaattgaggaagctgagtaaaccctaaacaggattaaacccaaagaaatccaaaacagcacacattatagtaaaacctctgaaaactaaagacaaagaaaaacaaatcttgaaagcaggaaaggagaaatgacactttaccaataacagaaaaacaagtctaatgacagcagatttctcatcaaaaaccatggaggacagaacacagtagaccaactgatggagaggaactatcaaaagagaatcttatatctagcaaaaatatatttcaggaatgaagggggagaaaatcaagacattttcagataaaggggaactagagtatttgttataagcagacctatcctgaaagaatggctaaaggaagctctttagacagaaaggaaatgataaaagatggaatcttcaaacatctggaaggaagaaagaatatggcaaggaaaaatatgagtacatataatagtttttccttctcctctgagtcttttaaattatattagatggttgaagaaaagttataacattgatacggttctaaatgcatgtaaaggacatacctaagaaaactatttataaagtggagagaaaaaagagatcaaagggagctaagtggttaaaaagtttgccccttgaagtgtaacatgaggacatcagtagactgtgatggtaagatgataagttatgcatgtaaaatgtaatacctacagcatccactaaagaagctgcacaaagagatatattcgtgctttggtagaaagattacttaaggccaaggtagaaagattacttaaggccaggagttctagaccagcctgggcaacagagcaaaaccttgcctctactacaagtaaaaaaataaaacaaaactcagccattcatgggggtatgtacccatagtcttagctgctcaggaggctgaggtgggaggatcactggagcccaatactttgaggcttcaatgagctatgatcaagccactgtgctccagcctgggtgacagagtgagaccctatctctaaaaaatttcaaaaaaataggttttaattaataaaaaaagagatatattcaaattaactgcagataagcaaagatggaattctaaaaaatgttgaaataacccacagttaagagaaatgaagactagagagaacaaacaaaaaacaaaaaactaaatgggacgcttaagccttaaaaataaataattagattaaatgtaaatcagtatgctgattaaaagacaaaggctggcaaagtagattaaaacccatgactcaactatgtgctgcctataagaaattcaccataaacataaagataaaggcaggttaaaagtaaaaagatggaaaaatacatagcatgctaatattaatcaagggaaagcacaataactatattaatatgagataaagtacacttcagagcaaagaaaattacaacagagaaggacattatagaatgacaaaatggataatctacaatgaaggttatataccatataattccatttatataacattcttgaaataacaaaactatggaaacagaaagattagcagttgccaggggttaagggttgggagtaaggttaaacatgtggaataaagtcggtttggctatgaaacggcaacatgaagattccctgtgatggaaatgttctcagttttgactgtatcaatgtcaatatcctggttgtaatactgtattagagttttgcaagacattaccattggggaaaattgagtaaaggttatgccagatctctctcaattatttcttaaaatttcatgtgaatctaaattatcttttaaaaaccatttaattgaataaaactaaggagataaaaatcagtaagtcacttaaaagcaatttgttgtatttatgcattgttatacataacaataaagaaaattatctaaaatgttttaggttaatatcacttaagtatttttcccttgctaggtgcctacagattttacacaatctttccttaaatcttgacataaatatcactggaaaacacctttcatcaaaagtacaacttttaggtctctcagaataggaataatattagctcagtgctttttaaatccacaggcaaaaaaatcttataaaattattcagagaaaactcacaaaatttatactctttgaaaacaaaagtatttctactaatactcatcttcaaaattaaactagaaatcataacattatcaccttcctttgaatacagaattcaaaacaaacacactacttgtcttttagtgcttaataaaaagactataagtgagatatacttttatatcaaagctggacttgagtgactattcctttatggagctccaggctaaagtagttctgttaagtacattaataaaccaataaaacacaaataattaaatgctctaagcataagcactcacttacaatcttaagtcatggttaattaaacaaatgttcaaactctacctgaaagtgatacataatgaaagtgctgtattaacagacatagcactattactaacaaaatcatcaaaatgtacataaaaaactgctttttataaccatctactcattccatttcttcctcattgttaattaacatactgagttcaattacattattttaatgaaagacacatatgtattgcttattttgctgtacaaatgtttaagattatggcagtatattataacagtaaaactacaaaccactgctcaaggaaatcaaagaggacaaaagcagatggaaaaatattccatgctcatggataggaagtatcaatatcatgaaaatggccatcctgcccaaagcaatttatagattcaatgctattcccattaaactaccattgacattcttcacagaactagaaaaaactattttaaaattcatatgaaaccaaaagcagctcatgtagccaagacaatgctaagcaaaaagaacaaagctggaggcatcatgctacctgacttcagactatactacaaggccacagtaaccaaaacagcatggtactggtacaaaaacagtcacatagaccaatggaacagaataaagaactcagaaataaaaccacacatctacaaccatctgatcttcaacaaatctgacaaaaacaagcaatggggaaaggattccctatttaacaagtggtgctgggagaactggctagccatatgtgaaaaactgaaactggatcccttccttacatcttatacaaaaattaactcaagatgcattaaagacttaaatgtaaaacccaaaactataaaaaccctagaagaaaatctaggcaataccgttcaggacatcagcatggacaaagactttatgatgaaattgccaaaagcaactgcaacaaaagcaaaaattgacaaatgggatctaattaaactaaagagcttctgcaccgcaaacaaaactatcatcagagcaaacagacaacctacagaatgggagaacatttttgtaatctgtccatctgacaaagggctaatatccagaacctacaagaaacttaagcaaatttacaagaaactaacaaccccattaaaaagtgggcaaatggtatgaacagacacttctcaaaaaaagatatacatgcagccaagaaacatatgaaaaatagctcaacatctctgatcattagagaaatgcaaatcaaaaccacaattagatatcatttcataccactcagaatggcaattattaaacactcaaaaaacagacgctggccaggctgcggagaaataggaatgcttttacactgttggtgggtacataaattagtacaatcattgttgaagacaatgtgctgattcctcaaagatttagaaccagaaataccatgtgacccagcaatcccattactgggtatatacccaaaagagtataaatcattccattataaagatatatgcacgcaaatgttcactgcagcactattcacaatagcaaagacacagaatctacccaaatgcccatcaatgacagactacataaagaaaatgtggtgcatatacaccatggaatactatgcagccataaaaaggaacgagataatgtcctttgcagggacatggatgaagctggaagccatcattctcagcaaactaatgcaggaacaaaaaaccaaacaccacgttctcacttataagtgagaactgaacaatgtgaacacatggacacagcgagggaacaacacttactggggcctgtcagggcagggttagtggggagagcattagggaaaagagctaatggatgctgggcttaatacctgggtgatggattgataggtgcagcaaaccaccatggcacacgtttacctatgtaacaaacctgcacatcctgcacatgtaccctggaacttaaaaaataataataaaattatttaaaaaaaaatttttaaacttatgtaaatgtttctatagtgtcctctatgaacataccatcatataggtttttgagttcacttccataagaaacatttttatatggtttgattttaatatgcatttacaaaaatatgaacactttacagaggattacttgcactactgtatttcttcaatatgtatttaattgaaaggatggcatttttaatgactataattaaaggtcgatgaatcactatcttattaaaatttagtaatatttcataacatacatggttcacaattgatgcaactgcttcctattgatgaatttttttacagttttaaaaaattatgcggccaggcatggtggctcacacctataatcccagcactctgggaggccaaggcaggcggatcacctgaggtcacgagttcaagaccaacctgcccaacatggtgaaaccccatctctactgaaaatacaaaaattagccaggcatagtggcacatgcctatagtccaagctacttgggaggctgaggcaggagaatcgcttgaacctgggacacagaggttgcagtgagccaagatcacgccactgcactccagactggatgacagagcaagactccatctcaaataaaataaaataaaataaaataaaataaaataaaataaaataaaataaaataaaataaaataaaataaaaattatgcaaactaataaaatattaataataaaaagatttcaaaagagtaattttctttcattagtatcttttccacatgattcaatgatcttatattgctactaataaaacttctacaaattaacatataatattacagaaattgtaatttcctaaaataaaagggattatttgaaataacaaagtttttataatgggattatgagctaacaaacatgaagaacatgttgcttatagctaaaatagttcatgttaattatcatttaaaaacattcccctcagaagaaattctcttatactttttatgaaatttcagtttggttctactgccatgagaacatcatgacacagcttcttagatccggctctcccagttactagctataggcatgtaccaactgcataattctctaagttggaaccaagcagagaaaaaattgacaagtgaagggtggacgtttttatgaggttaatgaaatgaaggagatgaggctttcttggaggacaagaatgaatctccaacaacatatttgaatctgtactactgtggactatgtttctcaggtttttaatgaatcagaacaggcattagtccaaacagaatggatacgtacacagcatatgggtgtatctggacacaccagttcaatataagtgctggctctatgaccatgacaaatcactcaacctttccttgtcttgatttttttccttgtcttggtttactcatctataaaagcagtaactatatcattatagtgtttataaagattgaatcagtttattgaacattatacaagcacttagtgcctgatacaaattaaagtacacaaacagtagctattgccactgcttctattattaagaaactttctttctagaagccatgtaattgaaactattactatgcctcaaattcaatatccctagatgccaaatatgaaaaaaagtttcccccctaaaattatccctcagaaagaagttgcctcatacttgaggatttataaatgtattatgaggctcttacacaactgcttcattttgaaccataatgtattgtttggggaactcattacactgaaacaacttcaatcaatgctagttatggatgcttaaaaggagtcacaaatcacagtgataaaagatgtcatttttaactaagcctttagagaacactttttaaaaacacataatataagattatatagttctatttctaagaatggctaaacagacaacttagaacaaccgcctgtcagtgagaactagaaaagctggggaaaagttaagaaacctgttagaaggcactggagggctaaaaaaacagtgatgaattatgcagacaagacccagaagaagtagtaaatctagaaacctagaattctgattggcttttggaattgcttttccccaaaaaaaaaaaaaaaaaaaaaaaggatgtgttaattagacaagaggaagctgagaggcctaaaagctcagtagagctttcagcaggttaacaaaaatgcagtaacaaaaggtgaggccaggatccgccaaaaattacaatcctgctaactctcctagtctttggtttaaaatataaaatctatgtcttggggagtaacgatggtcagataaaagcccagcttaaatcatctcaatccataattgaggtgataagtgaactcaagattgttgaatccattccctagaaccacaagtagaacaaaatccatcatccaaagcttcaaactagtccaacaacttatcagaaaggaaatgctggtatcactaagggtaaggatactgtttccttctgtaaggaaaagcagattattaagtgaagggtatcaagaagggggcttatgaagtatactgataattactgtttctcaatctaggtatttgatacataggtgtattcagtttgtgaaaatatatagtcatttgcagtatatgtttcgctcttattgcccaggctggagtgcaatggcgcgatctcggctcactgcaacctccgcctcctgggttcaagcaattctcctgcctcagcctcctgagtagctagggttacaggcatgcaccaccacacccggctaattttgtatttttagtagagacagggtttctccacgttggtcaggctggtctcgaactcccaacctcaggtgatccgcccgcctcggcttcccaaagtgctgggattacaggtgtgagccactgcacccagtctgcagtatatatttctacttcaacaaaatgtctttaaaataagcatacaagaaaaaaagacaaaaatgtaaatataaaccaagagaaaaaaaagcaaaaatagggaatctagaaaatgaatttggcagatgtaattttaagtgaactatattatgaactgaatgattctgccctcccacaaattcatataatgaaatcctaggccaggcgcagtggctcacacctgtaatcccagcactttgggagccaaggcgagtggatcacccgaggtcaggagttcgagacaagcctggccaacatggtgaaaccctgtctctactaaaaatacaaaaattagccacacatggtggcacacacctgtaatcccagctactccagaggctgaggtagaagaatcacttgaacctgggaggcggaggttgcagtgagccaaaattgcgccactgcactccagcctgggcggcagagcaagacactatctccaaaaaaagaaagaaagaaagaaatcctaatccccagtgtgatggtattaggataggagatggggcctttgaaaggtgattaggtcatgaagacggaactctcataaatggaattagtggcattacaaaatgaacctcagagagctttctggccttttttccatcatgtgaagaagacagtcatctatctatgaaccaagaagtagaccctcaccagataccaaatctgtcagagccttgatcccgtactcccagtctccagaactgtgagaaataaatgtttgttgtttaactcatccaatctaggacatttttgttacagtagcccaaactaagacagactataaaacaactatgattaatatgttcaaggaattaagtggtaggatcgagctttacggcagataatgcaacataacacaatttttcagaaaactcagatatatttttatattgtgtttaaataaagtgctagactttcagtgaccacttacagagttctttaaattcagtaatattttaaaaatttcaatttaactgattttacctttgtgatacttttgacatatcagataaagatttgtggtctgttagagataatagcctagatacttaagtaagttaagtagaggaatcaaagtttatatctgagaggactctgaatggttttaaaagtaatcattcttatttaacatgttaactatatgatgaaatgaattttactttctccttgtccagaaacagaatagttaaataagacaaacaagatatattaaggaaaatgtttagtctgcttaagagtaaaaataaatgaatttgaaagactttgaaatctactttatagtaagtttccacttattccacttggtatactaaccatacttcatatacacaaaagagaattctaatatctaattttaatattccctccatttgtatttgaaagtttttagaaatattctgtttttagtagaactgcttaatcttctgagcttattctatatcctcaaatatatacatatttatatatatttatatatttacatatatatttttaaatatttatatatttacatatttttaaatatttgtatatatttttttatatatatatatatatatatatatattttttttttagacagagtctcgctctgtcaccctggctggagtgcagtggcgtgatctcgctcactgcaagctcccgggttcacgccattctcctgcctcagcctcccgagtagctgggactacaggcacctgccaccacacccggctaattttttcagctaattttttgtatttttagtagagacggggtttcaccgtgttagccaggatggtctcaatctcctgacctcataatccgcccacctcagcctcccaaagtgcctggattacaggcgtgagccaccactcctggcccaaatatatttcttaactagacattgatattaggcagtctcaattaatacatctatgaatttgaaacaaagtagaaaaaccccttatgtagctagcatggctgttatgaagcctttaaatattattttatgtatgaagcccttatttttagtatattatgcatatcatttcaaccatcttgatattctgatttcttgttatacagataataaaagacacaattttaaaagaaaacagtaaaaattatattttccattgccaagggacaagaaaaatgtgttttacaaatgcatgaaaaggtttaaaaaaatcaattattatacatgttgtttctattgagcctacagaaatgaggcattatcatacatgggatttctaattcgtactaattaaaatgttttatattgtggtttcagtttttctatacaaccattaagtaatgccaactttgctccaatataatactattactattacaaaaagacagaaccatctgactgaaatctaagacagaaaacattacttctaaggccataaaacctgctcttttacatggaaacatgactggttctagagctaaggcagttaaaacaactaataaataaataaatgagggagaaatgacagatcttccttacaaaataattctaagtgactatgctaaatcatgtgaatgagtactcaaagtctgaaacatatttctatgacagcattgtatccatattccaaggtaatgtgtatctccaaaaatccagacagaagtaaagatgctttccaatggaaaactattaaatgaaaatgactcaaaaaggagtcctcaaaatgtctctaaaatatatgtgataaaactatttcataaaatgagtataaaatgttctatttataaatgaatgttttatttttccatgtttaaaatatgtacatgtatgaaatgaaatactaccatagaatactttttttagtttctttaaaaatatacatttaagctggaccaaaccaaaaaaaaaaaaaatttaaaaaaatggggaccaatttatactggagaaggctttgcagtttctttaaagcaaagataatgttttataaatacactctcaatagaaatgaaattatatgatatctaaaattttacatgaaatcttggaatggggtaaggtagcaaaacgagagcagccatgagctgatgaacagtgcagctacgtgatgtatacatagggattcgttgaactgtcagccatacttttatgtatgtttaaagtttcccataatcaagacttactgtaaagctacacatatcaagacagtgtggtatttgtgaaataacagagaaaaacatcagtggaacagaagagaaagcctagaaacagactctcataaatacagccaactgctttcacaaaagagccaagacaatacgatggagaaaagatagtcgttcaacaaatgatgctggaacaaacgaagagtcacaggccaggcgcagcggctcacgcctgtaatcccagaactttgggaagctgaggagggcagatcacgaggtcaggaattagagaccagcctgaccaacatggtaaaaccctgtctctaataaaaatacaaaaaaattagctgggtgtggtgatgcacacctgttatcccagctactcaggaggctgaggcaggagaattgcttgaacccgggaggtggaggctgcactgagctgagatcatgccactgcactccagcctgggcgacaaagcaagactccatctcaaaaaataaaaataaaaataaaaataaatctagacacagaccttacaatcttcacaaaaattaactcaaaatgggtcacagacctaaatgtaaaacacaaaactataaaacttttagaggttaacataggaatctagatgaccttgggtatggcaacttttagatacaatacaaaagacatggatctgtggaagaaataattgataggctggacttcattaaaatttaaaacttttgctatgcaaaagacaaggtcaaaagaatttgaagacaagccacagactgggagaaaatatttgccaaagacatatctgataaaggactgttatccaaaatatacaaagagttcctaaaattcaacaataacagcccaattttttaaaaatgggctgaagacctgaagagatacctcaccaaaaaacatacacaaatggcaaataaacatataaaaacatgttcaaaaccatgtcattagggaattgctaactaaaaccaatgatatactataacacatttattagaatggacaaaatccagaaacttgataactccgtatacagacaaggatataaagtgacaggaactctcattcattgccgatgggaatgcaaaatggtacagccactctgaaaggcaactttgcagtttcttaccaaagtaaacatactcttaccaaacaatccagcaatcacactccttgatatctacccaaaaaagctgaaaagatgtccacacaaaagcctgcacatggatacagcagctttattcctcattgccaaaactagaaagtgctcaaaatgtctttcagtaggtgagtggataaataaactgtggtatatccagacaaaggactagtattcagtgctaaaaataaatgagctaacaagctatgaaaagacatggagacaacttaaatgcatattacaatataagtgagagaatccaatctgaataggttacatattgtatgattccagctatatgatattttggaaaaggcaaactatgtagacattaaaaagactagtgactgccaggagctggtggggagggagggatgaacaagtagagcatagagaatttttagggcagcaaaactattgtgtatgataaaacacaatggtgtattcatgttatcatatatcagacaaaatccgaagaatgtacaacaccaaggatgaaccctaatgtaaactgtggactttgggtgacaacaatattaatgtaaattcattgatcgtaatgtaaaatgttgatggtgggggatgttttgcatgtgtggaggtagaggatatataagaaatccctgcaccttcaactaagttttaccgtaaacttataactgctccaaaaaataaagcttatttttatttttaagaaagcagtgagtttaatatatctgaacctatcttatataaaaataggtctctctctgctatgtttaccaaccaccctaatgctagtgaaaaaaaaaatcagaataaaatatagcttttcactttgctctaaaacattcactttcagaagagacaaacgttgttacattacatataagctttatgaaggcaaaaaataactccatgaagtatattttggaaaaggcatggtttatatactcttaaggtactattccacaggctcatggaataaagaaaagtgtgaaattatacttaagtagtagtactttctacatattttgtatctgaagctctaaacataaatgttcacaaaaatagtaataagtcagtaactgaacccacaattttgggtgctgagggtaatatttacttttcaaagagatcttaagatacagggagacttattttatctgaatggatttcctaagaaataaacacaaactatgatcttttgtcagttcataaggaataatagaaaaataaaaaatgaaattaatgacagttaaaactgcctacagcaaaatatttttatgtataaaaattgataaaggaatcaaacattcctgaaaaatatctacttttgtatcatgtgagcagtaacaatggacttagtagaaataaaaaacaacttcagcttaagaaacttctagtattaataaaacacttgcacaaatacctctttgaaacctgagaaccaccccatgtggtaaacaaagcaggtatttactatctttttcacagatgaaagaactgaggtgcacacaatttacataaattatcaatagtcacagagattaaaaatggtagagccaggatttgaactcgggaattattattctttatcctgtcacctctcacctttattaccttggcatttagagtagtcacataaaagacactgaatatacccacttgccttctgaattccaaggcagcctgaagggtgctagtgccatctcaagatttacaccaggatgaaacaatctctgcaacctgctgtggcctgagactcttgcaaaatgtttaaaagtgactttaacacatcatgacattcccacataatctaagacactgcactagtcaactcaggctgttataacaaaataccacagggtaggtgcctgaaacaagagacatttatttctcacagttctcggggctgaaaagtccaagatcaaggggcaggtgattcaattcatggtgaaggccctcctcctggtgtgtggacagctacctcatatggtggaagagaggaagcaagcttcttagaagggcactaatcccattatgaggtccccactctcatgacttcctctaaacttcattacctcccaaaagctaaagtaacctgaggcattgcctttaagaataccaacttttatccatctctaaatatcatcaccctggggctaagtcttcaaatatgcactcagaggggatgcaaacattcagtccatagcacataccacagcagtatattgtgttacatctctctgacattaggttagatgtacctgacaagaccagggtgggtaggtggtaactaatataataatcactcagtcaaattagttactaagcaggaagagaatacattattagagataattcactggaaaaaaattcacgtttaataaaacttttaatttagtatttttcacaaagaagaaaaagtctccttccccaaaatttgtgtctatgtaaaacaacaaaggatatgcatactggtttgagattttttttccttctgtgaagaaactgctatgctatacactttacatgttttatatcacagcccagtgaccactatactacacaggtggaagtgtgggtttgaggaccattgaacactgaatctcccccaatacatcacaattatagaaacacctgtgcacagtaactttgtgttgagccactatgaaacttcagtgttcaattgcccacaacacatctcatttcttatgactagattcagctctagtatgtaagaaacaagctttctgaatgcagcagtttccaaactttgtactgagaaatctagaggatctataataaagcatttttcaaattttctgaaataaaatatgctcatgaaacatgttgaacttaggtctaagggtttcaagacatgagaaataagggtcctacttatttaaaaactaaataatgtagatccagtgatggggaagaaaatagaaacattttttgttaagcaaaattcattttagagtagttttcatttgatcataaattatgaaacaaaattacaatgatcctaagtagaactaatcatgattcctcatgtattcattctctccataccttaatctctaaaataaaaagtttatattagagacaggaaagtaaatgtgtgttgaattgaaactgatgtttaattctcctctagggcataaaaacaaatgggttaaagcagaggttttacaatatttgtggacaacctaagaaggagggcgattaattaaaagttccttttgtttaatactatgaagaactcttaatacataaaacaggaaaaaaacttatattctaggtaaagggagggtagaaaactagatctccacaaaacaccaacttaacattttaaaaaagaaaaaacagaaataattggaatataaaaggtttttatataaagtttcaaaaagggactatttattcttcattatttccaaaatattcttgtatctaaattataggatacactgagtcactggggaaaaaaatcatataaacaagttattttttaaaatatgaagataaccagtagaagacaaagccaaaagagatctgtttgcctttggagagtaaccactggaggtaagacggggaagggaacatgcttactatagaaccctacagaaatgaaaacatatgcttacacaaacacctgtggcactggaggcaaagatgacagctccatgggtgtacaggagtcatcattcaaacataaatgggtgcaatctgtgactgccaagcagggggaggggggacaaggggaatgggtgtgtaacagaagggttcaaggaggctccaaccttgatttttgatttttttctaacccttcaattatctagttatggtttttgaggataaaaggactaagttttctaacctcaaaccatctcagaattaaatagttattctgtaatcccagcactttgggaggctgaggcaggcgaatcacttgagctctggagttcaagaccagcctgagcaacatggtgaaaccccatctctactaaaaagacaaaaaattagccaggcatggcagtgtgtgcctgtagtcctagctacttgggagactgagataggaggatcacttggtcctgggaggttgaggcagcagtgagatggcattactgcaccccaacctgggcaacagagaccctgcctcattaaaaacaacaacaaaaaagtattgaataattctttattagaataccactaagagaactcattttaaaatatcagaaaacccaacagaatggccaaaatgaataacattaacgttaccaaatgttggtgaggatgtggagcaaacaaaatctccatatgtcactgtaaggtttacagcttggttgttatgggccaaactgtgccccccaaccctaaattcttatgttgaagccttaacctccaaatatgactatatttggagacagggcctttaaagaggtgtttacattaaaatgaggccattagggtgggccctaatacaatgtgactagtgtcctaataaaagaaggaaatctggatactcaggaaaaccctaggaatatgcggacacagtgagaagatggccacctgtaagcaaaggacagaggcctcaagagaaaccaaacctgccaacaccttgagatcttgcacttctagatatcagaactgtgagaaaataaatttctgttgtttaagccacccaatctgtggtattttgtcatggcaactgtagcaaactaaaacaataatacaactactttgggaaaaagactgacaggttcttgcggaaccaaaatatatccaccttatgatccaataattctatatctaggtattgacccaacatatacaaaaacataaaaagatttgtgcaagaatgttcctaacagatttattacaataggcaaaacactggaaatagcccagtatttattaatatgagaatggataaactatggaatattcatacaatagactattattcagcaaaataacactgaaaatattattttgaagatgctaaaaatgaactactaatacaatgtggatcaatctccaaaatattatgctgagtaaaggaagatgtaccaaaaagaatacaatatgactctaattatattaagctctacaacaagttaaattaatctttgttatcagtaaacaatgttccatgattatattcatgtttttgcatgatcaggacttcctgagcaaagagtgctggcaacctggattaacagacgagtaaatggcaaatgagtcttggaagttaaagacagacagagagacatccaaggagatgtatgggtttatcttccatcatttaaattccacagggtaatggaaaaagagacgttgtcctcctctccccagaaaaaatgtgtttacattagaaagataaggtaactatccctctctctacacaggggaggaggagcgatgcaaaagcagtcctatataagctctgagatgtatacagtctgatatggtttggctgtgcccccacccaaatctcatcttcaactgttaactcccacaattgccatgtgtcgtgggaggaacccagtgggaggtaattgaatcatgggggtaagtctttcccgtgctatgttcgtgaataagtcttataagatctgatggttctaaaaaggggagtttccctgcacaagctctctcttctcttgtctgccaccatgtgagacgtgcctttcaccttccaccatgattgtaaggcctccccagccacgtagaactgtaagtccaataaacctttttcttttgtaaattgcccagtctcagggatgtctttattggcagcatgaaaatggactaatacacaatcctatataaattctgagattcatttatttaggaggagctcctctcctgtattacaactccccatcccccaagatatacagatggcactaaccctcataacatcaccctcatggggaactgaagtgcaggaaagtgacactaagataaccatgagtaaataaaaagtctcttctctgatccacacatcagtgtttctgcttttgtgtgtgtacatacactaaacatatgccatatattcagtgtgtgtgtgtgtgtgtgtgtgtgtgtgtgtgtgtgtgtataaatgcaggagtatggtaatacctcaaatcctttactttttgaatacaacactataatgaaaaaaattaaaacaatacttgcatctgagggcaaacaactaacttggaagcacaacagtaatacttcatataatgaaaagggtttgtgtgtgttactaacatacatgcaattatcaaaactctaaaatttgtgcatttcactgtgaaaattttatgtcaacaaaaggaaaataatcataaacaaatattgaattctaattaatgatatacatactgaagtgtttaggtgtaatgtgtactgatgtctgcatcttactttgaaatgcatctaaaacattggactgtttataccaatacaggcatgtaccgatttctccatttttgaaggaaagttttgccaaagaagaacttacttgttgacttttttgtttctttcaacacttcaaacatggttcttcaactaccttctggccccatggtttctaatgagaaactagctgttgatcttattgaggaaaccttgtaaataatgagtcacttctcttgctgctctcaagattctctttttgtccttagcttttgaaaatgtgatctttatgtgctgtattagtccattctcacactactattaagaaatacccaagactggataatttataaagaaaagaggtttaattgactcacggttcagcatagctggggaggcctcaggaaacttacaatcatggaggaaggcacctcttaacagggtagcaggagagagaatgagaatagagtgaaggggaaagccccttataaaaccatcagatcttgtgaaactcactcactatcatgagaacagtagggggaaaactgccccccatgattcaattatctccacctggtcccactcttgacatgtggggattattacagttcaaggtgagatatgggggggacacagacccaaaccatatcatgtgtcttggtgtgcattcagaatttctcctacttagattctgatgagcttcctgaatgtgttgattagtgtgtcatcaaattgggaagttttcagccatttttttcttcagccattctatttgcccctttctctctctcctttcctcctggaatatgtattatgtgtgttggtgcacttgatgtcatcacacaggcctcttaagtctcttgagctctgttcatcttcatgctttttgactttctactccctagactagataatctcaattgacttaagttcacccattcattttctgcctgttcaaatctgctgttgattgctacttgtgaatacttcatttaagttattatacgttttccctctagtatttctagttggtttctttgcatcatttctctatacatactgatactctctacttggagagtcattgttttcctggtttcatttagctgtttcagcatatttaacatggtgatttaaaacccttgggctagcaaatccaatgtctggacttccttgagtacagtttccattactttctttttttcttgtggatggaacaaatttatgggtttctttacattcctcatcgttttctgctaaaaactagacattttgaatattataatgtggtaactaactcagattctaactcctccccagggattattgttgctgcctatcaggtttttgtttgtttgtttacagtcgtttctaagctatttctgaaaagagtacattctttgttgcatgtggtcatggaagtgtttactgttttgttagcttgcagtttgcctaaaacttagctgggccatttaaaaatttgccttagccatcacttcctcttctgcagagcttgaaggtcagtctgacataaaagcttaggttcttatcagatcttttctgagtaggtgtctaaccctacgcatgaaatggactttctagatcccatattatccacaggagcttctcaactcccttattccccaaagcattccatcctccagccttttgttccaggcttcttggcatgtccattgtttactcccattgatatctattgccccaaggggcattagtagataatttgttctgagggagttatgatttcagcaaaataaaggcatgtcccttgcattagggatcctccaggcaggtcaaaacaaataatcacacctctttgcgaacagaatctactctgttccatccagcccctgtcactgaggcagagaagggaggatagagtgagggtaagtttaaatgccacaaatcttttctcctgagtttcaggccccattttcttaaatgtttgaatggttgctgtaaacctttgactattttctgaattcaaaaagctgattggactgtttttacagattttcttgtatctctgtggagcaacaagctcttgggagttctctactctgccatttttactgatatcactttccatttgcaaaattcttaaaataaaatgttggggaaaatatggattagaaacaacttatctgtttctcttggaactgtgacttacagtgaaaaacttgaaaatttaggaaacccaaaatgacataaaacagtaataaaagttcactaacaatatacgacataaagatacaatttttaaaattataagaaatgcaaaaataaggctagtcacacaaaaaggatgtttaggaaacagaaagtgagagaaagtgctaatataaactcactaaagagattttatattctaagtaagctcatgctctggtttctcttcagactgtataaatcttttgccttttactaagtaagctgaatgtataaaaataaaaactaaatcattaaatcaataaatacattattttaaagatggaatcatatatatatacatatatatatacacacacacacgcacacaaatatatatttttatatatataggcactaaactttactggcccctaaataaattaacaggaataacaactagctctggaagcaattatttgtaatagggaatctgtcaaggtctccactgggttgaggaaggcagtagctaaccactaaaggaaatgttaaaaaagcaaaggtcaatgtctggccctaaatttttaattccaacaacatggctagaactgttcaaattagaaaatggtcagcatgtcaaatggataactaaccagcaccattacctagtgcttacatacagcatactataagccccatgctagacaagtacatgaattttcagcaggacatacacagaatcatggggatggagggtgaagaggaaaggggatttattttgtctaaaaaaatttttttttttcagaatatagctctactatactaggaatggtttttctatgtactttatatgaaaatgtatgaagttacttatctaagaaaaattggtgtttctgaaggacatcaacccaagaaaacttatttttaactaacattttttaacagagttctttaaagcgtttcacaaaggtcagtatgagctgattttttttaatgtgaacatttccacaacaaattttaaaaattggaatgaatcagcaacttagatgacacagcctgaagtatttcctaataaatgagaatgagaaaaggtccattatttcacttataaattaattaagagcttccaacctacaatgtatcaggccttcctcacctaccagacatctattttaatgaattaaaatatactacattgtgatcaaactaaaatagaccatttcaaaatctagagggaacaggaggtgtactcctgagataaaaaaattttgtcagaacacttcattttaatctaatatttataccacatatatatacatgaatagtatatatcttaacagatgaaacaattattctttccaaatcatagtgtcttcaaaaattttttaggttattatggagaatgtggtagagactgttgattacctccaacagccagtagggcaaggaggaagaaggatctttctccctgaccacactcctcacatatataacggactatatgtaagtgtcaaaagcatatcactcaacacgttactaagaacacgaaatcaatcaaacagaagttcaaagataagatgataaactatagaataaaggaaatatgaaattcaaactgagtaagtaaacaacagatcaaagcaatggtgttactacatttacggaattaaaaataaaaactgaaaaaaaagattagaccattgaaaatcaaattactgacaatgaaacaacttgaaataatataaatgcaatcaaaaagacaaaaatgtggcctagcatagtggctcacgcctgtaatcccagcactttgggaggtcaaggcaggaggatcacatgagccccagagttcaagatcagcctagccaacatggcgaaatcctgtgtttataaaaaatacaaaaattaggccaggcacggtggctcacatgtgtaatcccagcactttgggaggctgaggcgggtggatcacatgaagtcaggagttcgaaaccaacctggccaacatggtgaaaccccgtctctaccagaaacacaaaaattaggcaggtgtggtggcaggcacctgtaatcccagctacttgggaggctgaggcaggagaatcatttgcatccgggaggcggagattgcagtgagccaagatcgtgccactgtactccaccttgggtgacagaacgagactcagtgtcaaaaaaaaaaaaaaaaaaaaattatcaagtatgatggcacacacctgtggtcccagctactcaggaggctcaggcaggaaaatcacttgagcctggaagggcgaagctgcaatgaactgtaatcacaccagtgtactcaagcctgggtgacagagtgagatcctgtctcaaaaaaaagaaaaaaggacaaacattaaagaaattttctaaaaatatgatggacatggtagacaaagattataaaacagaataacgggtattcctcaagtatataacttacaaatgaagcagaaaaaaaatgtaaacatcgaatttttaaaattacaaaaagaaaagaaaattccctaaaataaaaggaagaagtgaacctggagatcatatggaataactcacgttgagatgtaacctgattaattctcaaagactttttaaacaggtttttttagcatgcagaaaaaaaaaatcaagtcacctgcaaaggagaaaaatctttggctatcttcagatttcttcacagcaaaattcattgcagaagaaaattaagtaatgtctacagagttctcaaaagaagaaaagggtgtgtcccaacagtaccataaccagcaagatgtcaaatatacaagaaacaataaaccattttcaaatgcacaaggcctaagagaatactaatccaagagcccaggtaaaatatcaatcaagtgtgagagtgacactgaaagtctcaaaattttatctcccatctacccactcttaagaaaacattggaggatatgctccaaagccaggaaaaccaaaagaaaggagagagacagacagagacagagacagagagacagagagagaaagagagagagaagaagaaagcctaagaaataggattcaacacagaagagacatgaaattaagttctagaaaaacagattggaactgtgcaggcctagtaagcaatcagattagaacagagggtgaagactccaggaacatatctcctgggaagaaaatgaagctgttgaaatacttgatatacttgacaactgtactagtcagaactgtgttcagctatatataacagaaatatctagttaggtagctccataaaatgaaaagttgccccaaacactttgtttttcagctctgcccacccccagaatatagttttatccttatgcttgtaacatgactactgcacctctaatcatcacacatgcattctgggaaggaatcatgagaaagggcaaagggtaaaatatacatatgtcaaataagtctgtcagaaaaacaatagcttccccagaatcccaatttccagatgtggacccatttctgactctaaaggaatttagtatgttgattatttttcattaggcatataactactctgaacaaaatcaggatcctgttatttaaataagtgggaggggtagaactgacattgggtagacaagaagtatcacaacaactgcacataaaataatatttggagaatatttaatattccaatggagaacttggaatgcttcatatagtgacatgataaagtaagcaaatttaaaatgaagcaatttttgattccaaaaagaaccaaaagttccacaagagatgaaatgctattatacagctgaataatattcataaatcataggaaaatgaacacctatggattgaaaaaattctaatatatatattccaaagatgaaagaggtaagcagaagcataaggtaatagaagaatgacaaattctccatttctataataggaagtcaatacataatgcctaaaattgataaatcaagaaatagcaatatatgtctattacctagaaatggagaaaggtaaatacacacacacacacacaccaaaaataaaattcttaccccacaaccacctgaagggaccccttctcacgaccaagggcattccaaagttaacctgaaaaactagttcagaccatgataggaagggtgggtcagacatgcctcattacaccctcctcccttttggaattcaggaaaagccaaccagcattaacatcaacatagaccttaagtctgataaacatttataatctattctgtctgaagcctactacctggaggctttatctgcaagataaaactttagtcaccacaaccccttatcataatccagacatttccgttctattgattccaggtcttcagataacaacttaactttcaattaattgccaatcagaaatctttaaatccatctatgacctagaagccccgtcttcaagttgtcctgcctttccagattgaaccaatgtgcatcttacaggtattgactaatgtattatgcctccctaaaatgtataaaagcaagctatagcaaccatgggcacatgtcatcaggaccacctgaggctgcacatgtcacaggtgcatccctaactctggcaaaataaactttctaaattgattgagacctggctcagatacttttgagctcacacacagaagggaaaagaactgaggaagctaattcagacattgagaagggtcactcagaaaaatgtttctcataagccttgtagtactattcattttctttcttttaaaccatgcatatgttccttggtaaaatttaaagttttcttttttaaaaaagaaaacttcatgagttaaaaaaaattccaatcaataggaataaattataaacaacaaaaagaatacggaatctttacgataaatgcttcataaccaatgggaagagaggagacattatttcaatattagatcatggtccttagtttcaccttaaattatatgttgaaccctttgtcaacagttacttaaaacagtgcacaaaaaactgctcttattgcattgtaaagaatgtattctaccacaacttctcagtattttgtttttttaataaattccacagaatcgtggatctatagtccattggtaagacacatgacaaaatttgttttaacaaagaaaattaatcagtaaagaaaattaaaactcaataatctctaacattttggtccgttaagacaggatctggatgtggagttcatgaagtacttccctgaagtacctctgtacctacagaaaattgctcatcaaaaaactacatttataaattttggattttgataagttattttatggctaccactgaaaaacttaagaacttaccttaaaaatactttaaacaaaattctaaatttggactttgttaaacttatgtaaggttttataattgatgtacagatatacagagagagacaaaattaattactccaaattttaaactggcataaatactgccaccagaattacataacccggattcatattctaaaaaataatggtaaatatttagagttttaacttccaaatcactgaagtaaaatattttgataattcttgaaaacctctcatctcccagagaaagttcagttgtaaaaagctagattcatgcaattaaaaacattcctagcaggccccagtgtcagagtttcctttcagtttacaattgatgccactaacagatgttggtttttattttaaatcactcttaaaatttactctgtgttttataatatttatttttttaaatcgattaattttacaaaagcaactttagtcttagagatctaggtttatgcttcaagaaatctcccataataggcttgaatgacaaataaaatacttaaacaattttatatccttgaaaattatacaaacttgacctagaataaaaaacaacccacatggactgcaaagagtaaggtaaatttaagaaaataaaaatgcaaatgtgcattttagcagtctcttgaatttattaacctaaaaggtttaatttccattttcctgcatcagctttatttataaaatgtcgtgccctataaatacgccgttattttctatagtcaagcaccctcttaacaaatcttctcattaatatgtaaatttaaagtcaatcggtcttctccctgacagccccatgaattcctagtgcactgtataatcagctttgacttgacatccactatttatcatcaaagatgtcagttagaaaaattatggaaaatgcactgcaattgatatgactgcaatctactttgtcaacacttaattgttcctcaaatcatacatttacatataaacagcctaaatactgatctataatgatgcaaataaactaaattaaaaatctcttctgcccctgaagaagcttgtttgtatatgatgtgttcatttgagaacttattgacaaaagcatgtacatcagctcatctcaaaaagtgtatctacgaattttcgattcctcaacaaaaaacaattttgccacacttcaagcatattaacgtaaacaaatgtttgcaaaaattcaataggaaacatgatttttctctttgagagcaaatttaattatggttgttagctaattgcatgtctgagcactatggattgggagcctcaaagctggttttgaccggaacacaataaacaaacacagaaaacttattaaggtaactaagaaattattttaatttacaagtcacagggtaacaaaatataaaggcaataatgctggcctgggcatcagataattctgtttatatttctgctccaccttttataattaatattgtcttaagtgacttgctaaaatctgtatatatcaatttcttcatatataaaatgggtataataattctgattgccctatggcaaatggaatactatgtaagaaagtacaggccaggcatggtggctcacgcctgtaatcccagcactttgggaggctgccgagggcagatcacttgaggtcaggagttcaacaccagcctggccaacatgccgaaaccccatctctactaaaaatacaaaagttagctgggtgtggtggcacatgtctgtaattccacctacttgggaggttgaggcagacgaatcgcttcaacccaggaggcaagaggttgcagtgagccaagaacgcaccactgcaccccagcctgggtgacagagacagactctatcccaaaaaaggaaaacaaagaagaaaagaaagtacagcaaaaatgataagccattaagtataaagcatcacagtattatttttcacattttctcttagtatctgagagaaaactgctggatttaaatgaattcggtattacaggcaggtttttttaattataaatttaacttttatgtcgatacattgttttagtgacactttttcctactggcaaattctttacttcaaggtaaaatggcccttaattcatcataaaatggtgcttatatagcatttatgtaagtgacttctgcctgtaggtaaaagggaatggagggctagagtgaagacatttctacttggatgattccatgaaacaacacattcaagtgttgatggtaaaaggataaaaaagagaggtaaactctcaggaatgcctctgctagagtactgtttcaccttgtctttttattctataatcatcttaacctttctttactacatggtgttccttttacaacatcacataagaaagagcaagcaaatataaatgccaaatacttctcagtttcttctagctatggtcaaactctgctttgagatttagtctgccaacttcttttatttttatttatttatttatttatttttttgagacacccaggctggagtgcagtggtgcgatctcggctcactgcaagctctgcctcctgggttcatgccattctcctgcctcagcctcccaagtagctgggactacaggtgcccgccaccgtgcccggctaattttttttgtatttttagtagagatggggtttcaccgtgttagccaggatggtcttgatctcctgacctcgtgataagcccgcctcagcctcccaaagtgctgggattacaggcgtgagccaccgcgcccggcctcgtctgccaacttctaaagctaaaactaccatgtgtagtcgctaaaaagttggaagcaacatcaagcctagatcagaaagcactgaagactataaatggctacactgctcactccaaagtttctcagtaaaacaaaatcataattagcacagaggaagcctgagatgggttaactggaagagtgagagcacagacatggtcctagtgttgaccactcatttgaatcttaattttataaaatatatttataacaagagtctaacatattgtacaatccttgattctaatactgcaataagggctgagcctttcaaatctttcacactgcttctgaactgaacatatgtacgtatgtagacaaaagcctgttatactgattattctgggctaaacgagaccctcaaatagcacttacacaatcgatgaataatttttccttgaattgaggtcaactgatatcaacttaaattaataaataaagcaaaatgttttatccaaagtaaaatttataaccaccagagtaactgaaattaaacagttaccaataattgcctctaaggcgtcaaccaagaggttacgagaagggaacatgtacttgaattgcttctataattaaaaaacaacaacaacaataataggaatcaaattagctaaacttataaatcttctatttaaagtggttttctttctatctgtcttttaagccaatggatctttctcaaaggaaatcaaattcaacgctgcataagaaaggaaggcaaaaaaggcttctgtgtttgaaacagtggcaaaagcccaaaaagctgcacagtctagagcacccctgccctgcttggctcgttcctgtggcagtgctagcacatcctgagggctgatgtgcacactggaaaaccactaaattagtctaatgagcacagcatttcgaataattccaaggttggattgcaagtaagtggcaaagaaaagaaatgacttagcccattccagtatgccagggacaatgaccagacttcacctcatgtttgtcctaattcatgttcatggagttaacatgtgaaaacaccaagaatgaatacagtcccaatttttcaaattatctgtcaaaaaacaaatgtatatgatggtgtaaaacttaactttcctttgcaatggctttaaaaataaattttatctaaaataagataaaattcaaggaacagaaaaacaaataaacagacaaatatacaaaagcagagattttactacgggttacatatttttagcaggtatggtaagtacactatatattttaactccagtttctatataattacaagcaaaggatcatttgcatatagttactgaaaatgataggaaagtaaaatttaaaaatttaaatggtgacagtgattagctaaggcaaaattgcctataactttatacaatagaaaaaaaatctgagcagaagttttgaaaggaattggctgaaatcaaacaaataagctgtttggcaacaaaaatctctcatcaaagttatcataaaagggccaggacattttcatcatagagatgttccttaatctagcaaaagtgccatcaaaactgtactttgctcaatgataaataaaattaactttataaaattaaagttgacaaggatagtaaaatttcatcaatttaagagcattatgtaacataagacttacatattaataattcaaaacatacttcaatttttaagatggataacataatcatcattttgttaatattaaaagtgagatgaaaatcagtattactgtcttgtggataaagaagtattaaaatttctaaacagtttttaatgctaatactaaatcaatatagaaaatagtgatcaacattttataataatttgcaagcttgatgtgtcatttaaagcatgtatcatacatttttccatgttatttacatttttctaattaacaaaagcaagatgtactgagcactcaaggcctgtcataagtatgtatacagaccactttgatataacaggagctttttaaaaatcttttttttttttacacaaattggtttttaaaatctataatactgtattttaaaaagataagacatcaaaagactagaatgaatgtgctattcttacaacatttaaggatttatttaaactggtttaaaattaccttaaatcttaaatgtatacatcctaaggatcttaattacaagttatatgataaaattttctaaattgtcaatatgatgaaaagaataaggcatacttaaaaaaaagaataaggcgtacttctaatgttaatctgcacaaagaaaacaaatagcttcacttaaattattaattttactaaatgctaccagctaaagtgaagagaagaacacaaacattttataaatacaaaactaggaaaaagtagtttaaaagttcaacaatatttatctatagaggcaagaaattaattactttaggtataaattcacatgctataggagcacatcacctactttttttacaaatgagtacctggaatagctggggctcaaagacgtgaaagtaactagtaaccaaaaaaatccatggtttggcaatgtcactgtaaacactgtgtcatgctgctcctcctaacaagggcctcttgccagtatcaaactaaaagtgtatatacttacaccaataaatatgtatcaatcagtgccaaaataatggataattatgcttgcatttatattggttgcctgctttagtaaaagaacaagagacaaatgagtcttccttaaatatgcagatttctctagtttactactcctaattttttgcccaagttttaaaaagctcatccattctcttagtatacttgaaagtggaagactgttcaacacttacctctttccaagggctgacaaactgtgtccgagcatatcgagttagcatgtggattatgacaacctgcccccactcttcaacatccactagtaagttacatagcttgcggtaatttttatgaatcagatctattctgtccgggcatacttcttcaaaagccatcacaacactgccagctaccaactagaaaagaaagaaatagtaacttattaaaaaatgtttctcccctacatcaaaggtcttactcaggcattatagtaatcagtttcatgccaatcagtattaaagtattcagtcattcaattaaaatgaatgttcatgtttgaataacaaactttatggtgactattcgtcaaagaataattttaatagttctaatatgtctagaaaatactattctgaagagaagtaaattctgatgtgtttatttcaccaggttaaatttcaacacattgttcatatgtggattaaacattaatcacgcacatttttcatgtttaaagctaacctaaattctaatctaaaaattcagtactttgttcataatattcagaaaaagaatcaagacaataacaaagctcacattgtgtcagtttaaaatgagaacgacaatcattctaaaatgaacttatgttaaaaagtatatgagaaattcataaattttaatagaagaacactttcaaatcatatacatcttaatccaccggtttttacccaatataatttatttacaaagaaaacacactggctgaaattttagaacatcacctgggctcttatcactttcataacaatgtgtataagttggaataatatattactaacaaaagggggctcttccaacaccagttaatgaatcataatgttagtttctgaactgtgatgcttttacaaagtggtaacattgagattcctttactctaaagacacaaactaagcagaatatatattatacaaatacttctctatacgtacaaatgatatatgtgcagttagcccacaatataatacagttttgaaaaacaaattaataccatattctatctgaacactagggatcttcactttagtgtctaaaatttccccaatgacttaaaataagcaattaaatagaaatataacttactgaaatggtactttttgaaaaatattagatacaatgatattcatattttgagtgtttgtccctctagttggctgacatttagtttattaatatgcaaccaacaatacaattgaaagaaaacagctcagaatatagactcgctattatgctaaacaagtttcaagtcctgtggggattttatgaattaccaatcagtataaacgtgaagctgcatttattgactccagccctaaccatgtactggtgcctgctggtcccagcatgtatgcacctcaatcgaaaaagcacagaattgattatttgtgtgaactatataaaaatgtattatatatataattttctatttgttatagatatggcaaggaagttaagctcatgctttcaatcacattttgatgtcttctgcaaaagacataatttctttagaaattacattttgtgataattacatttctataaagtgacaattagtatcattttaaaatatcttacaactaagtttatgacattaaactctagaataactcattgtgagatataaacatctatatatatgtattatcaaccttatattaatatcaacatcaattggtaaagggtgttaaagtgcaaaaataaaggatagtatctaggataaaatgatccatgaaattgaacaggtaattcacagtttcaatttttaaaatactatgtaaaatcaagttattctgtcttagcaattattttcttccaaatgtgttttgatactaaacaattaaatggaaaatcagctaccatataatattaaattcattaaaccaagagctacatgtacacaataattctaaagtactaacaccttctaaggtactaacaaatatcattaattaaatagaaccaaataaagtttaagaaaacatcaaaataattaaaaagcatataaagagagtacttttacaaaataaaactgatcattttagatacttaatcatatagttttaacaatctgaccctgggctaaacactacaaggaaaattaataattttggtttattaaatgttcaatattctataaaatattcagaattaaaattaaatgatctactcagattttaaaaccaaaaatactggtttccaaaaaacagacagttaacttccatctcactgtgtcaatagtagcttttcatatcagggaaaaaataaatcactccaacaaaaccagcaatgagctcatcaaattcaaatgcagttttccatttatgtattttttatattaaagcaataaacatggttcatttatcttcccttggttgccacgtttttctgtgctgttgctatgaacttcagccattagctgtgctccaaggtaaactacatgaaccatcaacaaaagtgacaccccatctatggagttcatattttctctagattatctatgctagttgacaagctggtaatgaaaaaaatcacactaagcaaatggttcctctaataacaataaattttctataaaattatgaagggtacaaaacgtttccttgcatctattttgtcatgaattctaattaacattgcaaaaacctgagagtgctgggtcatcacaagaagtgcatcaaggtttgattgataatatggtataagttggccaatgctgccaagattttcttcccttaaattaatggccatccaaccttccctaatcatacagcccaaatgatattccccttcttatttcaattttcttgaggcatggaaaatgggaaagatcagtcatttatcttctaatagctggataatagatctatcacaataaaacatctgtacaaactcaggggtgtgttttttgcacataacggtggggcttttatcaacattaaatcaataacttaaaatttgtgtcttatccctacggtttagctatacactaccaatctattcattaaacataattttatagcaaaaatcaaaaagaggaaattttatgtcatcaaaaatatatacataaatcagtttttcagcaggcactgacctaatttgttttcctaagaaactctgttttctatcagaaagttcgatgttatcaaaaagatttatttaggattaacttgaaaggaaaaggaaataaataccactctgcttctaaagtgttctaaagaaaagaatgtcaacaaatatggattgctacattttaaagaaaaacaagagaaacttattaattttaaaaataaattcatacgtgaacattagaaaaggcttgtagtaaagtaggaaagtgtttaggacatgttgagaaggtagatgaaaatggtataaaatttaagaataaacaataaaaattcatataaagaaaaatggtaacagttgattggagatgacagaatatagattagatgcccccttttaagttcactgactacagttgtaaggtttctgtaatatcttttacctaaataacactaaaatgttctatttttaggaaaaaactattcatatgacacatactggtctttagtaaaagagaaaagccattctattatattttaatatatttataattccacctttccttaaaatgagaattatggaactaattttctttgagatctcaattgaaagaaaatatcctctagcctaaaagaagcaacagatggtatgcctcaaaatcaacagaggttaaatgaagaaagtttaatagatcaacatctttcaaatgtatatgtatcagcagcaacaccaatgtcatcatcgtaataatgatcccaaaaaactgctgctggcaacaaataaattccttttcaaaatgtggaaataaattagacctggtacatttaactgggagattttttaaatgaaagtgatttttgatcctctattgattttaaatgccaatgctgacattaaaaatttggtggtggggggcaggggagaaatgtacctgtcttccttcaatgaagaattacatgtgaccaaaaaaaggtaataattaagatatgatccacaaatatctgtgtagaatatttttaacctttctacaatggattataatcacacaaaagaaaaaattaccagaaaacattcacaaaatacagccaatttaaatactgggtagagaagttgatgatgcctaagtaagtctgaatctcccaacccaaatccaaaaaaaaaaacaacaagggaccaaaacccatgctttaagcctaacttcaaaacagagaatctctaaacctcaaattatatataagtagaaatataaaccctaaattccagataactattttcatgcttgtatcacaaaacttcacaaagacctccaacagtatagaaaaaaaactgcctggaacaaagcaagcagaagttaatggcaggcctaaaagtaaacgaaaatcaacaacagaaagagaaagaacaccctaagtgtgaaaatactggaaaagattcttggtagatcagagcagcctataagggaaagacttgaaagagaggatgattcaatgaggtagtgtagaaagggaaagtttcacggagaaaattagcttaaaaaaaaaaaaaagtaaggggagagcagtcctttggaaactgtgaaataacagaaaaaaagaaataagaggggctgggtgcagtggctcacgcctgtaatcccaatactttgcaagaccaaagcgagatcacttgagcccaggagttcatgaccagcctgggcaacacagtgggaccccatctttacaaaaaattttttttaattagctgggcatggtggtgcatgtctatagtcccatttactcaggaggctgggacaggaggattgcttgtgctggggaggtcgaggctgcagtgagccatgatcacaccactgcactccagccctgggtgacagagtaagacccttcttttttaggcagaaaagaaaagaagagagaaaaatttaggctgctacaaaacatatctcgaaatagtttggggacatatactggtcctatgcatgcacgccctcccaccaaaaggccatctactaagaaaacatactttgtaattctaacagagagggtactcttgtactaggaatcttgcaagctacctcaaaatcaaatcaccaatcctgtccaaagaaataagaagatgcaagtaatctgtaagtactaaaaacagaaaatgaaaatcaaaacaattcaactggcaaaaattaccgacaaagaaatataaatgatgaagcaaaaggaaacaacacgacacttcaaaatgaattaaataccctcaagagaagcatttgaagataggaaatataaatataaattataaattttttaaagttataaattaacaaaagaaatcaggattgattgacaacaggaaagaaatcaagagagcaaaaataatcagatgtgaagactaaattgcaaggtgcccttcgaataaaattactgaatgaaaattttaaaaggggtattaaagaaaggtagaaaaagaaccaaaagaataaaaatgagataaagaaagaagaggtttagagacacaatgattggaatgtaaaacaggcaaagaagatccaatgtgcataaaataggaatccctgaaaaagaaaaaaaataacagaattaatatttaaaattataatcttaaaaaaaaacactttgccagagataataaaaattctgaatctacattttgaaaggactcactgagtaccaaggcaaaacaattgacccatatcaagtaatcctgaagtaccttgcaaaagtactatatttcaaagataaaatcttcagggccagcatctttcttaatgcaaacacaatgtaagcatttcctttagactgaaacaaggcaagaatgcccaccatctccactactattgaacacaactgtagtgatggcactaaacaatataattaggcaagagaaattagagttctaggaactgaaaaagaggaagtaaaacatctctatttgcagatatgattcattctctaaaaaaaaaaagagagagagatttaggctgcttgcttctgcctcagagttggtgctgtcatggccagtcagtctcaggggatccagtagctgctgcaggttgctgaaaagggtgtctgagacctgcagtgaaagaaccggagggagaagcaggccaaagcagcagttcaaggtgaaattgaacaatattgcctgcagagggagaaagagttcaaggccaaggaggctgctgccctgcgatcccaaggcagctgcagcattaaagtagaggagacccaggagaagagaaccatctggaagcagtttaggcagaagaggggtgaagtcttggcctttttctgcaatatctggtagtccattcctgctagtggttagaacaatgaacactagtataattgtttgggccagttttagttacttaatcaaagaggacagaattcaagaacttgttacatgttactacttggtgtactgataatcatttaaaagtaaagactctttgtcatgcaaaaaaaaacccaaggaggatgaatgagaaaattaactcaaacaatagaagaattcagtaaaaaagcagaatataaaatttatcactcaaaaaaaatcaatagctttcttacataccaacacaacgagttcaaagatataaatagttgaagcaattttgatttaccatacattaaaaaaaagattaaagacaaaaacaactctaaactaatatttaactctaattaaatatttaactctaattattaggccccatgctactgtataccccacagaggtacagtgctagcaattctgaagcaatagtttctctgcattctgagactcagcaaaaatgtaaacagattgtggaaataggagccctgtttcttgtttttttgtttgtttgtttgtttctttttttttttttgtagagacaaggtttcaccatgttgcccaggatggtctcgaactcctggactcaagcaatccatccaccttggcctcccaaagtgctaggattacaggcatgaacaatggtgcgtggccagagccacatttcttaatgttgaataggcagtttcaaatataaaaaggaaggaggctggaaggaactctgtgctataccaccagaattacaggtgtcagtaaaaactttgttttttactatagacagaaaaagaaatatgtattcttaattaaaaaaaataaacatatagtatataacactttaggaaaaatgagtgcctcacaaagggtaggccaccaaagcccccaaagaatctacctatgaacactgagcatgaaaccactgcaggggggtgagggagacattaaaaacgatactacacacttaattactatcaccaagaatgtaacaaattaattcaacagtcattcaacaaatattaaatacctgtgatgaacaagtattcaatattttttactttctggtgtattttggaaacagacattccaattttacacagatattgtatctttacatctttttgagtacttatttcttatttggaatttttaatcacatcccatgtggtgttaggcactgtgctgagggttttatatacaatagttctttctctcgacacaaacagcaaatttataaattagatattataaaccctacaaatctggagcctaaaactcataaagaattggtacatatactatgtggcagacgctcagacattaagccagttctatctgattcaaacgctattgtttttacctatgatatgctgtatcctgtctgggaagacatgcacatattatacagagagagttcattcccaggccatccaaagaatttctcttagtctataatgtagcagaaatgatggtaaaactcattaaaatgacagatctgcttcttgtagatcttactactctccatggtacttagccaatctcttgcacttataatagaaaagcactaagtatttttttaaattattaaaatcaagttaaccataatattaataatattgacttcatatctggcagatagcatgcctgtcatacagaagacaaaaaggaatcaaatttcttttctctatcttcatttataatcaatctatatttagttacctcctacgttataccaactatgcatagaagaaatgcaataatgatttctggtacactacagactaacagaaatttactaaatggtctaggaatgaaactacaagtataatctccatgtataagacaatattttcaaaaatatatagtaaaaaaaccatgaaaagaattaaaatgttcactagaacatattcacttaatctaagaaaaagcaataaaggagaaataaggaacaaaaaaggcatgaaacatataaaagcaagtaaaatgacagcttaaaatccaactatattaataacaacaataagtgtgaatggattaaacattccaattaaaggcacacattggcaaactggataaaaagacaagagccaactatatgctgtctatggagacatacaatagatgcaaaaatataaacaggctgaaagtaaaaggatggaaaaagatatataatggaaacagcaaccataaaaaagctagaatagtagtatttataacaggcaaaacagacattaaaacaaaaaaatgttactagagataaagaggaacattttacaatgacaaaaggaagattaaaaaaattataaacatacatgcaccaaacatccaatctcctaaatagatgaagcaaacactaacagaattaaagagacttcaataccctgttttcaataatgaatagaacaagtaggcataagatcagcaaagtagaagatttgaacaacactaaaaaacagatatctatagaacactccactcaacaacagcagaatacacattctaatcaaatgtttattgaacattatccaggatagatcaaatgctaagccataaaccaatagttacagctacacagggctactgcctactgtattagatagctgccatgcatagatagtacatactccctgatgatagcatcctaagatgagctggaatccttttcctcagtagttttgagaaatataaagtgggtacaaaagccccatctaagatactagtacactagtaactcacatcccccataggtcacctctattccttgatcttaccatgttaaccacttagccacaggttaaagatttttttctcaacttgccttttttcagattctgatgaagaaacacataacgatctaaaactccaaatgcagtctttctcattacatgaaaatttttgttctttaaaaatagtcctgtgtgccattaatatttataccattttgaaatcaataaatacaactatataaaatatataatggtaaatgatactatgtaaataaagtacatttttatgtcaaagacgtaaaaagacattacttactgtgcttttatctttcagaagtttttcaattacttcaattaacatttccttctgctctggatcaaggctaaaaaatacaaaaataacatattaatttttccctttaattctagctttacatgatgctcaccaattcaaggatgttgagaaatttttaaagagggaaaggagagcaagaattataagttagaaataaagaaaaacaaataaaatgggatggtttttctcatgaatgtgtcctcatctttccctctaatattgttcatattaactaaaccagatatcaatggtttagttaagatagtactgaaagaacaagttcacttctaaaagagttggaaaacttcaagaaagcgactgtaagtagataaaccacaaactcttttcaactgggaggaaaaaaataactagatagcagtcattattttactatgcatacatacttcccaaaaacaaatatggagaatttccaaataagaattttatatcatactagttcactgatagagacatgcattataaaatctgccaactaaaactaggaaaaataagaggtagtaataagcttaaaacatttgagatagaatactaacagactataagctcaaggcaaggagaggcaagcattgaggctggaatatactggtgcccaatgatagaaggacttttaagccgttagagtgagcatggatcttatcccataagtttctaaggagaaaaggtgagtgagaagcatgataaaaccttgtctggcagttaacataggaatatgaggtttcactttctacaaacatacacatttattactaaacattataattatctggacaaactttttaattctttcaaatttcagcttaagtcttccttctcaaagcagtatttcactaccaatcccatctcattacatctttactttccggtaacaaaatatgatcatctctggtccctgtcctatcaaagacattgctagtgtacctttgtatatacatatatatcaagtgctaatatcttattcattatagattgcctttaattatttggtatgtctttgatcttcttcctcaaatacatgatatgctattcataattaagtgccacatcctctactgttttcatacatctaaatacacatagcacaatactgtgaatacaacaccagaaacagaagagagtctcaaaaagcttgaggaataaatgatagctgaaaataataccaaattgttgtagacaattctatttggacagtaaattttccacagagatcagggcattgtataatattgcataacatttctaaaatatcacacagatatggtatagcacactatatttcaaatcactacactttttaaaattacttaataaaatagctctggaaaagaattagacaacgaagggagcagcaggaacaaagatggaagaaaggaaaacacatataagtgagttgagaggatcagacacttaagattctaccctaaacaggaaaaaaaaatctcaattttctaataatacaagcatatgtgtacatgagatagactatataaatgagaattcaaattctgattattcttaagttataaaatctataaattatcacaggctctaacagcctcacaaataaaaacctgcatagggtctctatagccaaaacgaaattaaagatgtgtaaggaacatttgcagcagggggaaataccatcatacagtcactggatttacttagtgtaagagcagcctacctaaaagagcgaataaaacaagcctctgtggtctataacattccatgtaacatcagagatctttggtatattgttaacaatgcacctacctgtataatttttgtattgcatgggctgcattcttcctaacatatggtgataagtcagcagaagcttccttaatagcaagcatcatgataggtacaataattggcactctaatacttgacagaactctcaaagcgcttgcacgaattagttggtttgggtcctaaaaatagtgcaaaaatattcaccaaaatttcaactttacaatattttaaacatatctttcagacacagttaataggtgcttaaagggtgtaatatgacaatagcaaaagaaagctacttaatttaaaatgaacaattagtatataggaatgggaaaaaaagacagacataaatgtttacttctttaataatgttttaaagaaaagtaatagttataattctagttggtcatttattactaaatatgctgggtttttatactttcataataataaaatgctgcaggtcatcaatttcatgtttaaaaatgtcttataaccccttttgcgtactttcaacaactagtataatgataaacagctctttgaagcatgaaaataattatattgaatataaacaaacatacagaagctgtaacatatacagcaaggtttcagttggttgtataaattattttctaagtgtactgagtaggcactataggaggcttttaactctttcaagacactactgtgctatttagtggattatcgctccacttctttaactgacacactttcaactctgcagaaaccttgtagctatttgcctactcactccattatttaccttcagagctcgctgaaaagtgcttatggacaggagtgcaagatcctgctgttcttcagcatatcgaaccaggtaaacatataccaacttcttgatctgttaaaaaaaaatcatttattcataaccagagtgaaaatttaaaactcagtatttgctataccaaaatccatgctcaattcttctcaagtaaataactgaatctggtcacatgttagattgtaaaataaaaataatattttgtgggataataagtacaacaggaaaagcttttaaagtaagcattttaatagtccagttcacaatagcaatagcctatcaaagtgtcccttcctcttgaagggaataaaaaatccctgagcagatctcatataagaatattaactaaattgtaaaaatattttcaaaatgagggataaaaataaaagaaagaagccaggcatggcgtacatgcttgtagtcccagctacacaggaggctgaggcaggaggatcacttgagcccaggagttagaggctatcctgggcaacacagagagaccctacctctttaaaaaataataagagaaagaatttgggcccaggccactaactatatgttatgggaacttgtttcctcatctgttaaaagagtccagagccctaactctgatttttatggtaatactcacatttcaacacgcattacatgatattttcagtccagtaagaataatgtgtgactatgaataccaatttaacgtaataaaaattcaagaagattggatgtgtgttctggaaacagttttttttggttttcgattttttttctgagacacagtcttgctttgtcgcacagggtgcagtgcaatagcacaatcacggctcactgcagcctcaacctcctggcctcatgccatcctcccacctcagcctctccagtggctggaactacaggtatgcaccaccacacccggcttttttttaggattttatagagacggggtcttcctatgttgcctacccaggctggtctcaaactcctgggcttaactggtcctcccacctcagcctcccaaagcacaggggttacaggcatgagccattatgcccagccttgaaaacaagttttaaaggtaatttaatcactaagtttacaacaaaattatgaacagaaaaagaaataaacaaaaactagaatttgagttgaaatttatccattgcttccttctagcactatttatagcctgtatctaccttctcaaatatcttcacattcctgattacccttctaagataccaacacagtatatacctaaaagttatgtactcagccaggcacagtggctcacgcctgtaatcccagcactttgggaggctgaggcaggcagattgcctgagttcaggagttcaggaccagcctgggcaacatggtgaaatcccatttctagtaaaacaaaaaaaaaaaaaattagccaggcacagtggcatgcacctgtagtcccagctacctgggaggctgagatgggagagtcacctgagcctgggaggtcgaagctgcagtgaggcaggattgtgccactgcactccagcctgggcaactggaaagagactctgtctcaaaaatttaaaaaatttaaaattaaaaaaaaagttatatactcaaagaacacaagaaatgaggggaaaaagttggagatagctggaattggtgctggaaatataaaaacagtactatactggatcatatttccagtcatactaaccaatctggactactttagagacaactgtcatgaccttccttccttgtaccctaatttctcgtgaaacataacagctttagttcctctaccatcctgtttgctccttcctaaactcactccaatttttttcagcgtgacactacaaactacaaataaagtctaaacagaacaaactagataagaacttgctccagatgaggtacttccacagatatgactaattcttgattaaaaccatacaccttttccaaatgtactgctgaccaaatcaaaatccaactgtcctcacggaatttttttaaaattattttaaatgaaaggcaaaatcttccatttatctacagaaattgtcaacaatttagattcaacacatcttggcaccctgttaagataatttgagatgataattttataatccaaactatttctcaattcataagtacaaatgaaaacttaatgagcaaacaaactttgtacatcttcatcattgataaatatgttaaacacaaccattttaagttgatatcaatccatctatactatacgggtagagttataaatgaaatgaaaaaacctttttccaattactcttcaatgttgaatggctccacaaaaccttaaaaacaaaatctaaagctcttaacctagtactcaatacagtttataatctgttcgaaacctcctttcctagtcaaacagaaatagtccccaaatataacttgcactctttatctcaatctccactcaggttatcccaagttatcccgcttcaccaagttccacttccccaagttccacttattaaaatcttccacaagagcaaaaattaaacaataaagagtcctagtagataaacagtaaacaaatgacagttcctccatataacactatactattcagccactatacaaaattaaataaatctgtatgacattgaaaatatatccttgtggccaggcacggtggctcacacctgtaatcccagcactttgggaggctgagacgagcggatcacctgaggtccggagttggagaccagtatggccaacatggtgaaactccatctctactaaaaatacaaaaaaattagccaggtgtattggcccatgcctgtaatcccagctactgggaaggctgaggcaagagaattgctggaacccgggaggcagaggttgcagcaagccaagatcgcaccactgcaccccagcctgggtgacaaagcaagacaccatctgaaaaaaagaaaagaaagaaaagaaaatatgtccttgaaaaaggttttttgtttgtttgttttttgtttttaagacaaagtctcactctgtcaccaaggctggagtgcagtggggcgatctcgcgacttactgcaacctccgccacccaggttcaagcgattctcctgcctcagcttcccaagtagctgggattacaggcacgcaccaccacgcccagctaacttttgtattcttagtagagatggggtttcaccaagttggccaggctggtcttgaacacctgacctcaggtgatctgcccgcctcggcctcccaaagtgctgggattataggtgtgagccaccatacctggcctaaaattttttaaaggtgtaaaagagtatgcattgtatgatctcacttctgtataaaaaaaaaatagatgcccacatactgtattttatgcaatctaaatagaccaccaattgtaaaacataccattatattatggaccacaaaggaaagaacaacaacaaacaaacagaaaacactacccatcgtaatcaccaccagttgttaagttaaatcccaactgcagaaactttaaaatagcaaacatatgtcttagaatggacataatatggtaataatagcaaatccttataggtagcattaactacatgtcagacactgttctaaatgtcttacataaattaactcattttatcctcacaactcaataaacaagtatttattcttactttacagataagaaaatgaaacacagacagggtaagtaacttgactaaagtaccgtatctattaaatagaagaactaagattcaagtcaagtaagcacaaaattgagaaatctatacaataaaatgttaatagtaactatctctgtgtgatggtattaaccagtgactttcactctttacatccttctatattatctttaaaggaatattaattactttggggtcagataaaacaataaagatatttcacgataggggtgaatctcatctttccagatggccctcaaaacaaaataatagtgctgtgattcttctaatactttaaattctttaattataaaaagatttcaaattggtaatgtttttaagttcccacattcctcggagagacaggtttttctaaagccttggcaacatgtagccaccagaactgttttaaacctgttctacagaacaataaaaaggcacctgaatgaacaagttttcttgctcagcctcttgcttgtgaaagttagccagtcaggaacaactgcactcccatacacccacctctgagtgccaatcaatcaagagcagtctcacccacatgaccatgcatctacagatgatatcaacccacttaggaccctgaaagtccatcaatccctgaagactgcccttcccaataatccacaataatatcagcaatctctatgcccagagaagctgtgcctaaaaagcacagttgtcccttgctatagtaagcaataaattgtcttatttcagatatcatccttcaatacaacctactgaaaagttccaagactagttcactgaagcctcatataggcttcatttatgttttattctttctttcttttttttttagacagagtcttgttctgtctcccaggctggagtgcagtggcacaatctcggctcactgcagcctctgcctcctgggttcaaatgattttcctgcctcagcctcccgaaaagttgggaccacaggtgcacaccaccacgcccagctaatttttgtatttttagtagagacagggttttgccatgctggccagactagtcatgaactcctgacgtcaagtgatccacccacctcggcctcccaaagtgctaggattactggcgtgagccaccacacccggccgccttcatctatgtttttcaattgctaacactacaattataaaattcaggaaacataacatcagtgcattatttattatctaataaataatccatatttagaaattctcaataacatcctatatttatagtattttttctgatctgggatcatgcatcatatttaagttttcatgtctccttggtcttctttcatctggagaagttcctcagcctttgtttttcttttttctttttttttttttgagacggcgttttgctcttgttgcccaggctggagtgcaatggcatgatctcagctcaccgcaacctccgcctcctgggttcaagcgattgtcctgtctcaacctccagagtagctgggattacaggcgcatgccaccacgcccagctaatttttctatttttagtagagaacggggtttcatcatattgttcaggctggtcttgaactcctgacctcaggtgatccgcccaccccggcctcccaaagtgctgggattacaggcgtgagccaccacgcccagcccagcctttcttttctaaaagtacccttgtcattctggctagtattaaaattaattaggaaatacagaatatgaaaggaaaactgcctgcgacagcttttgttcttcacctcaatctgctataactttccagctagaatttaaatgtgtaaggccctacatctacattatattactcgtttaattctcatatctatcctaggtacaattatctccctctcaaagataaggaaagtaaggctcagaggtttatataacttgcccaaagtcacagagctagcaagtgcagaatcaggatgcaaacaggggcatgttcctaactactacatgttgtggcctatgatggcagtccgcagatatttctattaaggtacccctaacaaaagaggagacaactcttcccctaagagcatctgaaaacctaggaaaaaaattatattttatttataatatatacatttataaaagaagaatgctttaaatcactgttttttaaccccaattgcacatcttctcatttgaaaatgacatcattgcagtattattattaaaaatccaacaagaaatttacaactgtagtaaaaggtagtaatgacttcattccatagaaccccatctctattatcaatgtactttccatctatattcacgattagactctttacactttcttggtttaaattagtgcttctcaaccttcagaatttttcaaacccaaaatacacatatttgtgaaacactgttcctttaaatgatcacttggaaccaagtgatgttacacaagaatacaaatataggtataagatggaaaccaaatgattcaaactatacttaatgtttcagattatatttaagtgtaaatataagtttttcaaattcttagatcagttttagaagcgcttctctaactatttgaggatagatgactttttcctcaactagatttaaagttcctaagaatacagcaatggtagaaagcaattaacacgtggttgactgattaacagcagtcaatatatcaaatatatatcaatatatcagcagttgattaacaacagtttcaatatatcaaatcaacacataatatgtatttaactaagtaatttatcccatctgcctggaagtgaacttgaggctatttagtacaacaaccatttcttattcatctgtatattgcaaggacttattacattgcttggcatatagtaaaagctcaatatttatcagctggatcacattccagaccaactgtagactgaaaaaaattaagacatttcccattagagtgctacatctaggatctaacttctcacaccagtgggtataattcattgaacagcaaagtctagaaagacaccaacatactatgaagaaaacaacaggttttggaaagactgcctccaaagtctttaacttgttagtctggttgtttttttggtgtatgtgggtgtgtggggaggggtgtgtgtgtgtcagtgagtgggggtggaggtgtgggtgtatgtttaaagagagatagggtctcgctctgttgcccaggctggcctcaaactcctgggctcaagagagactcctgcctcagcctccctggtaattaggactctaggtgcacaccaacacagctggtttggttttttaaaatattcttttaaaatattctttctctttactaattatattcagatctcactctacagttctctggaaagttttgagaaagaatgggtccagttctcccttatccccttacaatttatttctcagcaatacctttattcaccaagtacagccagcttttaaaactggattatgaactctagaatatatcacagagtttatattggcaacactgaaacattcagaaccacagctgagctagcaggcattgcaataattactcactattggagaaggatttctgtgactgttatggcaaaaagcataacaatattaaatcacagaaggttgcgaaacactaaatttgttctacttctgttataagaatcaatcaatattgaccacaagaggcctatgcactgacaggctgcaggtgtgcaaagaaagcctaccttccctgaaaccattctgtgaccagaaatgggagtagttaaagctccgtgactacatcattctctgatcggttactttcattcaatgttataacactccttgctgtaaagctaatcatagcagagccccagtaggctggaagaacacagacagatctgtttaattagcttatcaatactagtacatcaaacttcatgagttattgactaaacctttgattatttttgtactataaccactgattgcttactaggtcacttttggtatcatttgacatttaatggtagatgacgtacagctcacctgtgtgtctaaagcagcatgtacttgtaaaaatgaaattttgcacttgagaggagtgaaacattcaatttctgaacataagttttaagaaacttatgtcagttttcccaaaacattaaaggcttaaccatgtttcaaaaaaataaaataaacaaggtatttaaagaacgaaagaaatccaaaacaaatagaccaataattatgtttatattgacatttttgtaacagaacattaggcagctaccagaatctaattgtaaagggaaaatatgagcaaatggaaaagttctcctactgataactatttgaatagtaaaacagttctgaaggaacaataattggtatggaattttctgtttacaacaagaactagaagtcctcagggaactagctactttaccaccaatttctaaggacttcgtcatttctacccataactaaaacataaaagaaaaaaaatatgccaatactaggtacctcccaaaggatggctaatgccagatgttgataaggagtcaaaaatattaagagacaaaacagagggaggaatcatcaaacaggaaagatggcgctgaatgggctaagatgggttctgaagtcaagcaacctagctttggattctgactgctacacactggctgtgtgaccttgatcagctaatttaacctttctgccatcttgtcctcatatataaaatacaagtaatgacagaaacagccccacagggttatttgtgaggataaaacggagtagatctatgcaaggcactaataaccttggtcagacaggtttttttaatgttagcaattattcctattgctactaagagactctattcctgataatactaagacaagcttcacctatgcctcataatttttctaagttaaatgtttattttttccagatatttggactttcttataccacaggccataaaactaataaacatatcaaattagaagctcagatatcatggccataaggtgtcaaagggagagtagttgaaaattatcaattcagaattatatataacaagcacatagtgtttaataaatatctactaaattaatcataagtaaaattgattttactcaagaaatctacaaagaaagtatggtttatcaagtcatttaaatccagtactaatttaatctaattcataaactggccacaagaatacaactgttttgattttggcttatccaacttagtctaattgagtttataagaactatttcattttgatagaaaaattcatctatctgaaatacagaatgcacttcctatctaatgaaaaaaattaagagctgggcacagtggctcacatctataatcccagcactttgggaggccaaggcaggaggatcacctgagcccaagagttcaacaccagcctgggcaacatggagacctcgtctctacaaaatattttttaaatagccaggagtagtggcacgcacctgtggtcccagctactcagaaggctgagtcaggaggatcacttgagcccaggaagtgaaggctacagtgtgttgtgttcatgccactacagttcccccccaaaaaaagcaagaagcatactttaaaatattaaatctttttttaaaagtaggtttaggctgaacatggtggctcacacccataatcccagcactttgggaggccaaggtgggcagattacttgagctcaggagttccacaccagcctgggcaacatgacaaaaccccggctctactaaaaatacgaaaaataaattagatgggcatggtgacacaagcctgtaatcccagctgctcgggaggctgaggcaggagaatcacctgaacccggcaggcagaggttgtagtgagccaagatcgtgccactgcactccaacctgggcaacacagcgagaccctgtctccaaaaaaaaagtaggtttaaagtacctatccttaaaatgctataatccagtgatgcattgcttaacaatgttctgagaaatgcgtcgttggacaatttcattgttgtgcaaacaccacagagtgcaacttacacaaacctacatggtatagactactacacacctaggatatatgatacagaccaggggtctacacacctaggatatatgacatagcccaggggttggaaccaggccacacagcaggcagtgagcagtgggcaagcaagtgaagcttcatctgtatttacagctgctcttcattgctcgcattacctcctgagctctgcctactgtaagatcaacagcagcattagattctcataggagcacaaaccctattgtaaactgcacacaagagggatctaggctgcgtgctccttatgagaatctaacgcctgatgatctgtcactgtctcccatcacaccccagatgggaccatctagttgtaagaaaacaagctcagggctcccactgattctacattatggtgagttatataattatttcatcatatattacaatgtaataataatagaaataaagtgcaccataaatgtaatgcttttgaatcatcctgaagccatcctacccaccctgggtccagagaaaaattgtcttccacagtactggtccctggtgccaaaaacgttggggactactgatatagcctattgctcctaggctacaaatctgtacagcatgttactgtactcaatactgtagataactatcacacaatggtaagtatttgtgtatctaaacatagaaaaagtacagtaaaaatacagtattataatcatatgggaccactgtcatatatgccaagaaatgcaagttggaaaaaaactaaaatgaaattttaaaatgtttctagttaacccaaaaaaggaataggaagaatagaagacaaaaataaaagagacaaagagaaaagaaaaagaataatagtagactcaaatctaagcagatcaataattatattaagtgttagcaaaatagacactccaattaaaaggcagagattgacacacgggatgtagggaaggctgcaactatacgctgtcaacaacaggtgcacactagatataaacagacaagctgaaagcaaatgaataaaaatgataataaaaagaaatgagaaggttggagtggcaatactaataacaaatcaaatatgctttaagacaaaacatattaacaaaaataaaggatttttttataataaaaaggtcaattcatcaggaaaacccaaagagttatgcctaataggagtacttttaaaaataagcaaaaaatactaaattaaggggaaaaataaaacattccagaatcagcccaggcacgatggctcatgcctataatcccagcactttgggaggccaaggttggcagattgcttgagcctgggagttcgaaaccagcctgggcaacatggtgaagccctgtctctgttcaaaatatgaaaattagctggacatggtggcatgcacctgtagtcccagccactcaggaggctgaggaaggaggatcacctaaacccaagaggtcaaggctacagtaagccacgatcatgccactgcactccagcctgggagatagagaggaaccctgtctcagaaaaaaaaaaaaaaaaaaaagccaggcacggttggtcacgcctgtaatcctagcactttgggaggctgaggcaggtagattgcttgagctcaggagttcaagaccagcctgggccacatggcgaaaccctgtctctacaaaaaaaaaatataaaaaactagccaagcatggttgtaagcgcctgtagtcccagctacttgtggggctgaggcgggaggatcgcttgagcccaggaggtcgaggctgtagtgagccaagatcacaccactgcactccagcctgagtgacgaagtgagactctgtctcaaaaaaaaaaaaaaaaaaaaatcaaaatcatgattgggagattaaaaattcctctctcaccaacactatcaatcacatttagttaagtaatatttaaagaacattagctcaaaaatgttttctttttctctggttggttttgctggcaagaatactttgaacatttaaaatcatcacgcaaaatagaaaaaacttcactaccaaaaaatgaccatactatgcatggaaaataaaatcataactacaaaattagcgaaccctctgaaatcacacacccatcctccttacgctctcacacttgcccgtgcaagaatgcttgtgcactttctctgtcaccataaccatgttccctggattagaatgtttctgttatttgttaatgagcttcatcatctgccaataaaatggcaaacaaatagtagcagtaacacatctttaattttatggtgagggaaaggctttaaagctttaaactgagaaaaatttatcaattaaccaggctttttcaattaatttatcaattaaccagggtggagaggagaatgtaaccttaatactagactatattagtgtagcttacagaaaacagtattttactgggacgtgttcattcaataaatccacatatatgtactgagtgcttagtacatgtcatgagtagtctgagaaacttgggaaatattcttgggctcagtcctagaaatcccaaaaagccccaaatcatcaaggtctggatatacccaaataggtctttttcactggacatatgctatcttaaaattaagtccctggaacaaaatttaaactaaacgggcctctaggaacaggtgaaaactcgacaacttaccatcattcactcaggggaatcaatctgttttgcttttcatattttctaccaaaaatccaaagctaggattgtgcctactttttatttgatcttacctacatttaaaattaaggacattttaatcataacaaaaatctagtgatacttaagtatcttatgttgcattatactacataaaaagtgtacggtcccatgaaaacaaaaggaatcataaaaattatagatcaaaacagtacctcaatatttttactggccacattcttcacaacagcaggaaacagttcagatgcatttttcccttttgcaatcatctgaagaataaacaaaacagacaatatgggaaattctatatatattaaatatttagaagattaggtcaacaaataagctacgtaattaaccgctgaactctttttgaatcatcttacctcaactatttacagcaaataataaacactatcttgtacagcaatataaatacacaaatacatagacacaataaacaagaaatatttagtaacttaagatatatatttaaatattttactagttttctctggctaactgggttataagtaattttttttttttttagacagatcctactctgtctcccaggctagagtccagtggctcaatcatagctcacggcagcttcgacctcccaggtttaagtgatcccccacctcagcttcagctgaggctacaggcgtatgtcatcatgcctggctaattttcgaatttttttgtagagacagggtaccactatgttgcccaggctgggtaaaaactttttaaaaatatttaaaaatatttttgctattttctattttccaggatctgacattaaagatgtactgcatttgcaatgggggaattgagagagggatgaatgttactttgaaccaactaattatgtgaacctttgctttcttttcataggttaccctacttctgcaaccattgcttttcaaagttgccttcactaaacattcttcctctgcccactaaagttctgcgcaccaccatcttttcagcctacactgttctacaatctctgaaactcctaagatttcattcaccgttaggactaactgtagcccaaatccagcctgagttccacatctctaactagacatcattagattgctctcatcccaaacttgctatgtctaaagccaaactcatctttcatgacaaaatggcattcatgataaaatgacattcatgatagaatttcctatttccacagttctcctagataccaaaaaccacaaaattaccctggtctcttctcacagaagagtaactaagtcctgctaatacttctcagaacacatgttaatcccttccactgctattatcctagcatgggtcagtatcacctcacagagaacttttcagtctcctcttcctatccataatgtatatcactgacagtttaatatgcttaaaacactactttgcacatgtcagcccccgtaaaagatttcaaaagcttctgactgtctggagtccaaatgattttatgtaacattcaaatattctcacaatgtgcactaacatctgttcttaaactctctgacctaaggttctattaaaatgaccttactcactactagaatattctctggctgccccactatgcctctgctcagatcatggccccagctttctaagttctccccttctatctaaagcatcatcaaattttactccttctcccttgctacagccatctcctaacacctgggccactgtgtcacccaatcctaatttctttcagaatttttttttttaagacagtatctcactctgtcgcccagcctggaacgcagtggcacaatcttggctcactgcaacctccgcctcccgggttcgagcgattctcctgcttcagtctcccgagtagctgggattacaggcacctgatgccaccactggctaatttttgtatttttagtagagacgaggtttcgccatgttgaccaggctggccttgaactcctgacctcaagtgatccacccccctcggcctcccaaactgctgggattacaggcacgtgccaccatgtgcagcctcctctagaatattttaatctacacttatcatttagaatttcctgtgcactattttacatttctatttattttagttttatatctatctgtattcccattttgtctttctcattctcagattataactttatatcttttaaaagtccagactttggtaaccacaaaataaagttcaaactatagggtaatttggggaaaagggattccttatgaattacataccatatctaataaactgcctttaaaaagatattagctttattaatttacaacaaatgttatataaatatgtgatacttgaagcattagaatccccgttaccaatttcttataagaactttctatatgatagccttaaaatattcttgaatacaagctagtctttttatattctatttccttacctgtgacattcttttgagtattttgtgaaacctgctgagcactatggagggtttacaaaatactgaagctaagacatctttctatgatttgtacacctctctccattttctcatctttgaaataagaaaagagagggattaaatgttctgtaggacccctgccattcattcattcattcattcattcattcattcaatgattacctaaagtcagacatcctgtcctatggtatcctactccatgactatctaactttattccgcagaacgttattcaaatatggggaaggaaaaaaacaccacaatcaaattcactcaacaaatatttgctgagaagatactttctagcagggaccatcctaggccttagggatccaaccataaccaatacaaagtccttgcccatgtgctgcttaccttctaatggggcaagggtcaataaacaataatagtgaggtggcaatagactactgtggagaaaaataaagtagtatcgggggatgagaagtgctgaggtggaggtgggagttgctcttttagataaggtggtcagaaaaggccttccttttggcagggatgcaaaggaagagaggaagggacccatgtgactagctagggaaacaatggtttaggcatggcatgtgccaggaataggaggccaggagagccagactggagtaagtgaggggaagaatggtgagagataaggtcagaaatgtataaaccactgtaaaatgagttggcttttactatgagtgaagcaggagaccaatggagagttgtgagcagaggaaagacatcattaaatatttagcaatgactcatattttaaaaggatctttctggctgcaatgtgaaaaatagaccagaagatatgataccatggaaaacagaaggctacagcaattatgcagaggaaagatagtgagcacagtgagaatgggctagatttgggatttattctgaaaatagattatatatgatataagaaagaagggacatgaattaagaagaactactgcctgtaatcccggcactttgggaggccaaggctggcagattacttgaggccaggagtttgtgaccagcccggccaacatgctgaaaccctgtctctactaaaaacacacacatacacacacaaacacaaaattagccaggcatggtggcagatgcctgtaatcccagttacttgggaggctgaggcaggagaatcacttgaacctgggagccggggattgcagtgagccgagatcacgccactgcactccagcctgtgtgacagagtttgagactccaactcaaaagaaaaaaaaaagaagaaggactacaaatgactaactggagaaatggaattgccatttactatgatgagaaagactagggaagaagcaggtatttggggagatgagcaatccagagtttggtttcagatatgctgagaagccagctgaatatatgggaataaaggctacagaatacaggagacagcactggttagcaatatgcatttggaaagggatgagatcactacaggagggcatacagacagagaagtagactgagtgacaagacatagtacaatcctaaaagtagaaattgtggccaggtgcggtggctcacgcctgtcatcccagcactttgggaggccgaggagcgtggatcacaaggtctggagatcgagaccatcctggccaacatgctgaaatcctgtctctactaaaaatacaaaaattagctgggtgtggtggtacgtgcctgtaatcccagctactcaggaggctgaggcacgagaatcgcttgaacccaggaggcgaaggttatagtgagccaagatcgcacccctgcactccagcgtggtgacagagcaagactctgtctcaaaaaaaaaacaaagtagaaattgtggagtgttggggaccagcctcaaaaccacccatagggtacccaaagtccggtggcaacaaaggattgagaagagacaagttaagagtaaaggtggggagccagggggccagttgtacttttggaggctgcaaaaggctcagagctctggtctccacactatttattgagtacaatcacttagatctgagaagcagacgttcagggcgaaacagtgaaagggaggcaatgcgtaataggcgtaatctacagcgatagtggtttaaatgaatctcctttgtgctcaaacagcctatctttaacttatcagagagcagctagtaggagcgggcttaactaggagcctgcacgcctgttcacattccagtgtttcaaaggagtgtctttctccttgaacacagtgtttacagataagaaagcgggtctccctctgagcatgggaacatgatggcaattaggagactttcctcctcagaggcctcttgtggcttccacaacttattgtcccatatttttatggccagtttatacagacaccccacaagcccttttcccaacatgaagaaaggaagaaaccagcaaagaagctcttagactccttgaacctcagtttgaaagcgggcagtccttctcagtattcctccttatccactcaaataacatacttctcccaccctctctcccttctgctttaggtaaaaaccctgttcctggtccccttgtactcttttacccagaacaaggagcataggaattgaggggagccacatttgggccctgagggaaaagtaaggttcataggtggaaagcataggagaatatgtcctttttcattttatttggttgaagttcctgatatttgaaaaagctgcagtaccagcgattctgccctttgaaggtgactctctagataaaaggtgagaaaggaagacaagttttcaggtaaaaagtgagagtcatgtttagggagcagctgggcaaaagttgaggagataacataaggtcatttgtagctctaaactctcctaggttctaatcatgccctctgctaagctcttagatagcttctacccaaggtagagatggaattccagagtgccccaaagaacattcactggttgcaggcatctgattaaaagagtgatcatcagtttctgatacctgttctctaacttcacacatttgacttttattttttttcatccttcaacctttggtggcctcagccccaacatcaatgtttttacttacaatgggtatagcctaacagcactgtattttgggaaatttgactgatttactctccatccaatcctctatgttcatgagggagatggacataatttaattttttcataatgtctttgtctagttttcagaccaggatagcactgaactcagaaattgaattcagaggtattttctcatattctatattctggaagagcttatgtagaactgaacgttccctgtagaaatttttttaatgaaaaattcaattactttattagatataggactattcagataatctagttcttcttgagtaaacatcatagcttatctttgaaggattttgctcatttcaacaaagtagtcaaatttatggggctaatgatgcctaaaatattccctaattatcccttaaatgtcaacagggtcttgcatttctgatattgataatttgtcctgttttttcttggtcactctgtctacaggtttatcaattttatctatcttttccaaggactagtttttcatttcactgattttactctactgtttttctctactcaatttcattgatttctactctaccttattatttctttctttagttttaatttgagtttaatttgctcttctatttctgctatgttaaggtagctgctcagagcactgattggaaatacttcttttcaaacataagcttttattactataaatttccttgtaagtactgttttacctaaatcctccaaactttgatatgtggtttttcaatttcatcctaatttccttgtgacttttactttgactttgactcatggatcatgtcatcatttctaaatgtataagtttgatgtataattttcaaatattttaaaaaaattttgatctcttccaatgactgtgtttagtttaattctatatggtcagataacacacttgcataattttaattcttttaagtttgttaagattgtgttttatggcccagaatgtagtctatcttgctaatatagataataattataatatatagataatatagataataatatagataataataataaaaagaatgtatatttcgctactgttgagtagactgctctataaatgtcagttaggtcatataagttgatattattctagtcttaaatttccttattggttttctatctccctattctattgatttttaagaaaaaagcactgacgtctctataattgtgaatttgtcaatctttcctgtcagttctaacaggtttttttttttactccgtttttgaagctctgttgttagacacatgtaagattattatgtctttttgggaaaatgactcttattgttatgttctttatcctaaccatactatttgttcaaaagtttactctctctgatataaatagattcatctgaactttttttggttagtgtttgtatggtatgcatttttccttccttataacttatgtctttatattaaaagtaggtttcttacaaagagcacagttgtatcttcacattttcatccaatatgaagatctctttttattggtaatgtcagaccacttacatgtaatagaattattaacatggttagattcaggtctaccattttagtatccgtttcctgtttattccctgtattttctgttctcctacttcctcttttctcttttccttagaaaatttttagtatttcatatttttatattaactttctgcctatatctttttatataatttactggttcctcgtaaaaatgcatcataggcataatctatagcaatagcggtttaaatgaatctcctttgtgctcaaacagcatatctttaacttatcggattatcagatacataggtagataaacagacatataaatatataaatacagaaacagcaaaccttacacagtctacttacagttaacactgtaccagatcaagaaaaatgcagaaacaggcagggcacagtggctcacgcctgtaatcccagcactttgggaggctgaggcaggcagatcacaaggtcaggagttcaagaccagcctggccaatatggtgaaaccccatctctactaaaaatacaaaaattagccaggtgtggtggcgtgcacctgtagtagtcccagctactcaggaggctgaggcagaagaatcacttgaacccaggaggcagaggttgcagtgagccgagatcacaccactacactccagcctgggcaacagagcgagactctgtctcaaaaaaaaaaaaaaaaaaaaaaaagaaaagaaaaatgcagaaacattgcaaccatatagactcttttatttccacctccccactagcttttatgtttagccacccatattaaaaacctctcagatagtgggataacttaagaataaaattagtcctttatacgtatttaccattttgattggtccgcctaaatatccatctggtatcatttcccttcagcctacacaacgtctattaacatttcattaaagtaaacatgttagaaatggatactcttagtctttatttcatcttcgttcttgaaggatattttcaatggatatagagttctgggttaacagttctcttctttcagtacttgaaacatattgttccactctcttctggctgccatgatttctgatgagaaatctgcatttattcaaattattgttcccctctatgtaccattttttcccgctactttcaagactttatttttggttttcaaccatttgattactgtgtttatgcgtggttttcttttagtttatcctaactggcatttgctgagcttctttcatctataaatttgtatcttggctgggcacggtggctcatgtctgtaatcccagcactttgggaggctgaggagggcggatcacctgagatcaggagttcgagaccagcctgaccaacatggtgaaaccccatctctattaaaaatacaaaaactagctgggcatggtggggctggggagcgggggcacctgtaatcccagctactcaggagactgaagcaggagaagcttgaaccccaggggcagaggttgcagtaagccgagattgcacaatgcactccagcctgggcgacaagagtgagactccgtctcaaaaaataaaaataaaaataaaaattgtatctttcatcaaatttgggaagttttctaccattatttcttcaaatattttttcctactccaatctctttctcctctccttctgctgttctaatgatgcatacgttagacctttagaatgaaccaacaaaactccaaggctctgttcttttcaatctctattcttcagaatgatttttttctttttcttttttttttttttttttttttgagacagagtcttgctgtgtggcacaggctagacggcaatggtgccatgttggctcactgcagcctcaacctcttgggctcgagtgggctttctgcctcagccttctgtgtagctgggaccacaggcaccctccaccatacctggctgattttttggtatttctgtagagacagggtctcactttgttgcccaggctggtctcggaactccttggctcaagcaatcctcagcctcctgaagtgctgggattacaggcatgagccaccgtgtccggccacaaactgaataatttctaatgatctgtcttcaacttctggctctttcttctgttatcaccattctgctattgcatcaatccaggatattttctattttagataaagtactatccacataacagaaatttcaacaaatttctgcaggggtatggttcacataagataacattttaggaaacaagcatctaccaatctagttacaacctaagaaataagtggatgaacttactacttaatcaaaagtggacctaattttacctactacttaactatcagacaggcccttggctccaatatattggtctttctaataatcttcagggaagtaccctgaggacaacataccaaacagcagaatatatagtacctattcccaaagaatcttagtacctattcccaaagaatacttaaacccaaaaaagaaaaataaaggaaaaaacagaaaaacagtgaagaacttaatgaagacgtaccaattaaagacagagggaagagtgctctcaggctccttaccctcagctatctgtttgtcccactctattctaaatagacatttggtcttctaatacttaatttattaatacgaatactactctcttcaacccacaatggagcctgaaattattgatcttatgaatttagagcctacaacagaaccaatttcaaacagaaattctggaaaaataaagataaataactctaatgctttctgaggatgacttaaggaggaaaaaaataacagggcatataaaaacattccacagttcaaaagaaatggacccactggagaagtatgaataaattatatggggaaaaagttggatataaaagagaaaaaccatgggaaatatatctaactcatattcttagtgagatttgaggggatgtggcatttttttaaaaaagaatgactttggaatagcaaagaaaattttcagataaagatataattaccaaattttaaaatataatgagagaagaaaggataatgtcaaaaattctaaactgacttcaatgccagctcaaaaaaaatcctaaaaatgacaggaaaggttagagaggtcaatttgacaggggagaagacagaggcaaacagaggatggatccaaaaaatataatacacacataataggaaggctaagagagaactggcagactgacagaaaagggagaaaataaatagcagacaaacattctctaagtaaaacagatttaaaattttagaatcaaagggttcattagtaacataacaaatcagtaaagaaaaaacacagaccgtatcttgaatattttctttttcctcaaaatattaaaaacatctacatatccagacagttgaaacagattctctaaaagagaaagagaaaaagcaatctcagaggcagagcaagatggtgcaatagaaagctccaccaatcgtccccccgaggacaaaaaagttaacaactatctacacagaaaaaaacaccttcataagaaccaaaaatcaggggagcactcacaggacttggtttgaacttcatatcactgaaagaagcacagaagagattaaaagtaacagtcctgaatcaccaatgccacccttttcctcagagtggtgactcctcttccagcagcagtgcatggtatggagggtatctctgggcactggggaagggagaacactgcaattgtgaggcactgaactctgtgctgtcctgttagagcagaaaggaaaaccggaccgaactcagctgatgcccacccacagggggagcatttaaaccagccctagccagaaaggaatcccagaggtccaaacttgagtccctggaaaacctcgccaccgagggctacagcactgtgtgtctccaagtaaacttgaaagacagtctaggccataagaactgcaactctttggcaagtcctacggctgaactaggcctagagacaatggagggagcacgcaacatactgagataccacctggggcagccaagggagtgctgacattatctctcctaaccccaggttgcacagctggtggctccaaaagagacccctcccttccacttgaggagaggagagggaagagtggggaggactttgtcttgcatcttggataccagctcagccacagcaggatagggcaccggtcagagtcatgaggcccccattccaggacctaactactcccagacgacattcctagacacaccctcgtccagaagggaacttgctgccttgaaggaaaggtctgaggcttggcagcattcataatctgctaactgaagagcccttgggccctgaataaccagcagcaatatccaggtactacattgagggccttggtgaaccactgagacttgttggcttcaggtgagactcagcacattcccagctgtggtggctatggggcaaaactcctgcttgagaacagcaggggggaaagtaaaaggggctctgccttgccccctaggtaccagtacagccacagcagggtagagcaccaagtgggctcttagcgtcttcaattctaggacttggctcttggacagcatttctggacatgtcctgggccagaagggagcccactgtcctgaagggtgagtcccaggccaagcagcattcatgaaaagtactgccagagttcccccgatagcttttcatgaatgctgacttaagagaccttgggcgttaagggactatgggggtactctggcagtactctttgtggcctggggtggtggtggctacaggttgaggctcctctgccttcagaaaggggaggaagagtgggaagcattgcaccttgtggtttgagtgccagctcggctgcaatacaacagaacactaggtagacttctaaggtttctgactctagtccctgactcccagggctcctagacagaacttcttgacccatccggggcctgggggagctcgccacccttaagggaaggacacaggcctggttggctttgctacctgctgactgtagagccccagggccttgagcaaacatggcaatagccaagaagcggttacagcaggccttgtgcaagacccagtcctgtgctggcttcaggtctgacccagcacatagtaccagtggccacacgggtgcttgtgtcaccattctcagctttatctggctcaaaacagagaagagagagactctgtatgtttggaagaaagtaaggaaagagaacaagagtctctgcccggtaatccagataattctcctagatctgttctaagaccatctaggcagtacctctatgagtctgcaagaaccacagtgttactgagcttggggtgccccctaaagccaatatagcttagatcacaacacccacgttctttcaaatatctggaaagacttcccaagaaggatggccaaaaatatgccaaggcagtgaagactacaataaatacctaactcttcaatgcccagacaccaaagaacatctacttgcaccaacctctatgaggctgcaaaaaccacagcattattgggcttggggcccaagttcctatgaatactagaaagccttcccaagaaagataagcataaacaagcccaggcagtgatgactacaataaatacctaacgctccaatgcccaaaaactgatgaacatctacaaacatcaagaccatccaggaaaatacgacctcaccaatcaaactaaataaggcaccaagcaccaattctggaaaaagagaaatatgtgacctttcagatacagaattcaaaatagctgtcttgagaaaactcaaagaaattcaagatcagagaaggaattaagaattctatcagataggccaggcgcggtggctcacgcctgtaatcccagcactttgggaggctgaggtagacggatcatgaagtcaggagatcgagaccatcctagctaacacagtgaaaccccatctctactaaaaaatataaaaaattagccgggcatggtggtgggcacctgtagtcccaactacttgggagggtgaggcaggagaatggcatgaacccgggaggcggagcttgcagatcatgccactgcactccagcctgggcgacagagcaagactccacctcaaaaaaaaaaaaaaaagaattctatcagataaatttaacaaagagattgaaacagttaaaaagaatcaatcagaaattctagagttaaaaaatgcagttgatatactgaagaatgcatcagagtctcttatcagcagaattgatcaagcagaagaaagaattcatgagcttgaagacaggctctttggaaatacacggtcagaggagaccaaagaaaaaagaataaagaagaatgaagcatgcctaaaagatctagaaaacagcctcaaaagggcaaatttaagagttattgtccttaaagggaaggtagagaaatcgatggcggtagaaagtttattcaaagggataatatcagagaacttcccaaacctagagaaagatatcaacattcaagtacaagaaggttatagaacatcaagcagatttaagctaaagaagcctacctcgagacatttaataatcagactcccaaaggtcaaggatagagaaaggatcctaaaagcagcaagagaaaaagaacaaataacatacaacggagctccaatatggtggcagtagacttttcagtggaaacaggtaaggtttcctaacatatttaaaagtgctgaagaaaagtaactttcacctcagaatagtatatccagtgaaaatatccttcaaacatgaagaaataaactttcccaaacaaaagctgagggatttcatcaatgccagacctgtcctacaagaaatgctaaagggagtacttcaatcagaaagaaaatgacattaatgagcaataaataatcacctgaaggtacaaaactaactggtaatagtaagtacacagaaaaacatagaatattataaaactgtagctgtgatgtataaactattcttatcctgagtagaaaaactaaatgatgaaccaatcaaaaatggtaactacaagttttcaggacatggtacaataagatataaacagaaacaacaaaaggttaaaaagtgaggagacgaagttaaagcacggagtttttattagttttctttttgcttgtttgtttatgcaaatagtgttaaattactatcaggttaaaataatggattataagatagtatttgcaagcctcatggtaacctcaaaccaaaaacatacaagatatatagaaaaagtaaaaaacaaaaaactaaatcatattaccagagaaaatcccttcactagaagacaggaaggaaagaaagaaggaagagaaaaccataaaataactagaaaacaaataacaaaatagcaggagtaagtccttacttatcaataataacatttaacataaatggactaaactcgccaatcagaaaaacagagtggccgaatggatgaaaaaacaaaacccattgatctgttgcccacaaaaaaacacactgtacccataaaaacatatatcagctgaaaacaaaggtatggaaaatgacattccatcccaatggaaatgaaaaaagagcaggagttgctatacaataccaaacaaaataagacttcaagacaaaaactataagaagagacaaagaaggtcactatatgataaaggagtcaattcagcaagaggatataacaattttaaatatatatgtaccctacactggagcacccagatatataaagcaaatattattagagctaaagagagagacaggcccaaatgcaataacagctaggagacttcaacattccactttcagcatcagacagatcttccaacagaaaatcaagaaacaccacacttaatctgcactatagacaaaaatgaatctaatacatatttacagaaccttttatccaagagctgcaaaatatacattcttttcctcaacacataaatctttctcaaggatggaccatatgttaggtcacaaaacaagtcttaaaagcgttcaaaaaattgaaataattgcatcttctctaatcacaatagaataaaactagaaattaataacaaaaggaattttggaaactatacaaacacatggaaattaaacaatatgctcctgaatgaccagtgggtcaatgaagtaattaagaaagaaactgaaaaatctaagagggaatttcatagctataagtgtctacatcaaaaaagaagaaaaacttcaaaagcacaatctaacgatgcatcttaaggaactagaaaagcaggagtgaacaaaacacaaaattagtagaagaaaagaaataatagagaccagagaagaaataaatgaaattgaaatgaaaaaatacaaaagatcaatgaaacaaaaagctttttttgaaaagttaaacaaaattgacaaaccatcagccagactaagaaaaaaaagagaaaaatccaaataaataaaatcagaaatgaaaaagaagatattacaactgatgctacagaaattcaaaggatcattagtggctactatgagcacccatatatgccaataaattggaaaatctagaagaaatggacaaattcctagatacatacaacctatcaagattgaatcaggaagaaatccaaaacttgaacagaccccaatatcaaatcacaagatgaaagctgtaataaaaagtctcccactgaagaaaagcccaggacccgatagcttaactgctaaattctaccaaacatttaaagaagaattaatatcaatcctactcaaactgttctgaaaaacagagcagggaatacttccaaactcattctacaaggccagtattaccctgataccaaaaccagacaaagacacatcaaggaaaaagaaaatgacaccccaatatctctaatgaatattgatgcaaaaatcctcaacaaaatgctagaaagctgagttcaacaatacatcagaaagatcactcatcatgaccaagtgggatttatccctgggatgcaaggatgcttcaacatacacaaatcaatcaatgtgatacatcatgtcaacaaaatgggcaataaaaaccatatgatcatttcaattgatgctgaagaaccgtttgataaaatccaacatcctttcatgataaaaaccctcaaaaaactgggaatagaaggaacatacatcaacataataaaaactatatatgacaaacctcacagctagtatcattctgaatgggaaaaaactgaaagtctttcctataagctctggaacacgacaaggttgcccactgtcatctctgttattcaacataccactggaagtcctagctagagcaatcagacaagagaaagacataaagggtctccaactggaaaggaagaaattaaagtatccttgtttgcagatgatacaatcttatattggggaaaacctaaagactccaccacaaaactattagaactgataaacaaattaagtaaagttgcaggatacaaaatcaacataccaaaatcaggagcatttctatatgccaacagtgaacaaggtgaaaaagaaattttaaaagtaatcccatttacactagccacacacaaaattaaatacccaggaattaacttaaccaaagaagtgaactatctctatagtgaaaactataaaacactgaagaaggaaattgaaaaggacaccaaaaaatggaaaaatattctgtgttcatggcctggaaggctcaatattgttaaaatgtccctactacccaaaacaatctacagattcaatgcaatgcctatcaaaataccaaagacattcttcatagaaatagaaaaagaaatcctaaaatttatatggaaccacaaaagatccagaatagccaaagttatattaagcaaaaagaacaaaactggaggaatcacattacctgacttcaaattatactacaaagctatagtaaccaaacagcatgtactggcataaaaacagacacacagaggaatggaacagaatagagaacccagaaacaaatccacacacctacagagaactgagaaagatgcgaagagcatacactgaggaaaagacagtctctaataaatggtgctaggaaaactggatatccatatgcaggaaaacaaaattagatccctatctctcagcatatacaaatataaaatcaaaatggattaaagacttaaatctaagacctccaaccatgaaactactacaacaaaacattggggaaaatctccaggacattggtctgggcaaagatttcttgagtaataccccacaagcacaggcaaccaaagcacaaacagacaaatcggatcacatcaagttaaaaagcttctacacagcaaaggacacgatcaacaaagtgaagagacaactcatagaatgggagaaaatatttgcaaactatccatctcacaagagatttaaaaccagaatatatcaggaactcaaacaattctataggaaaaagtctaataatctaaaaatgggcaagatttgatcaaatgataaaaagggggcaaaagatttgaaaagacgttactcaaaagaagacatgcaattggcaaacaggcatattaaaagatgctgaacatcactgatcatcaaagaaatgcaaatctaaactataatgagttatcatctcaccccagttaaaatggcttatacccaaaagaaagacaggcaacaacaaatgctggtgaggatgtggagaaaagggaacccctgcacactgttggtgggaatataaattagtacaaccactatggaaaacagtttagaggttcctcaaaaagaaactagtaattgagctaccacatgacccagcaatcccactgctgggtacaacccaaaagaaagaaaatcaggagtgcaaagagacatccgcactccaatgctcgctgcagcactgttgccaaaagctaagatttggaagcaacctaagtgtccaccaacagacaaatggataaagaaaatgtggggcaaatacacaatggagtactattcagtcataaaaaacaatgggatccagtcatttgcaacaacatgggtggaaatgaagatcttgttaagtgaaataaaccaggcacagaaagacaaacatctggccgggcacggtggctcatgcctgtaatcccagcactttgagaggccaaggcggacggatcatgagatcaggagatcgagaccatcctggctaacacggtgaaaccccatctctattaaaaatacaaaaaaatacaaaaaaattagccaggcatgatggcaggtgcctgtagtcccagctacttgggaggctgaggcaggagaatggtgtgaacccaggaggtggagcttgcagtgagctgagatcgtgccactgcactccagactggtgacagagcaagactccatctcaaaaaaaaaaaaaagaaagaaagaaagacaaacatttcatgttctcacttacttgtggggtctaaaaatcaaaacaactgaacttatggacatagagagtagaaggatggttaccagaggctgagaagggaagtgggggatacaggggaggtggagtggttaatgggtacaaacataacagaatgaatgaataagaccttctatttgacaggaaaatagggtgaccacaatcaacaataatgtaattgtacattttaaaataacttaaagagtgtaattgaattgtttgtaactcagaaggaaaaaggtataaggagatggatatcccattccccatgatgtgcttatttcacatgcacacctgtattaaaacatctcatgtacccccaaaatacatacacctactatgtgcccactaaaattaaaaatacatatatatggccgggtgcagtggctcacgcctgtaatcccagcactttgggaggccaaggtgggcggattacttgacggtaggagttggagaccagcctggccaaaatggtgaaaccccaactctactaaaaatacaaataaattggctgggtgtggtggtgggcgcctgtaatcccagctattcaggaggctgaggcaggaggatcacttggacccgggaggcagaggttgcagtgaactgagattgtgccattgcactccagcctgggcaacagagcaagactccatctcaaaaaaacaaaaaacaaaaaaaaattaataataaaattaaaagaaataaaaattaaatgttttttaaaaaagcaatctcattgtcatcacatcacatttctgctctgtacagctaaagccagacaaaatcaagaatgaaatctacaaaaatctaaggaaaagaaaacattgcaacccaacaatactattcttaagtaatctattttcccatggaaaaaaaaatagaaacctgttccgacaggcaaggactttgaaagaatgccatctacattctcttcctaaatgaaatgcccccatcacctgaaaataaaccaaaactctaaagaatgaggaggggccgggcgtggtggctcatgcctgtatttccatcactttgggaggccgaggagggcagatcaccagaggtcagatcaccagaggtcaggagttcaagactagcatgatgaaacccccgtctcgactaaaagtacaaaaattagcggggcatggtgacacatgcctgtaatcccagctacttgggaggctgaggcagaagaattgcttgaacccagaaggcggaggttgcagtgagctgagatcacaccactgcactccagcctgggccacggagcgagactccatctcaaaaataaaaaatagaaaataaaaaaagaatgaggaggaatgtaagtttaaaaaaaaaagtgaaagcataatgagtgggacagcgctcatgcctacacaactatttttaatagggttcataatatttaaaataaatgtccaaaatgatttttgaaagacaagctcccaatttctcgctttccccctagctgctggcaaccaccattccactttttgtctctatgagtttgattattctaggtacctgataaaagtggaatcatacaattttttgtgtgtgtgtgtctggcttatttgactcagcataatgacttaagtaaggttcatccatgttgtagcatgcatcagaattccattccttcttaaagctgaataacattccattgcacagatgtaccacattcgtttattcatccactgatgagcacatgggttgtttccacctattggcttctataaataatgctgctacgaacactgatgtagaaatatctgttcaagtatctcctttcaactgttgtctgtatatacccaaaaggagaatggtggattatgtgataattccatttttagttttttaaggaaccaccatactgttttccacagtaactgtaccattttacattcccaccagcaatgcataagagttcttatttctctaccctcaccaacacttacaattttgttttcttgataataaccatcctaatggtgtaaagtgatcttactatggttttgatttccattttcctaataattagtgatgctgcacatctttctctgtaattatttgccatctatatatcttctctggagaaatgtctattccagtcttctacccattttttcatttggtcggtttttgttgttgttgttttgttttgtttttgagacagagtttcactcttgtcacccaggctgcagtgcaatggcacgacctcggctcactgcaatctctgcctttcgggttcaagcaattctccttcctcagtctctcaagtagctgggattacaggcgcccgccaccacgcctggctaatttttgtatttttagaagagacgaggtttcactgtgttgaccaggctggtctcgaactcctgacctcacgtgatctgcccacctcggcctcccaaagtgctgggattacaggcatgagccaccggttgttgttttttgagacgcggtctcactctgccacccaagctggagtgcagtggcatgatcttggctcgctgcaacctctgcctcctgggttcaagcaattctcctgcctcagcctcccgagcagctgggattacaggcacccaccaccacacctggctaatttttgtatttttagtagagacgagatttgtctttttagtagagaccaccgtgttggccaggcttgtctcaaactcctgacctcaagtaatccgcccacctcgacctcccaaagtgctgggattacaggcgtgagccaccacacccagccatttggtaggtttttaatggttgagttgtgggagttctttatatattctggatatcaatcctttatcagatatatgatttgcaaatattttcttgtattctatgggttgccttttcactttgttgacagagtcctatgatgcacacaagttttaattttgataaaatccaaataatctactttttttttactgttcttgttttagtgttgtatctaagaatcctatgccaaatccaatgtcatgaagctttttctctatgctttcttctaagagttttatagttttagctcttacatttaggtctttgatccattttggtttatttttatttatggtgtgatacagaaagaaatccaacaccattttcttgcatatatatataatccagtttccccaacattatttgttgaaaagactgtcctttcccaattgattgatctggcaccattaccaaaaatcatttgaccatttacgtcagggttgatttctgagctccctattgtgttccattggtctatacgttgtccgtctttattccagtaccacaatgtcttcactactatgctttgtcataggttttgaaatcaggaagtatgagacattcaattttgttcttttttttttttttgagacagggttttgagatggggtctcgctctgttgcccaggctggagtgcagtggcatgaacacagctcactccaagcgataccacaacctcagcctcccaagcagctgggaccacaggcacaggtagtaatttttttcttattattagttttgtggagacaaggtcttgccatgtagtctaggctggtctaaaactcctgggctcaaatgatcctcctgcctcagcttcccaaagtgctgggattacaagcgtgagccactgtgcccagccaattttgctctttttcaaggttgttttggctattcagggactcatgggattctatataaattttaggatgaatttttttctatttttgccatgcacatcattggcattttgataggaattgcattgaatatacagatcattttgacatcttaacaatattagtcttccaacccagaaacatagatgtctttccatttatttgtgtcttctttaatttttctcagtaatgtttcagtgtacaagtctttcatctccttggttaagcttattcctgaatattttattctttttgatgctattataaatgaatatttgtttaattttattttcaaattgttcattgttaatgtgtagaaatgcaagtcattttggtgtgttgcttttctatcctgcaactttggtaaacttgcgtattggttctaacagttttttgtggaatctttagggttttctacatataagatgatgtgaataaaaataattttacttcttccttttccatttggatgtcttttatttctttttcttgcatgattgttctggctaaaatttccaatactgtgttgcacagaagtggtaaaagcaagcatccttgtttctgaccttggagtaaaagatttcagtctttcactactgagtgtgatgctagttttgggttttccacacctgctctttaacagataggttgaggtagtttcctcctattcctagtttgttgagtacttttatcatcaaagtgtattaaattttgtcaaatctttctccgaataaattgagatgattgtgagggatttttccctttccttctgttaatgtggtatattacaatgactgaattttgtgttatttttaaattacagtcgtgccacgttttggtcaaggagggaccacatatataatcttattgtaagattataatactgtatctttactgtaactttctatgtttagatacgtttagatacacaaatacttaccattgtgttacaactgcctacagtattcagtacagtaacatgctgtacagatttatagcctaggaagaatagactatgccatatagcctaagtgtgtagtaagcttgtgtaagtatactaggttgtgtaagtactctatgaggttcacaccaacaaactgcctaaggatgcatttctcagaaagcatccctgtcattcagcgatgcatgactctaagtgatgcatgactgtattgaataataatctagatccaaaaattcacataatttttaaacccagttttttgaaaaaggatgaaattatgtttaatttttaatttccactggtcattcttcaaagcaataaagatgagataaaagttcagaattttgaatttacagaaaactgctagttaattcacaggtaacaaaaacagagagaaaaggtttcaaagggtttcagacccaacagtaactcttaagaatcaacagtcaagaataaatggagatacagaaagttaactgacccttattttgtattccagagactacattggagcaaagctgatagaaaacccactaaagttctataggtgtcacatcaccagtaaaacctcaggcctgataaccaggaattcatcctgatgcacactaatactgcagaaaaatcttggtcttttaaacaatttccaacccaataattttttaaaagatgcaagcaacagccccaagttgaatcctttaaagcatacatagaaccaaagcattgttattgaaggaagaaagggaaagaacaagggataaacagtccgtctggaaagatttatacaaaactatttattacagtcattaactcaaaacagtataccacctgactcagctaattttcctgttttgacaaaaattttaagcatcatagatcaattgtaatttttccagttggcttattaaaatttctttccatggtttctgcttgcattcctgcagggcatagacctgcactaccatgcaaagtagggactgcccttatttatttctttaaactatggctcttacatcccattaaggtaatttatttcactaaatccctggatactatttaaaatttctgtcaaagcattaataactcttttactgtcagttataaatttataggaaagtgaaaaaataataaaaatcaatatttagtatactataacttaaaacgttggaaaaattgaaaattaacttggccaggcacattggctcacacctataatcccagcactttgaaaggctgaggtgggaagatcaagtaaaaccaagagttctacaccagcctgggcaatatagcaagaccctgtctctacaaaaaataaaaataaaaaaattagctgggcatagtggtacacatctgtagtccctgctactcagaaggctgaggtgggaggatcgcttgggctcaggagttcaaagctgcaatgtgttacaactgcacaactgtactccagcctggacaacagagcaagaccctgtctctaaaaaaacaaaaaaaaaggcaaagaaaatgaacttatcaagagtggtttgaacagaacttgttctcttatcagtgtttaactcatgatactgaggaagaatctttcgtattcctcagtaaattatcatgctcctttctaagtctggatcagcttccaacattttaccctttgcattttcaatgttctcaactatctcctagagttcctttaatgaatgtgaggtcttctgacagcatcacttcctctgagacagcttcatgctcttcaacaaaatcactttcatcatttatgttggttgaaaatctcaccttaccaagttcctccagctataaattcagtctcttaaaaacgtgtaatgtcagtagttccacagccagctacttctgtataacttcatttatattctacctgattttcattacatgttatcacttttcatttctttgctgtattttcactttgttgggcaaatgcctctttcaattattcatttctgtaaaatgtcacatgtgtttcttactgggagacaaagaggcaacacaactacatgctttgttgtctgtgcataaactgagtaacagatgcacagtgaccaatcactgacagattttgaaagaagtgacatgattgatcatggatcatgatacatgtttgtaatttacaagttatttgtagaatgaagagctagcagtcaagtttgtacattatccaagtacacaattaatacaccatggtaaatgaaatttgaaccatattgttaggggattggtgtcacttaactaaactgtagtaactgaaattcatatgtataaaagccatgcaaagcaagaactgcctgcccataaatactcctatgtatagagcataacattaacaaatcaaaaatttacaatggaatcctcaaaattgcccctatactgccaaatgacataaacatgaaagcaaggatcaagtcacttacagatgtcctacagatacaattagtacttgactttaatatatttgattttcataccacctcactttttaacagagcatgctgatacctgttatttggactttaatatatcaagaaaggaaaagagatctgaagctctcatacgatggcactgcctgctggaaaacagtattgttttagttgtgtcatcgccttattacagtagtttatttaagcaattatgcaaatgtattcaattttgaccttattatataaaattaagtggaaaatagaatcagcaatggtggtgataaaaaggatagtgttaataagaaaaatcagttttatgaatttgattccagtgaaacaaaagcaaaactcctgagcatcagatagtcagtggaattaagcaagttttttctctgtgaatgtggaaaatcaaatgagtacgtacagagagtgcaacataaattgcaaaactattttactaaagatggtatatacaactagaaccctggaaaaataaaaaattaaaattaaaacattaaaaataattaaggaactatattatatctttaattctctggcaatagaatcctcataacttattaatcaattgtttatgttttgctttacagctgaacactggtgaatgctcttatatttaataatatttattagaagttctaggcttctaaactgaataaagtgtttctattggtagtaagagaatttaaaaaacagatgaaagtatgctcagaacatttaggctgtgaaaggacaaaaaaaatcattctttagtatccctctgtgtaggaagtcaaaatagcttgtatatcatcttattttgtcttcaaaatgactaactacctcattctcatagtagaaataccttgaaattagatacagggaaattaaaacagagaaaagataaaattaaaacctaagtttcttgatttttgacacttcaataatgtacttttttctttaacatttttggacaggaaattctaagttaatattaagggcaaacagaatattagacttggtatttaacgtatttttatatatatatataataatatgatcactgcttgtccatttttccaaaattgaagtaaatgagtattttacctaccccaacaatccgcttcatagcatccagtttagcagaatctttgttgctctctaacatttgctttagatcttcattcctattacaaaagagaagaaaaaaaatccatactttgatttttatattagatagcttaaaatatatcattttcataagaattagaagtaatatcatgggcaatgttaaataactgcagcaagaaggtggccatctgcaggccagagagaaaggcctcagcagaaaccaaacccgccaacaccttgatcttgtactcccaggcattaattgtgaaaaaattaatttctgctgattaagccacccagtctgtggcattttgttatggcagctctagcaaactaatacaagggttaaatgttacaaactgtcattgcaagaaaaaaataagtaaaagctaagcacatttttttcaaaaggaataaatgcaatgaaatttattatgaaaaaaatgagccttactttccaaacagctcataaaattaaatgcaatggtgaccagtagagaagacaaaatacaattaaataattaaaacacctacttcttcctaattaaaaatacagcttgaaaatatttaaacagtagaggtagtaataaataaaaactgtctctgagaacatacaactactacacatactataaatgttcaccttaaggaatttaggatccctgcataaaacttttcaggctctttcagatttcacaggtaacagaaaagggagagaaattaatggaactatatatgtaactgtattttgttcttctactttttgctgtattttcctatttacttaatgactatgtatacttttataatgaaaaacctaaaccctaaaagaaaccttaaaaaaatcttactgaagttaggtaagaaaaaaaaagaattcgataggaactaaatagaaaggaaatgtggtcacacatacacacatgccaaaaaagaaaacaattttctcctgcttgttccccttttctgttccccaaagtgtcccattattctcctctaccagttttatctggagagagaagtgagcaatgaagaggaatgaagtgtcaatttttagaacagcccaacctctaattccaggcatagtcttactcgtaaactaatggaaacttggtttgctcatctaaagcccaaattcccagagtgcccagaacaagcacctgctctctgaaactaaaaacaagaaaacagaatctcaatattaaagataaaggttttgctcttcatggttaacagaaaagctagtcttcaacaacaaatactgcattaatataggaagagaaactaataattctgaggttcagggaagagacaagaaaaatcctaggcactgtttcaacctgatgtaatatgcagcttctcacgtatgtcataaggatctatttaaaattctgatataaattacatgtttcttcccaaattcttctttgcctgtcaccaaaacagtaaagatttaggaaagttaataccataacacctactttaccctcaaaatacattaacttttattaagttcttttaggtctaccttcttcattacgtagattcaaatatgatcagttaacatgtattactgcataaatcttagatactattttgttaaatatcaatatttgagtcaaaataatgctgaattagcaatattttcctcaactctttgctgaaaacaatagttgtttcaaatatattcatttttaatttacctgtgtcttcatttacctagttacctgtagctttctagctttgagtattaggataccaactttatttttacataagtgacatcttgtggtgttaaatggtataacttttcctttcatgttcaaaataggccagttttaagtttcaaaggacagagaagaatatataactgaacatttaaggcaaatcttactattaccaggaaagtcattcttattttagccccagaatgaactagtaactataactgaaaaataaagtttaccagttatatataagaactagggatgtgttagggctattatgtagtgtaaattacctctctttttaatcaatctataatccataactcattaaaaccttctactccttctaaagacaacataaattaaggggaaaattaagactatgtagtactgtacactatatcagtgctacttaaagtatgatctgagaaagtctggtccaagaatcatgactaattcacaaatttttgttaccaacccatgaggagataggtaccaaaattcagaataagcacattgagaaccgtgacggaacaatttgacaatgtaattttatgtttattgagtctaatttaaaaagtggggcttgtattttattttgtgtgcctttttcattttatttttctttaattttattatgtttttgtttgtttgttctttcttttgagacagagtctcactctgtcacccaggctggaatgcagtagtgtgatctccgctcacgcaacctccgcctcctggattcaagtgattctcctgcctcagcctcctgagtagctgggattacaggagtgcatcaccacacccagctaattttgtattttaagtagagatggggtttcatcatgttggccaggctggtctcgaactcctgacctcaggtgatccaccaacctcggcctcccaaagtgctatgattacagaaatgagccaccacgcctggcccattttatttttctagtaatttattttttattgtattttgtagaagtatccatcaatattggactggaaattttaaaaagaaaaaagaaaggacttttaccatttgagagccccacactacaaagttaccttctttttcctcaaaattatggtacaccaaaatttatataccatagaaagcaacacctaaaacttacatccaggaaatcatggactggaaaagtgataaggaatagcaatttccaatcagagatacatgcccaaaaaaggatgtataaaaatattcaacgaagggaaggctggacctttatggagccctaccaaaaaattccaaaacacaggcacctctttaggcatagagaaccactccaataaaagatgctactatccaagtggtgcgctgcaaatatgaatggatatgcagaaaaaacgctggaaacagagtcagaacttaccatttcccagtgctatgtagccaaagggagtggccctcataataataatgtttttgtgcaaaacattaaggcttaggaacattttcagttcacttaggatctaagcttcccttgcagagtgctcagaactttggctctttctgttgacatctgatacccatgaccactactctttcatcttgaaattccctcctccttttgattctgtagctctattctcatctggttctccattcgcatttgtgacacagcaatgaacaaaaatgacagaaaaacccttgccctcatagggatttcattctattaagtaaaagaaacaacaaacataataagtaagaaatttttaagtcatgaggtaatataggggaaaaacttttggcacaaagcctccacttaataaatgcaacagtgaatagaaacaaaaaactccattgctagtgtctttacctgctcacccatctattaactttctaggcagggcacagtggctcaagcctgtaatcccagcactttgggaggctgaggcgagaggatcacctgaggtcgggagtttgagaccagcctgaccaacacgaagaaaccccatctctactaaaaatacaaaattagcctggcatggtggcacatgcctgtaatcccagctattcaggaggctgaggcaggataattgcttgaatctgggaggtggaggttgcagtgagccgagatggcaccattgcactccagcctgggcaacaagagtgaaactccatctcaaaaaacaaaaaacaaacaaactttctaaaagtcagaatcataaattatccaaataaatatgaatattcctcctatactgttcacaagattaaaaagaaaaaagcctacagacccttcctcaactcttggtaatctcatttacctttaatttaaaatgtctctcacacagggtaacaaacaacgtcttaatttaaaaatccaaggtaaaatctcatgaatagtttcagattattcctctgtacttgtgaggactaaactctgacttttctctctcttgcccaaattcctaaggggcctgaggagtcctgccctacaaaccataaattctcatcagatggattttaatttaaccctacgtaacgtggcttactttccaacctgactatagcataacgtcacatgacatataaagaaggcaatcaaaatattttaccccaaaatatgcttctttgccatatttttgaaccggccctgcaaagcagccttttgtggaagaaaatctgcatctgtaaaggatctctacagagtttccccttccaggctctaacaattctaaagagattaactgagagtccagcacttttaaagatttgaataggaaacatttgccatctattgtctctaaaggcagccacctaagagacttcataagaatcttggtttctacagccctttatcctaacccagccacacctttctcttgatcccaggtttttcaataacaacttaactctttcaagtaattgccaatcagaaaatctttaaatccacctgtaacctgtaagccccctgcttcaagctgtcatgcctttcccaactgagccaatgtatacctcacatgtactaactgatgtcttacgctccttaaaaatataaaatcaagttgtaacccaaccaccttgggcacaggttctcaggatctcttgaggtcatggtcactcatatgtggctcagaataaacctcttcaattattttacaaagtttggctctttctgttgacatctgatacatatgaccattactcttccatcttgaaattccctcctcctttagattctgaagctctattctcatctggttctccattcgcatctgtgacacagcaatgaacaaaagtgataggaaaaacccttgccctcatagggatttcattctattaagtaaaagaaacaacaaacataataaataagacatttttaagtcgtaaggtgatatgggggaaaaaaacagaggaaaaggatacagaaaggaaagaaggaggcaattttaatagcacagtttgagtaaattttaaaagtgacatctgaacaaagattttcaaataagagagttagttatgcagatatcatggggagcaaagggggacagggaggataagcaggtcaaataactctaaaagtttttggtgttaactctgaataaataaagaactgcaggttttgaacacaggagagtcatgatctatttaacaggatcattctggctgctacattcagaatatactgtagggacttccatatctgtccatgacactgtagcttacaaaaaactaaacctgccatagaaaataactataaaagctgaaatacatacatatacacacatatatgtatgcatatacatatacacacacacaagtactcttaaggggccatgatccttgaaagaagagaagcacaaaaagtgagcccctaggccaggacagtggctcacacctattaatataatcccagcagtttgggaggccgaggctagtggatagcttgacctcaggagtttgagaccagcctgggcaacatggtgagactccatctttactaaaaatacaaaaagtagccaggtgtggtgacatgcgcctgtaatcccagctgctcagagacacggtgggagaatcttgagcacaagagggtaagactgcaatgaaccatgatgatgccactgcactgtggcctgggtgacagagtaagaacctatctctctcaagggaaaaaaagagctcctcattcacaccagctttttccctcagtacatttcccaaattgccatgtgggagaacagaacccaaggagaagtcacagtcttaataacttgaggagacaaatgttgaattccagggctgccacagtgactgagacttgaaggacaaaattacagaggagggaaccagagacaaggtacacaaaaatctgtgtgcaaaatgttggctgcaattcctaaggcaagactccaggaaacacaacaaaaaacagcagctgtcaagtctgtcctcagaagagaggctttggtgaatgccctggactttccattaagattactgaagagccacacagagtgctaaggaagatgcccgaggagtataagaaaaagttccataaacaagaccttaaaaagtctaaaactgagctttgacaagatcagaatgatctgcttacattctatttgcttggctggaaaaaaaaacaaaaacaaaaacccagccctgtatggaagaagctatcacccaaagcttcatcaatcatttttatcctaaatacctagcatctgatcaaaacttacgagacatactaaaaacaggatgaaattacccccgcccaaaaaagaaaaaaaggaaaaaaaaaaaaaaaaaaaccaggagcagatccatgagtgactcagataccagagttatcacacagggattttaaaataattacaattaacatggtcaggaaaatgtagaagagatggacaaaacagatgaaacaacacagaaatcaacaattagtagaatccatacaaaacaaccaaatggacattcagaactgaaaagtatagtatatgaaattaagaactcattagataggtttaatggcagactggaaatgggagaaaaaaaggattatcgaacttgaaggcaggtcaagagaaaatatacaaattgaagcacagagaaataaaagaatggaaaaaatagaacagagcatcagaggcatatgagataaaggtaaaatttctaacatacctctaattagagttccaaagagaaaagagagtatgaaacaaaagcagtatttgaagagataatggttaagaattgttctgaacctatgaaaaacataaacccacatatttaaaaatcttagaaaaaaaggacaaacataaaactacaccaggtacagcatagtcaaactgctgaaaacaagaaacaatgagaaaaatcttaaaagcatccagaggctgagcatggtgaatcatgcctataatcaagcactttgggaggccaatgcaagaggattgcttaaggccaggagttcaagaccagcctgggcacaacatagtgaggcccagtctctacaaaaaatatttttaaaaaattagctgggcatgatagtgtgcacctataatcctagctactcagaaggctgaggcaagaggattgtttgagcccaggagttcaaggctgcagtgagctatgattacaccactgcactcagcctgggtgagaccctatcttttttttaaaaaaaaaggcatccagaaaattaccttgagacaggagtcaacaaacgtaaagggccagaaagtaaatattttaagttttaccagccataccatctctgatgtaactagtcaactctgctattgcacaatgaaagcatctatagataatacaaaaacaaatgggcatggttgtgttctaataaaactttatgtacataaacagatgggtggtttgctggtccctaccttaaaaggaataacatttcaacagacattataaaggccaaaagatatcggaatgacatatttaaagggctgaaagagaaaagaatgccaacatagaattccatacccaggatattaaaaatattctttatttcactaaaggtgaaataaagtggttttcaaacaaataaaagctgaagatctgctgcctggacatagggtatcatttcaaaaggaaaataattttacatttatatgcaatttatacagattctaaatttacagtttccatgtgtaaagcaaatgctgacagactcatggaagaaaaacacacatccataatcatgataggcaatttttttttttgggggacagtcttgctctgtcaccaggttggagtgcagtggcgcaatctcagctcactgcaacctccgcctcccgggttcaagcaatttccctgcctcagcctcccaagtagctgggattataggcacgcgccaccacacccagctaattttttgtattttagtagggacagttttcaccatgttggctaagatggtctcgatctcctgacctcgtgatccacccacctcggcctcccaaagtactggataacaggcatgagccactgcccccggccatgattggcaattttaacacacctctcagtaactggcagaaccaggaaacgaaaaattcaataaaggtgtaaaaaattcgaacaacataattaaacaacttaaacttacaagcatagaacaatatatccaacaactgcagaataaacattcttttcaattgtacataggacatttaccaaaatagactatataaggtttcaacaaatttgaaaggtataagaatcagagtatgtggaatctaaatagaaaccaatacttaaaaaataaaataaaaactaaaaagtgctcacataatggtaatttttttttttgagatagggtcttgctctattgcccaggctggagtgcagtagtatgatcacagctcactgcagcctcaaactcctaagctcatgagatcctcccacctcagcctcccaagtagctggggctacaggcatgtgctaccttgcctggctaatgtttttttattttttgtagagatagggtctccctatgttgtccaggctgatcttgaacttttgaactcaagcaatcctcccacctcagtctccaaaaatgctaggattgcaagtgtgagccaccatgccagcctgcaacatactttgtgatttgacaaagtgcaacatttcataacttgtgggatgcagctaaagcaatatttagaagcaaatttaggctgggggaggtgactcatgcctgtaatcccagcattttggtagaccaaggcaggaggatcacttgagctcagcagttcaagaccagcctagacaacataacaaagacactatctccacaaaaaatccaaaaattagttggacttggtggcatacacctacagtcctagttactcaagaggctgaggtgggaggattgcttgagcccaggagttcaagaccagcctgggcaacacggcaagaccctttcaccacaaaaaaaacaaaaaattagtcaggcatggtggcatgcacctttagtcccagctactcaggaggctgaggtaggaggaccacttgagtctgggaagctgaggcggcagtgagccaagatcgcaccatttcacttcaacatgagtgacagagcaagaccctgtccctaaaaaaaaaaaaagaagaagaagcaaatttatatttctaattacaatacaaaatcagaaagattaaaaatcaatgatctaagtttccatctcagaatgctaggaaaaaaaaacagcaaattgaactcaaagtacaagtaataaaataataaagatacaagaagaatttaataaaacagactaacatgttttgcatttatagtatattattaacttatttagctacctggtattattttctgaagcttgtatcttattttagtatcacaaagcctctatgaaacaaaactacaatagagaaaaatcaacagaactaaaagctgatgtctatttcaaataggttgtcatgaagacttaataaaatcataaagcacttatcactgggcctagcacatttatttattcaacatccattatatgccagaagctgctctaagtattgaagtccctgaatattctaggacctaaattttaacaaacaaggaattggtgggagggagtttaaggggaatgacaggaaaaaaaggagaagggagggaagtaaagagggagagagcaaggcagagaaggaagaaagcagggaggaacaaaaacataaagaaagatcagataagtagtacacaaacaattaaaataaggaatgcaataaagtaagactgggtgatcacaaaagacctccacggataagtgatctgaggtctcgaagtacaaggagacaaccaaagaaatcatacaagataacagagcaagaacaagcttggctataaagaatccaaaagaagatctatgaagggcctctaaaggtaggctgaagcaggttacattccttaccggtccataacagatacacaataaacattagttgaaaaaacaaatgaaagcaggctatatactaaacttgtttcttagaaagacacagaagaaccctttcactgtaaagtctcaaaaggatccatgatcccaataaaagttaaaaaccaagcatatatcttccatgtcttcatatcattcatatgcgtattaaaagccatgatgtcatacagacatcacaggacatcttcatatttgccatgatctttatcaatgccctcagctacttggcctcttggtaggcagcaggaagtatgttttacctttgctcaggagattaggaatgtcttctagaatgtgactattcagtagtatatttgttaatgtttccttttattgcttctgagactcccccaatcttaatcttctatacaaagtggcatttttggtttacagtgtttttaaacagtgaaaaggaactttttgcctgttacaaattttatgcatcaccatatataaactaaactatgtcagtggctctatgagatttcctgtaaaacttttttcctacaaatagataaattcacacaggtatgcaaaaacttatgttgaaatattgtttttatgtgatgaaaagtgaaatcaatcaaatgcccctccaaaaggggactaattctttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagggggggggggactaattaattatgaggaactattacacagtggtttaaaacaggggtcctcaacccccaggccacagaacattacccatctgtggcttgttagaaaccaggatgccacacagcaggcaagtggcagatgaggagtattactgcctgagctccgcctcctgtcagatcagtagcggcattagattatcagaggagtgcaaaccctcttgtaaactgtgcatgcgagggatctaggctgcacgctccttatgagaatctaatgcctgatctgaggtggaatagtctcatccccaagccaacccccacccccttccatggaaaaactgtcttccatgaaacaggtccctgggtactgctggtttggcgattgctggtttaaaagattaaaatggtatcatatgttgatatggaaagacatatcaacatatggaaagatcttttaaaatataccaggtggaaagcaagatacatagagaatagtatatatatgatcgtttaatttttttaaaaaatttctgaaaggatacataagaacttgttctttgtagttacacatgaatgggagttatgagatatgggattggaagttatatcctttccacatcattgactaactcaccgctaacatgtcgtgtttataacatattattaacttatttagccacgtggtagtggttttattttctgaagcttataacactgtcttattttagtatcacaaagtctctatgaagcgtgtgtagctattattgttcccatttaatagatgagtaaaccaagtctcagaatatataaaggtaacataagattacatagcatgtgagaaattctaaaatcacatgccttttatgtatatcatcataaaaccagggaatggcaaagcaaggaattaaatttcaatcttgttttgaaattcaacattcttcctattcaccatactacgctgtcaatttctgctataaagctgactatattaagaatatatttcaatggccgggcactgtgactcatgcctgcaatcccaagactttgggatgcggaggcaggaagatcgcttcagcccaggagttcaagaacagcctgggcaacatagggagacctaatctctacaaaagaaaaatatatattttttaacatattatataaaatttatatatattatatattaagtcctatatatgtatatataggtgtgtatatatatataggacttaaatatatataggacttaaatatatatatatatgacttaaatatatatatatgacttaaatatatatatatatatatatattagccaggcatggtggtgtacacctgtgggcccagctactcaggaggctgaagtgggaggatcagaccaggaggttgaggctgcagtgagccgagatcgtgccactgcactccagcctgggcgacagggtgagactctgtctcaaaaaaaaaaaaaaaagaatatatttcaagaactataaagtaataccttataaaaggtataaaatccataacctggagtgtcatccccctccctacttaatctataatcacaagaagaacttttcttttaaactcaaaattttcatgaaaagaaaactgatcactagaatcatagtaaacactgattctaattattctcaatggtagtctaaaacatctgtgatacacttctgtataagtcaaaataaattttattttcactgacattactttgactgtatttggttaacattatctcatgtagattcatcagctcaaaattaattagtattacagaatagtgtattccgtccaaacaattcatctttgttggctcacatggctcactgctattggcatgccacagtaataataggcatggtgccacagtaacagatgggcatacacacaaacatgccaaagaatccgtttgtgcatcaagtttgagtattagtattagatttttctccaagaaattcataaactatagtagaggaaatataagttttctacaactgtgttaataagatatgccaactcaaagctagattaatttttaaattctttaaaaaaacaacaacaacaacaactttccaaggccacagaaggcaagttttccatctgatgagtttggatcagcattctgtaaagggaattcaggaaaccaatatgcaatgtctgcctttgtccctgatgcacttggaaatctcaataaaaaaattagtttttaaaaagtcacagggcagtattgcagatgaaacagttctagacatctgtagcacaacaatgtgaatatagttaacactactgaattgtacactcaaaaatggttaagatagtaaatttaatgttatgtgttttttaccacaattttttaaagtcacatggtcccaccaagtttcctgatgaaggctatgtagaaccagaaacagaaaaaaagtcctacaaatttgtacttgacaggaatagaatctaaaagtgcaaatcacttaagttttatgtgattattttaaagtatgctatcacttaaaaacaattctcggccgggcgcagtggctcgcgcctgtaattccagcactttgggaggccaaggcaggtggatcacctgaggtcagcagctcgagaccatcctgaccaacatggcaaaaccctatctctactaaaagcacaaaattagccgggcatggtggtgcatacctgtaatcccagccactcaagaagctgaggcaggagaatcgcttgaacctaggaagcagagattgcagtgagccaagatcgtgccactgcactccagcctgggcaacaagaccaaaactctgcctcaaaaaaaaaaaaaaaaaaaaaaacagttctcatctatagttaattatcccattataatttatttttaaaagactgactaacttatttccatgtgtagttttacatttttgaaacataaacatatcctattgaccaaactatattgaaactttttttatagttttgctacatgaatgaaaaaccgttttacaatactaagaatgctaagaaaaaaatcatttgcagtcactatcatccaaaattatttaagtaatatacaaagtatcaaaatagatgggactctgtgtgtatgtaggaataggagagaggagaaaatagggatttatttaatgggtgcagagtttcagtggtgcatataaaaagagttctggagagggatggtggtaacgattgcctaacaatatgactatatttaatgccactgaactgcacacttaacaatggttaggttgcttgataccttgtcaaataggggaaaaaatggttaggatgataaagttattcaggtgtattttaccataattaaaaataaaagagaaactactctaaaagaaaaaaaagctcgttagactccatgtctccctgcaataaccatccttcgtcctctacctgaaagccaaagttcttcggagaagtgatcttcttttactcacttctcacccatccaccaatggactgccatcgatttccacactcaacatcccttgacactgctgtcaccaccaccaaggtcaccaacaactgccttatcaccaaactgccttaccattttgcttgattccacaccagcagctggcactgctgaccatttagcccctcctctttttatttctgttaaagcaaaacatacataagcctgccttcttttaggaaaaatgagaaataggctgcttcttcaagaacagcttcaaagccataggatacaaaagaagactgaaaattgaaaaaaaaaaaaagtttaaaacaaatacactttttactcctttgtactataatcattgttcccaaatccttgataatcacacagaagaatcagggcttattaatttcatttatttttatgtggtgcacattaaaggtactttgtattaagctggtgcaaaagtaactgcagtttttgccattaaaagtaaatatatttagttgtttcaaacacttgtgaaatataattcagaaaaactgaagtttgatgaaaatttgaaaattaaaaacataaagcaatggttaatgttaaaattaacaataattctaaaattataatagcttaaaaagtacatcatattaaaaataaaacaggccaggcatggtggctcatgcctgtactcctagcactttgggaggccaaggcaggaggacggcttgagcccaggagttcaagaccagcgtggacaacatagtaagacttgtctctaccaaaaaaaaaaaaaaaaaatagctaggcatggtgatacatgtctgcagtcccagctactcaggaggctgaggcagaaggatcactagagcccaggagtaagccatgatagggccactgcaccccagcctggggcacagaaagagattgtgtctcttaaaaccaaaaaagaaaaatgaaaacaaaactttaaatgactttaatggtgttataatggtaatcataattactatgtttattatgtaccaggcactatttacatatgttaaatcttttaatcctcacaactagtcaatgagtgtaggtacattatcatcctcatccccattttacacataagaaaaccaagggcagagagttgtaaaataatctgtccaagtaccatttattaactctgtgccacattttgacacccaggaatagttccagagtgggtgtgtctaaccgtcataccacactgtctcaacaaaccacacaataaaccatttatcggctgtcttcctcctacggaagtaggaattaagtttcgccctttccttataccttaaacacaattcaaaaacttgtacaatcaactttcatggtttccccaaactgaattctcccttcttagttttctaagtaagttccaattctcctactctcttcaatgtagactttactaagattcctcactggccttctcttcacatgccgcacacacactttccactcaatggctccaactacaatgtcatcaattaatgactcccaaatctacatcaccagcccaggtagctgtcctgaataccttatctatctatctaactgctcaacgaatgcctaactatcaattcaaattcagcagatccaaaacggacctcaacacttaccctcctcactccaaacttactctatccatctgtgtttccagtatcacagaattctagcatcattcacatacttgtccaatccaaaaacactggtgtagccaaggtgatctttttaaaaaataaatcattttatgttgctcctatactttagcactccttactgtgcaaaccttcatgataaaatcctaatttctgagcatggtatgcaaaactcttcataatacagactgattacctcctaaccatctttcaccagtcagtccctcatttcctcctaactatgtgctctcgccacactgaattgtttcctgttccctatgtaagccataaatccttgcctctaaaccagcagtatccaatagaatgttctgtgataatagaaataatcacttatctgcattatccattatagtaactgctagctacatcacatacatgaaatgtgactagagtggtggagaaattaaatttaattaaattaaatttaaatagctacatttggctagttgctactatattgaacattacagctctaaacctaggtatatgctattctgtctgcctggtatacacaggtatgtgtggaaagtcctcatcagtgctactatctaacatcattagtattcattcttttgcaaggttattctatttatgtaggtagtaattaataaggtccattctacataagatactatttaaatcctctagtggagctagctacataacctcatttgtataccttagttgtttactttcctaatagctaatagatagtaatttaactacaatttgtcctaaaaggactatcattttaagaaatgagcaggctccatgcattggtaaatgaaacaagcaaattataatgtcatattataaaagcatatagctttgctctaaaaacacatgatatacacatacatacatataaatatatatgcaaaagaaaaaaggctaaaagatatatactacattaaccgatttcttctggatattgaaattagggttgttatttttcagctaacctgtatctgtaagttttctagaagaaaaaggggatatcagcaattctccagcaattttccttctctctaatgcatcatctattttctctcctctacatcagttggttccatcagcaaacaagataatacagtttctcctaccttaaggaaaaattccttgacataacattcctctccaagtgctgctccatttctctgctcttctatacttaaaaatatactaatggccaggcgcggtggcccacgcctgtaaatcccagcattttgggaggccgaggtgggcagatcatgaggtcaggagatggagaccatcccggctaacacggtgaaaccccgtctctactaaaaatacaaaaaaaattagctgggcgtggtggagggcgcctgtagtcccagctactcgggaggctgaggcaggagaatggcgtgaacccgggaggcggagcttgcagtgagtcgagatcacgccactgcactccagcctgggcgacagagcaagactctgtctcaaaaaaaaaaaaaaatactaaccacaattcttcttcttccttctctcttgagcccactcatgaggctttcagccccaccagtgcacctaaactgcttgtcacggtcaccaaagtccacccagtgacaaatccaaaactcccttctcagtaatcatcttacttgacctatttgtattatttgacacaattactccaggaatgtcccaggactgactgactctgacctttttctacactcacttcctcagtgtctcatccaatcccatgatacctgatgactcccaaatttatacttctagcctgactcctcctctaagctccacactctgatatccaactgcctatttagtatctccacatggatgcctaatcgcatctcaaacttaacatgcacaagctcttggtccctttccccctttaaaaaaaaattcctctttgcacaatattcttcattttagttgacagctattccaaacttcgagctgtgtaggcaaaaaactttgtatccacccttgatatcttttctcccacacacatatcacatccaaactatcagcaaatctcattggctctacctttcaaatatatccataactcacccacttctctccactaccaccaatcggatcaccttctcttgcctgaattactgtaatagtctccttgctggtccttgcctcaaatctgcagtccactcctagttcaagaggcaaaatgtccctttaaagggtaaacaatcatttcacccctctgctcaaaactctccaaatggcatcccttctcactcagagtaaaatcaaagaccttaacaatgattttacaaggccctacacaatcaggtctccgccttccactctgccccttatctctctgccctcatattttactaattaatttcccccacatccttcttgaccacattctcaacctaggctttaaaaacttgcagaaaacccattccaagaataaagttgggtgatgcctagctctgccaacctatgattttggaaccaccctactatggtttcaatgtgtcctctccaaaattcagatgttcaaacttaatggccaatatgatagcattaagaggtggggcctttaagatttagtcatgagggctcctcccttcatgaatgagattaaggcccttgcaaaagaggcttcacagtcttccattctcttgcccttccaccttctgcccagtaaggacacagcattactcccctccagaggatgcggcaacaacagaccatcttagaagcaaagagcagccctcaccaggaaactaaacctgcctgtgactcaatcttggacttcctggcctccaaaaatgtgagaaataaaattatattctttagaaattacccagtctcaggttttttgttatagcagcataaaacaaactgagacagggccttattcattcttctctcatttgtccagctaccatgccaactcactcagctgaattaaagacagtggacttctaattaggctggttcctatcagcaatataaataatcagtccatcaataaacagatattggctataaactgttcacttttgtagatctattaagtctttccagctgataggctaaataagccttctctaaatacacgaaccaacgttattcataataatatgaaatagaggaaaatcatttccttcttgattattctactttaagctcttcattttaaattttgaatttggactgcaggcaatttgtttttgtcagtagttcatttatatacacaagtgaaatactgtcaaattatttcactgtaatacatttgtcattctatgagcatttataacttttcatgcagcaaaaaagaacatttcaaccaaccatctgtctgcctttttcatgtgctttaatcattcagctctggtaatgttgctccaaatactaaattttttttaaataacataaaatctcacatcttatgatttaatggtaaggcttgaaatttaattttcagatttttctcctcaaattttaccagatcagtgattttaaaaataacatatcctactgtcaagaaagaatattttcttgaatatttattaagacaaaatgtagaagtcagaaccaactctccttcaaggagatatgcaagcaaagcaaaataagataaaaggttttataatctgttggaaagtaagactctgtttacaggcagtatttcatcaaatttctattcaatgtagtaaaatcttatttaatttgaaatatatttcaagaattaaatcataaatggaaccctactgcaccactgaaatgacaatccttaatttgaatagttggccctttgtaaaacttacgatcttatttttatgaagacaaaaacaactagttcagctgctaggaatgcactgcagatgctagtatacagtttcttcttttatttttagtcaccttggaacaaatgctgaaatttagtgaaaaatcaataaaatactaaaatttcctaataacttaatgtaccccttgtaaaaaaaaaaaaaaaaaagtaggatccagtttacatatgtagcaagcaaatatgttaacagctctagtaccagatctaatgaccataaatttcaattagctaaacataataaacaagacagatcagttatcaaacctggaattattagaacacaagagatttaaatcttcataactaaagatgatcagatgtataacagtatgctgacaaaatcatgactgaagcatattttcatagcagcaaccctgaactcctgagcacaagagaaaggaattcacaatgaggaaggagcccgtgcctcttcatgtcatgcttatgactcagggcaccaacacttcaacgtctcaaactaaaatgtccttaacatttcaaaattccagcatttccattttcttcagtaaatcactgtttacacaaacaaaggcttataacaaataattttcaataggtatgccacactgaaaagttgaattacacaatttaacactaattgtatacttgaattactgacggttagttcacattagcctaatctctccaaataaagtctgagtttcttaaaaacaagataaagacactataattgttatgcatttttatggtgaaaacacagaggaatgaaccatacatatggaataatccaagactgggaggtaaagatgcctttgaagactgggataaagactaaaaatcctgattgtaaagttcattccatacctacatgacaattccgagtcagttaatcctaaccacagcaaagacccaagtgaactacacaaaattagcttcagggtgatgctgtactacaatacaatggagataccagatgagggtttccttctgtatagggtccacggaatcagtcatgcttcattttttaacaacattggctaatgagagagcaaatgttaatggaatctaaatcactgaattgagtaaaaggatctgaaaatattttattaagcaaaattatgagccaaacactttgctaggcaccttcacacaaatcacagtctttaatatgagcagaatgtgtgaacgatttatctatataaatatttaagaaatattcactgagcaactacataaactgaaaatacacaatgagataaagtttaaatgagaaatactaggataagcaaaaagaaagtagagcaagctctaaacaactagaccatgaaaaaatgttaaatgaaaaaaaaaaacacccaaaaatatggtacagacactagataaaattaagtattaataaaaaatggacttaaacacaaacaagtttagaacccatagtgagacacaatgactctttgaggtaggtcaaatataatgcgttactattaataaaattgtatttttaagaaagtatattcaataacatccctctaagtaaatgaatctcactcagctgcatttctatatgcctttcagaaagatacaaaaagtagtggagataaagtcagagttgctataattgcgtacaaaccacagacacatgtaatcttcctactggactctcctgagaatcactgatattaaaggttaagaatgaatgtaatagaattttcatgtttgatattgtaaagttgacaatgaataagatttaagttaaaaaataagtcaggctttattgatgcaatccaaatacactgggttgtattactgactacaggaaagcatgcagtactttgcttggatctaaattagctctttgaatctaaacaaatgaaaagcccaccccgatttaaacagagtaaaaatgctacctttcaacgtgtgcaggaggtactgcattgctaagttactggctgctaaagtcacctttcagttgttaaacccaagggcctcttttcagccttcattctatttgcccttactctacaactcctgacatagctgaacatttccttcttttaattttcctgttagcatcttcttttttaaaccttcctgtgttttcccacccttctgagctcagtctctttttctagttcttccattcatactttatatcctgttgtcccctgggttttgtccaaactgccttctcgtctaacaagaaaagtcttccctgggtgatttcatccattcccatactttactacctactattcataattgtgatgtctaaatatccatctcatttgaacatgctttttcttttgcaaatcttctggtttctacatactctgcctaaagaatccatctttcctccccctggcaaaaacctcaggctttaagatctaaagtgtcactacctcagtgaagtcttcaccaactttcccaaatagcgttagttaatatcctagtttagaaatcactttgaagtacaccatctcatgagatcctcacaaaagaggcaagtattatcacatcccgtctagaaatgaggaaactgaggtttgaagagatcagcaacttgaacaaggaagcactactacaaatggaaaacatcaacttaaatccaggtcttctaactctgggcccagtgttttttgttttttcttcccattttcatttatagagacaaggtctcactatgttgcccaggctggtctggaactcctgggttcaagcaatcctcctgcctgggcctcccaaaatgctaagattacaggcaggggccaccattcccagcctcagtcttccttctaatacaccaagatgctctcaaaggaaaagagatttacaaatttagtagctttactattgtaattaagaaaaattaattagtcttgtctgtttctagaaattaattcctaattaaatgtttaatccagtaacagaattattaaaattatttttaattataggcacacatacccaaattggttaaaagaagtttttttttaaatgaagaaaaacaacttagaaaaaaacagaaaataaaagttgagaatattttaaaaagaaggaaggggccaagcacagtggtacacgcctccaattccagcaccttgggaggatgaggcaggcggattgcttgagcctaggagttcaagactagcctgggcaacatggcaagaccccatctctacaataaatacaaaaattagctgggcatggtagcatgcacctgtagtcccagctactcggaagcctgaggtgggaaggatcacttgagcccagatggttgaggctgcagtgagccatgatcacaccactgcactccagcctaggcaacagagtaagacatgtctcaaaaaataaaaaataagagtacaaaaataagttctttacattttaaataaagaaattgaaaatcttgaagccaataatctaatacacaggcctttttagccaataaattaggtataggatctactttcataaagccatctaattctgcttctgtttgaagagaggagaagataaataatattgataaataagattaaattcagaaaacaaaaattgccgataatactatgactaggaagtacctaggcatcattgagatggttagtgaaggatcagtgaacacagagctctaggccaagaagccaaagagcagaacagcagagggagttgcagctgaaacattaccattttgcagccattgtggaaaagacaggttcaggagattgatcaatggttgttaaatgtagaagtggtccatttaaaaaagagcaagacatctgcatggtctcagtgtctccccacagataatttgaaaaaaaaaaaaaaaaaaacagaaatgacaccacagagaaactggacaaccctgtgactaggaaaattaacatcatgaagatggacaacctatgcctccaaatgtaatagttcaagaagcatgcatcacctatggtagtatcccagccaaggatacataacctgaatctaaacatgaggaaacaccagcaaacccaaaaactgattaacataaaataaaataataggctttgcaatccttagatatgtcaaattcatgaaagacaaaaaaggctaaggaactatcccagattaaagaagattaaagagacatggcaactaaattaaatatattatcttggactggaaactgtacttgaggaaaaaaatgcttgggaaaaaaaacactttattggaacaaaggataaaattagattaatttcctgaatacatcaacactgtagttgcgtaagagaatatctttgttcttaaaaattacacattaagattttcattgtaaaagaacatgatgtgtacaactgagtctccaatggttcagaagacataataacatgaatacgtatatgtgcctgaatatgcatggggagagtgagtggcagagagagtaagcaagcaatgtagcattttttttttaattggtaaatctgcaaaagggtagctctctgtgtcattgttgcaacttttttgtaaacttgaaactatttcatcagagtaaaccattaaaaaccagaggtgaggaatagggtaagctttaagttttttatataaactttgtcattcgattttttaaaaggcaagtaatattacggttttataaatgagaaaatgtggactcaagagagatttaatgaccacttccagaacaggggtctccttgtttctgtacaattccattagactgcaggtcaatagccaaatgtttctaatccctggaagcttctctggtggtactacttggagctactatttaaagttttaaactttttgtgagttgtatgcactcactaataaaaataccatacatttcatcaagtagtaagtagcacatctaaacttttgagagaatgggctctaatattagagcccctgagttcaaattcaggcagtgcaatgttctacctttgtggccttttccaagttaacaaccttgctccaatttcctcacgtgtaaagtgggagcagagaagtacctggtaataacctgcagggttgtttaggaaaactgaatgagataataaatgtaaagtggtgtgcacaaatactcaataaatatctttcggggaacacaattcaaccatggttatttgcatatattacatatcacctctaatcaattagctacttttattttaaatccaacctgttaggtcacctcaagagcactggtcacagagtcaaagccgtaagttttttttgttttttttttccaaatcaggtccaaatttgacaaaaatctttttcttttttttctttttttgagacggagtctcactctgtcgcccacgtttgagtgctgtggcgcgatctcggctcactgcagcttccgcctcccgggttcaagcgattctcctgcctcagcctcccgagtagctgggattacaggcacgagccaccacgcccggctaatttttgtatttttagtagagacggggtttcaccatgttggccaggctggtctcgaactcctggcctcaagcgatccgcccacctcaccctcccaaagtgctgggattacaggcgtgagccgcagtgcctggccccaaatctgacaaaaatctaagagaaaacatcgtagatgttcacaaaccataaaagtaaattaatttgcgaaacagattgatgccgatatacaggttaattcagtctaaacattttgctaatagtagaggcaacaagctccgtacttgttctagaacaatggatcatcaaatgcatataatgaaaaatgaaatcagttaccttacttttaaacttttctaaccttgggaaaaaggaaaagattgtatcttacatgctatatatatgattttgatcctcaatacagccaaaatgtaatcccaatttgaagtagtagcactttctagactacccaatattgttagtaacgtttaatttaaattttaattataccctctaacagatctgcaaagctactagcacagctattctaccttaatttagcatgaatttagtgacagactattatgtgaccctattgcttagtaatgaaagatttaaaataagagaaatgtaaaaatgataattctggtaaatgtaaccactaccaccaacccaccccccaaaacaaacaacttgggatttctttccatttctcggtgatactttttacaaaactaagtgtaccttgtttaacattcgtttttaaaattcacattattaatctgtaaaagttttggatttgttcacagtaacactcttttaaaatattttctattcatatgcttattttggattggtgtttttgtctgtagtgcaaaggacataatccaagaacattaatactggtgtaaaccagtttgtccattcaaacagcctaaatccacctctctgctcctacactccggggtcacaaaataacttcccacaagcaacactcgcactctcaccttcaccaaaacactcctttcaccctaatcagggaatgtattaaagtctgatccggcgaacggtaaataaactagaagacgatgctcaaaattcagactcctgagcccagcccaagtccaattcaatcagtgtcttcaggggtgggatctaagctcaccaagtggtttccttttcactaaagtttgaaaactactagagacccctacacacattcgccccaaactcccacaactcccaccaccgccaaccaaccccacctacccacccgcgggacacgttaccgccctgccctgctcagacctcagggcgaccccgctcctctccaggaagcccaccctggcgcccactcctccgagtccgcagctcctccctcccatccccgcaacccaaacctttctcctcacttcttcaaatcgctgctaaagaggccgaaggcccccgagggggaaatggttgaggtcgcctcctgacccagctccgtcgcctcccctcctccggactgctcattgtaaggaaaactattgctggacattgccgcggtgctggcgggtgcggggttggtcctgccgggggttctctccaaaaggttccagtccagagggcacggaacaaaactagttctcgtacggaggagcgcgcgcaggcgcttccggactcgtcacggctccctgagccgacctggcagtccaccccctgcgcatgcgcagt

SEQ ID NO: 1526 - DNA, 292430 bp, Homo sapiens; identical to SEQ ID NO: 1525
  source 1..292430: mol_type = genomic DNA

SEQ ID NO: 1527 - DNA, 50602 bp, Homo sapiens
  source 1..50602: mol_type = genomic DNA
tagagagaagacattttattgagcctgctacataaatagctacagaaatctgggaggactgaagggagtggctgccatctctctctgcacagatcactaaggaatccatggggagggcattaggggagggcttggtcctccagagggagagaggacaccctgaatgctatctggcatgaggaggatgatgagagagagagagaaagatgagagagactgacagcctaggtgtcatggggaggtatagatgggagccaaacaggtcacagcatttggaagtcactgggtcagagcctgtatcacatcctttaccagcatggtgccaatcaccattttctcgctgttgacagtcagctgggcagctccagctggccgggcatccagggtcagcagaacgaggcttccaccagtcagtgtcctccctgcaaacctgaggtgggaatagaaggggtgaggaagagctgctaagggtgactgtgtttggaaggggatcagcagctggggctcctccttcaaaccagggcccccatgctcatcatttcccctctactggtggcctagtacctgtactcatcagatgtcccacaaggaacacgacccaggttggcagtggcagtcactttctgcaccacaatgtggtcactccgacaggtgtctggcagcatgagtttctctgtgatctcattcatgcccatcagctttcctgggggtagaggtcgtgatgagggcagaggccatggtgggtacagaggccagcacctgggtctgcttactgagcaacaagttctcccaggctgggaaggtatcatgcaaagggcaggtcagaatttaaatcatcagtcttggggagaaggtacttccctctcagactgggccctccctcaggaagcctttgtcagcctctctacccctcccacccaggcctttatccatgttgttaccaaagactgatttggcgcttcctccatcagacatctgggctaccagccccttgagagtggccagtcagttcttaagaggttcgcccatcctgaacctcacaccctttgatctttcctggggggccctccaacccacattcaactcccactcagctcctggaagctaagccctcacaaaaagatcacaggtggctgctgtgatctctcagccagaatccagtagtcacatgcagcattcacaggtacatttttaattgtacctctgcagtagcagctccagacctagccagggctcctgaagcctccaaaccttcacagcacccccagaactcctcattctgcaaggctgacttctctccactcacatgatccaggccccccatgggagctcctccgtctgctctcctgcacaccagcagtcttctcttcagcctctttcctccctccactgcttcccctattcttcacctccttttagaaactgacatccctctcctgtttcttctatccccttcattcatgactaataacattttcttgtttttgttccttcaatctgttcatgttcaagtgtccccgtctccaaaaaatcctttccagaagtgagatccttcatcgtgccaatgccctgtctccctcctcattcatggctaaagtcctccaaagaggactgcatgtacttgagccgtggtctccctcaacccactgcagttggcctctgtccctcctttagcaatgaccctctctccctcaggttggcagtagccttttatatgctgactctgaaggtcttaggtaactgtggtttgcagacaccttctgccttgttgtctctcctggttctcctcccacctctccctgtgctccttctcttatccctcccctcctctttcttctgcagaattcaggttttcccccaaggttctgtccttggccttcctattttctcccacctcccagagtgatctcattcatattcacagcttccattaccacctctatgttcatgactccagcttcaaagtgtttcctgggcatagacccatattttcagttgcatactaaatagctcctcctgaatttcccaaatgcatttcaaaatcagcttatccaaaactaaccatgatcttccctcctcccttgcccaagccactcttctttcttctaggccagaggttttgcaaattacagcctccagaccaaatccagcccaccacctatatggcccacaatgtttttaatattttttaagtgttgggggagcaatcaaaagattaatatttcatgacacatgaaaattacatgaaatttaaacttcagtatctataaatataaatggaaatttcttggaacacagccatactcgttcatttacatactgtctgtggatgtttctatgtttcaacagccacagtcgtgttgtaactgcaacagagaccacatgattctcaaagcctaaaacatttatctttggcccgttacagaaagtttgctgacccctggtctagatgaaggacaccaccattctccctaccatccaagctggacattctggagtcagcttctatacttccctctctgcccactcccagggagcactcaccctgttccttcttaaactcattttcactcatgaacacaggggccatcagctccccaacaggtggctgaatggagacgtagaactgtcgggtctgggtgctgggaggggtgggaggaaacggagaagaattaaggctgtcatctctcccctcacttcccaccctgtgtagaggcacagcttggaggcagtgaaagagtgaggtcaggaatgagggcctgagatggcttccagacccacccaatcatgatgtatccccactaagcaccacctccatttccagttcattgttaccctgtccctttccagcccatcctctcacccccacctcgagttgggcacataccacagctggaagttggctgcctgggttgagtcacagaaattaatgcccattacagcagtggcagattctccaggtgccagggactctgaagtggtataaggcagtgaaggggagagggagggccaccatcacctgataggtctagaacccagcctagccctactctcctctccactgtcacagctgaccagccctctacagaatcttggctttcttggctgctggagactgttcccggtttcctcctgaactctaagcaccctttcccccactcaccctcaccacatttaagttagtcctgaaacaaccaaggcccaaatctgctgctgcaagcacctcccgccctgatgtgaacttgcttatttcatcatctgtcttgtccaccagagtgttgatcatgttagatgctatctctgtgcccctatagcttggcccctggcctggcacaaggagggtatcagcaaccacagaaagactgactctgcccaggagcctcctcctccaccccatccaaagcccttcgcaccaatttcgggaaattcttggatgctgatgccagcaggcagtttgggagtgcccacatgcaggcccttgatgggggtatcagagctgttggagaagtggatgtgcacggacaccatgtggggatccccggagaaaggttggcggctgaaggtgtagtccacagccagcccctcgccagctacccggtgcagcagctcctgccgcccaacacccgatactggactcagaagctagagtggaggggtagggaaggacagaactgagcaagatggagagagcctgtcccagcattgtcccctagggccatccagcagctgggactcaaagctatcacatcctccatcacacccaccccccacacacatccacaccataggatgcagcacagggatgtgtccctgccccagcccggtcccctcctccatcccactcaccgacggtaccagggtggagtctgtgagtgtcaggccctccaggtcagcagccagactggtagacacaattgctgggggagacacaggctggacactgggaggggtgactgtgggagtagataagactatgaggaggcaaagtggaggtggcttgggttgagcagggagcctagggatcaaggagcacgcatttcagcaccatggacagcggggcacatggctgcctggaggctctcgcaaaatacccattcctagacctcaaccccagacctggggaggtcagccctgctgccctctcaggcctgaagatatgttctgtctgctcccctgctcccacaagacctgaggaacccgatccagagtccctatgggctgttctaattcatgctccccaggcctcctttcccctgtgacttttaccacccaaactcacaatcctctagatcaagcagggagatctccttggttgcaggagcacttttgctgctgggaggctgaaagagaaaaatgggatgtgggtgtggggaaggggagcaccttggcatgttctgggttgggtagaagatgtcatgttctgttctggatggtagggagatagatgtctgggcctggcccagaggttggggagggccctggcccatgagcacaccctgactctgccccaaggctctcactgttttcctgctccaggaggcaggttctaactgctcctcctcggactccgatgtcatctcggactctgatgagctactgctggaatcgctgccctcatcagaggatgacgcttctccttttctctctggcaccttcttctttgtcttcctcttaccatcctcctcactctgttcactgaaggagtgggaaaggttggctcaggcctggcctggacactccctccttgcttcacagaagcaggagaaatgctgaaaagctggagtggtgtggggagcctgagccaggagggttcacacctgaggtcctatagcagggaccccgtgagagcttgaagccagcttgtgccagctcaggctctaggactctggttgcttctccacaccagcccatgaggcctcagagatctcctgcagccagcgaaagtaggcgtcatgtgagctgacagccccacccagctcacgaggggctcaggggctcttaggagactggctaaagctcaatgctagccctctttccaggaaagccccctgaaccccaccagccatctggctagctcccttctcacctctcactgcctctccctttctcctcatcctcatcctggtcttcattgtcggactcactgctggactccccagagccgctctcactgctgctcttactgtccgattcactctcagactcagggtctgtggaggaacaatatgaggcctcctccctcatatgcaggcctccttgggtctggagcagacacctgggttccaccttcacattcagtactgaaccctcaaacctctctgacctgcccccagccctacatgccagctggaactgacagaaacacagatggactccatggatagaaacctgcacaagcacacacacctggaacatgaatccctcaggtgcacaaacaattcacaagcaggtgcacacccctagacacacaaccatatacatatacccctcatatagtcagtcacacagatgcatgggcagagcacagaggaccccagctctgccatctgctcaccactgtctgcggactccgtggggcctgactccccctcagagtccgagtagaagggtttttccttctcctttctcttctcccgatttgagcacttggtccattcaggtacctggagatgggggtagggtgcagggtcatttcatcatggttggggagaaggcaggcaggcacaagcccttaccctttattccacctctttgtgaggccctacctggtctgtcccacaaagggaataacagaggaggaagaaaggggcactgtccatggaggggagggaatgctgctcacagaggagcactgccaaaccaaggtggaaacagagtatgggaaggcccaggagcacaacacacaggggaagaagagggacacagacagggcaggggagagagcacacgtcacacgaaggtgggacctcagtgtattcgcccaacaggcccacgtgagtctcaataagggagagatcttcttcctgtgtgtgtgggggagggtgttaggagggctgggccggcactgccagggctccctactgtctgcccccaccaacacacacacacacacacacacacacacacacacacacacacacacacacacacacacttcaaccctccaccccgctgacctccacgttgcgcacagatgggtctggggcttcctccggccagtctgggagctcctggtagcctgtggccttggcattaagcaggtgggacagtgagcccagctggaagtggtcccggtctagggataggtttagaggtcaggcaggtagcagcagtgagggaaagctctgggagctgttttccaggtggggctgggtggtgattctggttgggacttcccaggtgggtaggggaaggagatggatgtgtgccctaatggctcttccaccctgactgcacctttaggcccacatgctggaagaaaaggctgtctggccaggccagagcagggactgagggccagggaaaggcagcctacagaggtgggcaggaggagactctgggcccacagatgctgccgacctgtctgctcagcatgcacgtctagtcaggctctggactcagcagggagggatgaacagtcagagcatgagtgtgtagaagtctggatcagagttgaggcactgctggaggagggcagcacaggcctgtgagtgaggatggtgtcggggagaaagggactgttgccttcttcctgggagaatttcaaagctgtgcccaccctcagaatctccccattcgtgaggtccagggaagagaaaaagaacgaaaagatacccagaagaactgagctttgtgaaggaggctctcttctgtgtaggttcctggcttccactcctggggcccggagaagcagcgggaggacccttccctcccaggcccatctcaaggccgttgtcttgggaaaagaggccttaagggccaagcccaggaacagaggcaaggctgaagccctggggcctgggatttggactgactgtagtgactaagctcacagaatgcaggcaactgctttctcaggacctttataaaaatatacacctctcctttgtgtgttgttttgctttctgccttcctgggtccttggtatttaagatcttggtatgtattccaaagcctagtgtctgctcagggagggagatggaaaagggagcctgagaggagaggaggcacaagtccatcctggccaggaaggcagaccctcaggtgagatgatgctggcagtggttatgggagggtgaaagagtaattcctggtgccacaggagggacaaaaggagtgagccagggagcaggactgtccacagaagcctggtgcctggctaggggcctcaggaaggtctggggcagagactctggccagttcctttccattcccctaggaaggttacccttgatttcagctcccacctttgaaggatgactccaagactggagctggtttgggtgccaggaagagcttcttggcatggcggctgagggccccaccctgctcggaagggacgatgagctgccgggtgaagcgcgcccggtcgcgaatatcatagttctggtcatatttggccagactcagcacatactgggtcagcagcttggtctggaggaacaggaagaggtgggtcagctgacggggggatggggacacaggaggctcagaaacagattctttaagccgacactttcaggcagaacgtctcctctccctgcttaggaccggcgcttccacccagctgtccctccccacctgcccttgttctgggctcagaattttctctcatctctctggacatgcctcctgatgatcccaactttgacaactgccttgggccaacaaaagaggttttccttttggactttccccactcctggctctggactccattcttccctagatttgtggtccctaccactccaggcctgtccagcctctttactctagggcagcagggtatgtggaagtatggaatgctctgctggacctcacagtttccaggctccaccacccagggggaattagacaacaaaaagacagggcagataaacaggggtccctttggcaggggccaccctcatgccctatccacccatttagtagattctgagcagcccaggggtctcagaggtctttatccttccctggaagcttctaatgacatcagggcaaactgcagctgcccatgcatttgccaaggtcatgtagggttcacagtctgcagtcagggaagctacaactgcagacctaaaatatctccatttctgccatgatcttggcctaatctaacctgccttaacatggcaacagcggtagcagccatcacttatcaagtgccttctggcaccaactctgtgctaggtgctccacactagctcatctaatctccccaagccttctgagaagtaggcattattgcccccattttacagaaaagaagcaggatcattaaggggcttttcccaggccaaggagcccatcagtactgcacctaggcctgcatctgctggagctgcaccccatctgcttcccttcactgcctacctgctgacataaggagcctgccctggcccaggtctccatgtttccatcacttgtgaccaagatcaaaaccaccaagtggtcaacaagcagaatgcccaagggcatcaggggccggcaggagggagcctggaactgactctgttcttcctgaggtttatggtgacatactgttacgtgtagccttggacatggttaacccagctaatctggcagggacatcaagcagatgtccataaggggcaaagcccctcagatgctgacccagagtctgagcagctgctttggcagaattgccccacaccactctagagagccactatgattccacattcctacctccaatctggcccacaggccctcttcagctcagtcccttccagcaaagcagcacctgcgatactgttatagtcacagataagcaatcccaatcccatgcaccgctaatagaatagacttaaaaatatgaaaataagatgccatcacaacagatttcatcaccaacctgcccctctcttggccagacaccatctaaatggccagggctagtggatgcccttaccaacatagtcaattatcaagaggctgctgatccctcttttggtttggacaatgtcttcctccacagatttcccagctggctgatcacagactccctccttcaagtccttgcctagttctagaaagaactgtttggtatttggatccatctgtccacagccttaactgcatgttaacaaccaacacaggaaggggctggcccaccacctcaacactgcaggatttgcctataataattcattacccttctccaccccaaggggccattccctgtggattgtggcatcctgtgtgcaccaccaagacccccacctcatctagccaggatgtgcaggaattacaggctgttcaagaaggcctctgagatacactccagtgtgccaagaacagaacaaggctccccctcaccaacaggctccagttgtcagagaggaattttaagcaggaaacactgacttcctttccataacctatgccaacatacatgctaccttgcagatgcctgctaatcatgcttagaaaactggctgttaaaaaaaattgaaatatatcctcaattcacacattacacatgagtaagtttaagctctagatggatgtggcagacagattctaaggtcttccccaccagtagctgcctcctggtgttcatgcctttgtgcaatccctcaccttgggtatgggcaaaacctgagacttgcttctaaccaacaggatatggcaaaggtggtatatgactatatatgatcctatgattatgttttattaagaagactctgtattggaagttctatctagagcaatcagacaggagaaagaaataaagggtatccaaattggaaaagaattcaaattatccttgtttgcagatgatatgatcttatatttaaaaaatcttaaggattccaccaaaaaactattagaactaataaattcagtaaagtcgcaggatacaaaatccacataaaaatcagtagcattggccaggtgcggtggctgatgcctgtaatcccagcactttgggaggccgaggcaggcagatcgtgagatcaagagattgagaccatcgtggccaacatgatgaaatcctgtctctactaaaaatacaaaaattagctggatgtggtgatgcacacctgtagtccgagctactcaggaggctgaggcaggagaaccgcttgaacccgggaggtgaaggttgcagtgagccaagatggcgccactgcactccagcctggtgacagagcaagactccgtttcaaaaaaaaaaaaaatcagtagcattgtccaggcacagtggctcacacctgtaatcctagcaagcactttgggaggccgaggcaggcagaatacctgaggtcaggagttcgagaccagtctgaccaacatggagaaaccctgtctctactaaaaatacaaaattagctgggcatggtggtgcatgcctgtaatcccagctactcgggaggctgaggcaggagaattgcttgaacccgggaggcagaggttgtggtgagtggagatcgcgtcactgcagtccagagcctgggcaacagagtgagaactccatctcaaaaaaaaaaaaaaaaaaaaacccattgcactccagcctgggcaacaagagcaaaactccgtctccaaaaaaaaaaaaaaaaaaaaaaatcagtggcttttttttttttggcggggggggacgaagatgaagtctcgctcttgtcccctaggctggagtgcagtggcgcgatcttggctcactgcaacctccgcctcccgggttcaagcaattctcctgcctcagcctcccaagtagctgggattacaggcacccgccaccacgctcagctaatttttgtatttttagtagagacagggtttcgccatgctggccaggctgctcttgaactcctgacttcaggtgatccaccagcctcggcctcccaagatgctgggattacaggcatgagccaccacgcctggccgtgaattcatttttgacaaaggtatcaagaacatacattagggaaaggagagtctcttcaataaatggcgctgggaaaacgggatatccacatgcagaacaataaaaccagacccctatctctcaccatatgcaaaaatcaaatcatagtggattaaaaacttaaatctaacacttcaaactatgaaactaataaaagaaaacattagagaaattctccaggacattgtactgggcaaagatttcttgagtgataccccacaagcacgggcaaccaaagcaaaagtagacaaatgggatcacatcaagttacaaaggttctgcacagcaaaggaatcaacaaagagacaagccacagaataggaggaaaaaatttgcaaactacccatctgacaagggattaataaccagaatacgtaaggagatcaaataactcaataggaaaaaaaaattcaataatccaatttaaaaatgggcaaaagagctgaatagacatttctcaaaagaagacatacagatagcaaacacgtatatgaaaaggtgatcaacatcattgagcatcagagaaatgcaaatcaaaactacaatgaaaggccaggcacgggtggctcatgcctgtaatcccagtactttgggaggctgaggcaggcggatcacctgagatcaggagttgagaccagcctgaccaacacagcgaaaccccatctttactaaaagtacagaaattaacggggcgtggtgacgcacgcctgtagtcccagctactcaggaggctgaggcaggagaatcacttgaaccacagaggcagaggttgcagtgagccaagatcgcaccactgcacactccagcctgggtgacagagcaagactccgtctcaaaaaacaaaacaaaacaaaaaaagatatatcatctcaccccaagtaggcttatatccaaaagataggcaataacaaatgctgacaagaacatggagaaaaggcaacccttgtacactgttagtggaaatgtctggagaacagtttggaggttccttaaaaaactaaacataggccgggcacggtggctcacacctgtaatcccagcactttgggaggccgaggtgggtggatcgcgaggtcaagagatcaagaccatcctggccaacatggtgaaaccctgtctctactaaaaatacaaaaaattagctaggcgtggtggcaggcacctgtaatctcagctacttgggaggctgaggcagaagaagaatcacttgcacccaggaggcagaggttgcagtgaggcaagatcacgccattgcactccagcctgggaaaaaagagtgaaacaccatctcaaaaaaaaacactacaaataggccaggtgcagtggctcacgcctgtaatcccagcactttgggaggccgagtcgggcagatcacttgcggccaggagttcaagaccagcctggccaacatggtgaaaccccatctctactaaaaatatgaaaattagccagacttggtggcgggcgcctgtaatcccagctactcaggaggctgaggcaggagaatcgtttgaacctgggaggcggaggttgcagtgagctgagatcatgccattgcactccagcctgggtgacagtgcaagactccatctcaaacaaacaaacaaaaactaaaaatagtgctaccatatgatccagcaatcccaatgctatgtatatacccaaaagtaaggaaatcaacatattgaagttatatctgcacacctacgtttattgcagcactgttcaccatagccaagatttgaaagcaacttaagtgtctatcaacagacaaatagataaagaaaatacggtacatatgcacaatgcagtactataaaaaaagaataaaaaagaatgagatcctgtcatttgcaacaacatggatagaactagaggtcattattttaagtgaaataagccaagcacagaaaaacaaacttcacatgttctcacttatttgtgagggctaaaaattaaaagaattgagctcatggagttggagagtagaataatggttaccagaggctgagaagggtagtgggtgggggaagtggggatagttaatgggtacaaaattatagttagatagaatgtgtaagatctagtatttgacagcacaacagggtgactacagtcaacaataatttattatacatttataaataactaagagagtgtaatttgattgtttgtaacacaaaagataaatgcttgagaggatggataccccattccctgatgtgattgttatgcattatatgcctgtatcaaaatatctcacataccccataaatatatacacctactatgtacccataaaaattaaaaaataaaaagaagacggtcttgctagcagactggctctagagactttctcccttgtggctttggagaaattaagcatccgtgttgggaggcccctatggcaatgagctaaggacggcctctagaaggcaagggcagcccccagctgacagccagcaagaagccagggccacaatcctacaactgcaaggaagtggatcgtggcaccatgtgacttggaagtggacctttccccagtacagcctccagataaaaactcagccttggctgacacctcagttgtagccttgcataagatccaactaagccatacctgaattctcgacccatagacactgagaaaataaacgtgtgttgtttgaagccaccaaatttatagtaatttattatgtagcagaaaactaatacaattgatttaaaaatgtgaaagtagaaaaaaatttggaggaaattctttttaatttttatttatttttgagatggatcttgctctgtggcccaggctggagtgtggtggtaccatctcagctcactgtaacctccacctcctgggttcaagcaattctcctgccacagcctcccaagtagctgagatttcagcgcaccaccacacccagctaatttttttgtacttttagtagagacagggttttgccatgttggtcaggctggtcttgaattcatgacctcaaatgacccacccaccttgggctcccaaagtgctgggattacaggtgtgagccactgaacccagcctggagaaaattctaagtgaaaagtttaattgaaatgtgaatggggaaaaaaaagtattaaatatgaaagcattgaaaagaagcagaaaagtttaaaatattggacaatagacaaaagtacaacttctgaatgactatatataggaataaaaaataaggaaatatataattaatggtggtcttctaaatggtggacttattaatagtttaaacttataattttctgagttttccaaatgttctatgataagcatgtattacctttagcatattaaaaaaagtttacgtttttaaaagcaattctgcaaaatttgtcagaatcttctattcactgtaaaggcggtcacatgggagggttgtagatcccactgtgcccctggcagaccctcctgccacacatctcacctgacacataaaagcaaactaacctgctaggcagtttccccagggtctatatccaggtggatgtaatagccactttgattaccaacccccccatcccccgccacctgcatgttatgcctttgtggcctctggtctagtatctgattatctgctgatcaatagcagggcagaggcctcatcttggtcatttccttggcctcatcctgggccaggatctggcatgccgtgggcccatgtccaaattggagagaatgactgagattactgtggccttttagctgggcagattgccactcatggtcccaggatgggaagcatcactactgttttgcaagcatggtcatgtgcgcatccaaaccacctccctcctagtaccccaaggactcccccttctttaccactcccagaagaggctgggaagaaaggagaaagaaagggaggacaaaaatctttattgaatcaaataaccattctaaggggcctgcaaaaactcacttgcaggtgaagggcgccctggaggtgagtgtccatttgcctgaacagcctactctgggttccctgacaggggtcattcctaggggagggttcagctgtatatacccacagctcgctgtgccaaccctgatgacagctgttactgctgtgtttaaaatgtttatttttgtcctgtttctcctacttggctgtgagtatctggagacctgtaaatgtgtctcactcattgtcatatcctcaggacgcagcacagtaccaggcaaatagtaggcctacatgttaaataaatgaacaaatgcacatgtagctcacagtaacaacttgggggaaatgacatgtggacaggcccaggcttatgaaaacatgccaacctcaccatcctggggtttaggactctggctcagtgctgagcatgtcagactcccacctacatatatgttaaataaatgaacaaatgcacatgtagctcacagtgacaacttgggggaaatgacatgtggacaggcccaggcttatgaaaacatgccaacctcaccatcctggggtttaggactctggctcattgctgagcatgtcaagactcccacctacctgggtggctccccacccaggctgcttcatcttttcaaacattcctcccacttgctccttcctcccacctgaacaaaggaagtatacaaatattttttcaacgattgaacgcttccccatggtgctctttctccctctaacttctctctctccccctctaacttctctctctccaatctgctttgcccacaacactgataacaagctcagggtcacatggtccagtgtctctcctccttccacctgaagacctaaggtttggaagttacttttgataaggctagcatatttaattatacagactcagttgcctccacatgttgctgctgtcctttgactcctgattacagtcacagcacttggtggccctgcctacctcaccttgagcctctggggctcactctggccacaatggatcaaagaagccactgaaaaagataagtgccaccatccaaagactcccacgcacagtggacatggcagggatgctacagtctccaggggatatccctgctataaatctgtagaccccagccacctagccagaggttttgcttcaaggattggcagagtctttttataaaagggccagagaataactattctaggctttgtgggcaatacagtctgttgcaactagttaaccctgctgttgtagcacaaaagcagccataggtaatttgtaaatgaatgagcagggctgtgttccaacaaaactttattacaaaaacaggaataggccaaattcagcctatgggcagtagtttgccaatccctgtcctgcttaactgagtgggagagtgtggaaatcgtcatggtgtttgatgtccctgacaccttgaaaagctcagcacattatgcttcattttaggagaatctcctggaaccatctcaggagatgccagacagctaggaggctctgaacaccctgatactacaacttagttgagcctcatccttggctgtgtatctcttataacctttcaccttgggaatgacagtggccaccagcaccacccaagcccaagcagagactcacccccttatctttggcacagactggccaagcattgtcaagctttggaaagaagcacagaccacatctgggatgcatgttctcccatcagtacctgccactgttgggcccttcccttatcccaatcaactgtggttcttcacagccccagagttccaaggtggcagacaggactcttgtactagcagactggaggtcacagcttcataggagagtctcttcaacagtgaccaccagcactacaaggtctttgtgggcactggggtagcattggttatgtgggcagaccagccaccttccctgattcttcttttccaaaataggagctagagttcagccctgcctagggagggccaaaagaatactgtctagggagtttctggggaccagagtatctggggggtcatctcttaatctttacctgtttagagttggtcaggtagagcttggctgccaggttgatgacctgcagcttgacaatatcctcctctgctgtgaatgacttggccatttttcttaagacatcaggtgcaatcctggggacatgctcacagtactctccgatgagccacaggatgctggctcgggccatgggcacctgtggttgtgggagaggagtgaagatgggtaaatacgggaaagtgggtgggtaggattgtggacttccagggaaacagcactcctcatctgtgctggcctgttgtattatgggttctctggaaatgggagttgggggtggtgagatagagagaggttaaaaggtagacatttcctagacagcatttcccctcttccctagggcttcattagcatagagctttcaagaccctaagtcagtcatgatgtaaaagattgattttctggattcattgtaccctcagtactttatttccatgttactctccagaatctttgggaatgccttgtttagatgtttcagcttagcagtgcgatagaaaaacacaagatttgtcactcaaccatggttggctagagctttagagagaaaacaagagtagtagtaaagtccatcgtgctcattgagggtctccaaagggaaagcaaatcaggggtaacaaggtcagggtcacatggtccagtgtctctgctccttccacctgaagacctaaggtttggaagttacttttgataaggctagcatatgtaattatacagtcttgaaatcatggggaggaccttgaagtggggagtgaaaatatggcttctccctcacctggatgttgtctgtaagctttgccaagtgtttgatgatctctccatgttgtgctggctgcatctgtagcaatttcttaatgacgaccactgactctgcaaccacaagctctacagaacaaaaatgagtgtgtggaccccaagacagtcagatggccacactcaggtggacagacacacctgcagtgccccaggcccttggctctttctctcaacccccttcagttctctagcagccctcagaggtgtaggaacacttgggccctgatcaagacagacagaccaatggatacacattgtgtctaggcagactggtggatatccagtggccagcagagtcagacctgcaggcagacaccctctgatcatcacggttagacactcagggaaacactgaccatcacggttggacagcagctgcaccaggccattgaggcaggtgtcacggactcggccgatgttagttgcacagcgtccaatggcctggattgtggctgccacaaagtccttgtccatgctgcgaatataggtctgtgggatatgacaaagaaatccctcagtgactctgcaggcttgagggtgaccttcaagaaggctgtggcctttcattttatggcttatcatgccggtgactaagacttgggaaagggggtgacaactccacccccaatccagtgattccttggcccaaagccagccaaacacattggaacgggaatgtaagataatagtttctccagccttgggctcataagaggaggtttacccaccagggcacaaggatctgatgggcccctctcccaggcccttctggctgggagctggcctgtacctggaattcccgtaggacagtaggaatgttggtctcattggccaggttggtcagcacttccagctgcagggagggttggagaggcagaaaatgggtgggttggccagtggactttctgtgctttcattccaaatacacttcatagaccagaaaacaatcctcatgacagccctgcatcatcctcacactgatgagggaattgacaggttatgaaacttgtctaaaaagcaagaggaccagtttgcctcttaagtggattccctacacagtatgcttacagtatgaccatgtcacctccctactgcattgaaaacttaaagcttcctattgctttcaggatggagaccatcgtattcaccatggtctgtaagtccctgaatgatctgcttgctgtctacctcccatctcccatcactgtcccccttgtcttccaggccccaatcccactccacttcctaacccagggtcttcgcagatgctgtttcctctgcgtggagcagttcttcccatttctgtccctgcataattcatgttcatctctcaggcttcagctcaagtctcatatcctccgggaaaacttccctggcaccagactagatgaggtctccctattttatgcccttatagctctccacactttcttccatattttgtaagtggacttttacatttgccttgtgattaactgcttaatgtctcctcctccccacatctgtaagctccacaaaggcagggtccctgattagtttgctcatcatgtacccctagaacatagtggatgttcacaagggttaggaagattaactgttgctgaaggaaatcactcaataatgaggcagcagagcaggaatcaaatggaggtatgggctcccgccactttccttgtccgtgaatgtttgcaggagagcctgagggggcaggtgtgtgggggccataacactgtgggtgggagagaaaagtgtgaaccttggagtcagcagaattatgtgacctggggcagttacctcccagagtctttttttctttttcttagattgagatggagtttcgctcttgtcacccaggctggagtgcaatggcacaatctcagctcactgcaacctctgtctcccaggttcaggcaattctctagcctcagcctctcgagtagctgggattacaggcacctgccaccacgcctggctaatttttgtatttttcgttgagacgaggttttgctatgttggccaggctggtcttgaactcctgacctcaggcgatctgcctgtctcggcctcccaaagtgctgggattaggcgtgagccactgtgcctggccagagtctatatttttataaaaggaatataatgtacacatcctgggattattatgaggtgatatcaggttacttcatttatgaagagtagcaggtgtataccaggtactaggcaaagagcagttcccttctccccctgaccctccttagcccagctccctgaacaaacagctccagctggggcagtcatgggctcctgggctcagccccaggaataggcaggcaccaggggggccactgtgagttatttgagtgggtacatggggtggggagggctgggaagcacatgcacttctgtccctcactcaccttcaggatcttaattgggtggggtcggtggacctgatgtagaagctcttcaggtagggctcaaacataccctggcacaagagaggcagctagggagctccaccgaagccccaggcctgcctcgctgcccagagacacccctcctatcctgacccagcgcccaggatccttgcctcctcaccactgccctccactcctcaagtcttccctcgtccatctcagatctgactagctctttttccactggacatcccctcagcggcccctcaggatccaggccctgctccctatctgtatttggagcctcccctgccccatcctctgcacagccagggtattcctccatcttccctttccccggccccggtcccagccccgacaacgcctccagtgcccgcagaagcggccctcggacagcgaggacagcccgccgtcgcaggctcacccggcgcttgatggacatggtggccacgttctggagcacaacgtactgcacctcactgcggagaggacgggtcagagcaccccgggcccctcggttggggcaagggtcagcggatgaggggaaaaggtggggcaagtcgttgcggggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcgcagcaggcgcaccagcgccttggcgatgacgcccacttccgccttgggcgccaggtggaagtagagctgcgccaccgccatcaccaccgcggcgctgcggctctgcagcaggggtttggtgttgcgcagcagcagccggtggtcggggtccatgacatagggctttcgggagggggcggccgcggcggccgtctcctcagaccccgcgcccttggcctcgtcctcctctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactgcgtgcgggcgtagcgggtgagcatgctgatgatgaccacctggccccactcctccacgtcgatcagcaggttacagagtttccggtagtttttgtgaatcaggtcgatgcgctccgggcagacctcctcaaaggccatcaccacactgcccgccaccagctggggaaagaacaaagacgagagggtgaacgcgaagggtggaaggccggctgccggtcaccacccctcccggagcgcccctatacacgcaccgtggtcttgtcagccagaagcttctcaatgacttctatcagctgatccttctggtcagagtccaaactgagggagaaatcggtgaggggaatttgccactctcagccccagccttcccaatatctgtccaagccatgctcacctcctgcaccccagccttattgttctcctccatctctgtcagtcccccaaactaccctcctcaaaccctctgagaagcagcaggcaagacttaggaaaggccaggggtgggttgagaacttaggaaccagcctcctggggagcgtgggacagggctggggcatacctgtagagtttagggatggcgtgggcagctgttttccgcacatagggtgacatgtccgaggcggcttccttgatagctagcatcatgatgggcactatgatgggcacacggatgctagagaggacacggagggcactggcacgaatcagctggttgggatcctaaaggcagaggtggaggcagagctatgaaagggcaccaggtgccctgatggggggaggccacacctttggaagtcactgtccccagcgaccactagctcttgcttccctgccgcttgactggagcctggatggtgtgccagtgatgggtatctgggggacacttaattttggctctggttgcagaaatctgacacctgaacaggtgttgcaatgggtagcttcacttccagaaacactgaaaaactttcagaacacctaaaattgctgaaacacctgaaacacttcctgttccttgtaagggtttttttggaggtgcctgttttaatgcctgaggtgaccgcccagcagatgcaagctggtctcccttccggagttcaaccttacactcctttctcccagaaatcattgcaaaagctgctgttcttccacagtgtttaaaacaaaataggggtgtaggcccttcctttttttttttttttttttttttgagatggagtctcgctctgtcgccaggctggagtgcggtggtgcaatctcggctcactgcaacctccacctcctgggttcaagcgattctcctgcctcagcctcccaagtagctgggactacaggcgcgcaccaccacacccagctaattttttgtatttttagtagagattaggtttcgccgtgttggccaggctggtctcgaactcctggccgcaagtgatccgcccacctcggcctcccaaagtactgggattacagacgtgagccaccacgcccggccccaagcccttcttctttattcctactgcatcctatacagaacgtataaaagcattccttacactgtattgtgatcatggggcttaggactgtcttcccactatcagcagcagcagctatatattacaggcatacctcggagatattgtgggtttgattctagacctcaacaataaagcaaatatcgcactaaaacgagtcacataaattttttgtttcctggtgcatacaagttatgcttatagttacagctgcttgggaagctgaagtgggagaatcacttgagcccagggagttggaggctgaagtgagctacatatgttcatgccactgcactccagactgagcaacagagtgagatcctatctccaaaaaaaaaaaaaaagttatgtttacaatatactgtagtctactaagcatgcaatagcattatgtctttaaaaaaacaatgtaggctgggcgtgatggcttgtgcctgtaatcccaacactttgggaggctgaggtaggaggattgcttgagcctaggagttcaagaccagcctgggcaacatagggagaccccagtctctacaaaaaaaaaaaaaattgaagtcagtcctcttaaactctgcctctgctttatcaactaagtttatgtaatattctaaatcctttgttgtcatttcaacaatgttcacagcatctgcaccaggagtttttttttttttttttttttttttttttgtaacggagtctcgctctgtcgcccaggctggaatgcagtggcgagatctcgggtcactgcaagctccacctcccaggttcacgccattctcctgcctcagcctcccgagtagctgggactacaggtgcccgccaccatgcctggctaatttttctgtttttagtagagacggggtttcactgtgttagccaggatggtctcgatctcctgacctcgtgatccacccacctcggccacccaaaatgctgggattacaggcgtgagccactgcacccggcagattccattttaagaaaggactttctttgttcactcataagaagcaagtcctcatccattcaagttttatcatgagattgcagcaattcagtcacatcttcaggctccacttttaattctacttctacttctaggtagaattccaccacatatgtagttacttcctccactgaagtagtgaacccctcaaagtcatccatggagtttagaatcaacttcttccaaactcctgttaatgttaatattttgacctcctcccatgaatcatgaatgttcctaatggcatctataatggtaaacctttccagaaggtttctataaacctttccagaaggttttcaatttactttgtccagatccatgagaggaatcactatctatggcagctctagccttacgagatgtatttcttaaataataagacttaaaagtcaaaattactcattgatccataggctgcagaactgattttgtgttagcaggcatgaaatcattaatctccttgtacctctccatcagagctcttgagtgaacaaatgcattgtcaatgagcagtaatattatgaaaggaatctttaagcggtaggtatcaacagtgggcttaaaaaattcagtaaaccataactgcaaacagatgtgctgtcatggcactgttgttccatttatagagcacaggcagaggagatctgccataattcttaaggaccccaggattttcagaatggtcattgagcactggcctcaacttaaagtcactagctgcattggcccctaacaagagccagcctgttttttaaagccaggcattgacttctctctaggtaggaaagtgctagatggcatcttcttccagtaagaggctgtttcatttacattgagcatctcttgttgaacatagtcacatctatcaatgatcttagctagatcttctggacaacttgctgcagcttctccatcagcacttttgcttcaccttgcatttttttgttatggagatggcttctgtacttaaacttcatgaaccaacctccactagcttccgtcttttcttctgtagcttcctcacctctctcagccatcatagaattggagagatttaagacctgcctatgaattaggctttggcttaagggaatgtggtagctggtttgatcgtctatccagaccacttaaattttcctatatcagcaataatcctgtcttgctttctttatcattcatgtgtttactggagaagcacctcaaacttctgggttcaagtgatcctcccacctcagcctcccaagtagctaagactacaggtgcgtaccaccacatcaggctaacttaaaaaaattttttatagagacggtcttgaacccctggtctcaagtgatcctcctgcctcggcctcccaaagtgctgggattacaggtgtgagccaccacgcccagcctggagtagcacttttaatttccttcaagaacttttactttgcattcacaacttggctaaatgtttggagcaagtggcctagctttcagcctatcacagcttttaacataccttcctcactaagcctaaccatttctagcttttgatttaaagtgagagatgtgtggttcctcctttcacttgaacacttagaggccattgtagggttattaattgatctaatttcaatattgttgtgtctcagggaatgaagaggcccaaggtgaaggagatgggggaacagtcagaacacacacaacatttattgattaatttcactttcatgtctgagcatggtttgtggcaccccaaaacaattacaatagtaacatcaaagatcactgatcaccataacatataataatcattaaaaagtttggaatattgtgagaattaccagaatgtgacagaggcacaatgtgagcacatactgttggaaaaatggcactgatagacttgattgatgtagggttgccacaaaccctcaatttgtaaaaagtgcaatatctggcaatatctgcaaagtgcaatacaatgaggtgtgcctgtactattactcttagagaatgacgggaatagaacactaaagaagggtagatattaccctgactttctgaaatggaaaaagacaagacaagatcctcacaattgcaggtaaaattgatgctaattcctgacaaaattctggaattgacttttaaacagatgggttagaaacatttattgaaaaggaaggagtctctgttttcttagagacaaatagtcacatcatctgcttaaacctgttttccttttttgtgtgtgagcattttatttgggaaatgattatagattcacagaaagttatcaaaaaaaatgtgttttcctttttgatggggtaactaggccggtggatattagtatcttgatttcagtgatatgtttgtggaagtctcatagcatttcctgcattgctattttttaggtaggccttttgtttcacctaatagccaagcatttttaagagcagaattcacatctgttttatctctgtgtcacccacaaccctttgcacatgaaaggtgttatttatttatttatttattgctattgaataagatccttcctaacaagatagaaaaatgccagctgtctgtacagtcaggtgggtctacaacgtggtgaaatatacttggagaaggtttattaacagatcagtgtcaacctggaaacatgctatgcctcagtcttttgccctggtccaaatagcttatcagtatcttgaaagaagacacaaaatcaggagggacataattaagattcagaatcaccctggtttggaccctgtgctaaactgataaaatgaaatagagtagggtttcatagggggttcaagggaccaactgtacaaagacaggatgtagggagacctggattatctgcttgccagtcagaggtttgattccatgagggatctcctaagaaagtgaacacggccctagcctgggctaggattgaaagaagggagaaggctggattgaaatgattggttccaacatgcaggagagaccaaaagccagtgacaacaaaaaagaaaacaagttttaaaggaatacatatgtagtacgatgacaccatttacaaaacattttatattgcttaacaatatgcaaattactagcacaggaataaatacatacctatgaatgataaacaagagaagatatataggaggctttggctatttgagaaatgtgtcatttcttatggatattcattatattattctttatgccttttgtgaacctgtagtaaattttattttattttttagatacagggtctccctatgttgcccaggctggagtacagtggctattcacaggtgcagtcataatgcagtacagcctgaaatcaattttttttttttttgagatggatctcacactgtcgcctgggctggactgcagtggcacgttctcggctcattgcaacctctgcctcccgggttcaagccattctcctgcgtcagcctcctgagtagctgggattatgggcacccgccaccatgccaagctaattttttgtatttttagtagagatggagtttcaccatgttggccaggctggtcttgaactcctgaccttgtgatttgcctgcttcggcctcccaaagtgctgggattacaggcatgagccaccacacccagcctgaaatcaatttttaaaaattatagttgtggaggtttcaacaaaagagaatggtttaaaaaacaccccaaatagtggtagttgtcttgagatggagcaagttgccttatgaaggagtgaggtccctatcagaaaagatgacctgttagacatgttctagagcaaaggctggcatgctacagcccttggataaaatctgtctattgcctgttttttatatagatttattggaacacggccacgcccacttgtcaatggctgcatttgcaccataagggcaaaattgagtagttgcatagttgagactataaggcctacaaaacctaaaatactatttggcactttgcagaaagaaattatcacattgagttgaactaaatgagctctggttttctaaaagggggacagggtcagttggtagagactataggtgaaaatctgtacaacaatttcagattagtttttatacttaacccttactcaaaccaaaagattacttgccaatctaagacggattccatggttttgacttataaaaagaaatctagcacaatgtgtggcatagagacacccaagtatttactaaatgaatgaattgtatattcaagtgaccatgctttctactctcaccccaaagaagccgactgtcaacccctcttgctggccatagcagattggacaaggggtgggccctggatttgagcagcaatcctgtctacccagcaacctacagaacttctggatatgaaaagatgagctggacctttcacaatctctctcacagaaatttgaactaaaagtatccaggctaggagtattagctcatccctgtaatcccagcactttgggaagctgaggccacttgagcccaggagtccaagaccagcataggcaacagggtgaaaccccatctctacaaaaactacaaaaaaattagccgagcatggtgatgcaggctgagtagtcgcagctactcaggagacagaggtgggagaatcacctgagctcagggaagtcgaggctccagtgagccatgattgcaccactgcactccagcctgggcaacacagtgagaacctgtctcataaataaataaataaataaaggtatgcaaaaatagaggagttaatggttgtaatcagagctgaaaaatccaatatggagagaatggccttgaaatggctgtctttaccctcaagatgtcttagactaaccagaaaagcccttaggggggagacttatacatgcacctaacatatgtaaatccaactagaggccttgggcaaaatgaaacaaaaggtgagaatggtgtgggggattcaggccactgctaaaggttgaaatctacctggctgtggaccacaattcacacctttacacaaaggggggtgagggttgaggggttctccattgctagagactctccactctccgggggctcaagtggttcatactagaagcagccattaccacaggctcctgggaagagagacaggggccctgggtacccacttcatctcttacgccccttctgagcccagcttccactctctgagggtctggctggcctcttctgactgtgaccctcccaattttaggcaggtaggaaggggtctgcagagcccgctcccatgctcatggcctctccccaggcctactcctccgatacagcgccaacgaggcccaggccctgggaggcaaactgagacccctgacctttaggccacgttggaaggtggagatggacagcagggccaggtcttgctgctcctcagcgtagcgtaccaggtacacatagacaagcttcttcaccttggggagagcacgtttctcagcagaacgcttctcagcaggcacctgtgcccacccccctacccctgggatgtcatctccccagccagctgcggtccatggggacaaactctcccagtgggggagagcacccctgagtgtatccgggtcctttaccttgatccacatccagttcagggacatggagacagtgtcttctcctggctcagagacatttctcagcaggtcgggcccccaggggctaaatcatttccttcctcaccccaagcttgagtgtggtcctgggggaggtggggacaagcaatccctcaccaggtagtgctcacctctatgttcttacaggccacgttcttcaccaccgcgggaaacaggtctgaagcattctttcctcgggcaatcatctgggtggtggggtcaaggtaggggaagagggacaaagcgagaggcacagcactaactagagggaaggtctacaaggagctaaggagagctgctcttggccacccaggccccgcccggagggaggcctcctccttcccctcttaccgccacaatcctcttcatggcctccagcttgagagaatccttgttggtgtccagcatctccttcaggtcatcatgcctggtgggaggtacaagaagtcagctgagggcacaagggtggggatggggtattaatcaggagggtccaggcacaaagaagggacatggccaggggaggctcaggcaggacctgacccgaggagggaccagagccagggggaacaagtaaagtacagatcaggggaaacatgtggccagctaatattgtgggttgaactgtgtccttcctaaaaaggatatatttaagtcttaacccctagtacctcagaatgtaaccttatttggaaatagagttgttgcagatgtaattagttaaatgcaatcctactctaatagagtgggtctctaatcccatgtctggtttcccataagaagacagccatgtgggctgggtgtggcggctcacgcctgtaatcccagcactttgggaagctgagacgggaggatcacttgagccctggagttcgagaccagcctggcaacatggtgaaacaatgtgtctacaaaaaatagattaaattgaaattaaaaaaacacaaaaaacaaaagacagccacttaaagagacagacacagggagactaccatgtgaaggcagacgattggaaagatgcgtctacaagccagggaatgccagagactgccagcaaacaaccagaagctagaaggggcaaagaaggatttccctatgggtttcagagggagcatggtcctgccgacaccttgagttcagacttttggcctccagagctgtgagacaattcatttctgctgttccaaccaacccaattgttgtacttttttttttcaattactaaactttttttttttaattatacttttaagttctagggtacatgtgcacaacgtgcagctttgttacatatgtatacatgtgccatgttggtgtgctgcacccattaattcgtcatttacattaggtattcctcctaatgctatccctccctcctcccccaacgccacaacaggccccagtgtgtgatgttccccaccccgtgttcaagtgttctcattgttcaattcccacctatgagtgagaacctgcagtgtttggttttctgtccttgcagtagtttgctcagaatgatggtttccagcttcatccatgtccctacaaaggacacgaactcatccttttttatggttgcatagtattccatggtgtatatgtgccacattttcttcttctttttttttttttttttttttttttttgtgagatggagtctcgctctgtcgcccaggctggagtgcagtggcgcaatctcggctcactgcaagctccacctcctgggttcatgccattctcctgcctcagcctaccgagtagctgggactacaggtacccgccaccaccacgcccagctaattgtttgtatttttagtagagacggggtttcaccgtgttagccaggatggtctcgatctcctgacctcgtgatctacccgtcttggcctcccaaagtgctgggattacaggcatgagccacgctgggattacaggcatgagccaccgcacccagccatgccacatgttcttaatccagtctatcactgatggacatttgggttggttccaagtctttgctattgtgaacagtgctgcaataaacatacgtgtgcatgtgtctttatagtagaatgatttacaatcctttgggtatatacccaataacgggatcactgggtcaaatggtatttctagttctagatccttgaggaatcgccacactgtcttccacaatgggtgaactagtttacactcccaccaacagtgtaaaaatgtttctatttctccacatcctctccagcacctgttgtttcctgacttttaatgattgccattctaactggtgtgagatggtacctcattgtggttttgatttgcatttctctgatggccagtgatgatgagcatttttcttaaacgtttaaaacatatttttaagcagaatgggccaactcagtcacagtaactgttgatctccatagcagagcaacccacaaagacggaactgattttttacccatattcaggagtgaaaaatatacaacttgtttctgaaccaaaaccacaatttctgcagtttaaaatgtttcactgctaatatggccctggtagaaagtatgtagtttttttttcttctttaaaaaaaaaaaattaaaataatttcctaagacgctaaatcctcaatctggaatgcagattctgagcacaaagcagctcagttaacctaaaaaataaagaaaaaattcccatcacctgtctcagtagggcctgaaaggagagaagtggtgtggggaaccccggctttagtatggagagtcacggccccttgacccaaaccgagactgtgagtagccatagctggtgcttctctcaggataaactcagatgtaggaagtttcactatcatgagagtggaatttagtgtcatccaatttatgcagggcatattccatgtcttcttttctgagatactcaaccatccccacaccgtccttctgcacatcggcataacagacatccccaacttctcgcatgtgatccttcaggtcctgccagctgcctgaggaagtcctgaaacaagaactcggaaatcagatcttcttgcagaaggcccattcctcccaccacggggccacccaccccgacttcgtaagtcctggagaactccacacgaagccgacactggccataatcataactatttcttccataaatagcatcctctgcatctcgggggtcctcaaagcgcaccaaggcgaagggcacaaggcagtgcccattcttaagcttgatcttgcggatccggccgtacttgtagaaaaggtcttccacgtccttctcgcgcacgttggaaggctcaccacgcagatgcgctcatccgcccagcccaacatcggcacctcccaacgccccctccccgcaatccccccgcagcgtccccgcgggctctgaggcgctcagccgcactgcactgtgggaacgagaagcaattgtggtacttttgatacaggagtgtaggaaatgaatgtagccagaaacagagagccaggaaacaagaggaagggtttggggtgggaaagtatggacctggctcagggaaaaggactagttggatggataagaaggaccagcggaaaagaggtagatgccaaaacaagagcagggtgcccttgccctgcctccagtatgtttccaagtcctgacctctcagaccaaactgattccagggactggaagggtcccagagactccatagatggcctcacaacaaaagccagacctgtcactgaacattgaacagccattcaaggaagtcattaaactctagtgggatgaataaagatttgagtaagtgatcccttgcacttggctgagaggaataagggtaatgctgagccaatacacaggtttctttttttttttagatctcatacttcatttcaaaaatttgaaatttcaaagggaacattttgtcaaacttaagtgacagcaaaattcatctggaaaaaaaaaatcagtaggtaagaactccaaagaatatttttgggaaaagaaggaaacaatcatagacaactcaccctattggacttcaaaacataaacaccacgagacgatgataaaagctgtttggtaccaggttaaaaacagaaggtcaaaggtcatggggggaatttcataaaaggtctaacttgataaattacgaaccaataagaatctccccccgcccccacccccccgcccccgccccacttaaataaatgctattgggacaactgctttgcagcactttttttttttttagatggaattttgctctcattgcccaggctggagtgcaatggcacgatctcgggtcactgaaacctctgcctcctgggttcaagtgattctcctgcctcagcctcccaagtagctgggattacaggcatgcaccaccacgctcgggtaatttttgtatttttagtagagacagggtttcaccatgttggtcaggctggtctcaaactcctgacctcaagtgatcttcccgcctcatcctcccaaagcgctgagattacaggtgtgagccaccacacctggccagcagcaaataatttaacttgtatacatatttcaccccaaaataaatcccgcatttgcttaacagttaattatttttaaatacaaaagaaggaagggaagattttattaaggtcataaaattattagcagcaacaatatggctaggtttaattggtacgtttttgttttttgagacagagtttcgttcttgttgcccaggctggagtgcaatggtgccatctcagctcactgcaacctccacctcctgggttcaagcaattctcctgcctcagcctccagaatagctgggattacaggcatgcgccaccatgcccagctaatttttgtatttttagtagagatgaggtttctccatgttggtcaggctggtctcaaactcccgacctcagttgatccgcccacctcagcctcccaaagtgctgggattacaggtgtgagccactgcgcccaggcctttttttcgtttttctgtttgagacgaagtctcgctctgttgcccaggctggagtgcagtggcgcaatctcggctcactgcagcctcaacctcctgggttcaagtgattctcatgcctcagcctcctaaatagctgagattacaggtgtgcaccaccatgcctggcaaattttttgtatttttagtagagttggggtttcgccatgttgaccaggctggtctcaaactcctggactcaagtgatttgcctccttcggcctcccaaagtgctgggattacaagtgtgagccactgtgccaggcctaggtttaatttttaaactttggtatctaaaaactaaatttatgagaaaaataaggcaactatactagcttcctagaaccaccataacaaagaaccacaggccaggcatggtggctcacacttgtaatcccagcactttgggagactgaggcagaaggattgcttgagctcaggagttgggaccagcctggacaacatagtcagatcctgtttctacaaaaataaaaaaaattagccaggcatggtggcacatgcctgtagtcacagctactcaggaggctgaagtgggaggatcgcttgcaccaagatgttggaggctgcagtgagctatgattgtgctactgcactccagcctaggcaacagagcaagaacctgtctctaaaaaaaaaaaaaaacaagaagtactacagatggtggcttaaacaacataaatttatttgctcacagttctggaggctggaaggctgagattaaagtgtcagcagggttggtttcttctatagcctctttctttggcttgtagatgattcttgtgatattgtaaagaaatatatatttggtctctataccccatttctgagacagagctcctaaaactcttgacaatagggatgctaggagaacttctgttctaatatttggtcttccacccagttcctcacgcagagatcctaagacctttataacttcctgagtgagaggaacaactgacatggaaatcccttggaatttcctgggtgatagaagcatcttttgttatcagatggttggaactttttttctttctttctttttttttttttttttttgacactgagtcttgctctgtcgcccaggctggagtggtgcagtgaggcaatctcggctcactgcagcctccaccttctgggttgaagcaattctcctgcctcagccttccaaatagctgggactacagttgcccaccaccacacctggcaaatttttgtatttttaatagagatgggtttcatcatgttggtcaggctggtctcgaactcctgacctcaagtgatccacccgccttggcctccaaaagtgctgggattataggcgtgagctgctgtgcccagctgagggttgaaactttcaatcccactatttgacctctggggaatggggagtggggctgatggttgagttgatcacatggccaaagatgcgatcaatcatgaagccttcataaaaacccaagaggatagggtttcgagagcttccagactgtggaacatgtgaaggtgcctggagggtgtggtgcctggagagggcatgggagctctgcacccctccttccatacctctccctatgcatctcttcatctggtgtttgtctctaccctttataataaatgggtaaatataactaaagtttccctgagttctgtgagccactcacagagttgaacccaaggagggtggcatgggaacccctgatttatagccagttggtcagaagtatagctgacaacttaccacttggaattggcatctgaagcagagagcagtcttgtggcactgagcccttaacctaaaaaatctaacactagattgacttgaattagagaacacccagttagtgtctgctggagaacaggttgttggtggggagaaatctccacccatttttgtggccagaggtgaagcactctctggtgagcggtgtgtatgagagtaggagaaacacactttgggtttttctgtctcttacaaccatcttctctgtcttcacatggtcttccttctgcgtgcctatatccaaatttcctcttcttataaagaaatcagtcatattggattagggccccccttaataacctcattttaacttaatcacctcaaaggtaacattctgaggtactgggggctagaacttcaacatatgcattttggagggacacaattcagcccataatagcaacaaaaggaaaaatatttgggatatggtaaattaaagtttaatattcgaaatagaggccaggtgtggtggctcacgcttgtaattccagcacttttggaggccaaggtgggcagatcacttaaggtcaggagttcgagattagcctggccaacatggtgaaaccccatccctactaaaattacaaaaattagccgggcatggtggcacacacctgtaatcccagctactcaggaggctgaggaacgagaatcgcttgaacccaggaggcggagattgcagtgagccgagatcgcgccactgcactccagcctgggtgacagagtgagactccatctcaaaaaaatttaaaaaaggaactgatatacatgtataaggtctctttgcagcattcactgtcagggctgctacaagcccattttcaatctgcatgcccctacagatagacacagccctgagctgttgctccccattctgtgtgtggagcatgggctggtattccttggccagatgcccttgtgcagtgaacaatgtggctaaccatactcagaggatgcagaactggtgatcacgaagtgatcagagaattgttaataaacccatgaaaaaaatgtgtctatatatagctgatagaattgtgtgaaactgatgcactcatatgttgccaagacaattccaaaatgtggtgagcagctgtgtgtggggactcacacacactaatttcccagatgacactctgataacccacagctttgacccaggcacaagaacccagcttgagaaatatcacagtgataaaaattaaaaatcaggccgggcacggtggctcacgcctgtaatcccagcactttgggaggccaaggcaggcggatcacaaggccaggagatcgagaccatcctggctaacatggtgaaaccccgtctctactaaaaaatttaaaaaaaattagccgggtgtggtggcgggcgtctgtagtcctagctactcagtaggctgaggcaggagaatggcgtgaacccaggaggtggagcttgcagtgagccaagatcgcgccactgcactccagcctgggcaacagaacgagactccatctcaaaaataaaaaataaaaaaaaaatcaatgtgtgcaaagttagtcacagacatgcaacatttagaaatgacagaaaatcagaaattggggatagcactgttaggagaggaaagagcatgataacaatcataaagtggcaaatgactgctgctaatgctgagaaacaagtgatgaatgctgagaggaagagaagaaccagacagaacacgcaacttagtcacagggctgcagaaatgcgtgagtacctgacgtcagacaagaagaggggcactaagaagtcactatcccaagaatgttagaaactgtctttcccaaagagatttttgatggaaagcaaaatagaaagatgatgccttccagcattatctgaggccctcgctatctgtcatgtgaggacagaagaaaatatccagccccatcatgttatctgaaactccctcacctggggggatgccccccaaatcagaggacaccttctactcttccagggtcaggccagggccagaagacaatcaccctcttaccctgccaaacacagaccagactgttgagtttcttagtgggtaggaggctgagctcaggacaccaggggcatggtcataggtacagaccattgagctgggtaggcgtgggcagcaccgagggcctaggaaaaatgacagagctgggcaccagcttccctgagatatgaatgcacaacactccacgtcaggatccttcatacgcacaccccacagacaactacacattgataccacccacatatacctcagacactcccatgtcccccgacatacctacacctcacggacagctcatacaaacatacctacaggtcccgcagacactagtagaatccatacataaacccacgcacacccacaaaatcctgcctacacaacgcccagagaaacacactcccccacatacagacacctcccacagaaaaactctacacacataaaccacccacacaactcacctacacacctacaaaccccccagacatataccaccaggagacctctccccactctcccacaccctcttatagacacacatatcccatacatgtcccctacagacatatatcacaagacctctccccgctcccccacaccctcatagagacacacacaccccacacacgtccccctacacacacacacacatgccgcatcacatctaatacacagataacttggaccaaacttggcctctccagtctcattcaccaaaatggtcagtggactcctagttgagatttttgatgataaatgtaggcttctaagatcaaatatatccagccccaagggtcctctgatcttctgaggagtcaccctgggatggcttttccctgggcttccgtggaaggagggccaagtttgcccaatctcctttaactctgggtattcccttcctcaccacacccacaaatgccacatgcgcctgtcaaatgcacacaccccagggcatcctccccacccagcctagtgagtacattccaggcccctgcaggagaaggggaatgaaagggggcaggaccactgggcctaaagcagccagcacaggtaagattgactgtcgaatatgcactgacacagaatatgcactgacacagaccgcagccaccacctgaggtgagaccgccctgggcctctcgtcctcactcccaccaacttctgttcccaagaggcagaggcagggactaaggcacaacaccctaaggccatgaaacattatctcccatagtcagatccccttacgctgctgcactcactctgacctgacccctagtctgacctagcctaagggactcttctgggggtggctggagccagccagggggcctggcatggcactgggggtcagtcatgctcacctcccttgatatacacctcgctgtcacctcttaccacctaagttccagtccactggcaggcagtggctggccaaaccctgtctgtgctgtatcctgtccccaaacctcgtccagagcccactccagtgggggcctgtggggagaaagaggtcaaggtgggacctcaaccctcaaatattttactatcctcctcccctcagagcctccagggagttaagcccctcatctctcctcactcataccctcagcccccatacggtgcccctgaccaccttctccgcccagcctggaccctaaatgccagcctaagcctccatcagaggaggtgggaccggaagaggtctgggctgagagtgcaactgcccatccctggccttcctggctgtgtgggtagggggttcctgtgggttcctctataccgtagtggctggctctggctctggctggcctctgggcaaggtccttccagagatgcttctggggtcgtgtcttcctcctgggcctgcagccaccgaagctcctcaggctccaaggcctggtaccggagtgggggcccaccttcgggagccagcacagggctagcagcctcttgatcagctccgcaggcccctctgaccccaggcctcaccacggcccccgggagctgcaggaatcgctgcatcaggttcttctccaggaatggactgagctggccagggcgctggggctcctgtcacagtcaccagatggcccgcccccaaaacttggtaaccggacactggcagggagggatgctccggtttcctcttcactgctcagagacaaggcctctagagggaaagaagggcagggacaggagaccaagcctacccctagtctctgggcaagggactagatggtcagtggagttgatagagaggtgagagatgccctcttcagctccaatcccactgccacaattagactgcagcctcctgagaaatctcatataccctcttctcactgaccctaggcatcttaatcctcacctgcctttccagagccaatacttgatttattccttcccatcaaccttctcttatctctacttcctcctagcaccctcccccgcaacccctgtgtctatccctccaactgctctcacatccttggccctcttgtcccactggtctccaatgccactggcctgccagtggtgggtggcttttttttttttttttttcagatggagtttcactcttattgcccaggctggagtgtaatggcgtgatctcggctcactgcaacctccgtctcctgggttcaagcaattctcctgcctcagcctcccaagtagctgggattacaggcatacaccaccacacctggctaatttttgtatttttagtagagacggggtttctccatgttggtcaggctggtctcaaactcccaaccttaggtgatatgcctgcctcagcctcccaaagtgctaggattacaggcgtgagccaccgcgcctggcctggttggctttcttcattgtatttgaaacccctttgaccctcaagtccccattcccagccttgcccttatggcttcaccacctggttcccgaaaaagggaaagtctttagatgaaatcccctgcagccccctgccccagactcccatccatctgcatttatttacttatttatttatttagagatggagtctcactccgttgcccaggctggagtgcagtggtgccatctcggctcactgtaatctccacctcccgggttcatgtgattctcctgcctcagcctcctgagtagctgggattatagacatgcgttaccacaactggctaatttttgtatttttagtagagacggggttttgacatgttggccaggttagtcttgaactcttgatttcaagtgacctgcccgcctcagcctcccaaagtgctgggattacaggcatgagccactgtacccagtctccatctgcatttatactctcctctcctcctgccctcttccctctgggcagagttggtcctccctgctcccaggctagtcctcccacccagctcagtaagcctcccctcccatcactcagtgttctgtacttcctttcttcccttcagcctctctcccaccaatcgctccttcccatcagcagttaaacttgctctaggctctcccgcctaatattaataataaacaaaaatatggagtcatacattttaagaaacaaaaaaaaaaacccaaaataacaaaatagacaaacttccttgaactgagtgaggttctcctccagcagctttctcttttacagtcaaatttcttgaaagcaaaatttccattcactgttttatctacttaccacctgtgtgctcctttattcattttaatctggctttagatgtcgacttagaatgtggggttgaagggtcatgatctctgcaacttaacatggttcaaccaaaaaaagtatacgaatagatggttagataaagcaaataaggtacgatgtcaatgacagttgaatctagatggatgatatacatgtgttcattgtattattcatttcatttttctgtatgttttaaatcatccacaacagaatgctgggaaagaaataatctagctcctgttctccttactttgccagaatttatctcccagggcaggaggtggggaatagagtagaaaggaattgagctcttctttgtcaaccaatggtcatgatttttttccttgtttgatttgaccttaatgggcattgaaactactgaccactccctccttcttgaaattacattgttttctttcagcctttagttcacctcttgggtaccttgaaacactttccactgttctctggtcacttctaatgttggtgtcttcagggttcagacttgtgcagtgtctgaactcattttatacctcctccctgagttatcttcacttctgtggctttaattaacatacatatgttaataattccctaatctctctcctggaacccaaatcgtaatatccagctacctaatagggtaatatgtccctcagagtttacaatctcaatatgtccaaagctgggctcaacattaattttccacaaatttgcttgtaacatctttatttccaattacactgaataacaccatcatccatccagttgcaggaactagtaacctgagtaacatccttgtcaggcctctgagcccaagctaaaccatcatatcccctgtgacctgcacgtatatatccagatggcctgaagtaattgaagaatcacaaaagaagtgaaaatggcctgttcctgccttaactgatgacattaccttgtgaaattccttctcctggctcatcctggctcaaaagctcccccactgagcaccttgtgtcccccgcccctgcccaccaaggaacacccccctttgactgtaattgtccactacctacccaaatcctataaaatggccccacccctatctcctttcgttgactcttttttcagactcagccggcctgcaaccaggtgattaaaaagctttattgctcacacaaagcctgttgggtggtctcttcacatggacgtgcgtgaaatttggtgccatgactcggatcgggggaccacccttggaagatcaatcccctgtcctcctgctctttgcttcatgataaagatccacctaatgacctcgggtcctcagaccaaccagcctgaggaacatctcaccaattttaaatcaggtaagcggcctctttttactctcttctccaacctctctcactatccctcaacctctttctcctttcaatcttggtgccatctttcaatctctcccttctcttaatttcggttcctttccttttctggtagagacaggaaatgcattttatctgtgaacccaaaactccggcgccgatcacggactcaggaagacagtcttcccttggtgtttaatcactgcggggacgcctgcttgattattcacccacgtttcagagttgtctgatcaccgcgaggatgcctgccttgatctttcacccttagtggcaaacaccactttttggggggcaagtaccccccaccccttctctccatgtttctaccctctcttttctctccacgttcctgggggacaagcacccccgactccttctctctgtgtctctaccctctcttttctctccactttcctggggggcaaagcaccccccaccccttctctccgtgtctctaccctctcttttctctgggcttgcctccttcactgtgggcaacattccaccctccattcctccttcttctctcttagcctgtgttctcaagaacttaaaacctcttcaactcacacctgacctaaaacctaaatgccttattttctttgcaatgccgcttaaccccaatacaaactcaacaatggttccaaatagccagaaaacggcactttcgatttttccatcctacaagatctagataattcttgttgtaaaatgggcaaacagtctgaggtgcctgatgtccaggcattcttttacacatcggtccctccctagtctctgttcccaatgcgactcatcccaaatcctccttctttccctcccgcctgtcccctcagtcccaaccccaagcgtcgctgcgtcttttcaatcttccaatcttccttttctaccgacccatctgacctctcacctaatccccagaatgctcctcaggtcactccccaccaggctgaatcagactccaattctttctcagcttctgctcctccaccctataatccttctatcacctcctctccccacacccagtccggcttacagttttgttctgcgactagccctccccaacctgcccaacaatttcctcttaaagaggtggctggagctaaaggcatagtcaaggttaacgctccttttcctttatccgacctctgccaaatcagttagtatttaggctctttttcatcaaatataaaaacccagcccagttcatggctcgttgggcagcaaccctgagacgctttacagccctagaccctaaaaggtcaaaaggcagtcttattctcaatatacattttattacccaatccactcccaacattaaataaaactccaaaaattaaattccggccctcaaaccccataacaggacttaattaacctcgccttcaaggtgtacaataatagagtaaaggcagccaagtagcaatgtatttctgagttgtagttccttgcctccactgtgagagaaaccccagccacatctccagtacacaagaacttcaaaatgcctaagctgcagcagtcaagcattcctacaggaccttctccatcaggatcttgcttcaagtgccagaaatctggccactgggccaaggaatgcccacagcccaggattcttcctaagccttgtcccatctgtgtggaaccccactggaaatcggactgtccaactcacctggcagccactcccagagcccctggaactctggcccaaggctgcctgactgactccttcccaaatcttctcggcttagcagctgaagactgacactgcccaatcgccttggaagcttcctggaccatcacagatgctttgggtaactcttacagtggagggtaagtccgtccccttcttaatcaatacggaggctaccaactccacattaccttcttttcaaaggcctgtttcctttgcctccataactgttgtgggtattgatggccaggcttctaaacctctcaaaactccccaactctgaggccaacttggacaatactcttttatgcactccttttcagttatccccacctgcgcagttcccttattaggccgagacactttaaattatctgcttccctgactattcctaggctacagccacacctcattgccaccttttcccccagttcaaagcctccttcacatcctccccttgtatctccccaccttaatcctcaagtataggacacctctattccctccttggcgactgatcatgcaccccttaccatcccattaaaacctaatcacccttaccgtgctcaatgtcaatatcccatcccccagcaggctttaaaaggattaaagcctgttatcactcgcctgttacagcatggccttttaaagcctataaactctccttacaattcccccattttacctgttcaaaaaccagacaagtcttacaattagttcaggatctgtgccttgtcagccaaattgttttgcctatccaccccgtggtgccaaactcatatactctcctcctcaatacctccctccacaacccctccacaacccatcattctcttctggatttcaaacatgctttctttactattcatttgcacccttcatctcagcctctcttcgctttcacttggactgtccctgacacccatcaggctcagcaaactacctaggctgtactgccgcaaggcttcacggacagcccccattacttcagtcaagcccaaatttcttcctcatccattacctatcttggcatagttctcatgaaaacacacgtgctctccctgctgatcatgtccggctaatctcccgaaccccaatcccttctacaaagcaacaactcctttcctttcaagggatggttaggtacttccacctttggatacctagttttaccatcctgactaaaccattatataaactcacaaaagcaaacctagctgaccccacagatcctaaatccttttgccactcctttccattccttaaaaacagccgtagaagctgctctcacactaggtctccctaattcatcccaaccctttttcatcacacacagccaaagtgcagggctgtgcggttggaattcttacacaagagctgggaccacgccctgtagcctttctgtccgaacaacttgaccttactgttttggcctagccctcatgtctgcgtgcagcggctgccgctgctttaatactttcagaggccctcaaaatcacaaactatgctcaactcactctctacagttctcataacttccaaaatctattttcttcctcacacctgacgcatatactttctgcccccctccactacctctcagaaagcttaactcattgccttaactcgagccctcagtcttgcaaaaggactatgtgtcaatatttatactgactctaaatatgccttccatatcctgtacctccatgctgttatatgggcaaaaagctttcctcattacacaagggtcctccatcattaattcctctttaataaaaactcttctcaaggccgctttacttccaaaggaagctggagtcattcactgcaagggccatcaaaaggcatcagatcccatcgctcagggcaacacttatgctgataaggtagctaaaaaagcagctagcattccaacttctgtccctcatggccagtttttctccttctcatcagtcactcctacctactcccccaatgaaacttacacctatgaatctcttcccacacaaggcaaatggttctcagaccaaggaaaatatctccttctagcctcacaggcccattctattctttcgtcatttcataacctcttccatgtaggttacaagccgctagcctgcctcttagaacctctcatttcctttccattgtggaaatctatcctcaaggaaatcacttctcagtgttccatctgctattctactactcctcagggattgttcaggccccctcccttccctacacatcaagcctggggatttgcctctgcccaggactggcaaattgactttactcacatgccccgagtcaggaaactaaaatacgtcttggtctgggtagatactttcactggatgggtagaggcctttcccacagggtctgagaaggccactgcggtcatttcttcccttctgtcagacataattcctcagtttggccttcccgcctctatatagtccaataacagaccagcctttactggtcaaatcacccaagcagtttctcaggctcctggtattcagtgaaaccttcataccccttaccatcctcaatcttcagaaaaggtagaacggactaatggtcttttaaaaacacacctcaccaagctcagccaccaacttaaaaaggactgacaatacttttaccacttgcccttctcagaatttgggcctgtcctcggaatgctgcagggtacagcccattcaagctcctgtatagatgctcctttttattaggccccagtctcattccagacaccagaccaacttggactgtgccccagaaaacttgtcatccctactatcttctgactagtcatactcctattcaccatactcaactactcatacatgccctgctcttgtttacactgccggtttacactgtttctccaaaccattacagctgatatctcctggtgctatccccaaactgccagtcttaactccctcttaaagtaaataaataatctttgctggcagggctatgctgaacctccttgggcactctctaattggatgtcctgggtcctcccaattcttagtcctttaatacctgtttttctccttctcttattccatttagtttttcaattcatacaaaaccgtatccaggccatcaccaataatcctatacaacaaatgtttcttctaacaaccccacaatatcatcccttaccacagaatctgccttcagcttaatctctcccactctaggttcccacgccaccccaatcccgctcgaagcagcccttcaaggctatggagaagcagtatctctccataccaccccccgccaaaatgtttgctgccccaacacttcaacactattttatgttatttttcttattaataaaagaagacaggaatgtcaggcctctgagcccaagctaagccatgatatcccctgtgacctgcacgtatacatccagatggcctgaagtaactgaagagtgaaaatggcctgtgcctgccttaactgatgacattatcttgtgaaattccttctcctggctcatcctggctcaaaagctcccccactgagcaccttgtgtccccccaccgccagagaacaaccccctttgactgtaattttccactacctacccaaatcctgtaaaacggtcccaccccatttcccttcgctgactcttttttcggactcagctggcctgcacccaagtgattaaaaagctttattgttcaaagcctgtttggtggtctcttcacatggacgtgcgtgaaaatcctcatcttctccccctgtccctctaaacccccacccaatatccaattaatcatcaggtctgaggcttccacctcttccacagcctcaaatcttctgcctctcccctggtctaggccacaatcatgccaggcctgtgaacttcaagacccacctcccttgtctcttgttcaatctggcccacctccaatctcttctccacaatgcagcagcctgacgtccttctaaaatataaatctgattatgtcgcctgcttagaatccttcaggagtcctccccaccctcttttctggtcagtccagtggctcacacagattgtggcctggctctcaaccttcctgaaagccctttcctctgcctggaacatacctcacgctcctgtcttccttctctccggcgccagagactaggtcctctccctgctcccactgcccccattacactcgactgtccctgactgcttcttcatctgtgctcccctctagagcatcgtgaggacaagaagggtctcatgttcacagttgtattccgtgactagttcaggactcgacacagttggcttttcataaatgcttgttgcagaatttacgaataaacaaatgaagaaacaaacgaacgaatcaaaggtgggggagggtgtgaaggtggagctgaactacaggggcaatgccaggagcagggatgtgagggtcagatggagatggggaccagagggaggggaaatgaatttgcagcagggccaagctgggaggctgtgcaagtacatccagggcccgccttcctgaagaggccccaggctcaagctcaagttcgctgactcagacccctcccccacatttttgggaagccaacccgcctagcacgaaaaaggaagggaacccctaacgcaacgccgcaaaccggagaaacacctggaaccggagggtttctcctctcgaaactgagctggcccatcccccgccagcccctatctgcccccctccgcgtcctaggccggcccctggagccggggtgccagcgctgcccgcgctgggccggggctccaggccgcaggagggggccgggcgggcttccggtcggcgcggccggggcggggccggcgctggggccgggcgctgtccatggtgcccgcgcgcctcgcccggtccccggccccaaccctcccgcgagcttcctggcgggctccctcaccgcttgtagtcggaggagaagatgccgccgctcgcggggtcgtggccgtactcgggctccccggggccagcggagccgcccttgtcttcgctgtaggcgggggcggccgacatggggcggccagggagacttcgccgaggaggaggttgcggggccggaggccggctggagcggaggaagggaaggcgggccggtccggtccgggctggcgaaggcggcggcgcggcaggggttcagcagaggctgcagtgtgcagcggcggaggctgcgcgcggatttctcaatcaggg

SEQ ID NO: 1528 - DNA, 50570 bp, Homo sapiens
  source 1..50570: mol_type = genomic DNA
tggaaatgcctgttttacaactttattggatcatcttgacacaaaatcatgacagcagcgtgatatgtctctctctttatacgggaatgtcgatagcaaataaattcttatgtaacacatcatacaatttcaaatcctggaatcactgcatgggattctgtaatggattacatgctaaagtgacagttttcatcaaaaggagaagataaaatgtcattatctctgaagaagggtcagtcctgtgcccacgctggccgtggggagtgagcggagtctccttgccctgcctggtgggggctctgcctgtgaggtggctctcacaggtcctgcccaagggcactgggcacactccttcaacacagaacagcccaggtccgctgcttccaggccctgcctgggccttcctaagggtgctgggaaggatgtggggaaaccttggtgcgcatagtggcaagcaggggatgcggaccaccccaaacccaagccgagatgcacttctgctgaccaggaagacgggtggcagagaggcctcaacccaccccgtccacggttctgactgcaacctctctttggcgtccctggccccgccctgcccacagcctggctggcgcgtggcctgggatcccaagacccagtcaccagcccacgagcacactgacaatggacaacgcctggcaagaccgctttcccactgtgggttctgggagagaaaaccttggcgacagcggcccttccttcccctcccccggacgcaaccgtcaggacctttgggtcaaaagcaggcgaccccagaggaggccacgtcagccccgccctgtccaccaagtgcccctcacgtggtgcccatcaggccctggcccaggacaggagcccctgaagccacattcaaggactcggcccccagcgcggggcagggcacagacccaggtgggggagtcccttgctggtttgggggcgagaaggggacttcttgccaaagagaatgggaagagtcacagtaaaaaaggatggtcagataattcaacgcaacaaatgacctcggatgtctacacggcggacaacatagagttaaattaacactcaggcttgggtacagtacacacgactgaggagaggcgagacacgtcagggctgcggtccctgggtacgtgctccgcggggtggtgcggggctcgcaggcagctctcaacacttggccagcgtcgccttcatctcttctaacaagttgctcagtagcgtggagtcactgcacttcccgtcgactgagacagagttctcaccctgtgtaaggaaaaaagatggatattttaaaagtgtgtgcaggggctaggcacggtggctcaagtctgtgatcccagcattttgggaggccaaggtgggtggatcacctgaggtcaggagttcaaaaccagcctggtcaacacggtgaaaccctgtctctactaaaaatacaaaaaatggccgggtgcggtggctcacgcctgtaatcccagcactttaggaggctgaggcaggcagatcaccaggtcaggatattgagaccatcctggctaacagggtgaaaccccgtctctactaaaaatataaaaaattagccaggcagggtggcgggtgcctgtagtcccagctacatgggaggctgaggcaggagaatggcgtgaacccgggaggtggaccttgcagtgagccgagatcgcgccactgcactccagcctgggcgacacagcgagactgtctcaaaaaataaataaataaataaataaataaataaataaataaataaataaataaataaaataaaaataaaaaatgtgccgggcatcgtggcaggacacctgtaatcccagctacttgggaggctgaagcaggagactctcttgaacccagggggtggaggttgcatgtgagttgagatcattccaccacactccagcctgggcaacaagagcaaaactccatctcaaaaataaataaataaaagtacatgcaggccaggccggatggctcatgcctgtggtcccagctatgcgggaggctgaggcgggagggtcgcttgagcccaggagggtgaagttgcagtgagccgtgtttgcaccactgcacaccagcctgggcgataagagtgagttcctacctcaaaaaaattaaaaaacaaacaaaaaaacactatgtgcaaatattgcctcgcagctgtatgtgttgtccttttaattttgcgaatttgctaattattaaaaaaaaaaatgggaagggctcgggtgagggagcggcccaaggcacctgggtctcccgtgggaggggctccagcctacatagaagtgggagccggcacctgagggccctgaggcagccagaggcagccggggatgaagaccagaatccgaagagctcctgagctagcagacagttgagcactgtctgtccttccgccctcctgccactgggcccctgaagtgactgtggaagaagccagtggagtggggtaaccagagcccccagagagggaggtacgcggggaaagccaccccgtgaagctgctcacgatctgctaggctcactccatgctgcggatcccgttccaaagagcaaccgaaggcactgagtccagaggccgctgccgggtcccaaggccagggacaagaggcagcactgacaggagaggctgggcaggtggtggtgtgcttggggccacagtccccagaaggcaggggggacttgcagctgggacctgaccacccacgtcctccacaggatggaacaaggcccagaggctcacagcactccacggaaaacgaccaggagaatccactcatacagagaggccctcggcagaccccagtgccaagaccccagtgccaaggcaccaacaccaagacaccagtgctaaggcactaatggcaaggccgtcggtagaccccaatgccaagatcacatcacccagatgccaacaccaaggcaccaatgccaaggccatcagcagaccaaacaccaagacactaacacccagaccctaatgctgaagcaccaatgccaagaccccacgctcaagaccccaacaccaaggccgtgagcagacaccaacaccaagacaccaacacccagaccccaacgccgaggcaccaactccaagacgccaacactcagaccccaacgccaagacaccaacactcagactccaacaccgagacaccaacgctgagaccgcaacaccgagacaccaacactgagactccaacaccgagatgccgaaacccagaccccaacaccgaggcaccaactccaagacgccaacacccagaccccaacgccaagacaccaacacgcagaccccaacacccagaccccaatgccgagaccgcaacactgagacgccaacacccagaccccaacgccaaggcaccaactccaagacgccaacacccagaccccaatgccgaggcaccaactccaagatgccaacacccagaccccaacgccaagacaccaatgcccagaccccaacaccaagacaccaatgcccagaccccaatgccaagacaccaacacccagaccccaacgccaagacaccaatgccaaggccattggcagaaaccaacacgaagaccccaacgtgcagaccccaacaccaaggccatcagcgtaccaaggtggacggacactaggactctctgacacaagtttttttttttttttttttttttggagtctcactctgttgcccaggctagagtacagtggcacaatcagggctcaccgtagccttaaactcctgggctcaagagatcctcccaccccagcctcccaagtagcagggactacaggctcactgtactaatttcttagtactggctaatttttttaattttttgtagacctggggtcttgccatgttcccaggctgatcttgacctccagggctcaagcgatcctcctgcctcagcctcccaagtagctgggaccacagtcacacaccaccatgcccagctggcctaagctttaaagtagctgttaggaaaatgctccaacagatcaccagggcatcagcaaagacatggaagatacaagaagggcccagtgggaatttcagacctgaaaaataagaccctccctgtgtgggctcaatggcagaacagctaggacgaggcagactggtgagcttggcaagagagcaacagccatgaacccatctgaatacggcctctggggcgtgaggggcagcagcccaggctggggaggtgttgggagcaggccccccaaaatctggccataaactgaccccaaaactggccataaacaaaatctctgcagcactgtgacatgttcataatggccctaacgcccacgctggaaggttgtgggttgatgggaatgagggcaaggaacacctggctggcccagggtggaaaaccacttaaaggcattcttaagccacaaacaatagcatgagcgagctgtgtcttcagggcgtgttcctgctgcagttaactagcccaacctattcctttaattcggcccatccattcgtttcccgtaggggatacttttagttaatttaatatctatagaaacaatgctaatgactggcttgctgttaataaatgtgggtaaatctctgttcggggctctcagctctgaagactgtgagatccctgatttcccacttcacacctctgtatttctgtgtgagtgtctttaattcctctagcgccactgggttagggtctccctgaccaagctggtctcggcagggaggaagtgtgcagcacccaaaaagcagcaacagatcagctccagccgcctcaggcccagcagaatggctgccgtcagccgggcgcgggggctcgtgcttctaataccagcactttgggagtctgaggcaggcggatcaggagtttgagaccagcctgaccaacatggtgaaaccctggaaaccccgtctctactaaagagacaaaaagattatccaggcgtggtcgtgggcacctgtaatcccaactactcaggaggctgaggcaggagaatcgcttgaacccgggaggagctgcagtgagctgagatcgcaccactgcactccagcctgggcgacagagcgagactccatctcaaaaaaaaagaatggctgctgtcagcacgatgacgacaggtgaagaaacagggcctcctgcacggcagcaggcgggaaacaaagtgcagcactggggaagacagtctggcagctcctcaaaacctcaaacgtggcattaccacaggacccagcaatcacactcccgggtgtatattcagaacaaatgggctcactcctgcaatcccagcactttgggaggccgaggcaggcagatcacccggggtcaggagttccacatcagtctggccaacctggcaaaaccccatctctactaaaaatacaaaaattagtggggcgaggtggcatgtgcctgtaatcccagctactcaggaggctgaggcagaagaactgcttgaacctgggaggcggaggttgtggtgagcccttggctccactgtactctagcctgggtaacagaacaagactctgtttccaaaacaaaaaaataaaaaaaaacaaaagtactgaaggcagggactccaacagttatttgtttaacaacaatgttgatagcagcacaattcacaacagccagaaggtgggagcagcgatggatgagtggacacacagcatggtccatctgtacaacaaaatatgattctgctgtgaaaaggaagggaatcctgacagaggctgcgatgtggatgcaccttaaggacatgaggtgtaataacagcagccagacacagaaggatacattccgtgtggttccactcctaggaggtccctagagccatcagattcacaaagacacaaagtagaatacatggtgccaggggctggggaggcaacggggagtgagtgtttcatgggaggcagtgaatcaggagaaaactgaacattaggaatgaaaagaacagcaatgacaggccggacgcagtggctcacacctgtaatcccagcactttgggaggccgaggcagacagatcatgaggtcagaagattgagaccatcctggctaacatggtgaaaccctgtctctactaaaaatacaaaaaattagccggatgtggtggcgggcgcttgtattcccagctactgcggaggctgaggcagaatggcatgagcccgggaggcggagcttgcagtgagccgagaccgcgccactgcagtccagcctgggcgacagagtgagactccatctcaaaaaaaaaaaaacaaagcaagggtatcaaaaccacaacagacctctaggaacggaatgctgagtagtgaacatgagccagaagaaggcagagaagcgaaagaaacacgtgcaaactggaaatcctcagtatgctcccagagggcactggaaccaaaccggacatcaagaaaaattggttgtttgaaaagtgcaataaaggccgggcgcggtggctcaagcctgtaatcctagcactttgggaggccgaggcgggcagatcatgaggtcaggagattgagaccatcctggctaacacggtgaaaccctgtctctactaaaaatacaaaaaattagccgggcgtggtggcaggtgcttgtagtcccagctacttgggaggctgaggcaggagaatggcgtgaaccagggaggcggagcttgcagtgagctgagactgcaccactgcactccagcctgggcgacagagcgagactccgtctcaaaaaaaaaaaaaaagaaaagtgcaataaaatggttctacccaggagaaccaggaaaaaagagacacaaaccgtgaccatcagaacggaaagtgacccggtatcatcacaaggagcagcgcgaatacggcacgcaccgccacgcgtcaactcagtgactgatgattccttgcgctaattctttgaaaagtacaaaactaccaaactcacccaacgtgaacggtaacttggggattcctacaactgttaaaacaaaaaactgaggatgtagctaaaagcctgcagaaaaggaactccccaggcccgatggttttctggtgaattctgtatacacatttctttctaaggaagaaatgccacttatcacacagtctgccccaaaacagagaggacacactctactgcacgtctgatgaagccactggatgacaaaaccaaagaagccaccagaaaagaaaactaaagacccaactcctcatatacagacacaaaagccctcaacaaaatattcacacactgcgtttggcagtcgacacactgcgaagacaaccaccctgcagtactcaggagagggaggcccggagcggagggagcgaggagtcattctagaagcgcagcagtgagaggtggagagtccgaccccagggccttggctgccttgtgcacaggggtggggtggtgggcaggagtgcagtgggagtggggcccctggagccatgtgtcagcctgcggtgagcagcgcagcaggaggcagaagccctgtcttgctgagggagagtctgtgctgctgagtggggctggcacaggtgaggggctcatggcagcagtgctgccatcactgtcctcgagccctctaagtcccaaagcgcgcctctggggatgaaggcctgggcatgaccccaggagaggtggcaggagccagggtgtgcacagcagcccgaggctcacctttttcaccaggaggcagacatggtggccctggatggagcggctgtacatggaggcgcaggagtccactcgctccacaactgcaacagagcgggcagtgttaggcttcccggacattgcatggctgcagccccacccccagagcaggggccaccttcttgggctgcccttggccacagcttcaggaggcctgtaggagcagggtgtggccctgagaggcctggggtgtggggaatgcagcccccgcaccagctcccaggcctcggggccaccagccacccgggatcccaaagggtgtgagtttgggtgggagggccacaggcccggctccaataggaagggacagctgccgcgtgcgtgaaagccccgtgcaatccatcagcccctcactctccttaccggaaaaatggtggtgaaaacagatcttcgccagaagattctggaaggacatccgaatgccatcgactttgattgagctcatgctcaagtccccagactccagcaacttagcaaaggcgtcactgtgggagggacagggaggctgactgcggtggggccgggctcctcaggcttcctggcacagaggccaacaaaacctgccacacacgctgcgcttggacaccctcctgtgtgtctgggccgggaggtcttgggggtcctggaaggtgtggctcattttcatgtgcggaagccgtcacacccagaaactgacaatgacttgtctttaaagaggtcacagaggtgcctgaagccatgggatgggccctcctccgacaaggacggatgtcctgtaggaagggactggggggataggctaggatgcaggcacgcagaggacggcctgtgaggactcaggggggagggggtgccgcacgccaagccgtgccgaggagaggcttcaggaggagcctgccctgctggctccttggtctcacccctccagccttcaggacttccaggggcctggacctctatgggtgacgctgcctggcctgtggcttcaactacacggccccggctggcgcagacaccaggcagcctgacctgcaccagtcacgagccagcgcctccaaatccgtctctaaagtcctgcccagaagcctcagtccccggggcacaggtgtctgcaaggtagaggggaggcggagggggttcggggacataggggagtgggcctgggccccacctgtagcagggagtggtgatcaagtaggagctgcagctgaagtgcagcctgaagtccagcttctcgtgggtcgcaccctcgtcattctgcggtggagtgaaggtggtgcagttgagaggggagtcgggcccagctcagggctcagggttccccaggcaggtggcccacttcccctagggacacctggacacccactgcgatggggcaggaggagcccctgcctgcagagtcggctcttcaacgccaagtggagccctgcataccttggcaatgaaggacagggtccccttgagcttctgcgccatgacgatgctctggatggtgaacacatactgggcttcgttggagacgcctggcgggggcgagagggagtggggcctgagacgctgcgggggctcagcatgggtggggcctccaggtctgtcctcagtcccaagtcctctgtggctgattaggaaactgagctcagcccccaagggagcaccaggggacaggagcagaaacaagaggctactggtgtccctaatttggcctggacttggtcccatccctgtttcagagggcagacttggccactggaaccgtggaacccaagaaggccccagaatccagcccccagcacaacccttgggactctagccaggtccatccgaggccattgcgcttctcagagagctgtggcgagaccccgacactcaggaggtactgaggtgcagcctggggacaaaggggacatggggaggaagcaacaagaaccagcggatccgggcagtcaccagctgccactgcgctcccacagtccccaggagaggccgtgagtggggcagggctcacctgggggcagctggaaaggcacggggacgccatcgtggacggaggagccctgcggccgggccatcctggcattgagtgagtccagcacgctgagctccatgcccttgaggatgctgctgctcctgttctccagcacgatggccacagtgacctggctgtcctcctgcagactgccccggatgtcacaggtctgcagggcatggccagtgttagcagggcaggcgggcccgccacagggaacaggcacagccacctgtctcttaatgaccacagaggcagcaggggtcccacaggcacaggaaggcacggagaggggcgccccctagccgcaggccaagcgcctcctatggctgctctttgagtgcatggcggggaccctcctgccagtccaagtctcagggcatgtctccaaccttaccccaagccagaggtgctgcccaagcaacgcccctgccaggaatcacaggccctgggtataccaacatccgggagctgtgggggctgcccgggttccgcgcgatcccatgccaaagagtgtgggctggcccaccctgcccctgggagcggctgccactcaccattttaacataggaattttcagcgaggagggagtagctggactcaggctggaaatagaaaaggcgcatcagccttgggggccccgagctccgtctcagcgaagactccagtatggcccaataccccaggtcgaatgccacgactccaagaatgcttggggcaaggggcttcaaaggagccgatgagggatccccggctcccaggaccacacagcccaccacgggggtgcctaatgtggggctgcgggccagggccagtcccctgcccccgccaggctcggcttcttctcgaatctgctcagttctctcccgcatggaggctgcaggagtggggagcagcgcacagcccgccaggaaccccggcgtggggcgggggcgctgaagtacccctcaccgggagctgctcctcctctggcgcgccattctgcaccggctcccccgctgcctcctcgctgcctggaggctgcttcttggacttcttcttgcctttggtccgctcctccttctccttcctgtgcttcttcttcttaggcttgggagatttctggagcaagaggagggtcgggttcagtgcccaggctgctccagcacgcccccatcacagtgtgaggtcaggatcacagcagggctgctcaggctgagggtcccacgtgcctgggtgggatggcaggaccagccacgcctcaggcctaccgggacaagctcaggccagaccaggcccagcggaggctggggccgtctctggttggcggcaagcgccaaagcagcccggggaacagtccccaccgaccagggagccatgcagggcaaaccagtgaggacaccacacttgacgcagcaaccccacgcccatgtgcacatccgagagggaacacacacatccacgcgcactgcgcagatgttcaaagcggcatactgtgtcaccacaaaggggaagcggcccaagtggctatcaacagatgagtgggtcagcacagtgtggcccatccgcggaggaacggggtcagcagagggtgacctgtccacgcactggaacatgacccggccacgaacaggaaccaggctctgacccaagccatagtgtggatgcaccttgaggacatcacactcagtgagacgccacacacaaaagaccacacggtgtatgaccccatttctatgaaatgtccaggacacactgatccacagagacaggaaggggatgcgtgggtgccagggcagggaagggagtgagaagtaacggctggtgggaatggagcttctttaggggtcatggaaagttctggaactagacagaggtgatgatggttgcacaactctgtgaatatacagaaaaccactgtatacatacttcaaatgaataaactctatgagacttatgaaccatgtgtgaataagaaggttattaaaaaaacacaagaccacaaccacaacaaaaggcccgtgagaacgccaacacaaatgcgagagcagggctgccctgggacctgggtggcggaagctgtgtccggccccacgttggggtgctggggctcatgcagccctccacagcccctgggggagtgacagcctcaccttgtcctggtcttgcccctcggcatcgtcctcctcgccctgcgcctccgtcttggcgtcctcacactcgtccttcggggtagtgacagtgttcacactgagctccccctgcagggagccagggcttggggctcatgctgggcaatgaggggccccactccactgcaccccagacagcctccatgccacacaccctcagcttgccctcacgcctgcctgagaggccacagtgccctccgagtgacagggagcctgtgagcacagaggccctggctgtcctccccttcccctggcccctgcttggcccactgggacccgggagcatgaccccggctccactcagtgctgggtcccacaggtgcacggtgctgaccgcgagagcacagggcctcaggagacccagggctcttccctgagtgccaggtatgacctctgcagacaccgaggctggcactggccagctgccagtctcttaccgtggatggaacgggggcgggggcgggggcgggggcaggcggtggggtggtagacagccagaagtccaggtcctcagcctgaaaccacaagacaggctgtcagcaaacgcagtgcaatggtcctgggaagaggggacggggacagcagggccaaggaggccccagctgccctcgctgcccccagggtcctggactagctgggccttgcagagcctgggaatccaggagctgaaggcgatgtcctcagccagccctgctggctctggctttcgctgccagaagagggccggggacaaagctgtgggtgggtgtgtgccattccagtggtcagaaggcccgtggcggcccatatgtcttatgtctgcctgggccacctgacgtgggtgtggacaggctcccaggccctgcaaacacatgctcctttgaaaaacccatttctttctctatgtgaaaatctgcacacagacactgcagaaacggttctggagctgcacgtgagggtggcatctggaccacgccgagctctgaccatgtccccccaacacaggtgaggacacggctcacccatgggatcgttgggtcctcctcagtctcccctgacacaagtgcacagtcagctcccctcagaagccacatgtcctcactccgccggggcacagggcgaggcggctggcactcgctgcctgactcagactcacagccatttcccctgagctcaccgctgtctcctgggagttcacggcaagggaggggaatggagaaggccgccgccctgggcactagccttaccttcttctccttctccttcttcttctccttgtctctctctttctctttgtgttttttctctttcttcttgggtttcttgctcttcttttctaccatgggaacgtccttctcaggggattttgaggtctcggtgtttctgtgtttctgaataggcagtttctcgctgtcggctaagggcctggaggaggaatgaccgggccacacatcagcaccactggccaccccccaggaccactcagtacatgccgtgtccaagcatgtggcagtgcgggacctgctcctccagcccctggccccagccatggcccaacatagatctactcaacacagcctgctggaggctctcatgggagggtctgtggtggccacaccctgccctgtcaaggcatggagacctcccgagcaccccaggcctggagacttcagagtccacacttaagagtcttggttgggagggccagccaagagcagtgcagtgaggacgtggtctggggaaggcccgcccgcaccccaccccagcctgcccaccctgcagagcccggccccacccggaagggaggacgagaggaagggaagcaaccacatgtggcctccaccctcaccctgaacccatatggactcacttatccaggtcaatatccagagccctgtaggggtcgttggggtctttgtcatcctcgtcgctgggcagagcattctgacaggaagagaggaaccccatcactggaacccgcccttgtggcctggtggaacgccatctatctgggacgcagtgggactgcccatgcgggccacacgcacaggtgggcagtgacgtggctccaccagaggctccgctcagcgtctaggcactaagggcggctgggccccaggacgcagccaacctgcatctgcctctgaagctgctggccctggggcggtgcgtcgggacgcgtgctcgaggacagagaggcctctcctcctatgctctccggggtggggcctcatcccagccaccaacgaagaccatggggagaggccactgtgcatggccccaggacacacacatgcggaaagatagacatcctaggaccgggacctccagcgaggctgacctcaggcatctcctctgtgacgatgtccacctgctgggcaggggcgatgtcctcgtcgctctccgtgggcagcgagctgtggcggcgcttgcccttcttctccttctccttcctctttttcctcctcttgtccttctccagcttctgccggtgccgccgctcctcctccagcttcacatactgatctgacataggcagccctgcgggccggcagcgggcagccactcagcactgcaccccaggggctcacggggagggcggcgggagcaccccacagcccatgtgacaaatgcggcgccgacacaccggagacacttgcctggaaccttcaaggggacggagaggtcaatctgcaccacgggaatgtgctccacgcccggggtgtcctggtaccgctgcaaaggcaacacccaggcgttaccggtgcaccgaggggtgacacacgtgcaagacaagcctcggggatgcagggagcgtgacgcagccccaacatcctaaggagctggggtcctgccagagccctgggccgcgaggagcgccgtgagcgagcgcatcccgaggacccgactctttaagacagtgaggactggaaagcttgtcacacgagtgaccccacaggcctatgagcagagagaagcaaatcctcgttcactttttttacgtgaatattctgttttctcctcaaatgagaaaagtaatgcggcctcaagcccagagtgaggcagcaggttgcccacgaccgtggggtcagggctggacagcagctgggctgccaggcgcagggaacagggccccccggctggaggctcgaatgaatggggcccacagggaggcgcctgcccctcaaaggctccgcacagtcaccgtgtggccccagctccattcccaggatcttcctgagggaacccgaaactcagatggatgccgcggggctcgggtggtgagggtagagggtgctgagggacaggcacccggggacgggcctcaccttctgtggcgatggcgagctcttgatgtagaaggggttgttggcctgctcctgcttccgggcctctcggcgctgtgggacacagcttggcatgagcccgagagaagcgggcaggatacccctctgtggacgtccaccaccagccacccagctggggaaggctggatctctggctattttcactactgagctttcactaacagggaaaccaaggcccgcaattgggaagagcacgtattgggggaaaaggaatcgctaacgctctgggaggcagggacgcccatgcctccactgccagggtcagggccaggacccacagaggccgctgacctgcctcaaagactccctgggacaggagggaggagacgagggctcgccaggggcagccagcagctcacccgagccagctcttcctcgtccgcctccgacggccggtgcttgggacgccgctgctcctcctcgtggaagacggccctgggcctctcgtcctctgactcgctgtccgagagtggctcattgatccaggcgtccaggtccaggctgcaccggacaggagggccacacaaggcagtgtgtgaccgagcacgcgcctgcaggcgtccgccctgagcaggctcaccacgtgcctggccatgtgatatcccaaacagtggggcctgccacccacacagggccagcgaggcaggtgtcactgccccttaagaggacgcagggacccaggaagactgcggcagggtcacagtggggcccccacggcaggctcaggctgcctcagagctttatggcaagggtgggagcaggcccacttcgcagggagcatccccaggcagaagccagatcccagaaccagtgagagacctggtgagtccgtgtgagggatatacccgcctgaggcctccaatcagccccacaccctcctggctgttcaggggtgcaggagcccccgctgtgccaccaggcatcaagggaccatgtcagggccatggttgcaatgcccccacccccgtatccttacccttcggggactggaaccttcttctgggccttgggggccactgggttcagctccccagcaaagagagcgctgacctcctctgccacaggcacgtccttggcctgaagcttctggatgtgcttgaccagctgcaggatgcaggacgcctgtgggggacacaggggtcactgctggcacctgcccggaaggccactcggccaccttcagggacacggggtggctcagcccctggcacagtgacgtgtgggccccctggtacagccacatagccacagagagcccagccttcatgccgtctctgtcgtcatcatcctcgccaggaagcggcagaaacagaccagtccggaaacagaacagagatgggggcacaacagggagctttgcccactgcagaaatgcctcccatcaggtcagtgccccgacaccagaagcaccacctccctcggcccccgcgggctccccgcctctgtgctggctccaactcagacacagccaggctgggcagctccaacagtgaccatgggccaaggatcatggccagccccgagctaatgccaccgcacagaggagcccggggccacgccccatgcagccttgaagctgggtctcctcagccattggacaggctgacgccactcccgacctctctcacagatggccaggtgcgatggttcacacccgtaatccttgcactttgggaggctgtggagtgtggatcacctgacgtcaggagtttgagaccagcctggccaacaaggtgaaactccgtctttactaaaaatacaaaaattagccgggcgtggtggcgggtacctataatcccagctactagggaggctgaggcagaagaatcccttgaacccaggggatggaggttgtcatgagctgagatcgcaccacttgactccagcctgggcaaaggagtgaaactccatctcgaaaaatcaaaacaaaacaaaaaacaagcagaaaaacagacacctgggaagtggtgggcaccgcctggcacaggtgtacagtctgctcaacctagaacccacgtcacctgcagccaccagaaagagccactgccagccccaggctctcacacctgctgtctcgccgcatgtgaaacaacctcttcctgtggccaggagcagcaccctcacatacccagcaccccagagacctgccccagtcctactgacggatcccccgtcctgctgacctccaggtcccactgactaaccccaaaccccagctggcacaagtggcaacaaaagaatctcagtgagtggcttcggaagaggaagcgaggccccgtcgacctggccgccactggacagaaaggcactgagggctccctgaggctcggcccaacacggagtgttggatcttacccgctcctgcacctccaggtctgcgctctgcacaaactggggcagccggtccaccatgagctgggtgacggcctgagcgccctctgcctccccggcctgctccttctgctgcaggatggaggcgtagagcttgaccacgttctgcacatacacggcctggatgtggcctggcagcgtggtgactctgggccgcagcatggcctccaaagtgtggtgtggttcctgcagatgcctgaggacaggaaacactgtgagcccccaggatgccaatcccggggctcctctctagcaggtgaggacctaggaggcctgggctcgtcaccaacaaggtgactctgggcccttcccattccctgagcggtctccaggggctgagacacgaagtagaagaaaccacaggccgtcaacagcccgtaacacaaacaaggcagagatgtggagatgacagagccactgaatggaggaaaggtcagaagaggaaaaaggacaacggggtcaactgtgcagctggccctgggaggataagcaggatgggcagggaacagacggaaccgggagaccctgatctgtgggacagtggggcctcggggtgcgcctcactggcgtctgacacaatgccttgggacttgaatatgtttctagtccacttttttcccaataagaaaatgatagaagtggccgggtgtggtggctcacgcctataatcccagcactctgggaggccgaggcaggcagatcacgaggtcaggagtttgagaccagcctggccaacacggtgaaaccccatctctactaaaaatacagaaagtgagggcgggcacggtggctaacgcctgtaatcccagcactttgggacgccgaggcgggcggatcatgaggtcaacagatcgagaccatcctggctaacacggtgaaaccccatctctactaaaaaatgcaaaaaaaattagcagggcatggtggcgggcgcctgtagtcccagctacttgcgaggctgaggcaggagaatggcgtgaacccaggaggcagagcttgcagtgagccgagatcatgccactgcactccagcctggaaaacagatagagcaagactctgtctcaaaaaaaaaaaaaaaaaaaaaaaaagagttaagagaccagcctggccaacatggtgaaaccccatctctaataagaatacaaaaaaattagccaggcttgagcttggtggcaggtgcctgtaatcccagctactcgggaagctgaagcaggacaatcacttgaacccgagaggcagaagttgcagtgagccgagatcacgccactgcactccagcctgggcaaagcttgggagatagccagactctgtctcggggcgaggggaaaaaaagaaaatgacagaagtgctcatctccaggatgcaggctggctggggaccctttcgggatcccagaagtcaggcgccttcctgagccggggcaggcccagggtggggagtgctcggtgtggccgtgatgagcagcaggtagcggccagtggtggtgatggggccgggcccgaggcagtgaggcatagcagcaaatctcataaatttccaagagagcctggaaatccagactgctgtgagaaccgtgagtctcagcaacacattcccacctccaggcaggcccggtgacccgagcctgcccagcagtggctgtgatctgtcctcttggccagggagaacctgacattcctggagacggcaggggcagtgtcgataagacccatccctgcggcccacctggaacctggcactgagacccctgtgcctccagaggggcctggcgcaggcaggctggggctgagcaggtgcctccctgggccacctaactgccacacggagctcccacctcacctacagcaaacagggctcagaagggctgccacgcgcccagctggaactgagccttgcagatgcccagggccagccccccgtctgcagcccaccccatggatcctcccacctcccagtcctagtgcccacgggatctacaatctcctgggaacgccacagatgcccgagggcagagggcagacagggcagcacagactcgcctctgtaaagggggaatgggcccgaccattgtcaggggacaggtgctggaaacccacggacctgcaagacggccggggtggcagggcgatgggagacggtaggaaggatctgccaggcacatccctggtccctacccctcagaagcttggagaagctgccagcccagaggcccagcgcccactcactctgagaactccccgcagatccaggcggcagcgtacagcacctcacagatcccgttccgctgggtgctgctggccagcaggtgtgcactgtcaagcagcgcagacatctgggacacggcgaacttgcggatggccttcacgcggatggccacgtccagcatttgggcggcgatgaggtggccgtgccgtgtgccctccagccgggtcagctccaccaggatgctgatgtacctgtggggcagaggcggtgagtgagcggcgccacggaacccccggccacacccctgggagcgggacgcaccactcgaagttggtgatgtactggtagttggactggctgcagatgtcaatgatcttggtgagcagctcgtcacggtaggtggtaccctctgccttgtctacgtgggtcatcagcttcttcacgatctccatcaggttcttcttggacacctgggcaaaagtgtacagacagtggtgagagcggacccagcctggggcctgcttggtgagacacccaacacctgctcctgagacagaatccacgggacacaggcggacccggattcacagatcgatgccagggaggcagcaggcccctgcgatgtgggctgggttagaggcacacgaccccagccagggagcaacaactggcccagcacagtctgttctgcaggctcggccccgccccctccacacaggccctggaagacaggcatggaccaggactggcgcccctctgccctgccccaccacactaactgatggccgagtgtgaggggactccatgcattccacgtggctctgcacctgacacttaatgtcccttagagaactaaggccaggcgggcgggcggcggacagagggcacgcaccatcccatagagcaggtccagggcccgcagccggatggactcgtccttgtcgtccaggcactgcaggatgaggtccttgtgggactgcacggacttggggtgggtcttcaggatcttggacattgccagcagccccaggtacttcactgcagagagaggccagagccgggtcactgggacggacacaggcagcagggtgcaggcagggcccacggctctccgggccgggtctccacctcgggaggctgcctggccttggcaacctgggggtggacagagcaagtatcccagctggagctcaccacgagggatgtcgccctagcagagccccctccctgggagccggggtgcaggctgcccccatgccggctccctcaggaaggcctcccctacctactaccacgttgtagtagctgctgtcagctctcctcttcccacccagccagtgcagggaagaacgcagagaagactttccagcagcagcagcagatacccttggcccaaggcagggtctcacctgtacccagtactcactgttcacccgactagcccaaaccagctcacggacagctaagggtggctgggcatgaggcacagatgccacaacctaagccagggccaccccagccacagggcacacagctgaacccattcacatactgccatccacggtggctttcaggccacggggcagcactgagcagagacagacaccgtgaggtccacggagaaaacgcagtagtccccacctacccgtgggggatgggcccatgaccccagtggaaggctgacacggcgggcggtactgagacccgcgtgtgggtgtttttctgacacgtctgtgcctatggcgaagttcagtgtgtacattaggcacaataagaaatgaacaactaatagtaactaagaacagaacaaccataaaacacggtcacgaaaggtatgtgatcgcggtctctcttgcaatacccgactgtggggtgcttgcctatttttggactgtgttgggggtacctgaaacctcagataaggagggccactccactatctgggctgttgcaggcgagtttgccaactcctgctctcaacaaaaagacctggcttcaaaatgagcatccaaaacaccgcccaggtacaaggtaccaggcaggggccgctaattctgattcctcaacagagcagcacgggggcacccacatgcaggcaggcacctgggcaagggtgctgtgtgctgctctatctcacaacgcaaagcctcacgcacccccgcaaaaacatgcagaggctgaaatatccagaaatttcggaccaaggtgctcagtgagtggcatctgtccaactgccaggatctccccagtgggggcctttgccatgccccctgcatctcccctgggactggggctcagaggagctggtgtttcccagccaccccacgcagataggtcggggtgcaagggcgccacagggcactggcagagggctgcctctgaggcagagtgccatccatcagggagacagctggggttgcagatgccgtgtccacttcctcctcacactaggaggacccctaacttcacagagctggggacacgaaaatgacagcactggggaggggatgactcacagttctgatcggagtcctcgatcaatatccttaatttctgaacacaaagctgaaaagaagaaaaaaacgatgctggttacatcctctaaaccaagggtgagtcccacaggtaccctccagattcaacctcaacctggcctaaggcccggcgtcagccccacccaccaatcaaagcccaggagggaaacaagcatggcccacatggggcactggagacaagggaggccctgcttcccacgggcgctctcccccactcctcagtgccccatgcatccaccccacagacacatgatggggatcccaagcaggctcgggtaggtagtgcacacaggacgcggctgtgccctcccaagccgcaagatggcgtggggggaccagcaccttggtcacagggtgggcaagctcccgcctgtggaaaggtgtggcctctgcagtgtgggaccccatgggccccgcccagtgcgggacgtacctggatgctggcgctgtggttgggcatgccggaggacagcgagatgagcactgcaacagacagcttggtcagcaccacggtcagcaccatggccagcgccgacaccaactcagggccacggggcaccagcaccccctcgccgggaggagggatgggagggaggacagaaatgccactgagtttgggaccacgcagcccaactgtgtttgcaaaaacctagctccatcacaggcctgaggataggaacctgcaggggcccccaccctcactgacaggatggctcggggcctcagctgttcctgcaaacactggttcactcgcaacccctgcttccctctggagtctggaatcccggcaggggccaggccccgaggccacaggaccagaccctgtaggaacccaggcgctgggtctctgggagcctccatggtgacacttcacaaattatcatcacagctcactgctgggggatgaagcacatccggcaggactccactgaaagaaggctctagaagctgggcctggcctccccaacatccccggagccattcccctttgctgactctgctgcgtcctttgggcagggacaggcaggcagcgagaagccgaccctcagagccccagctctaacagctttaaaagaaagacatgaagccaggggaccgccaggcacatgcagggacagagactcattttccaccaagccagtggcatggaatgaaggtgtacaggagaccgtgtgtgcgtgtgcgtgtgcatgtgttttctttttaagacatgggttcttggaagctaagctatgaggacgcaaaagcataacaatgatctaggccaggcgcggtggctcatgcctgtaatcccagcgctttgggaggctgaggcgggcagatgacctgaggtcaggagttcaagaccagcctgaccaacatggagaaactctgtctctactaaaaatacaaaaataagcgggagtggtggagcatgtctgtaaccccagctactctggaggctgaggcaggagaatcgcttgacctgggaggcagaggttgcggtgagccaagattgtgccattgaactccagcctgggcaacaagagagaaactccgcgatcccccccaccgccccaaaaaagaatgatctaatggactccagggacttgtgggaggtggggggtgagggataagagactgcacatggggtgcagtgtacactgcctgggtgttggtgcacataaatctcagaaatcaccgctaaagaactgatccctgtaaccaaataccaccaaatgccgcccaaaaactactgaaataataatttttttaatacaaaaaatacaaatatctggaaatgaataaccctggacagaaagtctacatataaatgtaaatacgaacgaagaaatgtggcaaaataaatgcatattcacgcatgcaagatttcagaaatgtcacacccaatctttgtaggagtgttgtttttttgttttgttttgtttcgttttttgagaagaagtttcgctcttgttgcccaggctggagtgcaacggcacaatcttggctcactgcaacctctgcctccctggttcaagcaattctcctgcttcagcctcccaagtagtcgggattacaggcgcccgacaccaagccctgctaatttttgtattttttaggtagagatggggtttcaccattattggctaggctggtcttgaactcctaacctcaggtgatccacctgcctcggcctcccaaagtgctgggattacaggcgtgagccaccacgcccggccaggagtgttatgtgaatataaaagtagatggtaatttttttttcttaaaataggtgtatagattacccaggtaggaacaaatgtattttaaacagaaatgtaggccgggcgcggtgtgtagatgtgttaattatctgaattgtgctatttgacaatctagaggtgtaccttaaaaatataccatttttaattgtcaactatacctaagtaaagctagaaaaaaaaaaacaaaagagatggggtgctggctgagtacagtaactcaggcctgtaatcccatcactttgagaggtcaaggcaggaggatggcttgagcccaggagttcaagaacagcctgggcaacatagtgagaccttgtctctaccaaaaattcaaaaaattacctgggtggggtggcatgcgcctgtagaagcaagaggactgcttaagcccgggaggtcaaggctgcagtgagctatgatcgcaccactgcacaccagcctcaagagagacggggtctcactctgtctgcagcctggaactcccgggctcaagtgatgctcttgcctcggcctcctgaatagctgggccctcctactggtgagaagcttctgctttatcaaccataaggaagtccaccgcccaatgccccgtgaggctttggctgacttggagcagcttggcagagaccactggggacattggtcgttggcccttgtgccctggcccagccggaggtgtggattctgactctgccttagaaaatatttttgtgggccaggcgcagtggctcaggcctgtaatcccagcactttgggaggccgaggcaggcggatcaagaggtcaggagttcgagaccagcctgatcaatgtagtgaaaccccgtgtctactaaaaatacaaaaattagccaggcgtggtggcgggcgcctatagtccctgctactcgggaggctgaggtaggagaatggcgtgaacctgggaggcggaggttgcagtaagccaagttgcgccactgccctccagcctgggcaacagagtgagactctgcctcaaaaaaaaaaaaaaaaaaagaaagaaaaagaaaatatttttgtggtagatgctgctatttaagtatccacgggtgaaacgatatgctgtctcaggagtgctttaaagtctcagaaaaaatgcagtgtactgtgagagcggatggcaggccctgagcagcaggggccggcatctgtggaagcaggtatgaggaggggctttatctgcaggtgaatctttcatacccaaggggactccagagtggctgggccaccaggcagcttaagaagcaaacacccagcaccaatggcggtggaagaccaggcagacgcatggccaccttgacagcagaggcctgggacggactcccagccagccccaggccccaccagccagctttccttctcagttccagcaggggtggcgctcggagacaccaggcctggcgccctcctgtccccacctgagaccccagcctggcagtgccagcccttccagatggggagagtgccagttctcacctgcaatcacggtgttcacacattcatagaggagagacatggcagacgtgctaaggaaaggaacacagggaagcggcatgaggactgggggcctcgtcagatgcagtgacccagtgccggcagctcagctggagacggcctccgccccacggctcagggagtgtgccccaggagggagcccgtgccttgctctccaaggcctgtggtgctcggctggtcatcgtctcatcttcccagaaagggcaggtgagcaatccctctgcaactgcaggcccgtgacagcatccacgcagggacggaccacgcacccccggcggcctgtgagatggcaataccgccttcctactgcatcttttctagagttttttttgttttgttttttgtcttttctgagacggagtctcgctctgttgcccaggccggagtgcaatggcgcggcctcggctcactgcgacctccgcctctcaggttcaagcggttctcctgcctcagcctcccgtgcagctgggattgcaagcgtgcaccaccacgcccggctaatttttgtattttttaggtagagacggggtttcaccatgttgcctagactggtcttgaactcctgacctcaagtgatctactcgccttggcctcccaaagcgctgggatcacaggcgtgagccacagctcccagcccttttcggtgtttcgatgtgttcagacacacagataatcaccatggagtcgcagctgcttacagctttacagtcacctgcagcgtagggccgcagccaggagaatggccacgcgccatagcctaggagtgtggcgagcttcagcagtgaagtccgtgtgcgcgtatgctacactgctcacatggtgaaatgtactaatgacacccttctgtgaatgtgtccttgttgccgacacatgactgcatctgaaagtcatggcgatgacgcctctgcctgcggcccactgcacccctccccttccctgcagtgggggccggggaggggtcctggctccgcctcagcacttggtctgaggaattaaagtgtccccttctagcaaccaaaggcagcctggcctgaaaaggctcctaacataggatcccattccacaaccttgcagtgcggagacccacaaagaaaacccaaactccccaaacgtctctaagcagcatggagaagagtctagtggccgggaatgccactacaggcttccagtctaggacggacagtcatctttcagctgcttcacgcccagcccccgctgtaccgcactggggccgggcttgcagccactccagcactgcaccccgtggagccggcccgcccccgccgctccgacactgcaccccgtggagccggcccgccccacagctccgacactgcaccccgtggagccggcccgccccacagctccgacactgcaccccgtggagccggcccgcccccgccgctccgacactgcaccccgtggagccggcccgcccccgccgctccgacactgcaccccgtggagccggcccgccccacagctccgacactgcaccccgtggagccggcccgcccccgccgctccgacactgcaccccgtggagccggcccgccccacagctccgacactgcaccccgtggagccggcccgcccccgccgctccgacactgcaccccgtggagccggcccgccccacagctccgacactgcaccccgtggagccggcccgcccccgccgctccgacactgcaccccgtggagccggcccgcccccgccgctccaacactgcaccccgtggagccggcccgcccccgccgctccgacactgcaccccgtggagccggcccgcccccgccgctccgacactgcaccccgtggagccggcccgcccccgccgctccgacactgcaccccgtggagccggcccgcccccaccgcgcatggcctgcactcacctgtggatgagattggtgaggggctcgatcagcttcttgcccagccgcggttccaaaggagtaagagcaccgaactgtggggacagcagggcctcggtcacccgcagggaatgccccacgcagggtgagggacagggggggcctcggtcacccgcagggaatgccccacacagggtgagggaatgccccacacagggtgaggaggccacattcccgggcagtacttgccagcttgatgatcttgatgaggacccagttgttggtggaggacgtcatcagcttgaaaaagagcggggccagggacaggtagttcttagggttgcgtctggccagctcgcagatgacattgacggcagccgactgaacccctggggaacaaggggttctcatcagcatgcctgtccttccacctagaaaaccatcctactgtcttcctggcccgcgaggaagttctggggcctgcagcagctcccactgaacatggccctggctctgccacctcctcctggtgacagggacagcagccacagacctgatcctccagggaacaggccacagcagccagctcctggcgctgagaaagcattgctcggcactgttgccaggaacaagtgcgcacaagcgtcaccaagctcaggacagcctgacagcggccctctgagtgggggtttcagcatgagggctccagaaacagctgcccagccatcggggctcagggagtcttcctgctgcatccatgcccaccactccagggagaagctcgcccatcgggtcccgggcttagggctggggtctcccctcctgcacacagggccttgggattcctgtgggctggctttggggtccaccgacccacgcctgccacacgccagaggcttcacacaccagcccagggaaactcagtgaaactgaatctgcagccgcgtcccgcagtcaccacaccacaaatacacaacagctacactaggtggaggcagctcctgcacgggacatatggtctagaccatcccctgccctgtggaaggtgcctcctggtggcactggtcctaagaggggctggcgggggtgggtacacctctgctcagggacacgccagactcaccgccagctgccacattggatcttactgcccccaccaccagcacctccctcctggctgccccagcaaggggaggcccagccacctccaacaggcatgttcctggactgagcccttcaccactccccgcagcaccccccaaaacacgccaccacctcttcccagggcaccggctgagcccccaccctcaaccctgaggcttaactcaaatccacaaaccggggtcggggtcctccagcttctccttcagccggggaaaggcagggcgcagcgactcggggtacttcaggaacaccttgtacatgatcagcacagccttcttcctgatgtagggcttggtgtgtgacatctgcggggcagcgggcttcagcctgcgcgggctttctgcgcctcatccctgctctcgcccctcccagccgcctcctccacagagaggagatgccctccagcccgacgctgtggctgcacaccagtcccaggggccacagaccagcatcttggatggcatggaagccagcctcactgtgcccctgactcaggcctgccctccagagagagccctcttcccttgtggccttcctgccccagggtcctgggtcccacagtgggaggaaggctggagaggaaagtcacacagggaacgagggtgtgctgggaacacagcctacagcccagctcctcacggctgtgccctgcgactgctcaaattccccagcgggagccctcccatctaacaggcccagggagtcgcctcgaactgcctggtcctgacagagccaatccatgatggggcactgacatccaccctctcgtgggctccccactgctttactctagaggagccggcactctgtgaaggccagcagtcagtgttttcagcttcatgggccagacagcctctgtcatgaccacacagctgtgccttcacaaccaaggccaccagagacaacacaacacgtgaaaagaaggtgcagccggctggatttggccctgtgccgcagcctgctgatccctgatctagaagcttagcaggctgtgctgacaatctccaagaccatcagccacgatctagacacctccaggtggacaggcagccacatggggacggcgcccatcggccacgatctagacaccaggtggacaggcagccacgtggggacagtgcccatcggccacgatctagacaccaggtggacaggcagccacgcggggacagcgcccatcggccacgatctagacaccgggtggacaggcagccacgaggggacagggcccatcggccacgatctagacacccggtggacaggcagccacgaggggacagggcccatcggccacgatctaggcacccggtggacaggcagccacgcggggacagcgcccatcggccacgatctagacaccaggtggacaggcagccacgcggggacagcgcccatcggccacgatctagacacctccaggcggacaggcagccacgcggggactgcgcccatcggccacgatctagacacctccgggcggacaggcagccacgcggggaccgcgcccatcggccacgatctagacacctccgggcggacaggcagccacacggggaccgcgcccatcggccacgatctagacacctccgggcggacaggcagccacgcggggacagcgcccatcggccacgatctagacacctccgggcggacaggcagccatgtgaggacagtgcttcccagggaggaaagcatgcccgctccacactgttaatctggctactgtgttttaaatgaaaaggaacaaaggtcccctcatgagctggaggttaagtcaggcacaaaacagatgtttctggggccaaaatttccaggggcttcccaggttttagactgtcacagccgggggcgtagcctttgacaagcagagtggcaaggaggagtcaagctgtggccagggatggaggaaagaggaccacacagaagcccactggcagctcagacaggagccactgtcagacctcagggcaaacatcccccaccgtgcctggcctgtcagggacaccctgttgctcctctcggcaagatgatttcaaatatcaacttaagacacgcaggaaccaaagcggcccaagagccgctccaccagctgacagtgatttggttcccatttcaggcaggccacgcaccggggaccccggccggtttccgcatagccaagcttcccaggcatgccactttgaccgagtttttcccagagcagacatgcaggggtggtgggcaggcttacaaactcaccagtgtcatgatgtcatttgccaggtctctggcaaggtctggggtgacgaagcaggacagacccgtcagtgcaacacctgtgtcgtactggctggggctgctcaagtcctggaaagtgagagaaaggggccgtggccaggatgccctgggtggcacatccgacgcctgggtcaccaggagcagcaggagcgaaattctcccaggatgccccaggactcggcatatcctcttggggtgcagctgtgccttagcacccctgctgctgaggggtctgaagctgaactcggacaaggaggaagaatttacagcccatgggagactctgtcaccaagagaggagccgggatgggcgcggctgggaacagtgaggtctgaggcacaggctgaaacgctctgtgggtgggaatcaaccaagtttcttggctcctcctggatgggcagggctggggacagagaggtctgaggcacaggctgaagcactctgcgtgggaatcaaccgagtttcctggcacctcctgggacagaggcgcctgtcacaagtcactccaagtgtggggaagggccaccccgggtgcaagagcagagcgttccaggcctaaaaccagggcttccctcacgtatcactggcagctcccagcttgcagagacggcggtgctgggcctggcacagaatgggcaggaaagccccacaggatggggtcctcagagaccctgctcccatttggggtccctttccgcaacaactgaggggaagggcccaggaacagctcccatgggtccctctcaaagttcagctggcagctgcccacgccctcccatgaactctgccccagctcttcactcccgcagctctcactaaaacacggaatctgccccagctcctgtgtcagcacttggggaaataaatcctctcttgatatcacaaacctgctcttggggagagatcttcttaaggaaactcccgagacttcatctatatatgcatctaccaagatccgttttcagggttaatattctgtggtcaaaatatgacaaggccagcttttttttttttgagacgagtctcactctgtcccccaggctggaatgcagtggtgcgatctcagctcactgcaacctccacctcccaagttcaagcaattctctgcctcagcctcccaagtagctgggattacaggtgcgtgtcaccacgcctggctaatttttgtatttttagtacagatggggttttaccatgttggccaggctggtcttgaactcttgatctcatgatccgcccgccatggcctcccaaagtgctgggattacaggcgtgagccacagtgcggggccaactggttcttttaaaaggacacagtggccgtgcgcggtggctcacgcctgtaatcccagcactttgggagtctgaggcgggaagatcacgaggtcaggagatcgagaccatcctgaccaacatggtgaaaccctgtctctcctaaaataaaaaaaattagtcggacacggtggtgcacacttgtagttccagctacttgagaggctgaggcaggagaattgcttgaacccaggaggcagaggttgcagtgagccgacattgtactccagatggcgacagagtgagactctgtctcaaaaaataaataaaataaaataaaataacacagtgagctgaagtggtggcacacacttctaatcctaccactttggaaggccgaagcaggaggatcacttgagcccaggggtttgagaccagcctaggcaacgcagtgaaaccctccctgcctctacaaaaaatacaaaaaaaatcagccaggtgtggtggtgtatgcctgcagtcccagctactcaggaggctaaggtggggagatcgcttgagcctaggaggtcgaggctgcagtgagctgcaattgcgctactgctctccagcctgggtgacagagcaaaaccctgtctcaaaaaaaaaaaagtaagaaaataattttttttagggctgggcgtggtggctcacgcctttaattccagcactttgggaggccgaggcaggcagatcatgaggtcaggagttcaagactagcctgaccaacatggtgaaatcctgtctgtactaaaaataccctaaaaaaaaaaaagaaagaaaataattttttttttttgagacggagtctcgctctgtcacccaggctggagtgcaatggcacaatcttggctcaccacaacctccgcctcctgggttcaaacaattctcctgcctcagcctcctgagtagctgggattataggcacgcaccaccacgcccggctaattttgtatttttagtacagacggggtttcaccatgttggtcaggctagtctcaaactcccaacctcagaagatccacccgcctcagcttcccaaaatgctgggattacaggcatgagccaccgcacccggcccaggaaataattttttttattaaaaaacaagccaggcgcagtaatcccagcacttggtgaggctgaggtgggcagatcacctgaggtcaggagttccagaccagcctggccaacatggtgaaaccctgtctctattaaaaacacaaaaaaattagccgggtgtggtggcacatgcgtgtactcccagctacttgggaggctgacgcaggagaattgcttgaacctgggaggcagaggttgcagtgagccaagatcacgccattgcactccagcctggacgacagagcaagactccatctcaaaaacaaaataaaacaaaacaaaacaaaaaaataaaataaaaaacaaaatgaggccaggcacagtggctcatgcctgtaatcccagcactttgggaagccaaggcgggcagatcacttgaggctgggagttcaagaccagcctggccaacatggtgaaaccccatctctactaaaaatacaaaaattagccaggcatggtggcgggcacctgtaattccagctactcgggaggctgaggcagtagaatcgcttgaacccaggaggcagaggttgcggtgagccgacatcacgccactgctctccagcctgggcaatagagtgagactcagtctcaaaacaaaacaaaacaaaacaaacaaatgacacactggactgcaaacatcggaagcacgtgatcctacacagaggaagcaggtgctaactggctgagccagggcccacctgcgtccgaggccaggccaggggcaggcaccaggtcagagccgcgcccgacacacagggtctaacagccctgagcacctcgcaaggcagcggcggatctaagtccccagtgaggtgctcacacagggaccggccgtgccgagcccatcagcaagagacacaaagctgggcacgacacgtggccctccttgctgggcagctgccacctgggtacctagggcggctggagccctccaccctcctccctcccagttaccacctgcaaaacccgcccccatcctcctcttagcgggccagactcccgcccaggccccacctgctacacggccacgacccaaggagactcccgcccaggcccctcccgctacacggccacgacccaagaagactcccgcccaggcccctcccgctacacggccacgacccaagaagactcccgcccaggtccctcctgctacatggccatgacccaagagccccacggcatctagggcgcatgtcgcccgcggcccaggcgggacgcccagctctataaccttgcccacaacggtgagcccagcagagccaacagtcccaggacctgcaccacaccctgtgccggacatcagtcacagccagtgcccccacacctgtccctcggcgtgctgggagcccccagcccaggacttcaggtcacactgtggggtcgacaacacagccacagggtcccgcccttgcacatggacattggagagccgggaccgtggcctctgacgtgcggtctggggccagaaaggggccagctgcccatgaaaagggtgggcctgattctccaacaccccaacccctctattgagaggcgggaaccaaaggtgttcagagctcggggccaataaggacctttactactacccagtggcctccgtgaccatttcaaaatgcaacatttacatggtgctgaaaaatgcacctcgtgggactcaaaaaaagccgcgggcaggaagcaccccacatgggcagggaagggcccacagctacaccaggcactaccatgaggggagaagggaagaaagtgggtgaccgcagaggccagctgcgagtggaccctggagccccattcgccggcccctccaggtggtgagcgagggaagggggcaccgcaccactcagcatccctccacctcacaagcccaccagggagcgcaggctcagacccgccgggcctcctctctgcgtctgctgggaggactgtggctccggaagccccgctcgcactcaagggggccacaggcacctgctgcccacaggaagacgcgtgtgggaaccagacgctccggcaagggcagactgcactcagcacagagcggccccggcccgggaacacccaccttacggatctgattggtggtcagcatgatgacgtcggtgccttcgtgaaagctctgggaagcagcgaggtagccaattcgctgggagagaacagatgagcacatcagaggcaggacacccgcagcctccaggagctccagctctgctctgcagcgaccacaccaggcagcgccagcccagaagcaacaccctgcagcctggacgctggggccaccagcaagtgggaaccaacccgcatttgaaaaccaacgcagatttcttcaaaattccatgaggaaattcccagtttggaatatgtatgtgtttttttttttttcttggagacaaagtctcgctctgttgcccaggctggagtgcaatggcacgatctcagctcactgcaacttccacctcccgggttcaagcaattctcctgtctgagcctcccaagtagctaggattatagccgcgtgcgccaccacgccccactaaattttgtatttttagtagagatggggtttcaccatgttggccagcctggtctccaactcccaacctcaggtgatccgcctgtctcagcctcccaaagtgctgggattacaggccactgaatccaccttgggtaacagagctagactctgtctcaagaataataataataaaaattggccagtcacggtgcctcacacctgtaatcactccccaccccaccagccttgccgtcccagaacctcaccttgaaggtgaacttggaggcactcatcacttctatgatgttgaaggcggcccagctgatgtcgtatcccaacatctgtaactgttaagggacgcacaggaaattgcactcacaagccaaagcagagagaaaggttttgagccgcggcatcaagcgctccctcccagcacacggtgctggaacagactcattcactgtcagcaaaccacccaatacgtacccctggggcctttaatttcttcttttgacaaacgactctgacatttaaaagctacagggacaagttagtaacaggcactaaaaagagactcaatgtctgcaattggttaactggcgcttacgggtactggctacattcccctaccaacccttggcgaatcggctccttgaaatagttacgagacgagcagcagcatgggggaccctggacgagccctttgtctcgtcctcccacggggaaacgggccagagggaggagtgcctgtccccagctcacgcactgacctggaactgcagccaggaaaggagccagccctggaaggtccagggccctagctctccccactaggtgtcctggcccagcctgtggtgggagggagccgagactgcaggcgaggggcgtccccagtgaatcccacccagaagaggaccccatggggctccctcagggctaccaccagggcctgtgggttgccaccctctggcctgtttgccagccatgtgaccaacatggctttctgctccaggactctgggttggccctgagtggctcaccgacagcaggtggtaccaatgactgacaggtggacagacaggctgatgaataggggacacgtgctgagtggagaagcagcccgacagtgctgggcgctggccactgggaggcacttacatacgtcagcttgcagaccgcgttcgccttcaccgctatgttgtcctgcttcagctcctgcttgatctcatcaatgcactgagatatgtattttgcctataatgggggataaacacagagattacaaacatccagctaagagggctggaataatgatttcgggccaggcacagtggctcacgcctgtaatcccagcactttgggaggccgaggcaggcagatcacgaggtcgggagtttgagatcatcctggccaacatggtgaaaccccgcctctactaaaaatacaaaaattagctgggcgtggtggcgggcgcctgtaatcccagctactcaggaggctaaggcaggagaatcgtttaaacctgggaggcagaggttgcactgagccaagatgacaccactgcattccagcccaggtgagagagccagactccgtctcaaaaaaaaaaaaaaaaaaaaaaaaaaaggaaagaagccaggcataagagagagcacaccgtgtaatccatttctatgaaatgtccagatcaggccaatccagagacaggaaggggattcgtgggtgccacaggctgggagaggagacgggagggttcgctttctttctaggctgataatgttctggaacttggccgtggtggtggcgcacagcattccgctatacacgccccaccgtttgccaactccttggtggacgaacatgtggggccttcccaccttcagccagggtgactctcactgctgtgaaaaccacactcaggttttgaggggatgtgtctggtgtgtctggatccccctgggcctgctcactaactgcgcgtgtctccagaacaccatcaaggacaattctgacccaagcgaactcaggcacgaggtccagaatggcagacaaggttcccaagggacaggcagacgtgaggcgcccaacatagcaccagagacaagccgagtcgatgccatgctggccccagagacaacccaccccacctggaaggagaggagggagcagcagaggcttggagtgcctccatcagtgaacgatgaggcacccacaagccctcctaatgcacaggagcccctctccatcatccgacaggtcaggagtgacggctgcccgggccccgtcctgccagcccctacgtcgggatgcaatgttcctcctgctgtgcccaccagaggcaaggatggcaagcccaccccatcacgcttctgtcctcagccccactgtagctggcctcgaagcagccccaggagtacccaccactcatgtgtcacccaggaccacaccccaacctcggctgccagctgcaccgggctggggaaggagacacagctgtgggggagtgggggggtgggggagggcacagacacataatattttcctccatgctttatgatccaactttgtacaatggaaagagtgccacccgatcctccagacgggcttcaaattactacacctcaccccaggactgtgctcccatccccggagcaaggataacccactcctcctgctcaaagggtcaggactgttgatttaaaaggaaaagaacaaaaagaccatcccaggcgtggagaggtcagaccctcacgagggcaaaggggatgtcaaacggcgcggctgctgtggaaagcagcctggggttcctccacggttccatgtggagttaccgccccagcaattccacttctgggcgtgcacccgaggggatggaaaacaggtgtccaaacaaaaacaagcacacgaacacacagggcagcaccatttctagtggcctgaaacaggaacagcccccacgctcgccgctgatgaatggatacacaccatgtggtgggtctgctccagtcaacttgcttgactttttttttttttgagacagggtctcactctgtcgcccaggctggagtgcagtggtgagatcactgctcactgcagcctccacaccccagactcaagtgatcctccccgctagcctcccaaagcactgggaccacaggtgtgcgccaccacgcccagccactagtcagctttctaggaactcggcagtgggtcacaaccctgggactccctcttggcttttaacttctgataaagtccaagtagctcctctcagaccaagcctcacacaaacgtcttttttttttttttttttttttgagacggagtctcgctctgatgccaggctggagtgcagtggcacaatctcggctcactgcaaccttcacctcccaggttcaagtgattctcctggctcagcctcctgagtagctaggattacaggggcacaccaccatgcccagctaattcttgtatttttggtagagacggggtttcgccacgttggccaggctggtctcgaattcctgacctcaggtgatctgctcgcctcagcctcccaaagtgccaggataacaggcatgagccactgcgcccggcctgaattagaaaaaaaatgtattagttggggtagggagacatgacctagacccaaaagattatattataaacatagatgtaaattagctgaagctataatgtggctatacatcattgacactttctacaaaaacaccgggaaatcagaggagcaacatggtgaaatttctcaaacacctcagctagttccacactaaattcacacttcaccacacagcaagtgagatactaaaacaatgatgctggtctcagcatctatttaattctgggatgtaatttagaacacagggtgcgtatttcctttatacactaagtcctcaggactgcagtaagacaggccatttaaaccctagatacacaggaaaactccctggggtacttttttttttttttttttaatggagtcttgctctgtcaccaggctggagtgcagtggtacgatctcggctcactgcaacctccgcctctcggttcaagtgattcaagtgattctcctgcctcagcctcccgagtggctacgattacaggtacacaccaccacgcccagctaatttttgcatttttagcagagacaggatttcaccattttggccatgacggtctcgatctcttgacctcatgatccacctgtctcagcctaccaaagtgctgggattacaggcgtgagccaccatgcccggccttttttttttcttttattgagatagggtcttcctctattgcacaggctaaagtgcagtggcctaaccatggctaactgcagcctcaacctcccaggctcaagagattctcccacctcagtatttgggagtacagtaaatagctgggattacagggccatgccaccatattgggcgaatttttaaaattatatatatttatatatatttatttttgcatatatttatgtatatacttgtttacatatatatacatttatttacatatatgtttatttatatatatatatgtatcttttgagacagagttttgctcgtcgcccatgctggagtgcagtggtgtgatctcggctcactgtaacctccgcctcccgggttcaagcaattctcctgcctcagccttcccagtagctggggttacaagcaggtactaccacgcctggctaatttctatatttttagagggggtttagccatgttggccaggctggtcttgaactcctgacctcaagtaattcgccagcctcagcctcccaaagtgctgggatttacaggtgtgagctactgcacccgacctaacattttttacttttgtagagttggggtctcactatgttgcccaggctggtcttgaactcctggcctcaagtgatcctcccaccttggcctcccacagtgctgggattaaaggtgtgagccaccgcacctggctggcgctttttctagttttaaacttccgattctcagtccttcgcctccaatgaattaagtcagcatcttgagaccagggaggccacatggtcacaacctcagcagctgattctcaggtgctgtccagttcaaagaccaacgagctgagcccttggcacatcccacggtgctttccacgtggccgcctggctgaggggagccgggccgctgagccgcatgcaggctgagggcctgggagctcacccagctcatgagagcaaagcccggtccccctcaccccaatgggggctctgaggggttttttctgttttttttttttctttttttatttgagacagagtttcactcttgttgcccaggctggagtacaatggtgtgatcttggctcaccacaacctccgcctcccaagctcaagtgtgattctcctgtctcagcctcccaagtagctgggattacaggcacgagccaccacgccaagctaattttatatttttagtagagacagggtttctccatgttggccaggctgatctcgaactcccgacctcaggtgatctgcccacctcggcctcccaaagtgcggggattacaggagtgagccaccacgcccagcctctttttcttttttttctgagatggagtctcactctatcgtccaagttggagtgcagtggtatgatctctgctcactgcaaactccacctcccaggttgaagtgattctcctgcctcagctttccaagcagctaggactacaggcacgtgccaccatgcctgcctaattttttttttttttttttttttttttttgagacagagtcctgctctgtcgcccaggctggagtgcagcagcgcgatctcagctcactgcaagctccacctcctgggttcatgccattctcctgcctcagcctcccaagtagctgggactacaggcgcccgcgaccatgcctggctaattttttgtatttttagtagagacgggatttcgccgtgttagccaggatggtctcgatctcctgaccttgtgatccgcccaccttggcctctcaaagtgctgggattacaggcgtgagccaccgtgccaggccaagcctgcctaatttttgtatttttgtgtagagaggaggtttttgaagccctgtttcaaaaaaatcaaaaaataaaaaattagctgggcgtggtggcacatcgtgtagtcacagctacttgcaaggttgaggtaagaggattgattaagcccaggaagtcaatgctgtagggggccgcgatcgcaccactgcactccagcctgggcaacagagcaagactgcctcaaaaaaaaaataaaaaaggaaataaatgaaagtgctgcctcggccaggtgcggtggctcacgcctgtaatcccagcactttgggaggccgaggcgggtgcatcgcctgaggttgggagttcgagaccagtctgaccaacgtggagaaaccccatctccgctaaaaatacaaaattagccggggtggtggctcgcacctgtaatcccagctactcgggaggctgaggcaagagaatcgcttgcacccgggaggcagacgttgcggtgagccgagatcgcgccattgcacttcagcctgggcaacaagagtgaaactccgtctcaaaaaaaaaaaaaaagaattccaagtcccaacagtaactgagtcaggaaaggggacgcgccggcgaagtggtccatcctgcccaggataagttactatccacaatcaccatcacttcgaattcaaacagaaaagccaccaaaccccagaaccccagaagcagcatgaaaggagcttctcctgcggagcgctctgctctttcaacagcccgggacaccgtcctgctttattctcttgttgtggacaggctcaacgccctctgcacccaggagcagagcggccgcggccaccctgaggcagcatggaaccgaggcccccacaccgggacctacctccactcccacaactgaggctggtgcagcacactaacacgcaacagggcagaaaccagaaacagccccatccaggaccagaccccggccagccctgcctagtccagccccagcccgtctctgtgctcagtcctgtaacttgcggcccctcagctcagcctggatgtctgtggggtggcacggtcaccattaaaaccctctgagtcaaggcggggcacaatggctcacacctgtaatcccagcactttgggaggccgagcagatcacttgaggtcaggggtttgagaccagcttggtcaacatggtgaaacaccgtctccactaaaaatacaaaaattagcttggtatggtggtgcatgcctgtaatcccagctactcaggaggctgaggcaggagaattgcttgaacctgggaggaagaggctgcagtgagccaagatcgcaccactgcactccagcctgggcgacagagggagactatgtctccaaaaacaaacaaacaaacaaacaaaacaaaaacgcttctggctcaaatccacagagacagcaggtcagtggtcgccagggcataggtttctctgttctgaacgtattgtgctgaatcactgcacgtttgtaaatatactgaaatctacttcatttcatgcctagaacaggcagattttgtggcatgtaaattatatctcaactgttcaaagaaaggaaccaccttggctcagcagcatcacaggacaggacaaaacaccaggaaggacgtgaggctccatctggaccgcagctccctgagggctggaggcctgggcagagcagaggagggtcctcaggccccagtcacagatgagcaggagcattagggaccactcagcacagagtgggccacatggtggatgcccagcaggccacccggggtccccacatccctccgcctgtctcactgccacgtggacaaatcagccaccagccagtccaagaactcctaaggcagtggttcccagcaggtgactctgcccctccaggggacactgggcgatgtatgcagcatctgtggttgccacgacttgcagatatctaggcatggagtgggtggaggccgggtacgctgctcagtgccctgcagtgccccaacacccccaccccaagaacaatccagcctgatgtccacagtgccacggctgggccagagcacacccagggctggcgtcgccgctcctgccctctggtcttcctggctctccaaagctcaacgcaagtgagcatcacccagaagctggttacaagggcagaactcacccccacccacatgcccctccaggacccacatgcctcggccttgaagccacctccacacacacacaccaagccttctgcccagagattgccttttgaaaacccctgcaaaggagtaaaatagacaaagaggcccaagcctctttgaagagagagcttcaggaagaacgcaagcggctaaacgcctgtgaatgagtgaaccgcactcataagcagggcagctgacactacagctgcaccccccaaacaccccagccctgctggtggtgcgggaggcgaggctgcggctttcatgcttgctgctgggagaagctctgtggggagcgggcgctttcctgagggcctctacggcttgagtccattcataaaacgaccccacatggaaaccacccacatgtccgactatgtatggaagctgtgtgtaaacaacagagcacagccacccacgtcaaggaccgaggacagctccctccccaccatgacggctgcaaagcacacacaccttaggcaatcacgcctatggttcagggacacaaatttaagtgataaaactacaagcaagtcaaggaaattaaacttacagaagtcaggatcattaccataataattagctgtacaggccgggcacactggctcacgcctgccatcccagcactttgggaggccaaggtgggtgggttacttgaggtcaggagtttgagaccagcctggccgatacagtgaaaccccgtctctgctaaaaatacaaaaattagccaggtgtgatggcggccacctgtaatcccagctacttcggaggctgaggcaggagaatcacttgaacccaggaggcagaggttgcagtgagccaagattgtgccgctgcattccagcctgggtgacagacggagcaagaccctgtctcaaaaaaaaaaaaaaaaaaaagccgtacaatgtcctatgcactgcatattttgcaatcaaagcagctcagagggaaaacaaagcacatttagaatccacgccctctggtccaccaccaccgtgacagcacgggggacgagggcacctggacaacagggacgcattcgggaattctgggagacttttcttaccatcaaggggggtcaggggcttttaatttggggttgattctacctccaagagacattctggtctgggcacacctgtggctggcatgaccagaggagcccctggcacggagtgggtgggggcggggatgctgctcagcaccctgtagtgcccagaatagctctacccagagaatgatccagccccaacatccacagtggtgaggggcagacgctgatctagtggaatgactgacgttattaaaaggagagaaaacccgctcagttcggctgggcgtggtggctcacgcctgtcatcccagctctttgggaggccgaggctggtggatcacctgaggtcgggagttcaagaccagcctgaccaacatggagaaaccccgtctctactaaaaatacaaaaaattagccggggtggtggcacatgcctgtaatcccagctactagggaggctgaggcaggagaattgcttgaacctgggaggcggaggttgcggtgagccgagatcgcgccattgcactccagcctgggcaacaagagcaaaactctgtctcaaaaaaaaaaaaaaaaaaagaaaagaaaacacactcagttcaaatttaatctctttatatcttttcctttcttttttttttttttttagttggagtccgctggggaggctgaggcagggagaactgcttgaacccaggaggcggaacttgcagtgagccaagattgtgccactgcactccagcctgggcaacacagcgagactctgacttggaaaaaaaacaagaagaagaaaaaaaaaacaaaaaagaaaaaagaaaaagaatatatgggctgggcacagtggctcaccctgtaatcccagcactttgggaggcaaaggtgggcagatcacgaggtcaagagattgagaccatactggccaacatggggaaaccccatctctactaaaaatacaaaaattagctggatgtggtggcactcgcctgttgtcccagctgcttgggaggttgagtcacttgaacctgggaggtggaggttgcagtgagccgagatcgtgccactgcactccagcctggcgacagagcgagacttagtctcaaaaaaaaaaagaaaaaaaggctgggcaccgtggctcacacctgtaatccagcactttgggaggccgaggcgggaggatcacgaggacaggagattgagaccacggtgaaagcccatctctactaaaaatacaaaaaattagacgggcgtggtggcgggaggctgaggcaggagaatggcgtgaacccgggaggcacagcttgcagtgagcccagatcgcaccactgcactgcagcctgggggacagagcaagactccgtctcaaaaaaaaaaaaaaaaagaaaaagaaaaaatggagaaaactttcccaaaactatgaaaaggacttgtgagaacaaaatattaaaagtcgtttgttttttgtgccaattctatcgagctttagaagctgaggacactcccaagtggaccaagacacatacacatgagaccactacttctcacgctttttggactcatcttaataggttttgcatgggaacccgatacgtttacacgtacacacaagtatcacatgcagaaatcaaagtttcaggacaggacggttactgtatgtgcctgcactctggtctcttctagtttcttttcctttttcttacctagcataaccattaaattgaattcacaacccacaaagaggtcacagcctgaggactggaaaacagtgaactagacaacctcagcgctctggcgcttccagaaaaccgcgtgtcactgcagcatcctccgcatcatccagcaaggagggaggtgactgtcatccccatttacaagggaggagacagagcagggggctctagatgggccgccccatgaagtcagccagtcagcccaagcacctggactcggatctcccaaacctcatgcgatttctactccatcgcactgcctttccacgtggctttcaaagtcattgctaagccttgtttccatgatgccacactcaagttttaggtgaaaatctattacgaaatggaaactttttttggaaactatactgctgcagaaaatgcgcacactgtctagagtctttgttccgggtgcagtgggcgggagggaagaacctacaacatacggtctataggatagctgctttttcaaagtgagtgggggtgctggaggtacaactagaactgtcattgaacagtcatttgctgctctccaatcaggagactccagcagctgcagagaacatccagaatcagacatgaacacctgagttaccaccctctggaccataacaatcgtcttccagtgagaaagccagggtccccagacactgcgtgtcctgcctgaaatcacccacccgccaatggcagggccaatgaggaagcctgggactttcaaggacaaccctgcgccgttttaaaaatgtttcccagccgggtgcagtggctcacgcctgtaattctaacactctgggaggctaaggcgggtggatcactgaggtcaggagtttgagaccagcccgaccaacatggtgaaaccctgtctctactaaaaatacaaaattagctgggtgtggtggtgcatgcctgtaatcccagctactcaggagctggggcaggagaatcgcttgaacctgggaggtgaaggttgtggtgagccaagatcatgcctctgcactccggcctgggcaacaagagtgaaactccgtctcaaaaaaaaaaaaaaaaagtttccaccaccaagacccccttgaaggggcccagacttgtggggaaggcgctatcaactcacaccaattccaaaggaagaaaaccaggctcaggggcttcccagtgaagacaggcacatccccctgaaaaccatgccccagactagaggtgtggtcctccactggacagaccccctggcccatcgtcagggtcccagaacaggctgctcagtgacatgcgctgaagggagcagggacgggcgctgggagatcctgcctgtgcagaaaaagtcctctcgggaagtgaaccacatttccaatctgaaccaagctcagtaaaaaccaggcccatcagcgatgctttcaactcacaaagaatctgaacattactccagttagttacacgttgtaaccaaagcagttagggagagcttctgagatgaagaaaaccaaggaggccgaagggaagtggggtggagaagaacaaaaatgacctcattaaggtgggggcaggcgaagccacaccacttccaggaaagtgtaaaggtgtaacaatacggcaagagctcgggttcccagagagagggacatgggctgagggacatggtgccaggaagcaagtcccttaacttccctgccctcctgggcacctcgtcctggacacagcctctggtactgggactggtgcggtatcagacggcggctctctttcaggcctgccttgctgtccacgcagggaagcaggcaggcagtcgctcaagtaggacactttctaaggctcccactgcccaagggctgcacgggtatccttaatgaagccagacacgtggtggccactctgcccattcttcttcaatctaggtcacaggttgggggaagggaggagcgggaaggaaacgatccccacggttgtaattttacttctggaaaactatttcctcgccctggctttcaggttcctacttgaagtcagcttccccattccagcttcccgcaagctgctacctcactggggatcaggatgccgctgtccttcctccctcctggcagcagccccaccttcctgggaacgggggcactggaggcaacgccccaagaccctgcctggttccgagccaggcctcagggagcgacctggacacgcatttacacgacccagaaggaagaaggagtttctccagggacggcccaggaccccctgcctcggtctcccggggagggtccgggggcggggcccgggcccctgcatttttaatcggtgattcggaaacacactcaggttgaagaagctctgcccagagacctcgcaagtctcctgggagggtggcccgagacgggggcaggtgggcccgaatctccctctgagagagtaaactgagggtccagggggagggcacctataggcggggcccagggcattgcattttgaacagcgcttcccccaggtgatccgatgaggcgaggatccgagatgtgctgctccaaggccttcgcccctcgtggggaaactgatgctgggggaccgaggaggtgggcggcgccccaggcccaggccaggcagggccggagccctaagcgggacctccaactaagacagagcccgggcgggcggcaggccgagcaggcccagtgagcagggctgggccctgggccggggctgtgaccaggccgagcagccccttggcgcgccgggctcacctcgtcctccttgtggttacggatgccgcggaccaagtcctgcagattcttgtcgaacatgcggtcgatgctgcccttcaccatcttgagggccatcgcggcggcccacgggcttttgcctcgggaggcccgcggctgggcgccgtgagggggcccggggcccgtgcctgccgcccgcggagcgccgcgctgccggccgctgcggcggggcaagctcccaggccagggcggcggcggggtccaaggaccgcggcagaggcggcgacccgctcggcaggtgccgcgatcccgctccgggccccttgcaaatggcggacaa

SEQ ID NO: 1529 - DNA, 50570 bp, Homo sapiens; identical to SEQ ID NO: 1528
  source 1..50570: mol_type = genomic DNA

SEQ ID NO: 1530 - DNA, 14461 bp, Homo sapiens
  source 1..14461: mol_type = genomic DNA
gactttcactttccctttcgaattcctcggtatatcttggggactggaggacctgtctggttattatacagacgcataactggaggtgggatccacacagctcagaacagctggatcttgctcagtctctgccaggggaagattccttggtaagttggggacagttgacctgcctccatcttattctcacagcttttgtagataagctgggagaggttaggtgactggttcagatagacaggaaagtagcggcaaagcctggatttgcacccaggcttgagtctgattgcttcccctctcctgctgggctcttaaactatagagggttggggaaacagctcagatgggttcacaaagctccctgggctcagccctggttttgactgctgagacacgactgagtgaacccagaaggaaggtttgtgttgggggtgcccatctctttgggaaatttgaaggaaccaaagaaggtggaggagaggaggtgacccagatcccagcctgttcttatggccaggccacaccaaggctggccccagggtgctgctgctgaggcccaatgggggcaacagaattttttttcaggtacaaggagttcagaggtcatctcacccaccctgagtctgagcaccaacttgtgccaggccctgtggggaaactgaggccctgggagcggaatgacttgcccagggtcccgtgtcaggaggctgagcaggtagatcataggactccacgtctctggccctcacctctgtccctctgttcagacttctggggtgatggagaagaaacaggctgtgctgtgtccctaatgggaaacgtggctgagacaggggagtgagaagggtgcgttgcagaatggtgcctgtggcatgatgccagctttgcaatcatgagattcaaaagccacactgtggaattgtgagtataactacaggagtgagagcttagatctctgtgttcatagaaggagaatcaaacctggaaacttttggattattaaaatcaaacatttttgcttcaatattagagtcacaagggcagatgttggcctcccctctgccctccaagagctgtgtgactctgggaaattcacctcccctcccagcctgagtattttcccctgtaaaaaacctgatagagctgccaaaagtccatgaaatcaggggggtaatttctgtgaaatctgagtcatggtcttatttgttcttcaccaaaaagagatgatgaagcctgtaaccccagtgctgtgggaggcagaggcgggaggatgacttgaggccaggagttcaagacagcctgggaaacacaggagatgctgtctctatgaaatcaaaaattaacaaattagcccagcatggtagtgtgtacctgtagtcccagctactcagaaggttgaaggaggcggatcacttgagcccaacagatctaggctgcaatgagctaggatggtgtcaaagccctgcagcctgggtgacagagcaaaactgtttattaaaaactaaacgaaaggccgggcgcggtggctcacgcctgtaatcccagcactttgggaggccaagacaggtggtcacgaggtcaggatatcgagaccatcctggctaacatggtgaaaccctgtctctactaaaaatacaaaaaaattagccgggtgtcgtggcgggcacctgtagtcccagctactcgggaggctgaggcaggagaatggcgtgaacccgggaggcagagcttgtagcgagcctagatcgccccactgcactccagcctgggtgatagagcgagactccatttcaaaaaaaaaatgaaatgaaaatggtgatttctcaggaggagcacactgtctcaacccctcttttcctgctcaaggaggaggccctgcagcgacatggagggagctgctttgctgagagtctctgtcctctgcatctggtgagcttggctcagagccctgaggcgggagggagggctccctgtctgggctgcacaattggactgggcttgggctgggccagggccatctgggcttcttctaggaaccaaagtcacttcccggaattgaccaaccggcagactcgcccagggaggacccgctgtatcctagttgaggctaacggtcaatatccggcctcaatattcagcagaggctccaggtcagggtctgagccaggccaacaatgaccaaggaggatgggatccagggtgcagctcctcacaagtgtcgggggaatccgaggcaccagctctctctaccctcctgctcctctgctctctcctggtcctcctgtgtcctcatggctcatgagatggtgttgagatggctcccctggcctaggggatcacacagtgaacaaagcaggaagaaggcgaagggatgcccctctcctgtcacccttgtcccttacagcaagaagggcccagacgcccctctgcatactcccctggtgaactgctgcccaggactgggtcccccttttacccttgctgcatggagtccccagaagacaaacatctgtgtgtctgaaccctgagacaaaggcaggaaagggaaagagggaggcgagtggcttttgaggagggggctttagtatgagagctggaggatggaaccccatcagggggcccgggaaccactgagctgttaaaataaagtctgcaaacaaagaccagctgctggaagtgggtgtgccagggagtgcgcagagacacacggtgagaaaagaacaatggtaatgcttggagccgcccctaactgggatgggcctgaaatggtattgttattatttatagtatcattattagtcattttcatcttatttgtaccctccctctatctctcctctccaccttttcctaacattctatcaccagttttatgtcttccattagcaactttgtagctgtaaataatttacttacaactttcatataccctcagttgtacccagtatttcttaacttccctctttaaaaaaatgataatattaatcctccttctccttcgttcagtgcttcacatcccaactgctacctttgtgctttaaattttgtactaattggtgttgataacaagtatatttagttctcatatttatatgttgtgtatatgttttggtttttttttgtcttaaacaagagactactgagagccagtaagactgaaagaaagggcatcttcatatactgctagtttgagtgtgaattggtacaatttgcctgcagtgtggctctaggtataaagccttttgagttgttgatagcctctgacctgctcattctactcctacaaatatcttaaggaaataatctcaaatgtgggcaaagttttatgcgaagaaggatgttctttgtagcataatttatatgaggaattagaaacaccctgaggtccatcagctagggaaagacagcagaggggacagggcagcaccaggagggcttggcagccacagcaggggctgggctggcatctggcaagatccaggtctttgtgggacaaagaatcttagagaagcaacggggacacaggctgtccagtgcagcaccagtgaattcaccaagatgaagagttgagcacagagtgtgagacaaggatttgcaatgaggagtcatttaccatgagcgtgtatacatgactcaatattgtatatttaagggagtagagcacagtcattgaaaacatggggttgaagcagaagtcctggctctagcactattgtaaaaacactggcaagttccctaacttttgtggattcctctgtgtttgaatgggaaagtggtacccatctcctggcctgtgtgtgatcatcgaatgagacacatgtaagaggctctgcacatcgcagacatgcaatacacactggctatcaccagctagttatcacacatgctcccaggccctggtcattgtcagaaccttcctccccatctctatttctgtgtatagactctgtagtttctgtaatgatcagatggctgcccgtcctctgattatcttctcctcataccccaacaggatgagtgcacttttccttggtgtgggagtgagggcagaggaagctggagcgaggtgagtgtctgcaaatagcagatgatgggggctcagtgatagacaaacaatctggtttaggttggtcttggtgtttgcttccaccccagagagatttgcagagccccggctgctcaagcaagcctccctctgtccactggtggctcacatttgatcccacaatttgttttctcctcctcaagggtgcaacaaaacgttccaagtgggacagatactggagatcctcaaagtaagcccctcggtgactgggctgctggcaccatggacccaggtaggctcacctcctcttccctgctggttcctactcgcacttagaatggagggtggcacctccacagctgagtgagccccagaagaacccggatggactaggaggccaatgagtctgcccaaagcagcagaagaggtcacgtggagtcccccgacccaggggtctgggggtcatctgcatcctgacctctccttagggtgacacggcccaggtgcccacttcctccctaccctggcacctagcaaatgactcaagtggggcaggacatccttggggaagtggaatcagcgggggggggggggagtgtggggagagcagggtccaggaggagaggagggctgggagaggaggttgaccagcagccccgacctgtcacctcccgctctgctccaagctgaccctggggtgtttccacctgaggctggtcccctccctccagctcttgccctgccctagcccctttgctctgagtggccctgtgggaatgtatcgggcctgattcagcttccagcttaactggaccccggtctgtcctttgccacatcccctctgtgtgacctggcgctccttacctcccttctcctgtaccatgagaataatatttccccatgttgtcttgaggatcaaatataacacggctacctggcctggccagtgcctgccacacaatagggcctccctaagggctggttcccatcccctctactggtcccctgttgattccaggtggaagccaccccgtccccccccagctgtgttagggcacccgccctgccctgcccatcacaagcacctgcttaccagggatgactgcctcaggcaggggctgagttcagtcatctaaaatacccccggtcaaagaaaaatctgaggcccaatagaattttaaagagttaattgagtaagaaaggattgctgaattgggaaacagcaaactggaggaggcttcgtgctatggtgaaaaagtgtcggagacaaggtttatcgggtgaatatgaaactgcagtaaggacattatttgattggttgcacttacaaaactgcctgtttgggtttaccttgttggaaaatccctggtcacgttggtgccagtgtgagtttagggaggtctccgaatacaggtgagaccggaacttagccttgcccaggtttttgatgctgaagagagaaaaaagtcaaagcaaaagcaaatcagcttttagtgcaaaacagaagtgcaggctcaggggtgggagtgcaggcggactcagaagagccagtcgggcccagtggagtttggggttcttgtctttgctggtttattaaattaaggtgtggagtaagcataaggatttctgggaagaggtggggatttcttggaattgggagggcaatgcagttttgtaccaaacatgggcatacatggaacggctgtggtgcgggtgggtgtggggtttagtgagacaaggagggtatgattgagtgtgaggcaaaacgtgggtcagacccagcgccgagttggatctcactggtcttagctgaattggccacttcctgtttgtcaggatcctgtgggcccatcccctccccctgtccctacaggtggtttcagcaactccttctgtgtctgtcatgtgaacctgctgcctggagttcttgtttcttctgtgacctcccagtatccacatctcagcatggccctctgtcagctggctttaagttttgtttgtatctaacagaagtacccatctgatatgaccccagttgagtttcccatagcttgcagtttcagggggttacagctgttctaaaggcctcgtaggtattgcctgtccaggaatgtttcagggctggtttttgttttaattttgcttttatatccaccagccccaccacatcaagaaatacacagatttagtgccagaggttccttccatccaaacctgggtttccttcctccttttggtgaagaaggaaaaagaaaaaacaagacaatcgctcgcccagccaagtcagcattgcgttcatttccctaagccccatttcctcaggagggcttcctccccttacagagttgccacggcaaccaagtcagctctgctcaggagccgccctggacagcaaactgggctgtgctgagtcctgtccaagacgaggggagggcagggaagattagaagccgagagcactcagccgaccccggaatccttacgaagggctgggctgggggactgaggaaaaactctccccccaaaacaagatgatctgtggtttaataacaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatggtagttgtactcaatgctgtggagtttgagacattatttttaaactttaaatagccccacaggtaagctataagggagaatgcagagaccacaggcattttcaaaacataaggagttttaatgttaaggagtttaaggagaatgtcaaagaaacattggccttggagtcaaatcctgagcttcctgcttgatggttttgggcggtgactctcgctgtctggattttactttcttcatctgtgaattaagaatgaggtggccgggcactgtggctcacgcctgtaatcccaacatttgggaggccgaggcgggcagatcacaaggtcaggagatcgagacgatcctgtctaacacgatgaaaccctgtctctactaaaaatacaaaaaaaattaccaggcctggtggcaggcgcctgtagtcccagctactcaggaggctgaggcaggagaatggcatgaacccaggaggcagagcttgcagtgagccaagatcgcaccactgcactccagcctgggtgagagagcaagactccatccccccaaaaaaaagaatgaggtctcttgtgtgtgcacggcaagaaacaattttacatcatgcctcagtgcacacacaaatacatactggtccccagttccttatctgcaattccataattcccagatccctgcaaaccacacgttttggtggcagctgacttcaggagtaatcctgctctgtactgacttgagttctttgtagacctaccattattttttacatttaatgtgaatatttgcttgtttcactgttgaaacatgtgtgggtgtgattacagggagcagtccagcctctgctgggaatggtcaggaatataccatatgcaccccgtgtcctttctaaaatagtggaaattctgaatgcctaaacacatctggattccaggaatttacattaagggatatatatttgaaataacccacaaaaacaatactcacccctgctacgcttggtacactctgatattttcaaattgattttctttttaaaatgctgcttttgaaccaataatttcataacccaatgatgtgttgatattcacattttgaagacactggtataaagtgtttgacccaacaggcatgtggcagatggaagtgatcactgggatgtttccacttccttggcctggaaggctcacttcatgttggtgctgagctgaaaaggattcattcctctccaaagcaccatggcactcccctggtgtttcaatgttctcaggctgccatagtaaaatatcacaggctgggtgacttcaacatctggcttttattttctcacagatccagaggcaagaagtccaaggtgaaggtgccaaaagggttggagtctggggaggactctcttgctggcttatggaagctgcctttgcactgtgtgctcacacagtcttcttgtgtccctttctgttcttacaataggacactagccctctaatagaattagagccctacccttgtgatctcattcagtcttaattgcttccttaaaggccagatctccaaatgtagtcacctgagtttaaagcttcagcatatgaattttgggggcacacaattccctctatagcactaatgactccataaaacaagtcccacatcacagctgtccaggaaaattaacatgtagtcatctcttatgcaatggctgttatgcactcccacactttcctccaaccttatcctttcttctttccaactagagagcagtatctttattgaggatgccattaagtatttcaaggaaaaagtgagcacacagaatctgctactcctgctgactgataatgaggcctggaacggattcgtggctgctgctgaactgcccaggtaagctccatggggttacctccattgggcactccggcgatgccacccagctctcccctgggctagttttccctgacaggcacacctcctccaggcagccccctctgctgggcttgaggatgaccttcttggcactccaggaagaatatttcctccatgtccttcgctggcagtgagtagcctcaggctgaggggataggaagcccacaggaacagggtcatttctgccatctgctggtgatgggaactttgccagttactttctcactttcagcctttcttcatcaatggagttttattgtgagaaaaatgagatcgtgcatgtaaagtgcttagcataatgactgacacacagtaggtgcacagttaacgttaacatcttacaagcttggtggaaacagaaccagggttaaggatcttcttcttgaagatgggagcccagcaggacttgacctttgggacaagtcagaaaaatcctgacctaaccaatgtgtgttcctggggatgctggctggagccctttttctcatctgaggaattccataaacacggcaggacccttctgctggtccaggatgccgagaggctggagtggagttgcacagcgctgggtctctttccagctctgtctgtgtccagtccctgggctctgggcttatgtcagagactggaaactgtcatcagtctaataggaatagcaactcaatgtgataggagtgtggtgaaggccttagaggcaactccaggtcaaaggtggggaaccaacaccaagatcctgcccaaaggcccagagagaccgggatcagcgtcagagcctggagtcaggatggagcaagagtcagccttggttgtaggacaagcaggaaggctggggcaccagggctgggactagggtgtggaaagagaggcaccaagggcttgaaacttaaggaggtcatgaacttgcagaggacatgtgagtgggagagggatatttcttccctgtctggatgatcccaacactcatgggcatatagggtcatggttgcctgtgtctctcacaccacgccttggaactggcaagttctgggctaccctttgagaccttcttctcttctacacagagaaacccctgacattgacaagcagtatgtcttagtgaccattttcatagtagaattagttgctgccaatttgtgtaatttcagggatactgagcagactcacaacttcccaaccaaggaggaaaacacttcctctaccatcttgtccaaattcaggtcttttcagcattagcaatttatataggtggttctgaaagtgttttgaatcttctagaggttccataaaattgcaaatggccttggtgtgcacacaggtgaagctgtcactactaaggcatcagttaggctggtgacacctgcgagtgagacctggaaggttgggggtgcaggtggtaggtcaggaggcagtaaggtggctggagcgtccatgtggagccagaatgaatagccagatctcccactccagtcagctggggcagtggccagaaccagtagccttcagccaggtgaaagggcatgaggcattggaagggagcagatgccaggcaaagtgaactcctgtctctccggggttttgtttttgtttgaattcaaagtactcagagatagccagactgcaatgtctgagggcacccttacctttgacaccacctgcaaatttaaggggatttctaaatccatcctttgattttgtaattcactggaaggactcacataactcactgaaaactgctatttcacaattgtggttgatcacacggaaagaacacagattaaaatcagcctaagaaagagacacacggggcagagtttgggagggttttaagtgtgaagcttcattgtcctcaggacgctgtgttctcctgtgtgaatgtgggacaaaacacatgcggtgttgccaaccagggaagctcacccagttaaggaaaaattcctgtgaatcacattaaaccagaaatgaagccttttttcaggattgttgttacaggggagggagactgagcccagctccaaatatagtaaagacagagggggagtcacagccaacaccagggtgggggcgggagatggaacaggactgataggagacaccagagtggggggttcctgctaaattggcctaacaggattctcactaaaggcaggtcagacactcacccatcaatggtgggggtgaagagcataatcagatagcaaagcgtaatcagacagcaaggggggaagaccctccctaaactgacttggggagattcttgctgagctgggtggtgcaggtccagcaagcagtgggtggctgtggaaggccaaggtcggcgcctagtggagaagaggctcagaagagcccagctggagttggtcaaggagaaagtccttctttctcaacccatgccttagtgtccagagtatctgctggggctggatcacaagctgccctcatggctgacctggagtctccagcccctccctgaggtctaacccctttagtccccgggtcctctgggatcaggaaagacaccaaatagccccaaaccccatcatccatcagattcctatacggtcccgtggccaaatcaccaggcaaagacagatgttcctaccaggcaggacattccaggggcctggagatcacttcccaggagctgaggacaaagggaaggcctctctttgggtaaagttcatgcttcactttcctgccatcctgggaataaggtctctttgtctcactctcactgctctttgttcatctgcagagttttccctctccaaacactttggcagtcacggtgttgacctgcccttgaatgaggaggcatctttatcaaacacctaccatgaaagagcatctgagatgcctttaagatatttatttccatatggaataaatattgaggagtatctatgatgaacaaaatgtgtttgagtttgaaagataattaattccatttgtaaaatttgtttctatttgatcgatagtgaaagctctgcaatttacacaggatagagatcacatggagctcatttcacagacagggaaactgcatttcttttttttttttttttttttgagttggagtcttgctctgtcgcccaagctggagtgcagtggcgcgatctcggctcactgcaagctctgcctcccggttcaagcaattctcctgcctcagcctcctgagtagctgggactacaggcgcccaccaccacgcccggctaattttttgaatttttggtagagacagggtttcaccgtattagtcaggatggtctcaatctcctgaccttgtgatccacccgccttggcctcccaaagtgctgggattacaggtgtgagccaccacaccgagccaaaactgcatttcttaatcctttaacctttccttgtgcaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctgga

SEQ ID NO: 1531 - DNA, 14461 bp, Homo sapiens; identical to SEQ ID NO: 1530
  source 1..14461: mol_type = genomic DNA

SEQ ID NO: 1532 - DNA, 14461 bp, Homo sapiens; identical to SEQ ID NO: 1530
  source 1..14461: mol_type = genomic DNA

SEQ ID NO: 1533 - DNA, 14461 bp, Homo sapiens; identical to SEQ ID NO: 1530
  source 1..14461: mol_type = genomic DNA

SEQ ID NO: 1534 - DNA, 227273 bp, Homo sapiens
  source 1..227273: mol_type = genomic DNA
tccacagttaggaaaagttttttccatttaatactagactttcaaggattgagatgcaagctttgtatgcaattacatccaatgttaaaattggtaatacataatttacaaagattaacatcaaaacaatcatctatttagatatgcttttgtaaaaaggaaatatattagcagcatttatattttccgcaatcacacagcctacagacatgcagactaactctgtatctatttgcagtgatgtagtgctttgccccgcatttcaaacaccaaaacccgcctggcagctggggggttctttttatttcgttattataaaataactgaaaaataaaaaaaggcattaatttctacaccagtaagaaaaaacaagtttttgcacttacctaacatttgattgtctaaaaaacatttcagtttttttttagtctttcaacaaaagaaagataaaatgacagagcgtagtgtcttttgcttctgttctcgcattttacaaagtttttttttctttttcatcttttttaaaattttagtgtttaacactataaaggaaacattgaattttaatctctttcttgtcattttctcgcttttgactaaaaggagacccccaaagtgcccctagtcccacctccctcccacccactccctgcaatgaaaaacaaaagaaaccactcaaacgggcttggacatgcgatttttccagctccacatgtgagtatcttatacccaggtctcttagtaatgtacagtgcttctctacagtaagaaaatactccaaactattttcttaattctcttttttctttaataaaatatttattttgctttttctctgctcaaggggatcattggcatcccctctctcttttgttttttcctcaagaatgacacagaaaggggaaaaaggaaaaaatatttaatggaatggaaggtggtcaatgtgtctacctaaacgagtcagagcatcgtcaccataaggggaaatgtacaattaggacagcattggtccaatattagaaaaaagtaatggggacatgtttactattgtattgcttaccaatcacacagcaggtgtgtgtgtgtgtgtgtatatatatacacacacacatatatatatacacacacatacacacatatatatacacacacacacacaacttggcacatttaaaaaccatcttttctcttataagaacatctaaaacatatatgcatatgtatgtctgaaaagacaacaaagctttttaaattttatttttaaagagacagtatagtctgttaacttctggtcaagagagtaggaaggaaggagacaccctggatatacctcctgatgtcattcaggagggtgagggaagatgggctaggggtgaagagaaatatactgtctctttaagaaagggacattgaaaactgtacaattaagaaaacaagagtagtgttttcaattgataatctatactcacaacaaatactctgataggtgaatactgctgaacagtttatgtagtgacttttgttgcaggggtgggtttagagttctttttatgtaggtttttaaatgattttattttgaactgaatctccatttgcacagcacagcagacacacaagaactacagcgcattaaaaacagcatgtgtgctggcgggggcctggctttctcattagaaaaaaatatgtttgacaggttatgaagggtaaaacaaaaataattgcaagaactaccgtgcccttctgaccccatgggggccttccctatcccatgattccattttggggagtagaggtagggagggggcagcagttacaagtgctttgagctgtcaactcacattttactttgacctggttgggcaagaaaggagagacaaacttccctagtcaggtatctaggaagaagcctcagctactgtttctgtttaaggtctctggggtagctcttggagccaacagagaatagatggggtaggaatagggatcctggccctatccctttggattttgagttatacctgggtataggaagcagcttcttcgcaatgcctgtgggatctgaggatgacagaaaaacctaagctgtggggtggggcaaatgctataaagtaccagtaggttctggtcatcaatgtggtcctccctcctctctacattattaacccttaaggtgaagcaatggagaagaaaattaattaacctgaactgtcttggacagaaccctttcctctccctctccactagctccaaggcttattaagtacctaatgtcaacaacatggccccattccccttgcccagatggacccttcccacccctgtctatacccagagagcaggaggcaggactgattagctccactggatcccagatgcttgaggttctcattctttgagggtcactttcgaaagctgttttctgggataaacaaagtacgccttcgcagtttcctgcctgatccttcctccagcaagtaggtcacatcaatggctgaaaacagaaccaaggaggctcatcaaaataccaatctcctactccttattccagatttgagctctaaggagagcacacgaactcaatgattccttttctgacctataagcaatttagcccatcctccaaccctacgtgaaaaaggtggttctttagaggagatcatctcaccttccagtttcactaccaagatacaactaaaagcaagcctataaaagaactataccattttcttagaatactttggatgctgaaccagtaattacaatttttttccattccctctcatttcgcatttatcttaaaccctagatatgaacctgattcttcttaccattttttccagggattttttcaaggagattgagcaagatctggttgagtcgttcccgttggttatgccgtcgttcctcaggggtacaggttgactggggttcttgactactttcctctgtttttttttcaccctcactgacgttagcagtggccccttcccgttctggctcctccaggctgggtatctcattggctgcttgctcttgactggctagaacctcttcaatcaagggtagagcatcatcctcctggcccaagtcttttaggggtggctttgagcgctcagacttccaggatgatctgccagaaggatatctgaatttagtgtaagacacttgaggaggaaaaggggatgaagggtaggaggcctcaagatggcttgagatcctggagtccagcagttagagccttagcttgaggtaagaaacttgactctcgttttcactttatattatttgaataaaacactacctttaccagaaatttatttgtaaaattcaacttttattatttctcttaggaatattcacaaatggtataggaatccataaaatatacaagggctaataaaattgcttagctggttctaaatgactgcttcatgactagagaagcacggcacaaccttgtgatgccaataatccaactacaataataaatatttaaatggagttttaaattttcgtgcttccctttttcatatcaatagtctaatattttctcccttatggtaagctattggtgtaggtaaagcagttgttatgcccccattcaacagatgaggagactgaagaaaaagccttctgtcatctttcttcaggaataatcctcacgtacaaaataagcaaaaataaaaactatgaacccatagttcatagctcagtgaaaactgtactggctacatctgttccttgatagaggtaccaagagctgatataccttgaggtaatggggaaagcttacagacatctaaaagaaacttttctgagtctggagttctgttccaaatctctgtctctactccctgcacatctctctgttgctccaattaaggctccataatgggaccacatctactgaaatttagttcttccatagtgctggcactacactgggctactctgcagagaatacccagtcctagaagtggagctgagtgggtagttgtttgttttcttgatccattcaagctcttagtcaatcccttaggatcctcatatccccccatgggacttaccgtcctccattcctcttgtagttgtctgggacgtaatgaggctgcagagaagaaaaggaagaggtaagcatattgtagaagctgggagagctagctcttctctggggccagtcaggataaggaacacagtagggcagtagacaagttgggtgactttgttttaagatgagaaatttagtacttctatgaatatgcaggccacaatgattatcagcattttgtgctcccaggatgacaatgggagggataagtgcacaattttctctatcccatttcaccttttaaatacagtcatatgtcgcttggggtcatacggggatatgttctgagaaatatgtcatcacgtgatttgattgttatgtaaacatcataaagcatccttacgcaaacctagatagtatagcctactatacacctaggctatttagtatagcctattgctcctaggctacaagcctatatatacagcacaatactgtactgaatactgtaggcagttgtaataccatggtaagtattgtgtatctaaacatagaaaaggtattacattgcagtatgttacgacagctatgacatcactagatgataggaaggaattcttcagctccattataatcttacgggatcaccgttgtatatgcagtccaatgttgactgaaacatgttgcacatgactgtagttaaggctggggtttcaaagctagtcagtaagctattgattgagcaagcaaaaccaaataagtctagatgcgaggaaagacctggtggtgggcagagaatacaaaagacggtctggaaaattaaaaaaaaaaaatagggaaaataggaacatattgctttgttttctggttagcttatttttctttctttttattttttgagagtcttgtcctgttgccaggctggagtacagtggtgcgatcttggctcactgcaatctctgcctctgggttcaagcgattcttctgcctcagcctcctgagtaactgggattacaggtgcatgccaccatgcccggctaatttttgtatttttagtagagatggggtttcaccatgtcgaccaggctggtctcaatctcctgactttgtgatccacccgcctcagcctcccaaagttctgggattacaggtgtgagccaccgcgcctggccctggttagattattgctaaggattccagggtgacagctatgacttttgacaggcccactaaaagaagactcaaagatgaggagctcagccagggttttattagagcaaacagatgaatggatgatcaaaatctttatggaatgatgaatgacaaaacgtataattggcacacggttctcaacaatttgaaagaaaaaataccaggaaaaagcctgacaatgaaaatgttaataatggttattttctggatagtggagtatatatataacttttttcctcttatgcttctatacttaattttttttttttttttgagacagggtctctgtcactcaggctggagtgcagtggcacaatcagcttactgtaacctcaaactcctgggctcaagtgatcctcctgtctcagcctcccaaggtgctgagattacacacgtgagccaccatgatgtttatacaataaacaccaccaccacaaattttgttttgttgttgttgttgttttgttttgagatggagtctcgctctgtcacccaagctggagtgcaatggcgcgatcttggctcactgcaatctctgcctcccaggttcaagcgattctcctgcctcagtctcctgagtagctaggattacaggtgcgcgccaccacacctggctaatttttgtatttttagtagagacggggtttcaatgttcacaatttttttttttttttgagacggagtctcgctctgtcacccaggctggagtgcagtggcgtgatcttggctcactgcaagctctgcctcctgggttcacgctattctcctgcctcagcctcccgagtagctgggaccacaggcacctgccaccacacctggctaatttgttgtatttttagtagagagggggtttcaccgtgttagccaggatggtcttgatctcctgacctcatgatccgcccaccttggcctcccaaagtgctgggattacaggcgtgagccaccgcgcctggctcacaaattttatataatgatcgtgtcttccatttttaatgcaggcataaaaagaaaaagcactgaattattttctgtgaaggttcttcttttacgggtgtgttctcaatgagagagaggaaaaaaaggagtttttcagggttcttgcttcttaaaattatgggtgtgaaagacaaaacaaaacaaaaatctacagaatggggctcgccagcaaaggttaaacagacgaaagagaaaagaggaaaggtataacactatatcaacaattttctgagatacagtctatgtgaggaaatgtacttatgctgttcaaatgtcccaaatagagacagagatatccatagtttgggatggaatttggatgaagaagcagagaactacgtgaagattttcgctcagtgaatttcatgcatgaaccagattgtcctaacatgtagtgttaagaaaggaaggagactcaccgagaaatcttttttgggagtgagcttcttggggaagtgatcaaaagcatagggtttggtgcagacaggatagcggttccggtggatcttgtaaaacaggtgtgctgacttgtcaagccgataatcacagatgtacacatcttgctcctttactcctttgggtctccctatgggtccaaccagtgttaaggaatcctatttagccatttctccccctgagctgcccaaagaccccatacacaccaatgggagagcagctagacccttaaaaccctacatggtagctatgtagagaggcaggacaactaagcatttggtagttgctggacaaagagttctcagacactagtgtcaacaaaggataaagtaaatatacagcagaatggatggaaataaaccagaaatgtaaactgagtgctgcagggatgtgtgagggagtattttgagggaaaaactgagcaggttacgaggagttacaagaaaagaacagaggcataaatttgagggaagcacatttgtacatgaacactttttaactgagacaaggaggactcatcagtatcacacagaactgcaagcagtctgtcagttttggaatggaatacgtagtcttttagactattttgctatgattctgagagaacagtctaggcaactgaactctgctaatagtgacaaataacatatattgagcttttactctaagccataaactaggctgagtgcttttgtagattattttatataatcttttaagaactctttaaaatagatagtccttattttcaatgggaaactgatacttagattaagtaaattccacaaaggaacatagataaaatgtggtagagctggaatttgaaattagtacacagtattaacaaaattaactaaatttaataaaaaagaataaacttttattgagtactaagccctaggtaaaagaaaggaaaaaatatagtagagctctctgaagtttcatagctagccttggagaatctttcatcatatacaggcaatcatatacaggcaacaagaatggggtgggcaatgaacaggagacatgaggtcattgaagtcttttttttttttttgaggcagggtttcattctgttgcacaggttggagtgcagtggtgcgatcttggctcactgcaacctctgcctcccaggctcagcaatcctcccagtagttgggactacaggcctacactgccatgcccagctacagaggcagagttttgccacgttggccaggctggtctcacactcctgggcttaagcaatctgcctgcctcggcctcccacaccgctgggattatcagcgtgagccactgcacttggccgaggtcattttttaactagcccagatcacttacctttacaatacgtataaaggtccaacacacagcaggtccccactacagcctccaagggaatgatctcatagagtggcacccgaaatagttcattatgatagaaccgacgggatggagagtggtgtgtttcgtggggacggaaataatggtgaccaaaggcaaaccgttcctctctaaaacaatggaaaagtgagaagggagaggtttagctgattagcaagatcctagtgaacattcagctccactggtacagcacggctggaagaaaaggacaggacctcagcacgtacttttcattcttccaaagcttctcaatgcgaaagatgtcaagtttatctcggttaatgtgagataacagtcgataggactgacggaccgggtggccatcaggggtgcgccgactatccctcatcagatacacacagtcacctaggaagacccagaacacagaagaaacataaaacaattcttgtatgaattctgttaggcatctgtttatctgactcagggtctacatagaactcataatctgaaacagtataaatacagagagctaaaagcagcagtgttaagtgatgataatcaattctagactatgacaataatataagggaggcattccatttcttgagcttcctatatgtttttcccagtcttaaaattagctttgtaacatgtctatcatttcaaattagtattatttggtggagaggtgatgcatgtaagcacaaggactacagatataaaaacttatattctattgctattcgaggccgtatggagacaatgactatgatggagacagcagagacttcctactattcagaaaggtcacctctgacaagtaggattagctcctgtatacataccctgacgaagcagcaagtcatctcggagcaaacagatgaagtagacacagccaggttgggcatagtggggccgagggatcatgggaacctcctgataggagcagaaagccaatgtataagggctggaattactacattcagcctacttatttctcaacctagaattctcaatcaaaacttactgtttagtcatttcaatataccacagatatacaaaaaagatgaaagcaactagagctgttaaacctggaaaagtgaaggtagaggacaaaactgataggctaagtatctcaatctatgttttatgaagcactaattgtgtagttgctctacgtaatctaggggccatatgaaaatgtgtgaagggagactaattattacaatgattggggtatgctactggtatttaatgcccagggtccaaggaagccaaacattctgaaatgcatccctcacaacaagaactattcacctaaacatgacaacagcaacattgttaagaaatactgcctaaatctcttctttttttaaaaatgacttgcccaaaatcacacatataaagatagcagagccaagcacagaacccacttaatgacttaggcaagccacttaccctctctcctatgaagtgagcctaacactaacctttgctgattctgagtccagtgctcttttcacttaaaccactgtctaacataaatgacgttaagggtaccaagttctggattttgtaagctattcctttcatggacatctgatagtgtttataaaaacctcagttttgtttttttttgaaatggagtctcgctctgttggcaggctggggtgcagtggtgcgatctcgacccactgcaacttccgcctccagattcaagtgaattctcctgccttagcctcccgagtagctgggactacaggcacgcaacaccacgcccagctaatttttgtatttttagtagagacggggtttcaccatgttagccaggatggtctttttttttttttttttttttttggagactgagtctcactccgtcacccgggctagagtgcagtggcgtgatcttggctcattgcaacctctgccgcccaggttcaagtgattcccctgcctcagactcccaagtagatgggattacaggcgcctgccactgcacccggctaattttttttgcagtttttagtagagatggggtttcaccatattggccaggctggtcttgaactcctaaccccatgatccacccgccttagcctctcaaaatgctgggattgcagccgtgagccactgcgcccggccgaggatggtctttatctcttgaccttgtgatctgcccgcctcggcctcccaaagtgctgggattataggtgtgagccaccatgcccagctttttttttttttttttttttgagacagtgtcttgctctgttgcccaggctagaatgcagtgatgcgatcttggctcactgcaacctctgcctcctgggttcaagtgatttgcctgcctcagactcctgagtagctgggattacaggcacctgccactgtgcctggctaagttttgaatttttagtagagacagggtttcaccatcttggccaggctggtctcaaactcctgacctcatgatccactgcacccggcctttttttttttttttttctaagagatggggtcttgctctgtcgcccaggctggagtgcactggcatgatcttggcttactgcaacatctgcctcccgggttctagcagttctcttgcctcagccacccaagtacctgagacttcaggtgcacgcctccatgcccggctaattttttttgtattttagtagagatggggtttcaccgtgttgcccaggctggtctcgaactcctgagctcaggcaatccatccgccttagcctcccagtgtgctaggattacaggcatgagcgaccgtgcccggccaaaaaccttagttttatatagtgccattccttccacagatttctaagtattttattttccctttggtcatactcctgaaatagggaagaacagaattatgacccttaatgtaaagtttaagaaaccaaggcccagagaggctgaacaacctattaaaggaaattctgcaaagcaggagcaggacaggtgagataccatgtgctacctctcctacttatagatcagagttttatcagaggttcagcttaccctgtccacaggccttgggtcacactgctcacaaaggtagtgctccacatctgagttcactcccatacaatcacagtgctgccatacctgtagaaaaacatacagtttggggaacatggaggctatgacttattgagagtgtcctgggagcccagaataaaaaattagcaataggtcagggtaaagtaaaagaggaactaagggataactgggtgaatgataaattagagataaatggtaaaataggaggaaaacaaaataatgactgttctaagcaaaagtataccgattgactcataatctatagatctgggcaaataaaatggggagatggacagagaataggaaaacaaatagactactgaactattactaagtaatttaagtaaatgctacagctattctgctttcagaatacagctacaaaatgttttatttactcctgtctaactttagcctcccaacaatcctgtgcgttacttacagccactttacacataaagttatgcattcacatatattagtggggacactaaggctcaaatccaggctttgacttcttcatcaggagccctacatgtattaacatatttcactctatcagaggattcaattaatagagtgtattatcactaatgattcaaaaggcaaagcactatatgaaatactgtcattttccttgatccagattatgtgagaagtgtacagtggaaagtgggcagaaagaaggaaagagccaggcgtggtggctcatgcctgtaatcccaacgctctgggaggccgaggtgggcagatcacttgagctcaggagttcaagaccagcctgggcaacatggtgacaccccatctctacaaaaagtacaaaaaattagccgggcatggtggcacgtggcacatgcctataatcccagctactcgagaggctgaggtgggaggattgcttgagcctgggaggcagaggttgcagagagctgagatcgtgccaccacactccagtgtggatgacagagcaagatcctatcttataaacaaaacaaaacaaaaaaacaagaagagaggagagaaggaaagaaaaagaagggaaggataaagtgaaagaaagataaaaggagaaaggcaatatagtaaacacagaaacctaacagaaaccaaggctaagttacagttcataaacagtctttcaagccaatccaaaagaggcatgggcttcttctttgaatatggtcaccgtgttcatcaggaccaagcttctgcttcatttcctgaccctcaccatgcacttgtcacactggatcatgagaccttcatccttgtagaggccacagatacagcgaataacatcgtcgtccttctcatgcccattctccttttcagagactgaggtctcactgctgtctgcctcacttgctgtctctcccacaatctcatcaatctgggctgatgcctcatgccgggcattgtaataggcctttcgtagacgacaaacatctctcccaactggggatttacgcccatagtacttctgaagaaagcaaataaagaaatcatgtttggttctctcaatgtggcttaacaatttacctaaagaggtagcaaggtagcatgactttctttaccctcccattttggttaacagattttcaatagtatcaaatatatggccagatagttggtaacaacttaaactgaactaaaatgaattcaagttagaatctgcatgttatttttccatttgctcaactgatctgtcattcaattcctgtcacgggccttcttgtccccagatcaaatacacagagatcatgaaatatgaattgatatcacaagcataatgtactgtagaagttcaacatacacctttgtcttgtggatatctgtgacagatctacaggtgttgaatctatgtggaagctgggtttcagtaggaagaatgttacaatttaagattgctctaactcttctcccgcttgtctatttttctttctcattttgtctttcaacttctattattcctttatctagtaggatcttttgtcttccaaacacctctccaaggcatgtcaaaattactgaataatttcctctcttctatgcaccatacaatagtccatcctgtcctttaaatcagttcaaggccactttctctccaatgagcttcagctattccataatctatcactgtgatactcctcaattccatcctcaagatatattactggccaggagccgtggctcacgcctgtaatcccaacactctgggaggccaaggcaggcagatcacctgaggtcaggagttcaagaccagcctggccaacatggtgaaaccctgtctctactaaaaatacaaaattagccaggcatggtggcaggcgcctataatcccagctactcaggaggctgaggcaggagaatcgcttgaacccgggaggtggaggttgcagtgagctgagatcacgctattgcgctccagcctgggtgacagagcaagattctgtctcatttaaaaaaaaaaaaaaaatatatatatatacacacacacacacacacacacacacacacacacatataaacatttacctatgcatatttctgtatatttcacatgtacttattttcttgaggaaagaaactacagatattagttaaatgtattaaaatatctatataacgcagtcataaaggtttaatactaaattagttttttacaaaaattatttttttgggggggaatgatttaaccttccattctagtcctatcaatgtcttcatagatagccttctataatatttagtatactgtaacacataccccaaggatactcaaaaatgactggcttttccaaccagaaatatggctgatagaggagggtaaaaatcttaaacttctagactaattcttttcagaacaaacttgtgaaatctgtttgaagtcagtgaaaaatacctcagcattccgaaagactttgagcatgtcagcatcaaaagcttccactgtcttatagtaaccagtgaggatctgcttctctatggtgataagatctaggggatcagagatcttctcataataatcagcattcctggaacacaaagccagggtgtcaatctggcacacttagcactttttaaaaactcagatgattcccacaaatgtgaacctactttttctttgggggaaggttcaaaagtggagctgccagtgcttgccgggaagaatctgcaaaagaatgtgaggtttagtagaaagattccaccatacaagggaggcaagcatctcctaactggaagaatagaatccctcaaattaaaagtgagagaaaaatccaagtctttttttttttttttttttttttttgagacagagtctcactcttgtcgcccaggctggtgtgcaatggcatgatctcagctcactgcaacctccacctcctgagttcaagcgattctcctgcctcagcctcccgagcagctgggactacaggcgtgtaccaccacgccaagctacttttttttttttttttttttttgagacaagagtttcgctctgttgcccaggctggagtgcagtggcgtgatctttgctcactgcaagctccacctcccgggttcatgccattctcctgcctcagcctcccgagtagctgggactacaggtacccgccaccatgcccggctaattttttgtatttttagtagagacgaggtttcaccatgttagccaggctggtctcgatctgacctcgtgatctgcccgcctcagcctcccaaagtgctgggattacaggcgtgagccaccgtgtccggccaatttttgtatttttaatagagacagggtttcaccatgttggccaggatagtctcgaactcctgaccctcaggtgattcacctgcctcggcctcccaaagtgctgggattacaggcatgagccactgcgcctggccaaaaatccaagtctttttaaggcctgtgaaaaagccactttttcagatatgtagataaaggcagggatcaaatgacaattctaagattgtctaggatatgaaagatatagttgcatctgcttgaaaggtagcacaatgttagttgggtaatgagaagaacttcctgtgaagaatgagagatgggaacttattgagggtaatctgcttagggcaaattactactcaacaaatcttataatagcaaaaagaatatcttatccaaaaagtgctttctagttctcattaactgcccttaattaatagtaatttgtttggctgggaatgggtgcggtggctcacacctgtaatcccagcactttgagaggtcaaggcgggcagatcatgaggtcaggagatcaagaccatcctggctaacatggggaaactccatctctgctataaataaaaaaattagccgggcgtggtggcatgcacctgtagtcccagctactcggcaggctgaggcaggagagttgcttgaagccgggaggcggaggttgcagtgaacagagattgtgccactgcactccagcctgggcgacagaacaggactccgtcctaaaaaaaaaaagaaaaagaaaaagaaaaaaaaaaagaccgggcgcgatggcacacgcctataatcccagcactttgggaggctgaggtgggcagatcacgaggtcaagagattgagaccatcctggccaacatggtgaaaccctgtctctactaaaaacacacacacacacaaaattagctggccgtggtggcacacgcctgcaatcccagctacttgggaggctgaggcaggagaattgcttgaacctgggaggcagaggttgcagtgagccaagattgtgccactgcactccagcctgggcaacagaatgagactctgtctcaaaaaaaaaaaaaaaattagtttggcggggcacagtggctcacgcctgtaatcccagcactttgggaggctgaggtgggcagagaacttgaggtcaggagttcgaaaacggcttggctaacatgttgaaaccccgtctcactaccaaaaaatacaaaatttagctgggcatagtggcgcacacctggagtcccagctactcaggaggctgaggtgggagaatcatctgaacccttgaggcggaggatgtggtgagccaagattgcaccactgaactccaacctgggcgacagactgagaccctgtctaaaacaataaaaataaaggccgggcatgctggctcacgcctgtaatcccatcactttgggaggccgaggcaggtggatcacgaggtcaggagttcaagaccagcctggccaatatggtgaaacactgtctctactaaaaaatacaaaacttaggcaggtgtggtggtgtgcgcctgtagtcccagctactcaagaaggctgaggcaggagaatcgctggaacccaggaggtggaggttgcagtgagccgagatcatgccactgcactccagcctgcgtgacagagtgagactttgtctcaaaaaaaaaaaagtaaaataaaataaataaataaataaattaattactattactctgttgggtatggatccaattaaattccagatattgaataatttagtactgtactgtgaatattttctgtaattgatttttcctgtaacagttactctgtattatgaaaatggaatttacggtgaggggccacttctcatttgctaccatacttaatttctggcaatttcactagcagagtaaaagagcccgtgtttcatgctcagaatgcagtgacatggtagacatacttactgcagtttcatgttcggtgagatgagcctacttgagaatgcaagacagacatggtggctcatgcttataatcccagaactttgggaggtcgaggcagaaggatcgcttgaggccaggagttcaagaccagcctgggcaacatagcgagacctccatctcaaaaaaaaaaaaaaaaaaaaaaaagacagaatgcagagagtgtgatttattttgggaatgtaaatggaataggtgcctcaaaattcaaaactttacatcttacatcttagggcagtttggtccccatttttctctttatatccttaggttaagaaaactgcaaaaagccactataatatcaaagataatcaggagacagaaaaagaaatgaaaaagaaaagaaatgcccacgagcagtagctcatacctgtaatcccagcactttgggaggcctagacagaaggatcacttgagcccaggagtctgagactagcctgggcaatatagcaagaccctatctctatttatttaaaaaaaaaagaaaaagaaaaagaaaaaaagaacgaatttgaaggtggttatagtcacctttataagagatgataccatcacaaatttctttgaagatctgggctaggcgggctgcccgagccacttcaatattttcctctgcagctgccaaccgtcttgttcgaacagatcgagctgtctgcagggcagagaactgggtcatgaagacatctggaaaaataaagtgaaaattaagttacaggaaacaaggagctctacatgtctttctctttcccaatggattcctgccatttgctctattttcccctgaagtgattaggtagattagtgggcacagagttctttctatcttctgtaatgaaaaatcaggaaacactggaatttactggagacaaaatgctgcaagagggaccttagcttagtgctcaaatgcaatacagtatagcagttgtaagtctgggcttcaaaatgaatctatcagcatctgaattctggtgtcactgcttattagttgtgtgatcttgggcaagttatttaacccatgggtcagcttctcaaacataaaatgagaacaatggtagtacttccctcataaggaaataatgcaggttaaatgagataatgcttttaatgtgttttgctcagtgcctgacatgtaagcactctgtaaatgatatctgttattattagaagaagtaaactagttaggatataacttcaaagaatttatgccaatcaaatcattgacaggatgtaagattatgggcaaatttttaaatctatctagttagcattcagcatatccctcacacatcacatagaattgcttctaccttttgaggggaagaaggaaaggattaaaaaaaagagcatgatcttttgaacactctgttttcagttagaaaggatgcttggacatgctagttcctctgctttcagtctcttctggataatatctgaactcaggagtgctgttattgaaggttacagaaaggaaatctgatggtttgtgagtacagtgctaatctgaatgtgagaaaaaaaggtcttcaaactgataatgacccgtcccccactgaatctgaatgtgagaaatgacccgtccccagctgaatctgaatgtgagataaaaaggtcttcaaactgataatgacctgtccacccactgataattacccgtcccccaccccaatttccccagtggatttggtatcactatttactctgtctgcaagttattttcaaggtaggaagtaacaaagagggcccactatctatctgatacctaatgactatttcagactacaggtcatgtttgaaaggctgtaggaggtttctttctattccctaaagagaggaaagctgaagaactgggatggataggttattactgactgatgtgtacatatttggatcataacttttttggtcaatactaaaaggagttgttaaatagattatctgctggaaagcaactaaaataaattaatagaaattcggctgagtgtggtggcttacgcctgtaatcccaacactttgggaggccaaggcaggcgaatcaccttgattccaaggcaggaggtcaggagttcgagaccagcctggccaacatggcaaaaccccctctctactaaaaatacaaaaattagccgggcatggtggcgggcgcctgtaatcccagctactcaggaggctgaggcaggataattgcttgaacccaggaggcagaggttgcagtgagcctagatcatgccattgcactccagtctgggcaacaagagtgaaactctgtctcaaaaaaaagaaatgtttcaaatgccttaccagacttgatattcccatcatctcggcagatcccattccaacgggtatataatgatgctgagtgaatattatcactggtgtgctttacttcctcctgtttttgacgaatcttctcccagtttcggaccaagaatacatgatgctttaacacaaagttcctgcaaggaaggaaaaaaaatcttcctttattcattaattaaataagcatgtattacatgtctactctatggaagccattgttagacgatatacgtgaattgagctgttgtaaagagaattatatgggcaaagcattactcaattttgtatcttcaatttttttacattacataaaacacataatatttacatacatctggcaaacaacaattaaaggctgcaaaaatgctggcaagtgaaacagcctgaccagaaggcagagatttatttgtacaaattctaaatatagttgtcaagatgaagtagggtctcaggatcagctataacaaggagaactggactggcaaatgaaggcaaagacacgtaagatggatacgcactgggcaaactatgttaggtgcagtgctgccatatggttccctaaacttactactttttttttgagtcgacgtctccctctgttgcctaggctggagtacagtggcatgatctcagctcactgcaacctctgcttcccgggttcaagcgattctctcagcctcctgaatagctggggttataggtgcctgccaccacgcccagctaatttttgtatttttagtagagacggggtttccccatgttggccaggctggtcttgaactcctgacatcaggtgatccacccgccttggcctcccaaagtgctgggattacagtggtggcgtgagccaccgtgcctggccctggttccctaaacttaaatgaattatgtgtatcttgactgatcctatacaattttgatgattccattattcaatttccacaacaggacatatgtaaatagatgtgatcttggataaatctcaaggtatgggtctcacttctcacttaaatgaagattagactaattttctagttcctgcacattggaatcccctgggagactttaaaaactactgatacctgggttctacctctgcaaattctcatttaagtggtctagggtgtggcctgggccttgggagtttttcaaagttccccatgctaataggcagccaaagtagagaaccactggactggtttttccgaaatttaaaatttctacaactcaaagggaaatagaatgaaaggggctaaaattacacaatggttataaataaagataaactttcaacaaataggacatactcacttgtttgcttctgaaagagacaattcttatctgaatacagggaacagcagaaattaccactaaagatcctttctattgctctgttaatatgtcaacaaagcaggtattctgtttttttttttttttgctttttgtttttttttgttttttgagacggagttttgctcttgctgcccaggctagagtgcaatggcgtgatcttggttcactgcaacctccacctcctgggttcaagcaattctcctgcctcagcctcctgagtagctgagatgacaggcatgcaccaccatgcctggctaattttgtatttttagtagagacagggtttctccatgttggccaggctggcctcaaactcccgacctcaggtgatccgcctgccttggcctcccaaagtggtaggattacaggtgtgagccactgcgccctgccaaagcaggtattcttaattttttctctactgcggactcctttgacagtctgatgaagcctatggaaccattctctgaacaattatttttaaattacttcaaaaaatttaaattattggccaggtgtggaggctcacgcctgtaatcccagcacttggggaggctgaggcaggtggatcacaaggtcaggagatcgagaccatcctggctaacatggtgaaaccctgtctctactaaaaagtataaaaaattagccaggcgtggtggcacgtgcctgtagtcccagctactcgggaggctgaggcaggagaatggtgtgaacccaggaggcggagcttgcagtgagccgagattgcaccactgcactactgcactccagcctgggcgacacagcgagactccgtctcaaaaaaaaaaaaaaaacaacaaaaaaccaaggtctttccatgttgccgaagatggtcttgaattcctgggctcaagtaattttcctgcctcagcctcctgagtagatgggtctacagggatatgtggaaatgttatttcatttagaaattagggaacataagatggtttggtgtgctggctcgtatctgtaatcccaatgccttgggagatcggggcaggaggatagcttgagcccaggagtttaggaccaacctgggcaacatagtgagaccttgtctctacaaaaaatttaaaaaaaaaaaattagccaggtgtggtggcatgtgcctgcagccccagctacttgggaggatgatgcagggggatcacttaagcccaggagttgagccaggcctctgtattccagcctgggtgacagagtaagatcccagctctacacacacacacacacacacacacacacacacacacacacaaaagggtaagacttaaaaaaaaaaaaaaaaaaaaaaaaaagattgtatttcttccatccaggttcatagatcccctgaaccctttggcttaagacaaaagaaagtggatcaacaatatagaagtttcataattttttacacagataagcaatcatgtaacttacaaagaacatggataaggatatttcctttttacctttcacgattggacattggcttcatctgtaattggggggtcaatctagttggggtgttgatattttcactgggttcctcagagagatggcctctctgaaaaagagatggatcagattagagatttaaaaaaatatcagtcagaaataatctccaagaatattaaaaccactcttaagatgccaccctctggtaattcccttattccagcaattgcctcaaagcatctcatgaacagcttttggggaaagtcattagataattattcacccttttcttcagcttgtgcttagactttctcttctcttttgaccgtccagattttttgtgtgtggccatgggctggctgtttttgctgctggtgagtccattcacacgctgactcttgcctccgatgattcctcgacatttctcaaagccacacttacaaagttgctttgaagggagagaataatttttttatttttatttttttaaggcagggtctttcctgtcactcaggctgaagtacaatagtatgatcatggctcactgcagtctcaacctcctgggctcaactgatcctcctatctcagcctccccagtagctgacattacaggtgcgtgccactatgccaggctaatttttgtattttgtgtagagacagggtttcgccatgttgaccaggctggtctcgaactccagggctcgagcaactctcccaccttggcctcccaaagtgctgggattacaggtgtgagccactgtgaccagctgagaataatttttttttagcttgcagtctcatttactagcttaaagaggattcctgagcatttggacacacattaagtataaatcaagaaatttgcatataggggaaaacaactgattgagagtataaatagaaatgggtttccactggaatagaaatgatggattaaattttaggaaaacttcttccccagaaaagttaactgagtggagaccaaaaatcacagggcaatctctttcttcaaagtaattgggcactatgtatctcagaaaggtggagtacagagtaaaaaactgtcctctcctatatacttctttaaaaaaaaattttaaaaaggccaggcatggtggctcatgcctgtaatccagcactttgggaggccaaggcgggcggatcacaaggtcagcagatcgagaccatcctggctaacatggtaaaacccagtctctactaaaaaaaatacaaaaaattagctgggtgtggtgacaggcacctgtagtcccagctactcggtaggctgaggcaggagaatggcgtgaacctgggaggcggagcttgcagcaagccgagatcacgccactgcactctagcctgggagacagagtgagactccacctcaaaaaaaaattaataaaaaaaaaaaaaaacatgaaatgcttcagtaatctgtttgtcatccttgcacaggggccatgctaatcttctctgtatcattccaattttagtatatatgctgtcaaagcaagcacttaattaaaaaatttggctgggcatggtggctcaggtctgtagtcccagcactgtgggaggctgaggtgggaggatcgcttaagtccaggagtctgtgaccagccctgacaaaagagggagaccccatctctacaaaaaatttaaaaaaaaattagcgacgcacagtggtacacgcctgcggtcccagctactcagaaggttatggtgggaagattgcttaagcccaggagattaaggctgcagtgagccatgatcacatcactgcattctagtgtgggccacagaacgagatcctgtcttaataacaaaaaactttaaacattttagagaaggggtcccgttctgtggcccaggttggccttgaactcctgggctcaagtgatactcctgtctcagcctcttgagtatgtgggactgtaggtaggtatgcactactgtgcccaggctcccatgtacttcttttctcccttttttctttttttgagctgaagtctcgctctgtcgcccaggatggagtgcattggcgcgatctctgcaacctccacctcctgggttcaagcgattctcctgcctcagcctcctgagtagctgggactacaagcatgtaacaccatgcccagctgatttttgtatttttagtagagagagggtttcactatattggtcaggctaatctcgaactcccgaccttgtgatctgcctgccttggcctcccaaagtgccgggattacaggcgcgagccaccatgcccagactttttctttttttgtgtttgagacagggtcttgctctgttccacaggctgcagtgcattggcgtggtcctggctcactgcaacctccacctcccgggctcaagcaatcttcccacctcagcctcccaagtagctgggaccacaggcacatgcgaccacacttggctagtttttgcatttttttggtagagacagggttgcaccatgttacccaggcgggtcttgaactcccagactacaagtaatccgcttgcctcagcctcacaaagtgctgggattacaggaataagccattgcgcctgacctcccatatactttttttttttttgagacagagtcagtcttgctttgtcgcccaggctggagcacagtggtgcaatctcggctcaacgtaacgcaacctccgcctccaaggttgaagcaattctcctgccttagcctccaataaactgggattacaggtgcgcgccaccacatccagctaatctttgtatttttgatagacagggttttgtcatgttggccaggctggtcttgaaattctgagctcaagtgatctgcccacatcagcctcacaaagtgctgggattaaaggtgtgaaccactgtgtccagcctcccacatacttcttaatggctccaagtcaatcatgtttacagaaagctcatgttattacagcattgtaagggataaagttcaatctccctctaggatttattattcttacctgtttttccacattgaaggaatgaaagttataatcataagtgagttcagtcccagctggcatgtctttaagagcatagagtccaatccggtatactccattaacagacctgtaaagagagaaaacagagttataaaggctggaaatttttttttttttttgagacggagtctccctctgttgcctaggctggagtgcagtggtgcgatcttggctcaccgcaacctccgcttcccggattcaagcgattctcctgcctcagcctcctgagtagctgggactacaggtgtaagccaccacgcctggctaatttttgtatttttagtagagatggggtttcaccatgttggccaggctggtcttgaactcctgacctcaggtgatctgcccgcctcggcctcccaagtgctagaattataggtatgagccaccacgcctggcctccacttttaatctcttttctatccttggcagcctgtataatactgccagagtaagaatcctaaataatttttcttgaaaacatgttctatgttgtcaattaggcttcaacttttcctgcttggtattcaaagtcctaaaatatggcttgcctgtattccccgcactttgggaggttgaggtgggaggatcacctgaggccaagagttcaagaccagaccaggcgccgtagctcacgcctgtaatcccagcactttgggagtccgaggcaggtggatcacctgaggtcgggagtttgagaccagcgtggccaacagggcaaaaccgtctctactaaaaatataaaaattagccaggcgaggccacatgcagtggctcacacctgtaatcccagcattttgggaggccgaggagggcagatcatgaggtcaggagttcaagaccagccaggccaacatagtgaaaccccgtctctactaaaaatacaaaaattaaggccgggtatggtggctcacacctgtaatatcagcactttgggaggctgaggcaggcagatcacgaagtcaggagttcgagaccagcctgaccaatatggtgaaaccccatctctactaaaaacacaaaaattagccgggcatggtggtgtgcacctgtaatcccagctacttaggaggttgaggcaggagaatagcttgaacctgggaggcggaggttgcagtgagtcaagattgcaccactgcactccagcctgggtgacagagtgagactccatctcacaaaaaaaaaaaaaaaaaaaaaaaaaaaaaaattagccaggcatggtggcatgtgcctatactcccagctactcgggaggctgaggcaggagaatcgcttgaacccgggaggcggaggttgcggtgagccaagatcctgccactgcactctagcctagcctgggcaacaggacgagactccatctcaaaaaacaaacaaacaaaaactagacaggtgtggtggcgcatgtctgcaatcccagctacttgggaggctgaggcaggagaatgacttgaacccctgaggcagaggttgcagtgagctgagatcatgccactgcattccagcctaggcaacagagcgagactccgtctcaaaaaaaaaaaaaaaaaaaaggcttagttcacttattaaatgagttaaaattactttttatggcttacctatacaaatcttccagttctaccaatctctatcacatgagtgcctctcttgttctattatatgtaaggtaatgatcatttaggattttaggtgtttttttgtttattgtttttgagacatagtcttgctctgtccccaggctggagtgcagtggcagaatctcggctcactgcaacctccaactcccgggttcaagagattctcctacctcagcttcctgagtagctggaatataggcacgtgccaccacgcccagctactttttcatatttttagtagagacagggtttcatcatgttggccagtacggtctcaatctcctgagctcgtgatccgcccgccttggcctcccaaagtgctgagattacaggcatgagccaccgtgcttgactttgttttaggtgttcaggagtttgtgactcgcctgggcaacatagtgagaccttatcttaatatattaaaaaaaaaaaaagaatatagtcattatcattatagctaacatttactgaatgctttttataacattttatattatttcatcctcctaacaattatataaaaatatgtaatattattagttattataaccctcatactacaaataaggcaactgaggcacacagggagccacttgcccaaagttacacagctgataacttagggaatcaagtttcaaattgacattgtggcttcaaaatcttaactaccatgccatactgataacaagttatatcatcaattctcaaaacaatcctatagaaaaaaccccaatcctgtaagataggcattatgatatctattttatatatgaagtatatacgcctcagagtttgtttagttatatagcaattaagtggcattcaaacccaggggattaaaacccaggctgtttgactcagcctttttcttcttgtctccttaccaatgtggaacacattaagggttagcttagatactgccctattacatgtaaccttgcctaaaatttttaatttttagtatttttccatcctgaattcagaaagcatttaaaaatttttatttatttatttattttttgaaatggagttttgctcttgttgcccaggctggagtgtaatggcgggaacttggctcactgcaacctccgcctcctgtgttcaagcgattctcctgcctcagcctcccaagtagctgggattacaggcacatgccaccacgcctggctaattttgtatttttagtacagacgggatttctccacgttggtcaggctggtctcgaactcctgacctctcgtgatccgcctgccttggcctcccaaaatgctgggattataggcgtgagccaccgcgcctggctaattttttatttttaaacagtatctcactcttgtataggctggagtacagtggcgcaatctcagctccctgcaacctctgcctcctgggctgaagtgatcctcccacctcgccaccacgactagctaatttttgtatttttagtaaagacagggtttagccatgttgcccaggctggtctcaaactcctgagctcagatgatctgcttgcctcggcctcccaaagtgctgcgattacaggcatgacccacggagcctggctgcagaaagcattttaaatgtataccaggagttggcaaactgctccacaggccactgctcccatctttgtgaatagttttataggtgcaaagccaacaagtttgctgatatatactgtaacttttctttttttttgagacagagtcttgatctgtcacctaccttcatgcctgtaatcccagcactttgggaggcctaggtgggcagatcacttgaggccaggagttcgagaccagcctggacaacatggcgaaacactgtctctactaaaaatataaaaattagccgggtgtagggacgcatgcctttagttacagctactcaggaggctgaggcacgagaatcgcttgaacccaggaggcggaagttgtggtgagccaaaatggtgccactgcattccagcctgggcgacagagcaagactctgtctcaaaaaaacaaaaacaaaaaaccaaaaaaaggtatcttctggccgggtgttgtggctcatacctgtaatcccagcactttgggagactgagcaatgaggatcgcttgagcccaagagtttgagaccagcctgggcaacatggcaaaactccatccctatcaaaaaatacaaaaattagccgggcagggtggcatgcacctgtggtcccagctacttgggaagctgaggttgcagtgagtcaagatcgtcccactgtacttcaaccctggtgacagagtgagaccttgtctccaaaagaaggggagaaaaagatatcttctagttgacattcttgcacaagtctagcacaaacactaatttccgctggggacatacttaggattagagttgctggtttaccggttatgtttagctttggtaggttgtgccattttttgaaagtggttataccaatttacacttctaccagcaaatctaagagcatttatgctgctctacctttgccaatactgtcagtctttaattttttacattttggagggtatgtagtggttttccaatttagtttaatatttcccctaataactgtatctaacatattaagcgctgttgtatatttattgaccactttgatattcttttttaaagtacccattcttttacctattttaaaaactggcttgtcaggcccggcatggtggctcacacttgcaatcccaacactttggaaggctgaagcgggctgacttattgagcccaggagttcaagaccagcctggacaacatggcacaaccctgtctctacaaaaaatacaaaaaaattaaccaggcatggtggtgtgtgcctgtagtctcagctactcaggaggctgaggcaggtgaacggcttgaacctgggaggaggaggctgcagtgagccaagatcataccactgtactccagctctgtcttaaaaaaaaaaaaaaaaaaaaaggctgctctgcgcctatggagtagccattcttttattcctttactttcttaataaacttgctttcactttattctatggactcaccttgaattctttcttgtgttctttcttgtgcgagatccaagaaccctcccttggagtctggatcagaacccctttctggcatctttctggcgatcacgaagggatgatacttaagagacccacaacccaaaggaaatagactgcaacactgattggctgaaacttttgagttactgacagctttgtttttttttgagatggagttttgctcttgtcgctcaggctggagtgcagtggcacaatctcagctcactgcaacctccacctcctgggttcaagcgattctcctgcctcagcctcctgagtagctgggactacaggtgtatgccactatgcccggctgattttttttttttttttttttttgtatttttagtagagatggggtttcaccattttggccaggctagtctcgaactcctgacctcaggtgatcaacctgcctcagcctcccaaagtgctgggattacaggcatgagccaccatgcctggcatattgacagttcttaacaattgagtaaaactcctgtgaacaaaatttaaaggatgtttgtttccctctacctcatttctccaaaatctggaaaccagatgatacaattggagaaactggttattttaccaaggctttgattggaatggagtgctttctattaaggaaccaaacttggcttagagagccaataaaagccccttgggaaaactggcctcataccttttccacaaagtccctgtatagggttcctgacccgtgatatcaccttttgtcagaactatgaatggcccttaccatactgacactttctgactgatctcttctctaccttggatacaagagaccctaataggcaggaatatcatcaccgctattcaacctgaagaaattactaaagatggatcttcatccctgtttacccctaaggattaagggttctcttataaaagggagggggaaaatgtcagaagcgtttaaaccagagcgactccatcttgtatagaggttgggtaaaattaggctgagatctgctgggttgcattcccaataggttaggcattcttagttacaggataagacaggaggttggcacaaaatacaggtcataaagaccttgctgacaaaacaggctgcagtaaagacgctagccaaaacccatcaaaactaagatggcaacgagagtgacatctgggcgtcctcactactacactcccatcagtgccatgacagttaacaaacactatggcaacgtcagaaagttactctatatggtctaaaaagtggaggaacccttaggtctgcgaattgtccaccactttcccagaaaactcatgcataatccaacccgtgtttagcatataatctataaagaaccataaagatgggcaaccagcagccctcggggctgctctgtttatggaatagcctttcttttcttttattcctttactttcttaataaacttcctttcacttaaaaaaaactgccaacactcaacccttgaacattgtgtatttttccattaatttaggtcatctttattttttcccaacttctgacagcttctagtatagaggtcctacaaactttcataagatttattcttagggactagtcttttatgaagctattgtaaattgtattggtttttatttatttatttattttgacacggagtcttggtgtgtcacacaggctggagtgcagtggcacgatctcggctcactgcaaactctgcctccggagttgaagcaattctcctgccccagcctccaatagctgggactataggcgtgtgccaccacaaccagctaatttttgtattttaagtagagacagggtttcagtcatcatgttggctagggtggtctcgaactcctgacctcaggcaatctgtgcatcttggcctctgaaagtgctgagattacaggcgtgagccattgcaactagcctgtaatgggtttggttttttttttttttttttttttgagatggagtcttgctctgtcacacaggctggagtgcattggtgcaatctcagttcactacaacctccgcctcccaggttcaagtgattctcttgcctcagcctcccaagtagctgggactacaggtgcatgccaccatgcccggctaatttttatatttttagtagagacagggtttcaccatgttggtcagactggtctcaaactcctgacctcatgatccgctcgccttggcctcccaaagtgctgggattataggcgtaagccactgcacctggccttgtaatggtttttaaatttcactttctacttggttgttgctaatatattaaaatgtactcaatacattaatttttatatactgaccatctttccattaatcttgctaaattcacttatgtctgtagaaatttcccatgtgtataataatgtcatctgcgaataatggtagttaaattttttttcatttctaatctttatacttttttccttttcttattgtattggttagactcttcaaatgtagatatgacagtggatatccttatttatgtataatggtagctaaagattttttaaaaatggatttcctttggcagatttgttagttcctttttattcctagtttgctgagttttaattatcaatgagtgttgaatactgtttaatgctttttctgcttctattgagacaatatatgattttttgtctttagtccattattgtgataaaattacattggtttacactgatttttgaatgttaaaccaaacaatcttttattcctggaataaaccccacatagtcatgatgtattaagctttttatttattgttaaattttatttgttgatattttatttaggatttttgtgtctatgttcatggaacacactggcctatattttttcctggttagattttagaagaaggtaatgctagttttatagaagcaaagagtttataagtggtactgccattatttcttcttcttcgtcttcatttttttaaatagacacagggtctctgtcacccaggctggagtgcagttgcatgatcacaggaaactacagcctcgaacttctgggctcaggcgatcctaccacctcagtctcccaagtagcaccatcacacccagctaatatttaaattttatctttaaatttttgttgagacaggtctcaccatcttgcctaggctggtcttgaactcctgggctcaagcaatcctcccacctctacctcccaaagtgctgggattgcaggtgtgagccactgcacccagcctatttgttctttaagtatgtggaagaattatcagtgaagacatctggttctccaggttcttttgttagatattttagttacattttcaattttgggggtacatgtgcagattttctattttgtcttatgtcagttttggaaaggtatgtttttctttttctttcttcttttttttttttgagactgagtctcactctgttgcccaggctggggtgtagtggcaccatcttggctcactgcaacctccgcctcgcgggttcaagcaattctctgccacagcctcctgagcagctgggattacaagcgcctaccaccacgcccggctaatttttgtatttttggtagagatggggtttcaccgtcttggccaggctggtcttgaactcctgaccttgtgatccacccacctcggcctcccaaagtgctgggattataggcgtgagccactgtgcccggctggaatgtttttcaaaggatttgttcatttcatctaacttttcaaatataaagttgttcacagtaattgataaacaaactggtaaattcacacaaagaagtattactccacattaaaaagtaacaaaccactaatgcattcaacatggatgaactgcaaaaacatgtttttaacaaaaaagacgccagacacaaaagaatacattcacatgaagttctggaataggtaaaactcatctgtggcaatggaaatcagatcagtgcttgctttgggggattgggagattgacttaaaaggtaactttctgaaatgacaaagtatgtcatattttcataggggtgttggttatatgggtgtatacatttgaaaaaattaatggaaatgtacacttaagatctatgtatttctagacgggcgcggtggctcacgcctgtaatcccagcactttgggaggccgaggcgggcggatcacaaggtcaggagatcgagaccatcctggctaacacagtgaaaccccgtctctactaaaaatacaaaaaagaaattagccgggcgtggtggcaggtgcctgtagtcccagctactgggcaggctgaggcaggagagtggcatgaacccaggaggcagagcttgcagtgagctgagatcgcgccactgcactccagcctgggcaacagagcgagactccgtctcaaaaaaaaaaaaaagtctatgtatttctctgtatatgaattacactttaatttttaaaaacttaacaaaaaaccccaaagttgttcatactatcctcatattatctttttaaaattattttttaggtgtgacttttttccttctcaattagatgctaatctatttgaggggaagggacctccagattcactttttttatttctctttgtgagaaatgcaccaggtatttaataagcatgcagtagagtggctgaatgaactgatatgagatgatccatgtaacacagtgcctagcacatagtaagaactcaataaatattaggtattattattatttttttgagatggagtcttgctctgtcacccagattggagtacactggtgtgatctcagctcactgcaacctcggcctcccgggttcaagtaattctcctgcctcagcctcccaagtagctgggattataggtgcacgctaccatgagtggctaatttttgtatgtttagtagagatgggtttcaccatgttggtcaggctggtctcaaactcttgacctcgtgatccgcccaccttggcctcccaaagtgctgggattacaggcatgagccaacacacccggcctattatcattattttttgtttttgattttttcttgctatgttgcccagactggcctgaaactcctgggctcaagtgatcctctcacctcaacctctcaaatagctgggactacaggtgtgtaccaccaccctggctatcatcatcatcattattatatttttctaggacatagatcctgaaactacttgcatgccaaacaaaaaaaccaaaaaagcaaaacaaaaaaacagaacacaaataaaaacaaaaatatctgtctgggagtgagaagttagggtgaaaacgaagcagcttactctgcccgtgggatctggggtaatggggaacagcctgagctgctttgtgtaagctgactgacactggaaagatcaatcccttgctgcactcaatgcttattctgctggattcttgtcttcaccttcttttgcttccttaccatttctgcatttcacaatttgggtcacagctatggttgatgaatcgggcctcatttcccatgcggtaactgtcaatcaccatcccactatccaggttcaggcagtagtggtcactgtgattatgatactgctcaatcatcctgttcctaaagagaagataaatgattgaaagacaattaaagagtagctgaaagtaaatttcacatcttccattctccattctaatcttataccttggcattttattagagtatcatcatttaccaccgtacctgaactcctgttcactgacgacctcccctaggtattcaatgatgaactgcccagcttttaggggctctttggttctgattccccaacctttttcctcagctcgaaatcgttctagacattgcacccattcatgcctctgtatcctctggttacagcattgctcgccacatgggcaagtgttgggggaacactcagcaaagatcattctagaaaaaaaaggaataactgtacatcaacttacatgatacataccttgatgcatccatttttaaattttacaaacatttaaaaatgaatacatgaaatcaatttttatttaataaaagtacccgaatcactaagattaaaataataaatgtcaaaaattaataatattcagaatttccaagtcgggctgcaaatcctgaatgcttcttgtaaatgattaagctaactgtccactcagcatcctgggtaaacattatcatatttatctattccaagaataaggctgggcaaggtggctcatgcctgtaatcccagcactttgggaggctgaggtgggtggattacctgaggtcaggagttcaagactagcctggccaacatggtgaaaccctgtctctactaaaaatacaaaaattagctgggtgtggtggtgtgcacctgtaatcccagctacttgggaggctgaggcaggagagtcccttgaacctgtgaggtggaggtcgcagtaagcagagatcgcaccactgcgctccagcctgggcgacagagtgagactccgtctcaaaataaataaataaaataaataaataaataactgtgatccaaagaagaatcagtaatttgatgatgatttcactgtactcttattttgaagcactcatgcccatttactgatttaaaaaaaaattgtggtagaatacctaatttactttttttttttttttttgagatggaatctggctctgttgcccaggctggagtatattggcacaatctcggctcactgcaaactccgcttcccaggttcaagagattctcctgcctcagcctcccgagtagctgggattacagatgtgtgtcaccacacccggctattttttgtattttcagtagagacagggttttaccatgttggccaggctggtctcaaactcccaacctcaggtgatccgcctgcctcggcctcccaaagtgctaggattacaagcttgtgaaccactgcacccggccgctaatttactcttatttatttttttgagacggagtctcactccattgcccaggctggagtgcagtggcatgatctcagctcactgcaacctctgtcctctgggttcaagcaattctactgccttatctgggattacaggcgcataccacaacacccgggtaatttttgtatttttagtagagatggggtttcaccatgttggccaggctggtttcgaactcctgaccccaaatgatccacccacctcagcctcccaaaatgctgggattactggcatgagccactgtgcccagccagttttttttttttttaatttatttttatttttttgaggcaaagtctcgctctgtcacccaggctggagtgcagtggctaaatttcagctcactacaacctctgcctcctggattcaagggattctcctgcctcagcttcccaagtagctgggattacagacatgcaccactacgcccagctaattttcgtatttgtagtagagacgaggttttgccatgttggccaggctggtctcgaactcctggcctcaagtgatccgcccacctcagcctctcaaagttctgggattacaggcgtgagccattgtgcctggccttttttttttttaattaaagagggggaagtctccctctgtcacccagactggggtgcagtggcctgatcacagcctactgtagcctcgaactccttggctcaagggatccatcctgcctcggcctcctgagtaggtgggattacaggcatgaactaccacacccagccttaaccatttttaagagtacagttcagtgacattaggtatatttgctgctgttgtattacaggaattttatattacattaattgaaatgacatttccaggctatatgactagctgaacccatagtagttagggaattaacaagttaaaaattctagatgggtgcagtggctcatgcctgtaatcccagcactttagggggcagaggcaggaggatcatgtgaggtcaggagttcaagaccagcctgaccaaggtggcgaaaccccatctctactaaaaatacaaaaattagctgggcgtggtggtatgtgcctatagtcccagctactcgggaggctgagacaggagaattgcttgaacttgtccggcggacgttgccgtgagctgagattgcaccactgtactccagcctgggcaaaagagtgaggctctgtctaaaaaaaaaacaaaaaaaaaacaaaaaaaaactgaacatagaagacaaaagaagtcacacacatcttgtcactgctttctttactttttttttggagacagggtctcgctctgtcacccaggttgaagtacagtggcacaataatggctcgctgcagctctgaccacctgggctcaagcaattctcccacctcagcttcctgggtagctgggaacacaggcgcgcaccaccgcatctgactacttaaaaaaaaaattatttgtagaggtgaggtcttgctgctatgttgcttaggctggtctcaaattcctgggggtcatgggatcctccctcatcggcctcccaaaatgctagggattacagcattttgtgagccaatgcacctggctgttttaatgggagctgtttagttttggtgtatggtttgaaatctcatctaggctgttaagcattattttttggtttgttttttggatacagggtctcattctggttgcccaggctggagtgcagtggcatgatcttggctcactgcagcctcgacctcctgggctcaggtgattttctcacctcagcctccagaatagctgggactataggcacacgccaccatgcccagttgatgttttgtatttttagtaaagatggggtttttccatgttgcccaggctggtcacaaactcctggactcaagtgatccgcccaccctggccttccaaaatgctggattacaggcgtaagccaacatgcctggccttaagcatgactaaaacaaggaatgatcaagaaaataatcgtcaaaatatcatgttatatttataataataattttaaaggccgggcacggtggctcatgcctgtaatcccagcactttggggggcagaggcgggaggatcacgtgaggtcaggagttcgagatcagcctggccaacacggcgaaacctcgtctctattaaaaatacaaaaattagccaggcgtggtggcaactgtaatcccagctacttgggaggcggaggtaggagaatcgcttgaacctgggaggcagaggctgcagtgagccgagatggtgccactgcactccagcctgggtgacagagcgagactgtctcaaaaaaaggaaaaaaaaaagtgaaaagttttgtaaagaaaatatataacagtttataccttaaagtactttcagagtaatctgacttactctaaacaaaaataccaccacgattctaaagggcacacggcacacagtgtcaaatcatgtaaataggagcagagaaagtatcgactggattattcttcaatttaagataatcagcttcagctgtaaagaagacagtgccttaacatcaaattcaaccacctttactcttccgtttgctgacttctttggtacatgaatattattgaatacccctcttgaaatgccttccttttttggctttcctcattttttatgatactggatttcccaccttgccaataccaattcctgtcttttctggtagaaatccttttttcctctaccatattcctttttctagagagctgatctataatcatggcttcaaatgtaacctctagttcataatattccacacctatattttcttcttttctttttttgacacagggtctcactctgtcacccagcctggagtacagtggcgtgatcacagcttactgtagcctcaacctccaggctcaagcgatcctcccacctcagcctcccaagtagctgggactgcaggcatgcaccactatgcctgctaacttttgtattttttgtagaggtggggttttgccatgttgcccaggctggtctcaaactcctgacctcaagtgatctgcctacctcagcctcccaaagtgttgggattacagacgtgagccactgtgcttggctggcaccaagtattttcataatacctaataacacatactataaactgcatccggatttaaaaaaaccctgaagtataaataaaagagtgctcagataagagagatttaaattttaaaagatttcttccagggaacaatcattcagaggttactgaaaatttgtagtttctagagttcaaggcattgaaatatattccccatttgttttgacaaccagaataagtccttaaattatataaaaccaaaacatgtttctatttgttgtgtctggaaaccaaactaaatttaccaaaatctgaaattagatgctgtaaactacaatgtgaggtctttgatttagtacaatttgtcattatctttagccagataatgcccttgaaaaacgagagttgggctggatgcagtggctcacacctgtaatcccagcactttgggaggctgaggcaagaggatcacctgaggtcaggagttcgagaccagcgtggtcaacatggcaaaaccctgtctctactaaaaatacaaaaattattagccgggtgcagtggcaggtgcctgtaaatcccagctactcgcaaggatgaaggatgaggcaggagaatcgcttgaacccgggaggtggaggctgcagtgagctgagattgtgccattgcactccagcctgggcaacgagaatgaaacttcgtctcaaaaaaaaaaaagaaaaatgagacagtcgcaccccagccagctactaaacgtagatctaggttgtccttcatatagtgagatttaagggttcaggaccggcctcggctaagtatcgagatcccgtctctactttaaaaataaataaaataaataaattagccaggcgtggtgacacgcgtctttagtctcagctactcaggaggctaacatgggaggattgcttgagtccggaaggtagaagttgtagtgagctgtgatggcgacactgcactccagcctgggcaacagagtgatatcctgtgtcataaataaataaaaatactgagcttgtggaccacactgtttaataaaagtgtgcatttaaaatatttgtgagtaaagaaaatcagtatgcaaaacactatgtgaacctgtatgtacataaaatgataaggtgtgaatttacagtgatgcaggtaaggtagaatttcccaactggcatgctgaagcaggaagaactaaaacattgattcccttcagaccacatggacagctgactagagatcaaagaagctacttttggccatgagaactatccagaacaggaaatactgatgtaaaattcactgattcttttttattttgctgcacatgtgcattgttactaaaacaacaaattctatatccactcctttgtctattagacatttctattttgaaatttcagtgccgtttaaaattatatactctcttggccaggtgtggtggctcatgcctgtagtcccagctactcgggaggctgaggtaggagaatcacttgaacctgggaagtggaggttgcagtgagctgagatcgtgccaccgcactccagcctggcgacagagcgcgactctgtctcaaaaaaataaattaaaaaaatacaaaaattagccaggcatggtggggggcacctgtaatcccagctacttgggaggctgaggcaggagaatctcttgaacccgggaggcagaggttgcagtgagccaagatcgcgccactgcactccagcctgggtaacagagctagactccatctcagaaaaagaaaaaaaaaaaattacagactcaaatcaaagtcataactcataattctttttttttgggggggagatggagtttccctcttgttgcccaggctggagtgcaatggcaggaccttggctcactgcaacctctgcctcccaggttcaagcaattttcctgcctcagcctcccacgtagctgggattataggcatgagccaccatgcccggctaattctgtatttttagtagagatggggtttctccatgttggtcaggctggtcttgaactcccgacctcaggtgacctgcctgcctcagcctcccaaagtgcttggattataggcatgagccaccatgccagccaaattcataattcttatctccaattcagttagattccacactttattttcagagagagaatatatccccatatgaagagcatatcccctatatgccgatggtttatcaacatacttttcttctaaaatatattatgcccttcctcttcactctcactgccactgtcctattctgcttcctcattgtggcaaccatatattgagagctaggaaggtacctaggactgtgcttaatgttttatgagctgggcacagtatcacatacctatagttccagctactcaggaggttgaggtaggaggactacttgagcccaggagtttgaatccagcctgggcaacacagtgagaccctatctctaaaaaaaacaaaacaaaacaaaacaaaaaccccaaaacaagaaagccaaaacttcacaaacattgtttatcaacagtctcatataatctccacaaaccctccatagagaaggtaaggtattacttttattagatgcattaaataacttttctcaggtctcataaatagtaaaaggattggctgggcgcggtggctcacgcctgtaatcccagcactttgggaggccgaggctggtggatcacgaggtcagattgagatcatcctggctaatacggtgaaatcccatctctactaaaaatacaaaaaaaattagctgggtgtggtggtgggtgcctgcagtgctggctaccagggaggctgaggcaggagaatggtgtgaacccgggaggcggagcttgcagtgagccgagatcgcgccactgcactccagcctgggcgacagagggagactccgtctcaaaaaaaaaacaaaacaaaacaaaacaaaaaaaacaaacaaaaaaaaagtaaaaggatttaaaccaacgaaggcacacacaagactctaaatctcattcattttctgtttctgtattccgcccacccattatggtttatatatctttgtgcaacttcttgaaaaaaatcaaagagcctatttaactgtaccctccaaaggaagtgttgtatgtataccttaaagcctatgctttagagaaatcaaagcatgacagtacctattgaggcagtcatcaacacagcccttcctggtgtcatcatctggcttcttacagttacaggtggtagcttcgtaaccagaaaggggtttgacatcaacgtagacatcttgaaaagaaagcaaagaatagtttgtgaacatacaggataatttttcaagtgctaggctcagaagaacattaacgtatagaggcagaaaaaatagctcctaagttactcacttgaacgaattttcttatatagtgggacatctggctttttgtatagctagaagaaaagaagaaaaatcttgatatagcatttaacttcaaatgccagacggcagcatcaatcactaaaaatacaggaaattttctatgtgctctgctcatctggaaatatttacaagacattttgggttggatacatttgagggaaactcttggtgtgatctctttttactctgaaataaaaggtgagagaataagattcaacagaagaagcactaaatagtttatacaagtggaattacatgtttcttcagcatgttgttggatagacttaaatgaaaatcacactggagaccaaagctattcatttggacaaattaagattctatttgcttctatcaaaagaaaggaaaacaacatgcataggacttacttagatgtctgggtgggtacatgaaattaaaaagatgagtaccctggcttttcaggttgagaattataggaaaacatttcaaattttaattaaggcaattaatttagtgaataaaggagagagggcaggcaggcaaaatggagctctcacattataatcaagaagatattagaaagaaaaaaaaaaagaatgcattagaagagaggcagtcttccagcattttgccataagggactgtacaaaacaaacagcaacttgcacaaagctagactgtttattaatatattggaataatcccaccattattttctagtcagtatgttcaaagcattctctccttcattgttaaaaactctgagacaaatacctaacatattaatactctcagaattcaagagaggccattggagaagacaacgcagaggggaatgtcaattttggctttccaaaataaacctttggtggcattttggcagaactcaagaaatctattcacctcaattgcatgactatttctatttcccaatggttgttctcaatatgagacctgggggctataagctaatacaaaaatcactacgggaaacttttcaatttgggaagcaagagaaaaaacacggcatcttcctgtttttagttaccaatatatttaaagattttttaaaagtgcaagagtgttaaacatttccctgcttcctttgatagaagaatctcttttgcatgtgaaaaataaatttcaaactgataagaaggagccaacaaaaataaagtctgaaatttcttagtgctgctggcagtacatctaaattctcctgagacctgcatcaaatagaattcttacagaacaaaatctttgctaccaaaataaaagtccagaataacaacagaaggttgcctaggaaagcaggaacttactgctattttgcagtaagagtaaaggcaaataggtcacattaaagatggatgcaaattcatttttcttagtcctaaccttcacagggacacttctgaaaacctcctaagatgaaaacataacaaggggagagaaaaacacttgcatttccacccctccccctttaccacttaagaatgaaacctggtaaaacaggctctctgtacctgattgtgtttccactgccaaaggatatcataaggaagctggaagtcaattctcttttgtcttagatactttcctgaaacaaaaaacactattaatttcaataccttttctaatatttgcttatacaaaggtgtcaaacagctacaagaactaacatgtactgactaaaaaaataaagatttaattctttaaggatttttccatcaccaatttttaattttagctcttctttcccactatactccacacgatatatgccgaagatatattttaagtataatagtctacataaaacaacaaatacagcaaaactacaaccaaaaacacacaggtcattatgaagcttattaaatattttattattattaaaaattattaagggtacagcatctggcacctgctcttcattattacacataacctaaggttgattacaaaaaggagaaattcttgtgtttaaataactcgagaagttttccaggcaaatttatgatcttttaacattttttcctacctattgaaatagtatttttgtttgatttttttgtttttgtcttatataaaattattcagccttaaaaagaatgaaattctttttttttttgagatgaggtttcgctcttgctgcccaggctagagtgcaatggtgcgatctcggctcactgtaacctccgcctcctgggtttaagcgattctcctgcctcagcttcttgagtagctgggattacaggcatgtgctaccacacccagctaatttgtattttttttttttttttagtagagacagggtttctccatgttggtcaggctggtcttgaactcctgacctaaggtggtccacctgcttcagcctcccaaagtgctgggattacaggcatgagccaccgcacctggccaaaagaatgaaattcttatacatatagtcatgtgccaatgttttagtcaacaatggactgcatatatgatggtggacccagaaggtaataagggagctgaaaaattcctcctagctgtcataactttgcagtgcaaagtgttaatcatgtgtttgtggtgatgctggtgcaaataaacctatagcgctaccagttgaatacaagcatagcagacataattaggtataatacataatacttgataaaatgtctttgttgctggttttataattaatatactatacttttcatcattattttagagtatactcctgcttattaaaagacatccttggctgggtgcagtggctcatgcctgtaatcccagcactttgggaggccgaggcaggtagatcacgaggtcaggcattagagacaaggctggccaacatagtgaaaccctgtattaaaaatacaaaaaattagccgggtgtggtggtgggcgcctgtaatcccagctactcaggaggctgaggcaggagaattgcttgaacctgggaggcagaggttgcagtgagccaagattgcaccactgcactccagcctggacaatagtgcgagactccgtctcaaaaaaaaacaaaaatcaaacaaacaaaaaaaccaaccttggctgggcgcaatggttcatgcctgtaatcccaacaacactttgggaggctgaggcaggcagatcacttgaggtcaggagttcaagaccagcctggccaacatggtgaaaccccaactctactaaaaatacaaaaattagctgggtgtggtggcacacgcctgtaatcccagctacttgggaggctgaaataggagaatcgcttgaacctgggaggcagaggtagaggtggaggttgcagtgtgtcaagatcacgtactgcactccagcctaggcaacagagtgagacacggtctcaaaaaaaaaggaaaacaaaacaaaacaaaaaaacagccttgccaggagtgctggcccacacctgtaatcccagcactttgggaggccgaggtgggtggatcacttgaggtcaggagttcgagaacagcctggccaacatggtgaaagcctgtctctgctaaaaatacaaaaattagctgggtgtggtggcgcacacctgtagtcccagctactcaggaggctgaggcaggagaattgtttgaactgggaggtggaggttgcagtgagcccagatcgtgccattacactccagcaggcaacgacacagactctgtctcaaaaaaccaaaccaggctgggcgtggtggctcacgcctgtaatcccagcagtttgggaggccgaggtgggcagatcatgaggtcaggagatcaagaccatcctggctaacatggtgaaaccctgtctctactaaaaatacaaaaaattagctgggcgtggtggcgggcatctgtagtcccagctactcgggaggctgaggcaggagaatggtgtgaacccaggagatggagcttgcagtgagctgagattgtgccactgcactccagcctgggcgacagagcaagactctgtctcaaacaaacaaacaaacgaacaaacaaaaacccaaaccaaaccaaaaaacagtcttaggcagatccttcaggagatattccagaagacattattaccatatcagatgacagctccatgagtgttactgcccctgaagacctttcagtagaacaagacatacagcgagaaaacagtgatattgatgatcttgcccctgagtgggcctaggctaatgtgggtttgtgtcttagctcttttttttttttcaagacagtgtctcgctctgtcacccagcctggagtacaatagcaggatcatggctcactgctgcctcaacctcccagactaaagcgatcctctcacttctacctgccaagttgctggcactacaggcatgtgccaccatgcctggctgattttttattttttgtagacagggtcttgccatgttgcccaggctggtctcaaactcctgggctcaagcgatctgcctgccctggcctcccaaagtgttgggattacaggcgtaagccgccatgcctggccctcttttcgcttttaactaaaaaagtttaaaaagaagaaaaaatgttaaaaataaagcttataaaataaggacataaagaaaatattttcttgtacagctgtacaatgtgttcatgtttaaagctaagttattatgagtcaaagtgttaaaaaattaagtttataaagtaaaaaagctacagaaagctaagattaacttaactattgaggaacaaaaaataaaaatttagtgtagcctaagtgtgcagtgtttataaaatctacagtagtttaacagtgatgtcctaggccttcacattcactctccactcaatcactgacccacagagaggaacttacaatcctgtaagctccattcaggtaagtgtcccatagtgggctgccattttttatcctttatattgtatttttactgtaccttttctacatttagatatgtaaatacttaccactgtgtcacaactgactactgtattcagtatactaacatgatatacaggtttgtagcttaggagcaagaggctataccatacagcctggttagtatattctgtttgcataattataagattgcctaacaatgcatttctcagaatgtatcctcatcgttaagcaacacatgatggtactacaacatggatgaaccttaaagacattatgctaagtgaattaaggcagatacaaaagaacaggtattatacaaccccactttcaaagaaatagacagtgattaccagaggctgaggggaacagagaatggagagttacagtttaatgggtacagagttacagtaggggataatgaaaaagttccggggatggatagcagtcatggtcatacaacaatgcgaatgtacctaatgacactgaattgtccacttaaaaatgatcaaaatgcaaattgtgttatgtatattttactggaagttaaaaaaaatgtaatatatcaaaaactatagtctattttaaaagagtaaattggatggtctgtgaattgtatcttaataaagttgctaaaacaatacagcagtgttaaaactttttgcttcaatgattaaacgtaacttagaaaaaactcaagagaaggaaagcctattgtatatatccatgtttttgcttactgtattcttccttcctaatgttccaaagtgtcttttttttaaaattgtttcctttctgttcacagaacttgctttactcatagggtacatctgctggcaacaaactctcttagttttccttaatctaagaatgccttcatttcttcttaattcctgacagatattttcattggttagaagattcggagttgacaattctttgcttttaggatgtgaaaaatgctgtatcacttccatttggcctccatagattcagatgagaaatctactgtcatttgaattgttttatccttataggtaagggtaatttctctgtcattgctttaaaattggtgtggtttttttttgttttttttattttttctgagattcgttctcctgagtagttgggatgacaagcatttgccaaccatgcctggctaattttttttgtattttttgtagagacagggtttcaccatgttgctcagggtggtctcaaacttctgagctcaagcaatcagcctcccaaggtatttggtattacaggagcaacctatctcgcccagcctaaaattgttttgttagtgtactgaaatgtgattatgtgtctcggcatatatttgtttgagtttatcctgttcggagtctgctaatcttcttgaatacagagatttctgtctcctgccaaatttggtaagtttccagttgttatttactaaggtgcttttcatctatgcccttttttttccctccttccatgactccgataacacaaatttgctttttttgtcatattctcacaagctcctcagtctttctgtttttaattctattttctatgttgttgtatacgctgagtaatatgtattattctatcttctagtgcatagattatttcctctgtcccattcattctgctgttaagtctatctctgaatgtatttttttttctggttcaatttctctcataaaagctctgaactttttatttcaattactgagtcagttataaaaattctaatttaaaaaaattattggccaggtgcagtggctcacgcctgtaaacccagcactttgggaggtgaggcgggcagatcacttgaggtcaggagttccagaccagtctggccaacgtggtaaaaccccgtctttactaaaaatacaaaaattagccaggtatggtggcacatgcctgtaactccagctactcgggaggctgaggcaggagaaatcacttgaacctgggaggtagaggctacggtgggcagagattgtgccactgcactccagactgggcaacagagcaagaacctgtctcaaaaaattaaaataataaataaaataaaatatgaaaaattatcttcttctatttcttgatttgtttcaagcatgttcacaattgctcactaaggcatttttatcaagactgctttaaaaatctgccagataattctaatgtcttggtgtggacataaattgtcttcccaaagtgctgggatttcaaggcatgagccaccatgcttggcaaataacatatgattttaaattcaaagttaaacacttttgtagtagtataaggttctagattttatgaaatttgtattttagctggctttttctgaaactgctccagcagaaaagggataaagctgcctcattactgccagctgtaagtaaaagaccaagttgcctactaggcctccactgaaacctgagtgttgggggatggggaagctccccattactgctagggaatggttagaattccaatttcccaaggggtctccactgacattgtggtggggtagttatgttactgctaggtgttggtaaaagtctgactcggctagacctcctctgacaccatggcagtggagggagagacatatgattgttggccacgtatatgtcttttgagaagtgtctgttcatgtcccttgcccattttttttttttttggagatggagtctcactcttgtcacccaggctggagtgcagtggtgtaatctcagctcactgcaacctgtgcctcctgagttcaagcgattctcccgcctcagcctcccaagtagctgggattacaggagcccaccaccgtgcccaactaatttttttgtattttaagtagagacagggtttcaccatgttggccaatggtctcaaactcctgacctcaggtgatctgcctgccttggtctcccaaagtgctgggtttacagatgtgagccactgcgcctggccaagagtctttaaaaaaattttattattattgttgttttgagacggagtcttacttttttgcctaggctggagtggagtggcatgttctcagctcattgcaacctctgccacccggagttcaagcaattctgtctcagcctcctgaatagctgggattacaggcacgtgccaccatgcccagctaattttttctattttttttttttagtagagacggggtttcaccatgttggccaggctggtctcaaactcctgatctcaagtgatctgcctgccttggtttcccaaagtgctgggatgacaggcgtgagccaccacaccaggccttgcccacttctcaatggttttttttcttgtatatttaagttccttatagatgctggatattagatctttgtcagaagcagtttgcaaaatttttctcccattttataggttgtttactctgttcatagtttattttgctgcgcagaagttcatactatttgtccatttttgcttttgttacaattgcttttggcatcgtcatgaagtctttgcctgtgcctatgtcctgaatggtactgcctagattgtctttcagggtttttatagttttgggttttacaattaagtctttttttttttttgagacagagttttgctgtgttgcccaggctggagtgcagcgatctcagctcaatgcaacctccacctccagggttcaagtgattctcatgcctcagcctctcaagtagctgggattataggcatgtgccaccacacccagctaatttttgcatttttgttagagatgggattttgccatgttgatcaggctggtctcgaactgctggcctcaagtgatccacgtgcctcagcctcccaaagtgctgggattacaggcgtgagccaccacgcctggcctacattgaagtttttaatccatattttgtttttgtatatgctgtaaggaaggggtccagtttcaaccttctgcatatggctaaccagttatcccagcaccatttactgaatagggaatccttacccaattgcttgtttttgtcaggtttgttaaagatcacgcagttgtaggtgtgcagtcttatttctgggttctctattctgtttcactggtctatgtgtctgctcttgtatcagtaccatgctgttttgattactgtagccctgtagtatagtttgaagtcaggtagcatgatgccttcagctttgttctttttttgtgtgtaggattgccttggctatttaggttcttttttggttccatatgaatgttaaaatagtttttttctagctctatgaagaatttcaatggtagtttaatgggaatagcattgaatctataaattgctttgggcaatatggccattttaacggtatttattcttccaatccataagcatggaatatttttccatttgtgtcttcgctgatttctttgagcagtggtttgtagttctccttatagagatccttcgcttccctagttagctgtattcctaggtattttattctttttgtggcaattgtgaatgagagttcaatcatgatttggctcttggcttaactgttattggtgtataggaatgctagtgatttttgtacattgattttgtatcctgagactttgctaaagttgtttatcagcttaaggaacttttgcttaagcaaacactccccagtgggtgtttgctggtgtaagtttgagagaggtgtgaaagttgattagacaaaacggaatcattcataccatatccaactaaaatggagtcaggaggccatgggggagggcactaaggtccctgatccaggaactgattttgcatttcaacagaaaattcactctaactataattaagactatgtcttatatagtaactgctgccactcaccaatgacaactgtaccagtgacctttttcttttctttctttgtttttgagacaggatctcactctgtctttcaggctggagtgcactggtgcaatctcagctcattgcagcctcaagctcccaggctcaggtgatcctcctgcctcaggctcctaagtagctggaccacaggtgcatgtcaccatacctggctaaatttttcttttctttttaaatttttgtatacatgggttttcattatgttgtccaggctggtctcgaattcctgagctcaagcaatccaacagcctcagcctcagcctcccaaagtgctgggattataggcttgagccactgggcctggctgaccttcttccaaccttcctcttttgctcaatacaaccccagcctttctctttgtttttcagacacacttagggactaccctggtctatgtgtcctgaattgcgattctttttttttttttttttcatagaaaacagggacttgatccatcacccaggctggagtgcgctggtgcaatcataactcactgcagcctcgatctcctgggctcaagtgatcctcctgcctcagcctcctgagtaggcatgtaccaccgcacccagcaaatgttgttattgctttatagagagaggttctcactacattgcctaagttggtctcaaactcctggcctcaagcgatcttctctcctcggcctcccaaagtgctgggattacaggcatgagccaccatgcctggactaattctttttttttgagacagagtcttgctctgtcacgcaggctggagtgcaatggtgtgatcctggctcattgcaacctccacctcctgagttcaagtgatcctcctgtctcagcctcctgagtaactgggattacaggcatccactatcactcctggctaatttttttctatttttagtagagaccatgttggccaggctggtctcgaacttctgacctcaggtgatctgcctgcctcggcctcccaaagtgttgggattacaggtgtgagccaccacgccaagcctaattattgtatattattcccaaataaaccctttacttggagatatatatttatattatctgaatatatgtttatttaagactttaaaaaagaggctaggcgcggtggctcatgcctgtaatcccagcactttggaaggacgaggtgggtggatcacttaaggttaggagtctgagaccagcctgggcaacatggtgaaaccccgtctctactaaaaatacaaaaattagctgggcatggtggcgcatgcctgcagtcccagatactcaggaggctgaggtgcaagaattgcttgaacccaggaggaggagaatgcagagagccaagatcacgccactgcactccagcctgggcaacagagcgagactccatctcaaaagaaaacaaaaacaaaaacaaaacacacatctatatgcaggtttttcttttcaatagatatgttttcaaattatttgagaaaataccaaggagcatgactgccacatcaaatgttcagagtatattaagttttataagaatacaattgattttttaatactgatgattttccagtaaccttgctgctactactaccagtagctttttttttttttttttggtgtggatctctttggattttttttttatataaacaatcatgtcatctataaacagaaacagtttcatttcttccttcctgatcattatgatgactcttactcatcttcttgacttaatacactgcctagaacatccatgtaatgctgagtcagagtggacaactctatcttcttcccaatcttaggaggaaacattcaacatttcaccattaagaatgatattaggccaggtgtggtggcttaccagtatccaaaataaaaaaagttgatctcactataggtcctagactcattaagagactaataagggaatgttataaataatgttatgccagtatctttaataatttagataaaatggacaaattcctttagaaatacaacgtatcaaaactgagtcaagatgaacatctgaatagtctagatcttttaaataaattgagtaccttaccatattattcacataaaaaatttcagttctaaatggcttccctagtgaagtctggtatatgtttgagaaagaagtaataccagtcttccagaaaacagaggaggaaaataattttccaactcatttaatgaagctagtgtatgcctaatacaaaacttgacaaagactttaaaagaaaaaacaactatagaacaaaattaattctaaagacttctgcagaaagctctcagaactaaaaaggaatttccttatcttattaaagatatctgtagttaatatcattctccccccccccccttttttctttcttttttttgagacggagtctcgctctgtcacccaggctggagtgcagtggcgtgatctcggctcactgcaagctccacctcccgggttcacaccattctcctgcctcagcctcctgagtagctgggactacgtgcgcccgccaccacgcctggctaattatttttttgtatttttagtagagacgtggtttcaccgtgttagccaggatggtttcgatctcctgacctcatgatctgcccgccttggcttcccaaagtgctgggattataggcgtgagccaccacacctgcctgtgttttttttttttgagacggagtcttgctctgttgcccaggctggagtacagtggcgcaatctctgctcactgtaacctctgcctcctgggttcaagcgattgtcctgcctcagcctcctgagtagctgggaatacaagtgcatgccaccacacctggctaatttttgtatttttggcagagatggggttttgccatgttggccaggctggtctcgaactcctgacctcaggtgatccacctgcctcagcctcccaaagtgctggcattacaggtgtgaaccatcacacctggctgacaatttatattcatatactttcaagttcaactgacacttctgccatcttcaatctgttattaaacctacattttgtgttttaaaatcagacatatatgttttagttctgggactttcatttgctattgttcattttaaaatttttatgtttccatttttaagatttatctgcttgttcattataagcatattttcctttacatccttgaacacagttataacaatgactttaaaatccttgtctgctattttcagcatctggatgaccttggaaattgtcagtgttgactgccttctctcttaatatgaattatattttcatgtttattaacgtccagtaattttggattgaattatggacattataagtaatacgttacagagattctcaattgtgttattatcctatgaaaataactggtttcggccgggcacagtggctcatgcctgtaatcccagcactttgggaggctgaggtgggcaaactgcttgaactcaagagtttgagactagcctgagcaacatggtgaaaccctatctttatcaaaagtacaaaaaattagccaagtgtggtagtgcatgcctgtggtcccagctacttgggaggctgaagtgggagaatcacttgagcctaggaggtagaggctgcagtgagccaagattgcactactgcacttgagcctcaacaacacaatgagattccatctcaaaaaaatagaaataaaaataaaaaaataagaaagaaataaaagaaaataagtttttctttgcattagagcaaccagttactgtgggttaaccaaaatctgtaacactctcttccgtggggtaggcagcagctgaaatccctacttagtatctttagtctcaactaactatactggattctggctgcatatacatagtttagggggtcagttacctagataagtggcttgagtttatatgcaaaatttgcagtttcccctattagcattttatccctcactttcctgctgctgtagctgtcctgaaacatggcccttaaataatcagtaagattcaaggtttctaagtgcttacttgtactgctaactgggacctggccacagataaaaagagctatacaagcgggaaatgcaaccagtgtgcttctcctcttctaattattgatttttcttcagtttgtgcctgcttttggttgctctccagtgacttaggattactatgttttaaatttgtccagttgatgcatttttttcttatttatttatttatttttttgagagtcttgctctgttgcccaggctggagtatagtagcatgatctcggctctctgcaacctctgcctcccaggttcaagtgattctcgtgcctcagcctcttgaggagctgggactacaggcacacaccattatgtccagctaatttttgtatttttagtgcagatggggtttcaccatgttggccaggctggtcttgaactcctgacctcaggtgatccacctgcctcggcctcccaaagtgctgggattacaggtggataattgttattcccgggagggttagcctgatgtaatctactctttcaataccaaaagtagaattcctcgtctttttttttttttgagatggagtctcactcttgtcacccatgccggagtgcaatggggtgatcttgaactcctggattcaagggatccgcccacctcagcctcccaaagtgctgggattacaagtgtgagccaccgcgtccagccttgttcttattttcaaagcctatttatcattagcagattttaaatttgctgagagcctgcttccgctgctatgatctcactagtaaatacaaaagactctttcaaaagagctttggcactaatcctagagaataaggaacttactcttaccttcattaagtaagcacacgtaaagtttatgtagctgagaattaaaccttgtaacttcatgttgtagttaaatctgtctccagccacccaatacagaataattcaagcaaactaatctttactgaagaacttgtttatgtctgctgattaaaaaactctgctggtactgaactctctcagggagaaaaggagattagttaatcagaatataaacaagagctccacagtcaagagagttaagagaatcatagttgaagaaaacactacaagacataggatcaacatcaagtatacaattaaggtgttcctggtttcatactatgtgtttaatgaacccctttaaagcaattttgtttaaacaaactgaatatatgaagaaaacctgacatttacattcaatattttatccttatttcttttcttttttttttttttgagactgagtctcactctgtcgtccaggctggagtgcagtggtgcaatctcggctcactgcacactccgcctcctgggttcacgccattctcctgcctcagcctcccaagtagctgggactacaggtgcctgccaccatgcccagctaattttttatatttttagtagagacagggtttcactgttagtcaggatagtctcaatctcgtgacctcgtgatccacctgcctaggtctcccaaactgctggggttacaggtgtgagccaccgcacccagccttctccttttctttcatttgtacggcaaatatttgataaacttctattatgtaccaggtgctgggaaatccagggagagtaagaaagacaatgatcctgtactgccggagattataatctaatggaggagccaaataaatattgtaattatagatatagagagtgatgttatctagaacaaagagagacgaagcctcttttgatgagactatcaggaaaattattttaaagaaaataaatcgtattgaagctgatactaacattaagatcatccttaaaagatgagcagaaaccaaccatgggaagactgaaaaagagcttttcaggcaatgggaataacaagtataatgaccctccagtgggaaaaagcttgctatgttctaaaaactgaaagaaggccagtatgacacaatatagtgaataaggttgagatgggaatgaataaaaggagagagatggggtaatcaggaaccagatcattcaagtcaagaagtttgcattttaatctgatggtaagccatgcaaagcttttaagtatgatctgggttaagttaaaaaataatttctgtttttactgaatggaggctgggccacatggaaacacaactggaaatagatctgttagatggctattgcagcagcctgaagaaaagatactactgtcacagacttgagagatagcaatgagatttggagaggagtaggatatatttcagggatagaaacacaacagaacttgagatgaactggataagggacagaaaaaaatgggaggaacttagaatgacttcttggtactttttacttatctgataagctcaataatagggtcctggaaggtactactatccaaatgctaaacaaagtcttgacatttttgccaagaatgaacagtagaataaatatcactccactttcaagcagataaatactcagtaaaagcagtggggcttcttactctgatcatatgtgtgtataaatcatctatttttgaacgtggaaaatatttgacactgaatggctactacttggtttttcctaggtgacatacctatggaaacaaaaggtacagacatagtgttatttatttaattttttttagagacaggatttctctctgtcaactcaggctagagtgcagtggaaggatcatgactacaccatagcctcaaaatcctaggcttgggtgatcctctcacctcagcctccagagtggctgggactacagacctgtgccaccacgtccagctaattttcatattttttgtagagacagggtgtcaccaagttgcccaggccatcaactcctgggctcaagcaatccacctgcttcagcctcccaaagtgctaggattataggcatgagccaccatgcctggcccagtgttatttattaaggctccaatgaacaagatttatgccactgtgaccccctgactatcaaacagtgtataaaattcttcagagtaagtttaagtaaaatggtaaagaaagagcttgatcccactggagaaatagaaataataacaagattaaaaagacatttccctcaaacccaggaaatactgtttcttctcagcaatacattgtgtggactcggtacttaccaacatgaatgggcgctggaaataatccatattcatgctctcctggagtatactccagcttctctttctttaattggatcaatcgactctttgggctgtgataaaaaaagaatgggaaacagtcaagaggcaaagaaatttcctcctgtggtcaaatacagataacagatcatcctatgaggagagggtaccaagtacattgataaattaaaaaaaaaaatctttacttctgaaactgtccttaagaaagaggctcctggctgggcgtgggggttcacgcctgtaatcccaatacttttggaagctgaggtggaaggactgcctgagcccaggaatttgagactggcctgggtaacaagtgagaccctgtctctacttttaaaaaaaaagaaagaaaagaaagatgctcttttattttctccaacagttttggagaaggaacacaaattttagatcggattataatgactgccttatatttggttactttatatcaatactgtgaagtaggtaagaggaaagatgctctataagactgagtgacttgccttgattttagtagttgggaaggagatttaagcttcaaaacctcagtttcttgctcaacatctactcactatattattctatattattctcttgcttttattccaccatgtctctctgggcttgtgtcttctactcacattattggtttgtttcctaaagtttaaaatgcgatctcaagagatttcataaatatataaaagggggaaaaaaagaaggaaaacaaaaaaggaaaatgagaaaaaagggccttagaagagtctcatttaagatattatgactatattttagcttaaagttccaattaattcttttttttgtttttttcagatggagtttcgctcttgtcacccaggccggagtgcaatggtgtgatcttggctcactgcaacctccacctcccaggtttaagcggttctcctgccttagcttcccaagtagctgggattacaggcatgcggcaccacgcctggctaatttttgtatttttagtagagatggggtttcaccatgttggtcaggctggtcttgaactcctgacctcaggtgatgcatccgcctcagccaaagtgctgggattacaggcgtgagcaactgtgcctggcctaaagttccagtgaataagacaaagctgatatatttatttcctttaacgaaattataacatactgacttttggccgggcgcagtggctcacgcttgtaatcccagcactttggaaggccgaggcgggtgggttatgaagtcaggagttcgagacaggcctggccaacacagtgaaaccccatctctactaaaaatacaaaaattagctgagcatagtggtaggtgcctgtaatcccagctacttgggaggctgaggcaggagaattgcttgaacccaggaggcagaggttgcagtgagccgagatcgtgccactgtactccagcctgggagacacagctagacaccatctcaaaaaaaaaaaaaaaaagctgggtgtggtagtgcatgcctttggccccagctactcgagaggctaaagtgaaaggatcacttgagcccggggtggggcagaggctgcagtaagcccagatagcacactgcactccagcctgagtgacagagccagactctgtcaaaaaaagaaaaaaaaaaaaaaaaagcatggtaacaaaaggcaatgcatgatcatggattatatcctgaatcagtgtaagaaagattgctgaccggacagggtggctcatgcctgcaatcctagcactgtgggaggccaaggcgggtggatcacctgaggtcaggagttcaagaccagcctggccaatgtgataaaaccctgtctctactaaaaatacaaaaattatctgggtgtggtggagcgcgctggtaatcccagctactcaagaggctgcagctggagaatcgcttgactccgggagacggaggttgcagtgagccgagattgtgccattgtactacagcctagacaacaagagcgaaactctgtctcagaaaaaaaaaaaaaaagaaagaaagattgccatcattatgaagacaaccttcatttatttatttttttcttgagacagagtctcactctgttgcccaggctggagtgcagtggcatgatcttggttcactgcaactctgcctcccaggttcaagtaattcttgtgcctcagcctcccgagtagctgggattacagatgccaactactgggattacactatgcctggctattttttgtatttttagtagagacagggttttatcacattggccaggctggtcttgaactcctgacctcaggtgatccacttgcctcagctcccaaagtcttgggattacaggcgtgagccacggcacctggccaggttatcttaataattcataaaacaggtaataaacatcatgtgctttaggaaaatattaaatgatttttaatttatttactctcataatttattatgattaatatttaaacaagtataaaattatttagtaccaaataaccagaggaaaaataggatcaaaatcatactgacagggaaagaaaaactgtcttggatttaaaacaatgttccagtaaaaacaatatatttataaagactgttatgatctgagtctattaatatacatctaggactataacatagatgtacttaaacacagcacagctcactcaaacgcagatatatgtaaaagcactttataaacagcaaaggagaacacaaacataacttaatagatgtaataaatgttgctcacagaaactgttttggatagaaatataaagtcatttgtcatttgatagtgatacattctgacaaatgctgtgtgaacatcatagaatatacttacacaaacctagatggtatagcttataggtcctaggctacaaacctgtttagcatgtaactgtactgaatattgcaggcagttgtaacacaatggtaagtatttgtgtatctaaacatttctaaacataagaaagatagagtaaaaatacggttgtaaaagataaaaagtggtacactttatagtatagagtacttaccatgaatggaccttgcaggactggaagttgctctgggtgagtcagtgagtgtgtggtgaatgaatgtgaaagcctaggaaattactgtacattgtacaaaaaaatgtacaaaaaagccaaaatgctaggaaagctatgacatcactaggtgataggaatttttatttttttgcttttttgagacagggtctcattctgtctcccagggtagagtgcagtggcgagatctcagctcactgcagctgcagcctcaacctcccagactcaagtgaacctctcgcctcagcctccttgccctccgagtagctggaactacaggtgcatgctaccacgaagggatgggacattttatttatttatttatttttgtagacacggtgtttcaccatgttgcccaggctggtcttcaactcctgggctcaagcgacttgcctgccctggcctcccaaagtgctaggattaccggtgtgagccattgtgcccagcctacaaacttttcaggataaaatttggcacttaatccattttgaaatgtctatcttgggtagatatgaaattgatgaaccaaaataatttcctcatatttgttaccacatgagagggcagatgcatttaaatctctttaaggagattttaagtcatagatattttagtaattatatgtagaaaatgctgctgggttctacaaggcatccaagttgaacaaagggtggccctggccataagaagtttacaatttggtgggacaacaagtatgtatgtagatatctagattatctatcagaatgtgataaaactttgaggccgggagcagtggctcacatatgtaatccaagcatgtaatccaagcactttgggaagtaggggcgggcagattacctgaggtcgggagttcaagaccagactggctaacatggctaaaccttatctctactaaaaatacaaaaattagctaggcgtggtggcacctgtaatttcagctacttgggaggctgaggcatgagaactgcttgaacacaggagacagaggttgcagtgagctgagatggcaccaccgcactccagtctgggtgataaagtgaggctgtcccaccccaacccccaccccccaaaaaaaacagaatgtgataaaactcataacactacttactaggaggagatactaagttctacaaaaggagaaagaaaagtaattgtaattaggaaagaattaagaaaacttatttgaaaagataaatgggattttgacaaggaaaggtgaagtagggaaggtagttcatactacacagagcagacatctaggataaaccccaggagaaaagtgtaggatggaggaagtaaggaaaatgatcagatgtggctaaaggaacaagtatttgaggactatgactggacaaataactagaaaaataggttacacaagataagggtgggacttaaatattatgcaacagttctgcaggaagtaacaagatttcaaaggaatctgggtagggaataacgaccccaatgaggacatatgctgggcgtggtggctcacgcctgtaatcccaacagtttgggaggctgaggcgggcaaatcacgaggtcaggagattgagaccatcctggctaacacggtgaaaccccgtctctactaaaattataaaaaattagccaggcatgtagtcccagctacctgggaggctgagaaggagaatcgcttgaatctaggaggcagaggttgtagtgagccgagatcgcatcactgcaatccagcctgggtgatagagcgagactgtctcaaaaaaaaaaaaaagaggacatattacttctaaagaggaagagtcttagaggagtaatttgtccaaggtcacaatatagtgattgtggagtaagacattaaataatattttgaatgcctacttcatgtatggaaagcattctgacattgataactgagtaacaggtactatttatcattgccattttaaagctgaggacactgaggatcaagggttgcccaaatcaataacttgcccaaattcatataactagtaactgacgaagctaggatctgataaattctataaccacaaatgacaattctattctatattccactggcagttaaacttttctgaaaatactgttttcataaattaccttcctaaagatgttaacatttctctcaaaacaatctatccaccaaagtacagtctactttctggaacagatttattttgctaattttactaaatttagataaacataaatttacatacttcagcataatcacctatttacagggagagacggtccagacccagacaaaagataaattaagatcatgccagtgatgtggtggctcacgcctgtaatcccagcactttgggaggctgagtcaggcagatcacttgaggcaaggagtttgagaccagccttggccaagaaggtgaaaccccatctttactaaaaatacaaaaattagtagggcgtagtggtgtacgcctctaatcctagctgctcatgaggctgaggcacgagaatcatttgaaccagggaggtggaggttgcagtgagctgagatcgtgccactgcacgccagccagggtgacagagtgagactctctgtctcaaaaaaaaaaagtgttaaaaaagatcgccggtggccgggcatggtggctcacacctgtaatcctagcactttgggaggccaaggcaggcggatcacttgaggtcaggagttcaaaaccagcctggccaacatggtgaaatcccttctctactaaaaatacaaaaaattagccaggcatggtcgtgggcacctgtaatcccagctactcaagaggctgaggcaggagaattgcctgaacctgggaggcggagattgcagcgagccaaagtcatgccactggactccagcctgggtgacacagcaagactccatctcaaaaaaaaaaaaaaaaaagattggtagggcacggtggctcacgcctgtaatcccagcacactggaaggccaaggtgggtggatcaccagaggtcaggtcaagaggtggagaccaacctggcgaacatggtgatatcttgtctctactaaaaatacaaaaaattagccgggagtggtggtgggcacctgtaatctcacctacttgggaggctgaggtaggagaattgcctgaaccccggaggtggaggttacagaaagccaagatcgtgctattgcacaccagcctgggtgacagagtgagactctaagaaaaaaaaagagcatactggcttccgggaacagtggctcatgcctgtaatcccagcactttgggaggccaaggcaggtggatcacctgaggtcaggagtttgagaccagcctggccaacatggtgaaaccccgcctctactaaagatacaaaaaattagctgggcgtggtggcaggcgcctgttatctcagctacttgagaggctgaagcaggaaaactgcttgaacccaggaggtggaggttgcagtgagccaaggttgcaccactgcacaccagcctgggtgacagagcaagactgtctaaaaaaaaaaaatcatactagctgggcatggtgattgtgccactgccagactccgtctcaaacaaacaaacaaacaaacaaacaaacatcatatcagggttaaaatacttctgaacatcatctacagacaacaggaaaacagactcccttaatgttctttcataaacaatatggcaacttttgccctggggatatgaatttgaagaagggggaggcatcattttttcataatgtcacctttccctaaccttgctccaatccagaccattttactgcacaacttaaaatcctcaaggaatacggcacttttagataaaaaggtaaaattatatttcagattactatataaactttatgctaaaaagtacagaatgtaaaaaatggacatgttattctagagctaatcttttaaataaaaaaaaggaattaatcaaatggtccagacaagttatccatgttttactgctttgttttgtttttaaagacagggccttgttctgccacccaggttgtacagtggtgcaatcataattcaatgcagccttgaactcctaaggctcaagcaatcccaccatcccagtctactgagtaactaggactacaggtctgtgtgccactatgcctggataattatttaaaaactttttgtagagatggggtcctcaccatgatgtctaggctggtctcaaactcctggcctcaagcaatcctcctaccttggcctcccgaagtactgggattacaagtatgagccaccacacccagccaagttatactttttttttttttttttttcagcataaaaagacattgaaggccgggtatggttgcctgtaatcccagcactttgggaagctgaggtgggtggatcacctaaggtcaggagttcaagaccagcctggccaacatggtgaaacccgtctctactaaaaaaaaaaaaatacacaaattagccaggtgtggtagcgcacgcctgtaatcccagctacttgggaggctgagacaggagaatcgcttgaacctgggaggcagaggttacagtgagccaagatcgtgccattgcactccagtctgggtgacaagagcgaaactccatctcaaaaaaaaaaaagagctggtggtggtgcaaatgcctctaatcccagccttttggaggttgcagctgaaggatcattgtggaaggatcccaggagtttcagaccagcctaggcaatggagtgaaactcctgtttcaaaaaaaaccaaaaaaacccacaaaagatatgtcagtactgtagaagctaagtaaagtagggaaaagtacaaacaactctgcagccaattattgccagaactcaaatgttaactatgctattgactaactgtaaaactctagacaaattacttaagtttctctaattctctaagccttagcttcttcaataatattaataatacctgttctctcacaaggttcttgaataaatttataagataacatatataaactcattagcacagtaactggcacataataggtatgcaagaagtattaactttctttttacttcttcagtattagcccagactaatatacctgaaaaaattccaaatatattagggaactagatgcaaaaattgaatccaagcaattaccagaagaaaacaaaagtaaatttcttacttgcttaaaatttgtgtgtgggagagcttttctaatgacttgaaatacagaagctttttttggagggcggcgatctattctgcagaagctgtatcccctctttcacttcctgctgcagccaataaaggccgttcctaccattaaaaaaaaaaaaaaatagccaggtatggtgatgccatgcctgtaatcccagctactcgggaggctgaggcaggagaatcgcttgaacctggaaggcagaggttgcagtgagccaagaacgcaccattgcactccagcctgggcaacaagaacgaaactccgtctcaaaaaaaaaaaaaaaaaggaagcaacctgggcacggtggctcacacctacaatcctagcactttgggaggccaaagagggacttgactcaagagttcaagaccagcctgggcaacatagagagaccctgtctctgaaaaaataaaaaaattagtccagtgtggtggcatgtacctgtagtcccagctactggaggaggctgaggtaagatgaacgcttgagtctaggaggtggagactgtagtgagctggtattatgccactgtactctagtctggatgagaggtagactctgtctttaaaaaagaaaaaaatccagaagcaatttaaaaataaaggccagatatagtggctaacccctgtaatcccaacactttggaaggacaaggcaggaggatcacttgaggccaggagctcaagaccagctcaggcaacatggcaagacctcattgtctctacaaaaaataaaaaaattagctagatgtggtgacgatgtgaatgatcttaagcaaagtcaagacacacatgacggaatccactaaaagactcttaggactaacacctaggttacaggagacaaactcaatacatgaaacacatctgtcagggtaaactggtgggaaaaaaaaatcaattgtatttctatacatagcaataaacaatccaaaaatttaatttaaaatatccaattggagggctgggcgtggtggcatgcctgtcatcccagcactttgggaggctgaggcaggcggatcacgaggtcaagagatcgagaccgtcctggccaacacggtgaaactctttctctactaaaaacacaaaaatcagctgagtgtggtggtgcgtgcctgtggtcccagctactcgggaggctgaggcaggagaatcgcttgaacctgggaaacagaggttgcagtaagctgagaccgcaccactgcacgccagcctggtgacagagtgagactccatctaaaaaaaaataataataatagaataaaaataaaaaaataaaaataaaaaatccaattccaattacaacaattacaatagcagtaaattaaaaaaaaattcttgggaacaagattaacaaaagaagaatagcacctgtacactaaaaactataaaacactgttaaaagttttgaggccaggggcagtgactcgtgcctgtaatcccagcactttagggggctgaggggggggcagatcacttgaggtcaggagttcgagaccagcctggccaacatggtgaaaccctgtctctacaaaaatataaaaattagccaggtgtgttggcatgcacccatattcctagctaatcaggaggctgaggcacgagaatcacttgaacccaagagggggaagttgcagtgagccgagatgaagccgctgccctcaagcctaggcgacagagtgagactcagtctcattaaaacaaacaaacaaaacaacaacaacaaacactgttaaaagttttggttaaagatcaaaataggtcgggcatggtcactcatccctgtaatcttagcaatttgggaggcctaggtgagtgaatcacctgaggtcaggagttcaagatcagcttgaccaacatgatgaaaccctgtctctacaaaactacaaaaaattagccgggcatggtggtgtgggcctgtagccccatctgtttgggaggctgaggcaggagaatcacctgaacctgggaggtggaggttgcagtgagccaagatcaggccactgcactccagtctgggtgagagagcgattctctgtgtcaaaaaaaaaaaaaaaaaagtcaaaataaatggaaagacatcccatattcacagatatggtgatgaccaaatactgttaagacagcaaaacttggccaggtgctgtagctcacgtctgtaatcccagcggtttgggaggccgaggcggatggatcacttgaggtccggagttcgagaccagcctggccaacatggcaaaaccctggatctactaaaaatacaaaaagtagatgggcatggtagcacatgcctgtaatccaaactactagggaggctgacagaagagaattgcttaaacccagggggcgaaggttgcagtgagctaagatggtgccactgcactccagcctgggcgacagagtgagactctgtctcaaaaaaaaaaaaaaaaaaaaagatgacaaaacttcccaaattgatctagagtctgtgaagattccagttgcattttttgcagaaatagataagctgatcctaaaaaatcacagagaaatggcaaggaatccaggaatagccaaaacaatcttgaaaaagaacaaagttgaaggaatcacactttctgatttcaggctttcttacaaaactccggtatttggccaggagcagtggctcacgcctataatcctagcactttgggaagccaagaggggaggattgcttgaggccaagagttcgagacagcctgggcaacataatgaggccttgtctttacaaaaaatttaaaaaatagctgggtgtggtggtgaatgcctatagtccagctactcgggaggctgaggaaggaggatggtttgagcctgggagaaagaggctgaagtgagctgtttgtgccactatactccaggctgggccttagagtgagaccctgtttctaaaaaataaataaataaaaaagctatagtaatcaacacagtgtttgaacagtaacaatatattattactggcataacaatagtcacggtcaataagcacaaaagtcaaataacaaattgacaaaatatatctacaatttatatcacggacaaaggcaaatctaatagataaagaactcttaaaaatcgaggatagaatttcccctgatagaaaatggggaaacacacatgaaaagacagttaaaagaaaaagataattaaatggccttcaaagatataaaaagatgcttgacagtattacttacaaaaaaaaggggaattgaaccagcctggccaacatggtgaaaccccatctctactaagaatacaaaaattagccaggcgtggtggtgcacacctgtggtcccagctactcgggaggttcgggcaggagaattgcttgaacccgggaggcagaggttgcagtgagccaagattgcgccactgcactccagcctgggagacagagcgagactccgtctcaaaaaaaaaagtaaattgaaattcctcacctattagattaataaacatataatcgtttgacaacataggacgggctgtggaaaagtaagacagactcataaatttctaggactacaaaaggatacaattcccatggaagcagaatttagcaatatttacaatattatatatacaattactatttaacccagtaattcaatttctaggaacttacccttaagatatacctccaaaatatcaaacaatgtgtggataaatttattcactgggcattatctataggagcaaatattagaacaacccttccttactagactggttagatagactatgaagtatctatataatctaatatcatacagctataaaaaataaaaacgtggatgtacacaaatgttcatagcagcattacttgtgatagccaaaagcagaaacaacccaaatgttcattaactgatgaatggataaataaaatgtggtatacatatgcacaatggaatattatttggcaaaaaagacaggaattatatatactacaacatgcatgaaacctgaaaacaatatgctaagtgaaaaaactcagtcacaaaaaaacacatattgtatgatactaaatatccaggactggttaaaaaaaaaaaattgtatttatattacatatattccacacattaaatatctaaatggacagttgcctaatggtggggaaattagggagtgattgcctagtgatgtgggtttctttctggaataataacaatgttttaaaactgattactgtacacttaatatctcaataaaggcttaggattgctctcagtccagagtcttaaagaagcagactgtctttgttgaagacttgaagaagcaagccaccaaccatgagttacacaactgcaaagaaatgagttttacctacatccatgtgagtctggaatacagccccagcctcggatggtaccttgattctggcttatgaaactcagaacagaggatccaactaagccaagactaaactggaatctgtgagataataaatggatgatatttaagctgctaaatttgtgataatttcttcaacagcaatataaaatttatacacttgtgtgtacgcacatttttttcattccatggtactgaaaggggctagaagcatggcatcatagcagtaacaaataccctagtagaaaaagcacatgaaaaattcagattttgacttctaaataataatcctcactaaaagaaaccaaagctccttgagggaaatagttgattccagatacaggccaaagaaagaacaagtctgataaacaacagcagaaaagtaaaccaaaacaaaaaactaaatcctcactactccgaacagcagaaagcagggaagtgctcaaagataagtaatctgaagacatgtataaaggaaacaggggccagtttaaaggggctcctgtggtaaaatcagggaattttgagcagtttcctataaaatgctaatagattataatatagtcaattttatgccaagcatgatagcttatgcctcctagcactttgggaggctgaggcagaaggacttcttgagcccaggagttagagtcaagcctgggcaacatagggagaccctgtctctggagaaaaacaaacaaaaccacccaaacaaaaaaaattcatgagtctataaggtattcaaaaaaacaaaacaaaacaaaacaaacagagagtttacggagaaaaaaaaagagaagctcatcttcaccagaaaatgtcagctaaaaatcaagaaataatggaattagaaaattttcttttctttctttttttttgagacggagtcttgctctgtcgcccaggctggagttcagtggcgcaatctcagctcactacaacctctgcttcctgggttcaagcgattctcctgcctcagcctcccaaatagctgggactacaggttgcatgtcaccaggcctggctaatttttgcatttttggtagagatggggtttcaccatgttggccagggtgttcttgaactcctgacctcaggtgatctgcctcctacagttctcggattacagggatgagcaaccacacccagcaaaaattgtcatttttcaaccatcaatgtaattattaaacttagggaaaaaacattaatggatgattaaatgttagattaaaaaagactgatagagaacaagccatagccttaaatatcaacccatggtttatgtaccaattacaatgggaaaaaatgtagtatctttgcaatgaaaagacttggtggataccaccttcactaagtaatcaaaaatggcaccatcaatgctgggacaataagtgggatgcaaaaagaagtataaagtatcacatatgcaatattcctgccatgatttttaaattttattaagttttatttatttttatttttgtagagactggatctcactatgttgcccaggctggtcttgaactccaggcctcaagtgatcctccagcctcagcctcccaaaatgttgagattacaggcataagccatctttcccaggcctctgccaagatttttttaaacctaaatttaatcatgaagataggatcaaagaaatccaaaatgaagggcattctaaaagacaacaaaagcctgagttcttaaaaaatggtcgatcttggccaggcgtggtggctcagacctgtaatcccagcactttgggaagctggggcgggcagatcacttgaggtcaggagtttgagaccagcctggccaatatgtgaaaccccgtctctgctaaaaatacaaaaattagccaggcgtggtggtgggcacctgtaatctcagctactcgggaggctgaggcaggagaattgcttgaactccatctcaaaaaaaaaaaagttcgtattattttctctttctttttctgagacagggtttcaaaaaaaacgctttgtcacttaggctggaatgtaatgtcatgaacacaactcactgcagcctcggacccctggactcaagtgatctgctcacttcagtctcacaagcagctgggactacagctgtgcgccaccacacctgctggatttttattttatttacttatttatttctgagacagagttttgctctgtcacccaggctggagtgcaatggtgcgatctcggctcactgcaacctctgcctccggaggtcaaaggattcttctgcctcagcctcccaaggagctgggattacaggtgcctgccactgcgcccagctaatttttgtatttttagcagagacagggttgtgtcatgttggcctgactggtcttgaactcctgacctcaagtagtctgcctgccttgccttccaaagtggcctcaagcaatcctccagctccagccgcctaaagtgctgggattacaggcgtgagcaatcgcacctggcctttatttttattctgttgtatgatattacaacagtagatacatgtcagtatacatttgtcgaaacccatagaatgtatatcaccaagaatgatatacaggattacaggcctgagccactgcgtctggcctgaattcttaaatttttagtagagacaaggtcttgctatgttgcccaggttggtcttgaactcctgggctcaagcaatcctccagctccagcggcctaaagtgctgggattacaggcgtgagcaatcgcacctggcccctttatttttattctattgtatgatattacaatagtagatacatgtcagtatacatttgtcaaaacccatagaatgtatttcaccaagagtgaaccctaaagtaactacggactttgggtaataatggtatatcaatgtaggtacatggatcataacacatgtatcacaatggtgtggtgtaacagtgggcaggttgtgtgtatgaagaacagggtgtatatgaaaactctgtactttccactcaattttgctgtgaaactgaaactgctctaaacataagtttattaatgaaactgctaacaacaaaatagccagcccacaataatatcctggcttcacatctttcaagaatgcatacatgtactaaactgatcaatgttcttaaaaatgcttaaagaataaaccattttcttcctacttatttttgggagaggaagagctagttctaacatacataaagtgatatttcagtccattttcaggtcaaatcttttgtatgaccagagacacttacaaatcactgatacggttgtataatttgatgtgaaatcaaattacatcaaaagatcagaatcttccatttttaaatctttaatcaagaaaaagcacaaaagtaaaaaacagaagtgtggtcttatgatatatataaatataaatatgaatataaataaataaataaatatatatatatatatatatatatatatatatgttttcatccatggttcctggctcttaactcccatagtccctgttataatgttggggcactttaagtctcaggagtgggcctcaggagatagaatctctctttgaccttctcctgtcttcctttcacctacctaaggcaggactctaatctgattctgggccaagaaaaccctcactccagagagggtcctgccccataccctagagaaaggaatgtgacacagagaggccaagaagtctagacaggacatgctgggtttacatcctctacattttgttcaatcacatttctacatggctgtcattgacgcctatgaagcttccataaaaactcaaaaagaggccgggcgctgtggctcactcctgtaatcccagcactttgggaggctgaggtgggcggactgcctgagctcaggatttcgcaaccagactgggcaacatggtgaaaccccgtctctactaaaatacaaaaaattggctgggcatggcggtgtgtgcctgtagtcccagctactcaggaggctgaggtaggagaactgcttgaacccaggaggtggaggttgcagtgagccaagatcttgccactgcaccccagcttgggcaacagagcacgactccgtctcaaaaaaaaaaaaaaaaatttagctgggtgtggtgacaggtgcctgtaatcccagctactctggaggctgaggcaggagaatcacttgaacctaggaggcagagcctgcagtgagccaagatcataccattgcactccagcctggttgacaagagcgaaaccccatctcaaaaaaacaaacaaaaccacaaaaaacaaaactcaaaaagaaaggttcagagagtttctggatagctgaacatgtggaggttcctggagggtagtgcgcccaaggagggaatgaaagctctatgctccttccccagtatatgtcttcatctatagcgtctgtaatatcctttataacaaaccagtaaatggaagtacatgtttccttgagttttgtgagccattctagcaaattaatcaaacccaaaggggggattgtggaaaccccaacttgaagctggttggtcagaagttctagagagccagagttgtgactggtctaaagggagggtggcggtcttgggaactgagcacccaacctataggatctgaccctatatccaggaaaacagtgacagaattgaattgaggacacccagctgctgcctattgcttggtgtatgggaaaaccctcatacctttggttacagaagtcttctgtgtgttttttttttttttaattttattgaaaaaaatggttttttttaaaccagcagtttgctcttacagacttctttgttgatgattattgtgatgtgacagcagaggaaaaacacagtctgagaggttctccctaagcaagaaataaaacttgaattttatttagcagaaaagttgataattatatttctgctctatttagcagactctgttccaaaattatgactgaattagatgtgtcccaaagtgtatttctactttctcatttctactgacagaatgttgattttttttttccttaacagctattaacacctagagtaatgaccattatttccgcaacctgtcttatggctaaagtgtggctatgcaatttaaattctagccaatttatataaatgcgggtttgaaattttcttacaaagaaggagcatgggccaggcatggtggctcacgcctgtaatcctagcactctgggaggcagaggagggcggatcacctgaggtcaggaattcaagaccagtctggccaacatggtgaaagcccatctctactaaaattacaaacaattagctgggcacggtggtgggtgcctgtaatcccagctacttgggaggctgaggcaggagaatcgcttgaacccagaaggcagaggttgcagtgagccgagatcgtgccattgcactccagcctgggcaacaagagtgaaactccatcgcaacaaacaaacaaaccagaaaacaaaaaacaaagaaggagcatgcttttcctcctcttttctgtctgtaacaaacatcaaatggctggactctagtaactatcttggaacatgagggaatcttaggaatgcataattagtgctgagatagaagggagaaaaaggagcctaggtccctgaagacattgtgaaggtaccattatgaactttgaactacatacttcacaacttctcttaaattaaaaaaaatagttaagtgcctatctttttaaagtcttggttatttgagatgatttattattataattagctaaacttaagcttcattagtaaaatgttttcatgacctaagaagcacgttcagagtataaaaattttgtgatatctacctcagtgacaaatcaataaaaatcttttaaatgcaaaataaagtggtatggtttacatgtcaattactttaacaccaccaaacgagatgtacctctaaaatctaaggtttcctctttcaatcttattcttctctttgtctaaattcagatattcatgactttttgacagaaactgtgaggtgagagtttttgccactagtaattcattccatttattttccaccctgctgctggagttatcttaaacaaacctatacctttcacatccatcccccaaactcattttttatttcctatagcaaaatagcattaaaaaaatttcttttttttttgagatggagtttcgctcttgctgcccaggctggagtcaatggctcgatctcggctcactgcaacctccgcctcccaggttcaagcgattctcctgcctcagcctcccaagtagctgggattacaggcatgtgccaccacactcggctaattttgtatttttagtagaaacggggtttctccatgttggtcaggctggtctcaaactcccaacctcaggtgatccacccgccctggcctcccaaagtgttgggattataggtgtgagccaccactcccatccaaaaccaaatatcttaaagttaactaaatatctcaaagtccatggttatatgttcctcatcatataatgcttatttaccacagggccactacatttcagaagccctaaactttcaagttgttttgatatatgaaaaatctttgtatcctttttacatgctgttctgactggaatatccttctccatctggtaaactactaccacacctctaaatcctaactcaaccagaaaatatttcttaattgatgataatttgctatccctttgatgctttaaaaattctcaattagagtgcttattaaattgtactctgccaagataatacaaagttcttaaaagcaaggcaaatattttattcatctgacaaagctcatggaacacagcgtccaatcagtgaaaaatgaagtcaccaatataaaaaatgaagtcaccaatatcattttagttacacagagccatttattgcttaagttaataagaaaagcatcattagggccaggcacggtggttcacgcctgtaatcccagcactttgggaggccgaggcaggtggatcacgaggtcaggagatctagaccatcctggctaacatggtgaaaccccgtctctactaaaaatacacaaaattagctgggcgtggtggcgggccctgtactcccagctactcgggaggctgaggtaggagaatggcgtgaaccccggaggcagagtttgcagtgagccaagatcgcaccactgcactccagcctgggtgacagggcgagactccgtctcaaaaaaaaaaaaaaaaacaaaaaaagaaaagaaaagcatcattagaatctcaatctagaaaggcagagagaagataaccatcagaaagacaattagtctcatacaacataagacagtacagtagtacagtgaacactggtatttgtgcatattacttttgtactgatttccccccacatcagaaagggtaatgtattgaccttgacacaaagtttgagggaggcgtacctcatacatgagtgcaaaaacacaatcatcacgcttatgaaacacaaaagaatctatattgttttttgatagtcaaagtatttttccaaatgtggaagaaaaagggatgttagctaataggtactactacttactctgtagttttgtaaacgtcagaatacagccctgctttctgatacttcttctttgggggacgtgggggcttcttttcccttgggatgagagaaagcacaggctgcaaggtactttcaggttcagaaggtttagctggggtttcagaaggactgggaatctcaactggtgcttcattaaagctagaaagagaagtttaaagataattttattatgaaaaaaaagttttcctacaaataattgtctacttaaaaaaaaaaaaccatagcaattaaaaaaagagatatggggacttccttatctggccatgtttaaataactggtaccagacttctcctgacaagaagtaatagaaatatggtagtctactagatacttagagaaaattttattttattttattttttgagtcggaatctttctctgtcacccaggctggagtgcaggggcacaatcttggctcaaggcaacctccgctttctgggttcaagcaattctcctgcctcagcctcccgagtagctgatattacaggggcacgccaccagttttgtatttttagtagagacgggttttgccatgttggctaggctggtcttcaactcttgacctcaagtaatccacctgccttggcctcccaagtgctgggattataggcatgagccaccgtgcccggcatgagaaaattttaaaagacaattattatcagatactggacaacagttaatgcagcactgttatccctgagaaatctgaaaaaaatgcggtgagtcacacaaccaccttgcctttcttttatctttttttgtttattgagatggagtctcgctctgttgcccaggctggagtgcagtggcatgatctcatctcactgcaacttctgcttcctgggttgaagcgattctcctgcctcagcctcctgaatagctgggattacaggcgcctgtaaccacatctggataatttttgtatttttagtagagacggtttttagtttcaccatgttggccaggctggtctcaaactcctaacatcaggtaatccgcccacccaaagtgctgggattacaggcatgagccactgtgcccagccccaccttgcctttcctttccttccttttcttcctttccttccttccctcccacccaccttccctccttccttcctttctttttcttttctttccttttcttttttttttttcttttttgagacggagacttgctctgtctcccaggctggagtgcagtggtgtgatctcggctcactgcaacctccgcctcctgggttcaagagattctcctacctcagcctcctgagtagctgggattccaggcatgtgccaccacacccagcttattttttttgtatttttagtacagacagggtttcaccatgctgtccaggatggtcttgaactcctgatctcaggtgatctgcccacctcagcttcccaaagggttgggattacaggcgtgagccatcacgcccagcctccaccttgcctttctaagaatgactgtggtgcagaagtagaaaccaagcagagaatggccaaactgatgagctgaaaagggatatatcagagtacagagggactgagatagctggaatttgtggaaatgagtatcagaatggaaaaacctatggagaattataactctagaaatctaactatgggtgtctcttttagtatactgctaaacactacgttgtgcatgtgaagggtgaaattccatatggctgaacaaggaactaccagaaaactgtaacctgagcaattcacacaactcacacatgatggcagatactcattccattaggcaaagtagaaagacattgttcaacaataggggacattaaacagcaagcccagagggtaatgttatccactgttagagggcttaattatcctgaaaggaagactagccttcactggtggggcgcagtggctcacgcctgtaatcccagcactttgggaggctgagacaggcggatcacctgaggtcgggagttcaagaccagcctgaccaacatggagaaaccccgtctctactaaaaatacaaaattaggcgggtgtggtggtgcaagcccgtagtcccagctactcgggaggctgatgcaggggaatcgcttgaacctgggaggcggaggttgtggtgagcccagatagcgccattgcactccagcctgggtgacaagagcaaaactccgtctcaaaaaaaaaaaaaagactagccttagctaagtttaaaaacaatatgagaatccaaactgatccataagtaacttaactgcctaccaaaataaaattgaatatttgtaaaggaaaccaacaaaaaccagacatacaataatgcgacatcacaatgtcttgcatccaataataaattcctacatatgccaaaatgcaggaaaatgtgacccaggggaaaaaatcattcagtagaaacagcaacagaaatagaaatcacaaagatagaaaagaaaataactttaaaatactactctacaagcataaatcaggaatttagaagaaaatacaaagataatgaggagaggaagagaagacttaacaacaacaacaaaaggaatattgagaattgataaatacgaaatctgaaatgaaaaactggagagtacttaacagcaaataaggcactggagatcagtgaacttgaagacagcaatagaaacaacacaaactgatagagattaaagaaaagaataaattatgtaaagaatataatactaacagaatcttagaatcccgggaaaggagaaaacttactactaaaacaattggacacttgtaaaggaaaacaacaaaaaccagatatacaatgatgtaacattcacaaaataaaaaattcacaatgaaaaaaattgagaattatggctaaaaagtttcccaaaatgataaaaagcataacctcagagttagaagaaagtaagcaaaccataggcaggataaataaaacaaggtccagtatatcgtaataaacttgttaaaaactactgatgaagaaaacaaaagaagctaaagaggctgggcgcagtggctcacgcctgtaatcccagcactttgggaggccgaggtgggtggatcacgaggtcaggagattgtgaccatcctggctaacacggcgaaaccccgactctactaaaaataaaaaagaaattagccaggcgtggtggtgggtgcctgtagtcccagctactcgggaggctgaggcaggagaatggtgtgaacccgagagcttgcagtgagctgagatcgcaccactgcactccagcctgggagggcaaataaataaataaattaattaattaaacaaaaaagcagcagctaaagagaaaacacacgttataaaaaggggccgagcacagtggctcatgcctgtaatcccagcactttgtgtggctgacgcaggaggattgcttgagcccaggagttcaagaccagcctgggcaacatagcaagacccatttcttaaaaaaataataataataaaaaagtttagatctcatatccaaaacagtgcaaaccagaagacaatgtaatgacatcaaacagtgttaaaaggagaggcaaaggggaagcttatcaaaatagaaatcaaaataaaacaaaaacattaaaaaaaaaaaaagatgtgcttgattcagcagcacatatactaaaattggaacaatacagagatgagcatggccctggtgcaagaatgatatgcaaacttgtgaagtgttccatatttttaaacaaagcattttacttaaaaaataatacaggtgattcttgttccacacaaaaatcgaacagatgcacatctacctctcattttactaagtacaactaaaaactctggaaattgtctataaaataaacataagcaaatgtactggcaatgaccaggcaggaagtttcccagatatttgatttgcctcatatgtacaggttaaattgcataaagtttccctattattaaggacaaggcaaacatatgctttcatcatatatgttcagtatcataacagaggtcctagccagtgcaaaaaggccagaaaaagaaaacaatattgaaaaggaagaattacaaactatctctactcacacattgtgtgattgtctatataaaaacacccaaagactctacaaaagagaaagtactacaattagtgaaatacacaacaatgttgcagaatccaaggtcaaattcaactgtatttgtatgttctatcaatgagaaaactgaaatcaaaattaaacaatgctacttaaacagtagaatagtagccaggcagggtgactcactcctataatcccaacactgtgggaggatgaggcgggcggaccacctaaggtcaggagtttgagaccagcctggtgaacatggtgaaaccccgtctctacttaaaatacaaaatacaaaaattagctgggtgtggtggcacacacctgtagtcccagcttctcaggaagctgaggcaggagaatcgcttgaacccaggaggtggaggttgaattgagccaaaatggttccatcttggctgggcaacagaatgagactccatctcaaaaaaaaacactccagcctgggcaacagaatgagactccatctcaaaaaaaaaaaaaaacaaaaacaaaaaaacaagaaaagcattaaatgcttagatataaatcaaacaaaataatacagaaatataatttctttataaatgtataaatataataaagtacaaatttaaaagaaaaccaaaatataaatctaacaaatacatgcagtacataagagtataaacaaaacaatgaatttaaaaaaaaaaaggccaggtgtggtggctcatgcctgtaatcccagcactttgggaggccgaagtaggtggatcacttgaggtcaggagtttgagaccagcctggccaacatggtgaaactccatctctactaaaatataaaaattagccaggcatggtgccaggcacctgtaacctcagctactcgggaggctgaggcaggagaatcacttgagcccgggaggtggaggttgcagtgagccaagatcgcactactgcactttagcctaggtgacagagcaaggctccattaaaaaaaaaaaaaaaatcaaagataacctaaaataaatgcagtaacataccatgtccatggatgtccatggaattaaacactgaatgtcattaagatggcaatttctgtccaggcttggcagctttcacctgtaatcccagcactttgggaggctgaggcaggaggatcacttgagcccagaggttggagaccaaccgaggcaacatagtcagaccccatctttgcaaaaaattttaaaaaactagccaggtgtgatggcttacacttgtagtcccagctactgaagaggctaaagtgggaagactgcttaaacctaggaggtcaaggctgacagtaagccattgcactccagcctgggcaacagaggaagattctgtgtcttaaaaaaaaaaaaaaaaaaaaaaagttggtgattgcaactttcccccaaactgatctatagatctaacacaatctcaagtaccaacagtttttttttttttttttttttttgagaaaatgccaagataattcacaaattgctatggaaagacaaaacctaaggccaggcatggtggctcacgcctgtaattccagcactttgggaggccgaggcaggtggatcacgagatcagaagattgagaccatcctggctaacacggtgaaaccccgtctcttctaaaaatagaaaaaatagccgggcatggtggtgggtgcctgtagtcccagctactcgggaggctgaggcaggagaatggcatgaacccgggaggcagaggttgcagtgagccgagatcacgccactgcactccatcttgggcgacagagcaagactccatctcaaaaaaaaaaactaaaaaaaaattggaggatttatctaatttcaagacttactgtaaatgtattgtaatcaggacaatgtgatactagctacacaaaataaatgtagaacaacgtaatagagtgtagaaatagatacacatatgactaattttttttttgaaaaattgtggtaaaatgcatataccataatatctaccttttaaaccattttaagtggtctggacagttcagtgacatcaaagtacattcacattgttgtacaaccatcaccagtatccatccatctccacatctttttcatcctcccagacagaataactgatcctattaaagaaaaactctattccatcctccctccaacccctaataaccaatattctactttccgcctgtatgaatttgtctattccaggttcctcatactagtggaatcataaaatatatgtccacttgtgtctggcttacttcacttttattcttttttgagtcagagtctcattccgtcaaccaggctggagtgcagtggcacgatctcggctcgctgcaaccctacctcctgggttcaagcgattctcctgcctcagcctcccgagtagctgggattacagggtcacaccaccacgcccagctaattttttttttttttttttttttgagatggcatcttgctcttgtagcccaggctggagtgcaatggcatgatctcgcctcactgcaacctccgggccaccagggtctgctaatttttgtatttttagtagaagcggggtttcaccatgtttgccaggctgctcttgaactcctgacctcagatgatttacatgcctctgcctcccaaagtgggaggcatgcctgggattacaggcatgagccactgcgtccggctgctaatgattttcttaatagcatctgggaacttgtctactgcctcttggttggcagaagcttctccttttaccttgattttttctttttctttctgtttttttttttttgagactgagttttactctgccgctgaggctggagtgcagtggcgtgatctcggctcactgcagcctccacctcctgggttcaagcgatttctcctgcctcagcttcctgaagagctgagactacaggcacccgctaccacgcctggctatttttttgtgtttttaatagagacaggtttcaccatgttgaccaggctggtcttgaactactgacttcaaatgatcgcctgcctcggcctcccaaagtgctgggattacaggcgtgagccattgagctggcctttcttttttttttttttcagacggagtctcgctttgttgcccaggctggagtgcagtggtgcgatctcggctctctgtaagctctgcctcccaggctcaagcaactctccctgccttagccttccgagtagctgggattacaggtacctaccaccatgcccagctaatttttgcatttttagtagagacagtgtttcgtcatgctggccaggctgatcacaatctcctgacctcaggtgatctacccacctcggcctcccaaagtgttgggattacaggcgtgagccaccacgcctggacatgtatgcttttttaaggcaatcctgcatccacataaaaactgcattttcggccaggcatggtggctcacacctgtaatcccagcacgttgggaggccgaggcaggcagatcacgagttcaggagattgtgaccatcctggccaacatggtgaaaccccgtctctactaaaatgcaaaaaattagccgggtgcggtggtagtcccagctactcgggaggctgacgtcggggaattgctggaacccgggaggcagaggttgcagtgagccaagatcgtgccaccgcactccagcctggcgacagagcaagactctgtctcaaaaacaaaacaaaacaaaacaaaaacaaaaaaacccctgcattttcaatatgagataaaaagataccttggaaaaagtactaagttttcgcacttgctggcacagctacggtgatggctttgcaaaattccttttcttttttcaagtccttatgctagattcatttatctttcttcttttgagacggagtctcagtctctcgctcaggctgcaatgcaatggcgtgattcggcgcactgcaacctccacctcccaggttcaagcaattaacctgcctcagcctccggagtagctaggattacaggcgcccgccaccactcctaattttttgtatttttagtagagacagggtttcaccatgtcggccaggctggtctcgaactcctgaccccatgatccgcctgcctcggcctcccaaagtgctgggattataggtgcgagccaccgtgcccggcccatttatcttgaaatggtgggcaaccacagctgcagaccccaatctatggtacatatcaagcagttcaactttttgttttcttgtaatgccatgacttttctcttgttcttggaagcccttctaacatcactaatggcacttcatataggtctcatagggtcattcaaggtttatggaatcgtagtaaaaacgatgagaaataaagaacttcaagagatcactttgtactgtgatacgtaatttactggagagattccagtaaactgctcacttggagatgattagtgtcatatggctttgaagtggattctggcaacactttcttcattgcaataacaacaagaggtggctatgaaattattacagtagtacagtatgtattacagtttttttttttttgagacagagtttcgctcttgttgtccacgctggagtgagatggtgcgatctcggctcactgcaacctccgcctcctggattcaagcgattctcctgcctcagcctcccgagtacctgggattacgggcatgcgccactacgccgggctaattttgtatttttagtagagacggggtttctccatgttggtcaggttggtctccaactcccaacctcaggtgatccgcctgccttggcctcccaaagtcctggaattacaagcataaactaccatgctcggcctattacagttaattttatgattaatgctgtatgtctttgtttacatttctcataactgagaatggcgtcatgtatagtttgtgtttgtaaattttgataaattttaactttttatttgagacagagtcttgcttttttgcccaggctggagtgcaatggcatgatgttggctcactgcaaccttcgctacccagggttcaaatgattctgcctcagcctcacaagtagctgggagtatagacacccaccacctcacctggctagtttttgtgttttttttttgagacagagccttactctgtggccaggctggagtgcattggagcaacatcagctcactgcaatctccgcctcccaggttcaagttattctcctgcctcagcctcctcagtagctgtgattaaaggcatgcacaaccatgcccggctaatttttgtatttttagtagagacagggtcaccatgttggtcaggctggtctcgaactcgaactcctgacctcaagtgatccacccaccttggtctcccaaaagtgctgggattacaggcatgggccaccacgcccggcctagttttttttttttttttttgagacagagtcttcctctgtcgcccaggctggagtgcagtggcgcgatctcggatcactgcagcttctgcctcctgggttcaagtgattttcctgcctcagcctccaggtagctgggattacaggcactcaccatcatgcagggctattttttttttttttgaggtggagtctcgctctgttgcccaggctggagtgcaatggtgcgatcttggctcactgcaatctctgcctcctgggttcaagcgattctcctgcctcagactcctaagtagctgggattacaggcatgtgccaccatgcttaattttttgtatttttagtagagaccaggtttcaccatgttggtcaggctggtcttgaactcctgacctcatgatctgcctgccttggcctcccaaagtgctgggattacaggcgtgagccaccacacccggccaagcagggctaatttttttatttttagtagagaagaggtttcaccacgttggccaggctggctcgaactcctgacctcaggtgatccacccacctcagcctcccaaagtaccaggattacaggtgggagcccccatgcctggcctaattttttttgtggtgttttttttttttgagacggagtctcgctctgtcacccaggctgcagtgcagtggcgcgatctcggctcactgcaagctctgcctcctgggttcacgccattctcctgcctcagcctcccaagtagctgggactacaggcgcctgccaccatgcccggctaattttatttatttatttatttattttttaagacagggtctcactctgtcacccaggctggagtgcaatggcacgatcttggctcactgcaacctctgcctcccaggttcaagtgattctcctgcctcagcctccctagtagctgggattacaggagtgtgccatcatgcccggctaatttttttttttgtattttagtagagatggggtttcaccatgttgcccaggctggtctcgaactcctgagctcaagcaatccacctgccttggcctcccaaagtgctaggattacaggcatgagccaccgcacccagctttttgtattttttagtagagacggggtttcaccgtgttagccaggatggtctcgatctcctgacctcgtgatccgaccgcctcggcctcccaaagtgctgggattacaggcgtgagacaccgcgcctggcccattaatttttatatttttaatagagatagggtttcaccatgttggccaggatagtctcgaacttctgacctcaggtgatctgcccacatcagactcccagtgaaattttaactttttataatagatttgtgtatatcttatgtctttctgcaaacaataaaatggattaacatctacaaatattttatccgttcatgacatactttttaatttttttgactatttctaggctacacctactatgtatccacaaaaaataaaaattaaaaactaaaaaatttttttctaggctacacagttcatctgtgagtttaagtatcgcaaatctcaaatctgtgttgttcaagggtcaactgtatttaatcaactgggagttgattttttgtatagaggataagacagaatccaatttccttctgatccccagggatttcaacttactgggcacaatttgttgaacagttctttatatgcctctgttacccagcaagcttccatatatgtgtaggtctgtttcttttatctattcaattccacaccaccttaatactccatagcttgaaattaagtcttgggacaaatcctttattttattcagtaattacctttccaggtatatactctgatataattttttttttttttttttttgagacagagtctcgctctgtcacccaggctggagtgaagtggtctgatctcagctcactgcaaccttcacctccaaggttctagcaattctgctgcctcagcctcatgagtagctgggattacaggcatgcagcaccacacctggctaattttaatttttctttttttttttgagatggagtcccgctcttgttgcccaggctggagtgcagtggccagatcccggctcactgcaacctccgcctcccgggtccaagcgattgtcctgcctcaggctcctgagtagctgggactataggcgcccaccacctggctaatttttgtactttttagtagagacagggtttcgccgtgttggccaggctggtctcaaattcctgacctcaggtgatccgcccacctcggcctcccaaaatgctgggattacaggcaagagcgactgcgcccggctaatttttctatttttagtagagatgggtgttcactatgttggccaggctggtcttaaactcctgacctcaggtgatccacccacctcggcctcccaaattgctgggattacaggcacaagccactgcacccggcccctgatacagtttggatgtgcgccctgcccacatctcacgctggaatgtaatcaccaatattggtggtgagacctggtgggaggtgactggaccatgggggtggttttctcttaagcagtttagcaccatcccccgatgctgtcgttgccatagtgagtgagttctgttgagatctggtgctttaaaaagtgtatggcacttcgtccttctccttcttgctcctgctctagccctgtaaccagtatactccccatgactgtaagtttcctgaagcctccccagaagcctaggagatgccagcatcatgcttactatacagcctgcaggaccatgaacgaattaaacctcttttctttataaattacccagtctcaggtatttatagcaatgtgagaacaaattagtataatgccttaagtctgggtgcagtggctcacgcctgtaatcccagcactttgggaggccaaggcaggtggatcacctgaggtcaggagttcaagaccagcctgaccaacatggtgaaaccccgtctctactaaaagtacaaaaaaattagccgggtgtggtggtgggcgcctctaatcccagctactcgggagactgagggcaggagaattgcttgaacccaggagatggaggttgcagtaagccgagattgtgccactgcactctagcttaggcgacaacaatgaaattccgtctcaaaaaaaaaaatatatatatatatgttgggaacaggccccccaaaatctggccataaactggccccaaaactggccataaacaaaatctcttcagcactgtgacatgttcatgatggccatgacacccacgctggaaggctgtgggtttaccagaataagggcaagaaacacctggcccacccaggctggaaaaccgcttaaaggcgttcttaaaccacaaacaatagcatgagcgatctgtgccttaaggacatgctcctgctgcaggtaactggccaaacccatccctttatttcggcccatccctttgtttcccataagagatacttttagttaatcccgtttcccataagggatacttttagttaatctaatatctatagaaacaatgctaatgactggcttgctgttaataaatacgcgggtaaatctctgttcggggctctcagctctgaaggctgtgagacccgatttcccacttcacacctctatatttctgtgtgtgtgtctttaattcctctagcgccactgggttagggtctccccgaccgagctggtctcggcatatatatatatacaatgctttagagaaattagtgtccatatccaccagtggacattagaggaatattaaaagcagtttttttgggcaataacctcaagttgaaaataatccaagagtaaaatcgaagaactgtattacacacaaacaatgaaacaacacattaaaactacagcaacatgcattaacatacataatttaacatgactatgttgagcaaaaaaaggtgagacacaatagtatatgtcctctgtaattaattttgtttgtttgtttttgcttttttgagacagggtctcactctgtcaccctgggtggattgcagtgatgtgatcttggctcactgcaatctctacctcctgggctcaagtgattctcccacttggcttcctgagtagctaggactacaggcgtgtgctaccacaactggctaactttttgtattcttagtagagacgatgttgcctaggctactctcaaactcctgggttcaagcgatccacacgcctcggcttccaaaattgctgaaattacaggcatgatatggcacccaacctgtataattagatttacatgaaattcaggaagaataagctgtattgtttagagctgcacacataaatagtattttaaaaggtaaatatgtggttaccttaaaagtcagaagattggttatagcttctggcaagaaaaggggtttacaaacagggaaagtatggtcacctcctgaatatttatatgggtacgacctctacagaaaatttacttagcttatgttatgtattctcttgtttgtctcttatttgttttttaagacaggttctcgctttgtcacccaggatggaatgtggtggcacgattatggctcactgtagcctcgacctcctggacaagctcaagcaatcccttaacacctcagcctccctagtagctgggactacaggcacacatcagcacgtccagctgatttttaagtttttttttttttgagacagagtctcactctgtcgcccaggctggagcgcactgatgcgatctcagctcactgcaacctccgcctgccaggttcaagcaattctcctgcctcagcctcccgagtagctgggattacaggcatgcgccaccacacttggctgatttttaagttttttgtagagatggagtttccctatgttgcccagggtggtcttcaacccctgggctccagcaatactcctgcctctgcctcccaaaatgctgggactacaggtgtgagccacctcatctggcctgtttatgtattctctttagatgtatcctcttctgtttgcagcccatattctctttaatgagatgggaataatatttttcttgaaagtgtggtagaagttaaaattgggtctgatgctgttcttggggcaagactttaaataatagattcaatttaggcaataggagtgctcaggtaatttcttttgagtatgttttgttaaaattgtatttttctaggaacatgtccatttcaacagttttcccatttgatgggcttaaagttctcacagtagtaaatttttaatctcttatatacactttatttccttttaaatccctatttattccctttctcattcctattgatcggctttaccagaagtttgtctattttattagttttcaaagaactttggtcttaaaagtgactcttactgttatacatttgccttattttattaacttaaggtgtatgttttacattcttccaatatcattttcaggctcattcacttgttcttttaatttcttattttcataaaattgtttttagaaatagggttttgccattgcccaagctggtctcaaactcctgggttcaaccaatcctccagcctcagcctccagagtagctgagactattggtgtggccagcaagctcttaacaatttttttcggtcaggtgtggtagctcacgcctgtaatcccagcactttgggaggccaaggtgggcagacttgaggtcaggagttcgagaccaccctggcctatatggtgaaaccctgtctctactaaaaatgcaaaaattagccgggcatggtggcaggacctgtaatcccagctactccagaggctgaggcaggaaaatcgctagaacccaagaggtggaggttgcagtgagccaagccattgtactccagcctgggcaacagagcaagatgccgtctcaacaacaacaaaaatatatatatatataatatttacatataatatacattataagatacatatttttagagacaaagtcttgctataatatatatgtatttttagaggcaaggtcacactctgtcaccaaggctggagtgcagtgaaggaacacagctcattgcagcctcaacctcctgagtgcaagtgatcctcccacctcagcctcccaagtagctagaaccacagacacgagccaccacgctcatttaatttttaaatgttttgtagagatggaccaggtgcggtgctcacacctgtaatcttagcactttgggaggtcaagttgagaggatcgcttgagtgcaggagttcaaaaccagcctgggtaacatagtgagaccccatctctacaaaaaacacaaaaattagccaggcctggtggcccccgcctgcagtcccagccactgtgggggagggatgggggtggagacgcttgagcccgggaggtggaggttgcagtgaactgagattgtgccactgtagtccagcctgggggacgcagcaagaccctgtctaaaataaacaaacaaacaaacagttctttgtagaaacggtagctacaaccagccacactgctcaggctgtcttgaactcctggcctcaagtgatcctcctgcctcagcctgacaaactgctgggattacaggtgtgagccaccacacctggcctgattttattttttacagcaaaaatttataagtgttttaaaaatatacctttttctttttaaaaccaggatttgaacctaggttttccgagtctagaagcccacctcataaccattaaattcttcctgtgcattctggttttatattaatcaacaaatagtgaccaaaatctttaatatatcatacaaggttcttggcacaatctgatccctacaacctctatctgtatcccatgctactctactccatgttttgaccacaaaagctttctttcgcttgcctgaaactatcatgctttttcagacttttgtgtatgctctctcctcactcctttaaataacagatgaagcctattcttcacatttttagcatagtccttactttttctgggaaactaagttagttatttctattatatacagtactcttataactctaagtaactcttcataatagcacttggatggttaaaatccatgaaggtaggaaaagtttctagatttattcaccactctatcaattctaagtacatgaaacataataatcttccaacaaatactaattgaaaaaataaatgaatacatattatataacaagtactagtgtaagctccaattagaacaagttgaaaaactgttgctatctctgggaactcagtgtgtcatgtccttccctacacaatctcttgagggcagaaattttatctttctctttataatctcttcaaatctcagaatacaatcttgtgaaaaagtatgtgtttaattttgctgaccatgatactagaatttgctggaatagaaaggctaacctattcaaaagccttttttgtcgttgttgagacgaagtcttactctgtcatccaggttggagtgcagtggtacaatctaggctcactgcaacctctgcttccctggctcaagcgatccccccacctcagcctcccaagtagctgggaccacaggcgtgcaacaccaccacgcccagctaatttattgtattttttggtaaagacggggtttcaccatgttacccaggctgatgaaagccttttcttgaagcacattttaaagatgacccttcctaacataaatggtcaagatgtctcaaactacagtaaaggcagaaatcatcctccttgtcagtgttttaaagcttcaataattaaactgctatgacagagataccaaaatagactgatagaaaggaatataaaaatatttgacatttcaccaggcccccagcttggggcgccttccttccccatggcgggacacctggcttcggatgcctgccttcttgccccctccaggcggtggaggtgatgggccaggggggccggagccgggctgggttgatcctcggacctggctaagcttccaaggccctcctggagggccaggaatcgggccgggagttgggtcaggctctgaggtgtgggggattcccccatgccccccgctgtatgagttctgtggggggatggcgtactgtgggcctcaggttggagtgcggctagtgccccaaggcggcttggagacctctcagcctgagggcgaagcaggagtcagggtggagagcaactccgatggcacctccctggagccctgcaccgtcccccctggtgccgtgaaactggagaaggagaagctggagcaaaacccgcaggagtcccagaacatcaaagctctgcagaaagaactcgaacaatttgccaagctcctgaagcagaagaggatcaccctgggatatacacaggccgatgtggggctcaccctgggggttctatttgggaaggtgttcagccaaacgaccatctgccgctttgagggtctgcagcttagcttcaagaacatgtgtaagctgcggcccttgctgcagaagtgggtggaggaagctgacaacaatgaaaatcttcaggagacatgcaaagcagaaaccctcttgcaggctcgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggtgccagaaaggcaagcaatcaagcagcgactatgcataacgagaggattttgaggctgctgggtctcctttctcaggggtaccagtatcctttcctctggccccagggccccattttggtaccccaggctatgggagccctcacttcactgcactgtactcctcggtccctttccctgagggggaagcctttcccccgtctccgtcaccaccctgggctctcccatgcattcaaactgaggtgcctgcccttctaggaatgggggacagggggaggggaggagctagggaaagagaacctggagtttgtgccagggcttttggaattaagttcttcattcactaaggaaggaattgggaacacaaagggtgggggcaggggagtttggggcaactggttggagggaaggtgaagttcaatgatgttcttgattttaatcccacatcatgtatcacttttttcttaagcctgggacacagtaaaaaaaaaaaaaaaaaaaaaaaattgaaaagaccctaagatctaacagtatataagaatttaggatggtggggcgccgtagctcacacctgtaatcccagcacttcgggaggccgaggcgggaggatcatcaggtcaggagtttgagaccagcctgaccaatatggtaaaaacccgtctctactaaaaatacaaaaaaattagccaggcatggtggtgtggtggtgtgcgcctgtaatcccagctactcaggaggagaatcacttgaacctgggaggcagaggttgcagtgagccgagattgtgccactgtataccagcctgggcgacagagcgagactccgtctcaaaaaaaaagaaaaaaagaatttagtgctgggtgtggtgagtcatgcctgtaatcacagtactttgggaggccaaggcaggcggatcacttgaggtcaggagttcaagaccagcctggccaacatggggaaaccccgtctctactaaaaatacaaaaattagctgggcatggtggcgcatgcttgtaatcccagctacttgggtggctgaggcatgagaatcacttgaacccaggagacagaggttgcagtgagccaagattgcgccactgcattccagcctgggtgactcggtctcaaaaacaataacaacaacagcaacaacaaaaacttagtgtatgataaatgtatcattccaaataagttgggaatggctaaactaatcaatagtactgaaagaaaattaaacctctaactcatagctaatattcagtattacataagtgacataaagagctaaatataaaaaagcaagatctagtcaatcacaacagtgtaattacataaattatgatatattcctaccacagtataaggtaattctgtatgttctgatgacaagctctcagcattaaagaatacacaatgtactgttaatagcgttatccatggagagaagaatgggataagagcaagtgagagcatgtgaaaagagacttttacttttaaatcagtaaactactagtttaattaaattatttattaccagcgtgtattgctcctgaaattaaaaaatatattctctagaaaaaagcaattatttttatataggtggatggaaaaaaaaaaaaaccctctctatacaggattcaccaggagagatgatagagaatatgagtaagagtgaacatgccacattaagaaaagccatttataaatgatgaacattaaattggttcattaaaaaatattaaatatgggccaggcgtggtggctcacgcctgtaatcccagcactttgggaggctgagacgggtggatcacctgaggtcaggagttcgaggctagcatggccaacatggtgaaacctcgtctctactaaaaatacaaaaattagccaggcatggtggtgcgcacctgtaatcacagctgctcaagaggctgaagcaggagaatcacttgaaaccacgaggtggagggtgcagtgagtggagatcgtgccattgcactccaggctgggtgacagagtgaaactccatctcaaaaaataaataaataaaaataagaatggtttattgcctgtggctttgttattacatctaagaaatcacggccaaattcaatgctgtgaagcttttgccctatattttctcctaagagtttacagttttatttttatttatttatttatttattttgagacaaagtttcgctcttgttgcccaggctggagtgtgatggtgcaatctcggctcactgcaacctctccacctcccgtgttcaagggattctcctgcctcagcctcctgagtagccgggattacaggcatgtgccaccatgcccagctaattttgtatttttagtagagacggggtttctccatgttgatcaggccggtctcgaactcctgaccctcaggtgatccagctgcctcagcctcccaaagtgctgggattacaggcgtgagccaccatgcgtggactttttttttttttttttttttttgagaaggagtctcgctttgtcacccaggctggagtgcagtggcgcaatctcggctcatcacaacctccgcctcctgggttcaagcaattctcctgcctcagcctcccaagtagctgggattacaggcacacaccaccacgcctggctaatttttctatttttagtagagacggggtttcactatgttggttaggctggtcttgaactcctgacctcgtgatccgcccaccttggcctcccaaactgctagaattacaggcgtgagccaccacgcctggccaagagtttctggttttagattttacatttacatctttgatccattttgagttagattttgtatatggtttaaagtaagactacaacttcattcttttgcatgcagatacccagttttcccagcatgatttgtcaaaaagactgtcttttaccctgctgaatggttttggcacctttgtcaaaaatcatctgaccatgcatgcaaggttttatttctgggctctctattctacttcgctggtctatatgtctctctttatgctactaccatacggttttgattaccatagctttatagataaaacagacaattggacttcatagatatcagaaaattttgtacgtcaaaagacagcataaacaaagtaaaaatgcaatccacagaataggagaaaagatttgcttatatgccggttaagagaataatatccagaatatattgagaactgctaaaactcaacaacaaaccaaatagcccaatcaaaaaattgaaaaagcgattgagtagacacttctctaaagatacataaatggccaataagcgtatgaaaatatgtttgtcactaatcattagggaacagcaaattaaaactacaatgagatacccatctcatactcatttggatggctgctataaaaaaaaaattgaaaatagcaagtgttggtgaggatgtaaactgaaatccttgtgcattgtaactgaaatctttgtgcatgcaaaatggtacagcccttctggaaaacagtatggcagttcctcaaaaaattaaaaatagaaatgtcacatgatccagcaattccacttctgagaatatgcccaaggttaaagcagggtctgaaagaggtatttgtatacccgctgtcatagcggcgttacggcatggaaacaccccaggtatccatcaatggatgaatggataagcaaaatgtggtatgcacataaaatgatcacagagctcatacatctctatattggataaaatacataatctttctgggccttgatttcctttgtctgtaaagtgagtgggttcagagtggatggttacttgccctttgcttcttttgtgtttgtttttgagacagggtctcgctctgtcgcccaggttggagtgcagcggtgcaatcttggctcactgcagcctcctggattcaagcaattctccctcctcagcctcctgagtagctgggattacaggaatgcgctgccacatctagctaatttttatatttttagtagagaaagggtttaccatgttggccaggctggtcttgaactcctcacctcaagtgatccatccacctcggcctcccaaagtgctgggattacaggtgtgagccactgcacctagcctctctgattcttaattataacttgtaaaagcaatacataagaacagtttttgaaaagaaatggtctcatatagtaaaaaatgaaaggttataagatgaaataattcagctatagagttacattacagtttttcaaagctagtttcctctactcagataatatgttaaatgaggaattaccttttattattctcttgctcttcttcctctggtaatggcttctgcttttttctggtctgttcttccaatagccaaccttttctcttcaacccctttttatgttctgggttcagatttacactctgaacaacagcctcaattacatctgtaactgtgtcaggactgaggtgcagtgctgctccttcctcgtctctgttcaattctgggttgacaaactgagcagcctggaatgcttgcattgatacgacagcctgaaggggacatttccgaggtcgacctggcctacgtttcacaaagttattccctgtcctggcctgcctttgaagttttttggcttttaagattttattgacatggtctaggtttttctttgtggccaagattttgtcgtaattgcacattttccgagcttggcgttgcatagcttccactacacttctcttgatatgatggggggaacagctgcttgtcaacttttcagataggagtgagatgctattattgcaagagtcacttgtgactgcaggcactaaaaggctgtctggttttcccagggttcggtccttgctgtggctacggcctggactggaagaaggtggtgcagaggcagttgcaatcacagcatcaatacttttctccatgggctcttggtcctcattttgtaccatccgctgcagcagactatccacagagtcatccccagaagcaactaatcttggacttcgagagggaactccgtttactgaaagagacaataaatcacacatagacaaaattggacacggctagttatttaaataagtttttacacagataaaagggagtactactctattttccatagcaagattacacatcataggtaaattgatggtttactttcctgaaaaaggttattacaacaagataaaaccaaagttggcctatatttctctaataatatgtaaatttaaaaagaacaactctcactttgaggtaaggattagaaagaaaaaaatttaattcttcaaaaatgaaggtcaaaaataaaaaataaataaaaaataaattaaggtccagttaagctaagggacttaaatgttggataaagagtgggcacagtggctcatgtctgtaatcccagtattctgggaggccaaggcaggaggaatgcctgagctaaggaattcgagatcaacctaaggaacatagcaagaagatgtctctacaaacaatataaaaaaattagccaggcatgctggctgaaacctatggtcacagctatttatgaggctaagttgggaagactgcttgagcctgggaggtcgaggctgcagtgagtcactgcactctaatcaggacgacagagcgagaccctgtctcaaaaaatactaataatttaaaaatcagttcaaaataagtcacttcccatgctgcctagtttactactattattcatgggtcatacttctccaaagttaattaatggatttcttatctatatgacttttaaatgtgataactatactagatattcctttattagcctcaggcattctagattccaatatcatcagactgtggaatttttctcaaattaccaataactttcttcaaataatatccaatagccttgtctaaatttttaagacttttttttttattttatcatcaactctggcctatagacccttgtctcaatttgatatttaaacattttcaggccaggaacggtggctcacactggtactctcagcattttgggaggccgaggtggaaggatcacttgatgccaggagttcgagactagcctgggcaacgtactgagaccctgtctcaacaaaaaataaaaattagcccagtgtggtttcctgtacccgtagtcctatctactcaggaggctgaggcgggtggattgtttgagccatggagtttgaggctgcagtgagctatgatcacgccactgcattccagcctggatgacagagcaagaccctgtctctagaaaaataataaaatttaaaaaaaggaaaaaatttcaaactctcagctatatttgatttcataattctttaaaatcctgcctacactatttctataatatcctttgattaactttcaattacttgcaactccattaaatttaactgcggaggtcctcaatacagagtacttgttatttaccttttatacttactttcccactgggaacatgtttattctcatagtctcaattatcatcagtatgtaagtgacttctaaatattcataccaatcttcagttttatctgaaaattaccaaaacgaaaaatgaccccttccttttctccaacctttaaatgctatagtttttaaaaactttctagcctgagcttttttcctgtctgactctctattctctctttagcaattcttttaactatcatctatattctgatgactactgaatttctattttctgaatagacctttcttctaattgtctacttttgcatgtttcacagatttctcaaactcatattcacatctcatttcattttcgctcccttcaaactagctcctccatccagattccctacatcagtgaatgataccataaagctaacattatgtatactgaccatccatcgtgtggcaggacgttggttatctaagctcaggccacatcatttattctggctccttcaccctccccacaaatcataaaattctgtcttctgttagtttaaactcttgaacctgtccactttcctttcttctactacagccatcaagactaagataatgttatctccctgccctgaagcaatagtgtaattccttgtggggctattaaaatacgtacattaatctcttgaagtttccctatcaagttgtagtctagtccctctctgctgccactgaagacttgccttagcaaagaaattcaatagaagaatgtgatgatttccaatgttaggttagaaaaggtctgtctctctctctatctccaccccccactcccaccccggccccgccacaagcccttggattcaagcttccaagctgcaaggaagcccaagcaatgagttggcatactggccaacagatcctgctgaggtcacagccaacaaccagtatcaaccaccagatatttgaataaagaatccttttttttttttttttttttttttttgagacggagtcttgctctgtcacccaggctggagtgcagtggcatgaacttggctcactgcaagctccacctcctgggttcacagcattctcctgcctcagcctcctgagcagctgggactacagacgcccagcatcacacctggctaatttatttttgtattttttagtagagacggggtttcaccatgttagccaggatggtcttgatctcctgacctcatgatctgcccgcctcggcctcccaaagtgctggaattacaggtgtgagccactgcgcctggcctttttttttttttttttggagacagggtctcactatgttaaccaggttggagtgcagtggcacaatctcagctcaccgcaaccgccacctcccaggctcaagcgaccctcccacctcagcctcctgagtagctgggactacaggcatgcaccaacatgcccagctacttttttgtattttttgtagagatggagttttgccatgttgcctaggctggtctcaaactcctgagctcaaatgatctgaccacctcagcttcccaaagtgttgggattataggtatgagccgcctgcctgaccaaacaaggaatattttgagatgactttacctcaccaccatgtagttacaaccaaaggaagggaatcctgagaaactgtgagatgataactgattattactgtttcatgacagtaagttcaaggtgctttgttatgcagcaatggacaactgaaacattgttcttcctgcttctactttcaccatcctccaactcattctttagacagcagcctgagtgatctttaaaaaaaaaacacaaaggcccggcaaggtggcttacgcctgtaatcccagcactttgggaggctgaggtgggcggatcaggtcaggagtttgaaaccagcctggccaacatggtgaagccccgtctctactaaaaatacaaaaattagccgggtgtggtcgcaggcgcctttaatcccagctacttgtgaggctgaggcaggagaattgcttgaacctgggaggcagaggttgcagtgagccgagatcacgccactgccctccagcctgggcgacaagagcaagactccatctcaaaaaaaaaaaaaaaaaaaatcaaaaaaaaaaaacctcacaaattttatcaggtttcagcttctgcttacaactcttaaaaaggctcttaccacataaaacaacttcaaaattattattaccttttcttctagcatcaatctcatattatcttagaccctaattctagtaataataaacttcagttccttaaactcatcatgttttttcttgattcaaggcctttgagtctgcctttctctctacctggaacaatctttctccacaaattcatctgcttaatgactattcattctttagtttacagtgaggacataatttcctgaaaggttatttacctgaccaggaagcaccctcttcattcttaatttaggtcccctattaagaattatcctaatactttctcctttcctaacactaatcacacttcaaattagtggtttaatgtatgtaattctcaaacaatgtttggtccattaacgcggtgactatattcaccaaaatcactttttatctccaatgaccaggacataattcattaacacgtagttgaagaatgaatcctgggatcaaaatcttggaattatttttatctcctctatcccttcatcaactactcagagctaccaatgcatttaatccatgaatatcagtttaaaagagaatcctaaaatgggtacacacttttgaagcctccttcctgggccattcacctagagctattaatacctcacacttcatttttgaattgttcctatcttcacaaattctggcctgccaatttatgtttcttggtagtctaggacatgatgctgcacactatattttagatgtaacttattttcaaaattaacttcactgtggtaaagtaccacataaaattcaatgcatgttttttatatatacatttttgagttttgaaaaatttaccatgtagccatcatcataaccaatatatagaacatttctgtcaccctaaaaagttactgtgtgtcctttccaagaaaataaattgcctgtcatccacagcctcagagaagaaacaactgatctgcttcctgttatatattaagtttgcttttctagaagttcatatacatgaaaagaaagaatatgtattttattgtacggcttcattcacacagcataaatctgagaatcattcacattgccacatttctttttactgttcctttttactattcacatatttctttttacaactgaattatatgaatataccacaatttctttacatattcacctggaaatctgcgttgtttccagtttttagtcataaagaaaaaatatcctatgaacatgtgtgcacatgacattttgtttaaacatattttcatttctcttgggtgaatacctaagactggaattactaaatcttttttttttttttttttttttgcgacggagtctcgctctgtcactcaggctggagggcagtggcgtgatcttggctcactgcaacctctgcctcccgggttcaagtgattctcctgcctcagcctcccgagtagctgggactacaggcacctgccaccatgcctggctaatttttgtttttagtagagatagaatttcaccatgttggccaggctggtctcgaattcctgacctcaaatgatccacctgccttggcctcccaaagtcctgggattacaggtgtgagccactgcaacctgcctagaattactaaatcaactaattgtatgtttaagaaatttttacaaagtgattgttctattttatagtcccatcatcaatgactgagttaaagatcctatacatcctcaccaagacttggtattatgcagtcttttacattttaatcattctaatgggtgtgttctcatttataaatttaatttgcatttccctgatgttgagcatattttcatgagcttattggcaattcatatgcattcttttgagaaaattctattcagatcttttgccgattatttttattgggttcttttattttttggcttacattttcattttcttaaataatgttttctgtttgtttgttttctgagatgaagtctcgctttatcacccaggccggagtacagtggtgcaatcttggctcactgcaacctccacctcccggggttcacgggattcctgtgcctcagcctcctgaggagctgagattacaggtgcctgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggccaagtcaaatttttttaaatggtccttgctttttatactatttaagaaatctttgaccatcccccaaggtcttaaagattttttcctattcttctaaaagttttattatttccgaaatttcataggggtatatgatcttttttgatttaaatttttcatgtggtatgaaacagggtcagtgatctttttattccataaggatatccagtagttacagcaccatttgttgaaaagactatccttgtcccattgaaatagtcacatttgtcaaaaatcaattgaaagttagcggagtttcactcttgttgcccaggctggagtgcaatagcgtgatcactgctcactgcaacctccacctcccaggttcaagcaattctcctgcctcagcctcccgagtagctgggattacatgcacccaccaccatgcccagctaatgttttgtatttttagtagagatggggttttgccatgttggccaggctggtctcgaactcctgacctcaggtgatctgcccacctcagcattccaaagtgctgagattacaggggtgagccactacacctggtctaaatttcatttttaataattaaaaaaaaataagccacgaagtgtctgtcgcccaggctggtctttaacttctgggctcaagtgatcttcctgcagtggcctccgaaagtgctgcgattatgtgtgagccaccacggctggcctctatgtaaattttagaatcagtctgccagtttatattaaaatcctgttgcaactgtattgagtccactgactctacagagtgatctggagaaaggtgacatctcaacaataatgagtctttcaaaaatgcctctgacatatctctcccacttattcttcaatttttctcaaaaagactttgtatttttttaattttttgtgatttaattttaattttagtgagtacatagattgtgtgtgtgtgtgtttgtgtgtgtgtacattttttattttttattttttccctaagggacaaggtctcactgttacccacactggtctgaatctcctggccccaaatgatcttcctgcctcattcccccatgttgctaggactacaggcatgaaccactgggcctacactgtactttttttttttttttttttggtatttttagtagagacggggtttcaccatgttggccaggctggtctcgaactcctgacctcaaatgatccatctgcctcggcctcccaaactgctgggattacaggcgtgagccaccgcacccggccactgtactttttattatacagatcccgtacatgtttttctaaatttatcgttaagactttaatggcttttaatacaactgtaaatagtattatttatatttcaattaattaattaaattttttttttttttttttgagacaaggtcttgctctcatccaagctggagtgcagtggcatgatcttggttcactgcaacctccacctcccgggttcaagcaattctcatgtctcagcctcccgagtagctgagactacaggtgtgcggcaccacgcccggctaatttttgtaatttttgcagagatggggtttcaccatgttgcctagactggtctggaacttctgggctcaagcgatccacacacttctgtctcccaaagtgctggtattacaggtgtgagccaccatgcctggctacatttcagtttcttttttttttttttctttttttttttttgagacggagtctcgctctgtcgcctaggctggactgcagtggcgcgatctcggctcactgcaagctccgcctcctgggttcacaccattctcctgcctcagcctccccagcagctgggacttcaggcgcccgccaccgcgcccggctaattttttttgtatttttagtagagacggggtttcatcgtgatcctgacctcgtgatccgcccgcttcggcctctcaaagtgctgggattacaggcgtgagccaccgcgcccggcgctacatttcagtttctaattgttcactgtatgtagaaatacaattatttctatatgttgagcttaaacacacagaaattgtactgttaaactcatttattaagttccagcaactttttaacaaattccttgggaattttctgcaaattgtattatttctgaataagacattaagacttccctataatgctgaatagaagtagtggacatctataccttttccccaatcttagggaggaagctttcagtctttcaacattaagtgttaggttagctgtaggtttttctgcaaacaccctgtaatgggttgagcaaatactattctagtcttattttctaagagcttttttttaaaaaccatgaatggatgtcaaattttgtcaaatatgttcccttaatctacttagacaattaggtgatttttctcatgtattgtttttcttaaaaaatattaatttattaattgatttgagactgggttatgagactggctaatttttatatttttggtagagacggggtttcatgtgttgctcaaggctggtctcgaactcctgagctcaggcaatccgcatgcctcaggctcccaaagtgacaggattacaggagtgaaccaccacactcagccttgttactgcctgtcttttgggtataaaccattttacctggggtgagatgatatctcattgtagttttgatttgcattcctctgataatcaatgatgttgaatacctatgcctgttgccatttgtagcatcttcttttgagaaatatctcttcagtcttttgtccattttttaaacagattattagacttttacctatagagtggtttgaatttacatattctggttatgaacactttgtcagatgtgtagtttgcaaatattttctcccattctgtgggttgtctcttcactttattgattgtatactttgctgtgcagaagcttttttacttgatttgatcacatttatccatatttgtttggctgcctgtgcctgtggggtattgctcataaatttttgttcagatcaatatccgggagagttttcccaatgttctcttatagtagtttcatacttttgagatcttagatttaagcctttcatccattttgatttcagtttttgtatgtgctgagagacaggggtcaagtttttcttttgcatatgaatatccagtattcccagcactatttattgaagagactttatgctcttgggacctttgtcaaaaataagttcactgtaggtgtgtggatttgtttctgggttctctctcctgttccactggtctatgtgtctatttttatgctagtaccatgctgttttggttatcatagctctgtagcataactgaagtcaggtaaagttatttctccctttcagcttagaaatagctttggctattctgggttaatttttatttttcttttcgttttgttgttgttgttgttgttgttgtattgagatgggtcttgccaaggtgctcagactagcctcaacctccttggcttaagtagtcttttccctgcctcagtcacgcaggtagctaagacttcaggcacaggggtgccacaccacccaactttcactttcttcttttttgagacggagacttgctccgtcacccaggctggagtgcaatggtgcgatctcagctcactgcaacctctgcctcccagttcaagcaattctcctgcctcagactcctaagtagctgggattacaggtgcgcgtgaccacgcccagctaatttttgtatttttttagtagagactgggtttcaccatgttggtcaggctggtctcaaactcctgacctggtcatctgcccgcctcggcctcccaaagtgctgggattacaggcgtgagcaactgcgcccagcccactatcttctttctaatgcaggttttacttgctcttcttttttcagcttcctaaaggtgagaactgacttagatagatctttggtgtttaataatctcagctataaatattcttagattatcccacaaatttctatgtgtgtgtgtgtttttttttttaaacggagtctcgctttgttgccaggctggagtgcagtagcacgatctcgtctcactgcaacctccacctcccgaggtcaagtgattctcctgcctcagcctcccaagcagccgggactacaggcatgtgccaccacgcccagctaatttttttgtatttttagcagagatagggtttcaccatgttggccaggatggtctcgatctcttgacctcatgatccactcgccttggcctcccaaagtgctgggattacaggcgtgagccaccacgcccggccctatgtgtctttcatttttattcatttcaaagtattttctgatttcatttttggggattcatcttttacttatgaattatttagaagtgtgttatttaatttccacatatttagagaatttcataacttgtgttactgaattctaatttaattctgttgtggtctgaaaatatattctgcatgagtttaatcttttaaaacgtatcaagacatttgattacccagaataggatggtatcttggtataattccacacgcacttcaaaagaatatgagaaaaatgtggttgtttttttttttttttgagacagagtctcgctctatcacccaggctgcagtgcagtggcacgatctcggctcactgccagctctgcctcccaggttcacgccattctcctacctcagcctcctgagtagctgggactacaggcgcccgccaccatgcctggctacttttttgtatttttggtagagatggggtttcaccatgttagccaggatgatctcgatctcctgacctcatgatctgcccgtctcagcttcccaaagtgctgggattacaggcgtgagccactgcgcccagccgagaaaaatgtgttttatattttcccattggttgacaatttctggcactctttactcctttggtagatccatgtttctacctactatgttttctttctatctgaagaacgtcctttagtgtttctgctactgtaggtctactggcaacaaattctttaaacttttctttttctgataatgtttatcttgcctccatttttgaaagatatttttgctggttaaaaaattttaagttgacagatgttatttttcctttccacatttaaagacatcattccattgtgttttggcttgtaaaatttctgacaatatgtctgctgatagttgttactgtgttcctctgtatgtgtttgtatgtatgtgtttttaattttctttctgctggttaattttaagattttctctttacaatcgttttccagaaatttggtaataatgtcctttaatatgtctatgtatgctgtcagtgtgtttatcctacgtgggattcgtagagtttcatcgatctgtgggatatagttttaatgaaagtgtgaaagaaatattaaacattatttcttcaactgctattcccaatttgttctttatgagactctatcccatgtatattagccctcttgatattgtaccacaggtcactaaagtttcattcatttttttggtcaatcttttattccactctgtacttcattttggataactattaagtgtttggattttgttgtcttcctttaaaaaatgttgaagttgaaaaaactggaacatttgtacactgttgatgggaatgtaaaatggcacaccattgtggaaaacagtaggacaatccatcaaaaaattaaaaatggaattaccatataatcgaggaattccacttctgggtatataccagaaagaactgaaagcagggtctggaagaggtatctgttcaccattgctcatagcagtattattcacaaatggccaaggttggtagcaacccaagtaaccatttataaacaaataacaataaacaaaatgtggtaaaacatacaaaggaatattattcagccttaaaagggaaggcaattctgacacatgctaaaaaatggataaaccctgtctgggtgcagtggctcacacctgtaatcccagcactttgggaggctaaggcggtcgaatcacctgaggtcaggagtctgagaccagcctgaccagcatgaagaaaccctatctctactaaaaatacaaaattagcttggcatggtggcacatgcctgtaatcccagctactcgggaggctaaggcgggagaatcacatgaacccaggaggtagaggttgcagtgagctgagatctctccattgcactgcagcctgggcaccaagagcaaaactccacctcaaaaaaaaaaaaaaaaagaaataaaaataaataaaaaataaaccctgaggaacttatgctctaagttaagtaagccagtcacaaaaaaacaaacaccgtatggttccactttagtgggtgattgccagggactgaagggacaggggaatatgaagttcttatttaatggatacagagtttcagttttgcaagatgaaaaaagttacggagattggttgcacaataatgtaaatgtacttaacactagtgaattaactgtacacttagaaatggggagtctaggcaggcgcggtggctcacgcccgtaatcacagcactttgggaggccaaggccagcggatcacctgaggtcaggagttcaagaccagcctggccagcatggcaaaaccccatctctactaaaaatacaaaaattggctggcgtggtggtggacacctgtaatcccagttacttggaggctgaggcaggagaatcgcttgtacttggaatccagcctgggcgacaggagcgagactctgaaaaaaaaaaagaaaagaaaagaaatggggagtctagctccatctcctaggctggagtgcactggtgtgatctcagctcacggcagcctccgcctccaagttcatacgattctcttgcctcagcctcctgagtagctgggactacaggcatgtgtcaccatggccggctaatttttatatttttagtagagatggggtctcaccatgttggccagactagtcttgaactcctgacctcaggtgatccgcctgcctcagcctcccaaagtgctgggattacagacgtgagccattgcacacggctttagaaatggttaagatggtaattttttttttttttttgagacagtctcactctgtcacccaggctagaatgcagtggcatgatcttggctcactgcaacctccacctcctgggttcaagcgattctcgtgcctcagcctcccgagtagctgggattacaggcgcccgccatcatacctggctagtttttgtatttttagtagagacggggttttgccatgttggccaggctggtctccaactccggacctcaggtgatctgcccacctcggccgcccaaagtgctgggattacaggcgtgaccgactgcgtcctgccggtaaattttatattgtctgtattttgccacaattaaaaaaaatttttgttttttcacaattaaaatgtttttaaatgttgaactttgttttaaaaatcagttatttgtagaacagtttgacagtttgattccttgaatcctgttttaaatcattactagggtctagtgtaatcttcattccagagatactttagccctgctaaggtgtaaccttttttttttttttttcctttttgagacagggtcttgctctgttgcccaggctggagtgcagtggtgtaatcttgggtttacaacctctgcctcctgggttcaagcaattctcctgcctcagcctcccaagtagctgggactacaggtgtgcgtgaccatgtctggctaatttatatgtgtttttagtagaaatggggttttgccatgttggccaggctgccctcgaactcctggcctcaagtgatctacccgccttggtctcccaatgtgctgggataacaggtgtgagccaccacgtctgaccaagatgtaatctttatgggggccttcataattgtccccaaggactctacagttggtagtcagagttcaaatgtctcatgccacatgtaaaccttaggaatttttcatatacaactccctagtttttcttaggccatttttttggagtttcactctatgcaaggagggcctagtagccagcaaagatttaagactactcatcacatgtggctaaacaggccaggcacagtggctcaggcctgaaatcccagcactttggggggccgaggcaggcagatcatctgtggttaggagttcaagatcagcctggctaacatggcaaaaccctgtccctactaaaaatacaaaacttagccaggcgtggtagcacacacctatagtcccagctactgtggaggttgagtcaggagaatcacttgaacccgggaggcaaaggctgcagtgagccatgatcatgcaactgcactccagtctgggtgacagagcaagactccatcccataaaaaagaaaaaaatgtggctaaacgcctttgcaatctttttttatgctttaccactatactccgtctcccttgtatatgacctaattctcattccataccgtcataataatggcaggagggccaacggtagcaacagtaacaacagaagttaccatttatggctgggtgcagtggctcacgcctctaatctcagcactttgggaagccaaggcaggtggatcacctgaggtcaggagttcaaaaccagcctggccaacatagtgaaaccccatctctactaaaaatataaaaattagctggtgtggtggtgcacatctgcagtcccagctactcgggaggctgaggtagcagaatcacttgaacccgggaggcagaggcttcagtaagccgagattgcaccattgcactctagcctgggcaacagagggagactgcgtgtcaaaaaaaaagaaaaaacaaaaaggccgggcacagtggctcacgcctgtaatcccagcactttgggaggctgaggcgggcagatcacgaggtcaggagatccagaccatcctggctaacacggtgaaaccccgtctctactaaaaatacaaaaagaaattagcggggcgtggtggcaggcgcccgtagtcccagctactcgggaagctgaggcaggagaatggcatgaacctgggaggcggagcttgcagtgagccgagatcgcaccactgcactccagcctgagcgacggagcaagactccatctcaaaaaataagagaagttaccatttactcaaaaactaattcagtgataagaatttcttatccacttactctaattcccactagtctgcaagataaatagaagtagtagcctcatgttacagataagaaagccatgggttgaatggtttatgtaacttccacaaggttacatgatattgctaaatgtgaatcaactagatctaagtcaaaagtacatagttttcccattacatcaaaatgccttctcctcttctcccacttacctcttcagtcatggcatatgtatgatgtcttttaaacctcaatacaaagattatggaagcattttctgattaactttccatcatttcagcattcggttatgtgtagaataatactatacaggtcaggagtggtggctcaggcctgtaatcccagcactttcggaggccgaggtgggctgattacttgaggtcaggagttcgagaccagcctggccaacatggtgaaaccccatctctagtaaaaatacaaaaattagccaggcgtggtggcacatgcctataatcccagctacaagagaggctgaggcaggagaatcgcatgaacctgggaggtggaggttgcagtgagctgagatcgtgacactgcactccagcctgggtgacaagagcgagactctgtcaaaaataataaataaataaataaataaatttatgtaaaatcactagcatattttattgttgctctcaagataaattgatcttaacataagttccttggtattatggaatgtctcttatagtcttttggcttaaaatagtagttgaatttggtagcctgaatataatagttgctcagtaataaaattataaaagaactacctctctcatcaatgtaacaatatttgtaaaccagctataaaaagacgaaatgattctgtgaaacactattgaagggatttatgttctctagaatgtgaaaattaccatggatttgtgtcctaattataaaaatcttcagttatgtcaaatacctgagaaatgagcaaagagacataaatatcttaaaagctacaaatatttaaaaaaagacctctaagagagatgtaaactttaacagagtatttgcaaatactcatttcagaaatgaaaatagttatcctcatattacatcctaaagacctaataagatattaaaaacctccagaaaaggcttagattgtactcatcaataataattttgttactatgggttcctgatatgcataataaagactacagatttcagtaaaatcatatactgttagtatattatccctttggatttatctcaaaaacaggaatttagttcaaggatgggccttgaggcatcttatccaaaatacaaattgctttttgtttctacagttgtttacatacctcagtttactaaacagatggtttctagaggtatggtattcctttgactatacctagaaggttaggacatgattctggtttatttctttgcctttaaattgcaaaataaaggctgtcattccctgtgttgctacaatatatgagaaagctaggtcaaccaaaattgtgaatacagtgattttgaaagctcaggtttatatttaatggcaattctctagagtatttgcatttggctctgcaatgcaactgggaacattacaaacctatgacaaattttattttaacttttttctgggtctgacaaacaatataaatctgtaggagaggcagagaattagtaagagcttgtggtcaggaactcctttttcttcctccttccaaagccaaaactaaaacaagaaactgtccttttctatgataggtttatttctattttcccgtacattgttaagtgtcaccttttgggggttccaactttatgcatatgtggttttttgttctactagagtcctaggctctgtcttttgtctcttccagctggatgtgttccaattaccagactcccagccaccagggatcaagcagatgtcaagcagctctaatgctctttatctctgttgaattgaactttctgaagtttctggtttcctatttagttacttcaaagttcagtcatactgtaagaaatgttgtccatgtattttcaggttttagataacaaggtgtttgcttgctctgcacacctaatctaccacattgctggaaataaagagctctaatttatttcaatgccacctgaattttaagtctcctttccctctttcaagctccaaactttcacattctcagactattttttcttattttctcaatcatttgacactttctgatcgaactcttcttgatctctttgtgacatctaatgttgactaatctattccattctgaagtcttgtttaggcttctgtgacatatacagtttgatgtttcttatttaagtgtccttcactaaacatcttttcttccacttccctccaaaatgctcgagtttcttaggtctccgtccccatcacctcacttaacacattctccctggatgatctctttcactgccaaattcaagttcatatatatactggtagatctctaccacagatgtctctaaaagtataaaccactgcttctaacggtctattcaatatctctacctaaataggccaaagacagtccaaatttaatatatccaaatctgaagcccttatctactctgtctgcatgcatttgtcacactccattcttcatattgtaatgttatagcattttttaacatacacatatgatagactataatattacttacaaatatttgctatccaccccccaccgccaaaaggattatactttctagtcccattgacacaagacttaaccacatgacttgctttggcactgaaactgagaagtaacatttaatgcagaaattttaatagccacttagtgctttactatggccctttcccctccgccagaagacaagcaacattcaaggtacaggttctctgttagccggggtcctagagggaaggcaacatggagtggactcttgatggtcacacagcatgaacaaaaaataagcctttgttgttttaagcctctgagatttggggatcattttttaacactccaagacctatcctattcttactgatagagcatatcaaataatttatcttccttgttagaaattgttcagtagctcccaattgcatgtacaatgaagttccaactcctctgaatgaaaaaaacataccatatatgatatagtccccattattgcttttacaacctccttttccaaccaccatcaccaccacttatgtacattagtcatatccaacaatgggttattcttcaaaaacactatgctatttcatggttttgtgcctttcttcgaaagtgctgttgttactgtgctacattattaccctttatgttgtcccacttgcctacttaagtaaattcaatatacagtagtgtgcgtgacttattcagtgatatcttcttcagtcatttcaagtggttagtgcttgaatttctctgtgtcatagcattttgtacactgctctgttacagaatttaatacattgcttttcagtgaatatgtctgaattattgagggcagtaactcaatcttactcgtatttgtattcccagtgctcactactcacagcaaccctcaacagaaatctaattcaatgaacagaatagtctcattgcaaaagaaacattatgaatttagatattctttcttttgtttacaaaagtaaaatattttggtgattttcaacattgatatgtcccttatcaaaatctcattcatttgttcaggggttggtgaactttttctgtaaaaggccagagagtaaatattttaggcttttgaggacatatataatgcttacctcatattatacttcatcttttctccccaagcctttaaaaacctaaaaataattcttagcttgagggctacacaaaaacaggccttggactgcatttggcccataggctgagtttccttaccctggtctaggtaaacatcagagaaattaagtcacttcttgttagagtacaaaagtctctccatggtagtataaaaacaaagcaccaagagagatacaactatcacttgctgccaagcagacaactggactaacaaagagcttctaaagataatcatcaactaaattcaacaaataccatattgatacaatttgaaaggccttctacttcttcaaagacctagagatagaaaggcaggagataatgtcacttccttgtttacgtttccacaacttccaactgtgtttaaggctctacatcactaattctctactacgtttccagcctcatattaaaaaaccatctttggctgggtgcggtggctcatgcctgtaatcccagcacttttggaggctgaggccggcagatcatctgaggtcaggagttcgagaccagcctggccaacatggcgaattttagtctctactaaaaatacaaaaatattagccgggtatcatggtgggcacctgtaattccagctactcaggaggctgaggcaagagaatcacttgaacccaggagtcagtggttgcagtgagccgagattgcaccactgtactccagcctgggcaacagagtgggactcatctcaaaaccaaccaaccaaccaaccaaccaaccaaccaaccaaccgtctttagtctgaccacactggcttttttatttattttcctgaacactctaaattctctttaatatattcctcactatctggaattaatctatcactctccatctctctcagtaaaattaatacattaaaaaaattatttcttactcttcaaccatcaggaaaaggcagaaaacaggtataaatcatcctctctctttttttttttttttttggtaaacacacaaactatccataaaaagaaaattggaagcataccctaaatttctgtataaattatacaaatatgttgtatgtattaacaggttgtaaatatataaacattagcaattaagaagtttaaaaataactattaatagaggttctcctcatgaactcttaattattttgcatatccctagagatttctgaatgctactttggaaattactagtttactaaacaatttttttttttttcagacagagtctcactctgtcacccaggctggaaagcagtggagtgatctccgctcactgcaacctccgcctcccaggttcaagagattctcctgcctcagcctcccaagtagctgggattacaggtgcacgccaccatgcctggctagtttttgtatttttagtacagatggggtttcaccatgttgaacagggtggtctcgaactcctgatctcaggtgatccacccacctcagcctcccaaagtgctgggattataggcgtaagccacagcgcctggccttaagcaattttatatgtatctaaatctttattaaacagctacaatccacattcccctattattcccaacacacacttttactttaattcagctttgtaaaggggaagactactatattgtttcaatgtacattactgattctcaaataccaagtctattgtttcaactcctttgaatggaaaaataaaataccatatatgatacagtccccattattttttctacaatattgtaactccttattcacaaataacaaatgggaaactatcttgaaaatctggtaaaacaaatagcactagcctgttgaagaagtactctcagatgaagaccttttccgggtagggctacaatttgtgctctctgatggccgctgggagggtttatcagaggttggctgggagcctggagaaagagaaaaagatagaaatcataggaaaattcaactttaaaaataatgtgaaaccatcttttgttagaacttgttacagtttagttgctgccactgtcatcccctgtaataacatgacttgtaacctgatattaggaggaaaataagcagaggacaaatcacactatatgttgttgtcagaatttcacagatcttatatacataagttctcctgttacattaccagaggaaaaactaattttaatggaagaataaacaagatatgatttagttttcatgtgttactagcctaaaacattatttaaaatattgatacaaattactaacaatattttaaccaaatctgttctggattattgattaaaattcatcatataaactgacaaaatttacaatgtaatttattaaaaagttgatgtgagggcccagcgcagtggctcacgcctgtaatcccagtactttgggaggccgaggcgggtggatcacaaggtcaagagtttgagaccagcctggccaacatggtgaaaccctgcctctactaagaatacaaaaattagccaggcatggtggcacatgcctgtaatcccagctactcgagaggctgaggcaggagaatcgcttgaacctgggaggcagaggttgcagtgagccgagattgcgccattgcactgcagcctgggcaacagagcaagactccatctcaaaaaaaagaaagtaaagcctcaaaccttaaacccacacatcctatccaattcacagaaattattttcagattctatgtttttcttccttttgcaaattctagaaaaactggtaattaatttatccatgaaatacagtaagtttcttttaaagctgtacacttaaggatccttggctatatacataaaagcttatgaagacaaagaaactcaatttcctttcaaaaactttcatgcttttagcaaaaccgcaaatctatagagcatattacatctcccgctcaaaagaaaagtatgttgttgatgtaagattattttcctgaataaaatatacttgattcttatattggattctttataatctaaaatgccagctattaagagttggtaatgaatgtctacctcatgtttgtcaaaaaactagtaatctgaaatgcttattgatgggaaaaaattacaaataaaaaaacttacatgtaactggagccgcaaaaggtacaataaatcaaaaagttgaagattttcaagatctgcctctaaatgaaagttcactcctaaaagaagatgtgattaattctctaagaaaacttagggtcagaagaactgaatggagctaagttgctgtttccttttctctaagagaaatagaccatgagccttgtttcaattaagtagtatcttaaatcacattgctgtaaatagtcttttagcaggctatgggaagcactgctcaggtgagatgtaagactatatgctgtcattcaagagtaacacgttaaatttttttttagaaaattgatgtgatagtacatcctacttctgaaacacaatgatgactgatgtagacctattcaagcagcaagattgtttattgttgaatcttaacaacagatacaagatggatttttatatctgacagtataataaatcctcctcgagtgtggttcagatgagatatttccattaaataactgaatgtcgcaatgaaacatctaagaaataaaaagcccaggcatcagagaagacataactttaagtattaatactgaaaacttaatatacagacagatacatatttcctacccaacacatagtcaagacagaagacaatagtggccaagaagcctgagataatagtcaactgtatcaccattcctgatcatggattaagtactaagaaaagaggggtttgagggttttttttttttttttttgggagacggactctgtctcccaggctggagagcagtggtgcaatcttggctcactgaaacctctgcctcccgggttcaagtgtttctcttgcctcagcctcctgagtagctgggattacaggcatgggccaccatgcccagctaattttttgtatttttagtagagacggggttccatcatgttggccaggctggtgtcaaactccttacctcaagtgatccgcccgcctcagcctcccaaagtgctgggattataggcatgagccactgcgcccagccctaagagcactttttatatagtcttttctctcagtaataaactaacatttattaagtgagtatagtttatatgtttggtactatgctagatattgtgaaggtagggggaagactacaaatggtgtaatggtctctgccctcaaggagcttactaatcatcgtgtatatcatcatgcactacattttaggtggcacttgtgccatccattcttgagctccatcttcagttcttaggctatttggtagtgtttcctgaatttcttggtcatcttcaagaaagtcttgatgaaggcttcaactgtacctttgataatcaggatatcctgagaatcaccctgcctggcctcacccacctcagggtaaaaagagggtacaggcactttcttcaaagctccttcttttggtgacatctggagcttcagaggcagtgggagatggaatgggggtcagatccatggagatcattattggcagcattattggcagcaattcctgagaaactgaaacaattgagagagagatggcttacttagctcacttagcttctaagccatttttcatttcctgaaagtaatggaagccagcagcctattcttaggatttaataggagatttgagtaaaatttcattcaggaaggttctcatttttcatttttaaaagtttgaattccctgttcatacagagcagagctattcttaacaatattccatatttaaaaagaatcaagttgtatccttgagatacagatctctatcgcttggtaatcatcagctctagcatcttatttcacttaaaagcagtgctcacagaggcagtaagaagatgaggataactgaaaaaacattaacgatataaagcaaccaagtttaagactggaaagtgatgctatcacttatgtaaaagaaatagcaaccagttaaaagatgttcaaagtatgttaaaattagcctaacagtaggaatcatatgaaatctgcaaacatctgtaacattgccagaaatacactgttttataaacgccaatttgcagttgggcttccagaaagaaccagataatgcccagagaactagtatgtccaattcaacagagaccaatatatatgtatgtgtccaaacctaaaacataatgcagagcagagtcgagtgcgatatcgtgttcagtacatggactatggagtaaagcatccttgggtttgactcctggctctgctacaaattaaactagagagaatctatagaagtaaatgtgcctgggctttggtttaataaagctaagttacagcattgttgtgagtcccaaaacgagataatgtaatccaaaaacaattttataaaattcaaaatgttttataaatattagtgactactatatattaattgagtccttaggtttattatggaatttttacataggcaggtgtgggggctcatgcctgtaatcccagcactttgctaggccgaggtagccaggttgcttgagttcaggcgttcaagactagcctggacaatatggcgaaactcagtctctacaaaaaaaaataaaaattagctgggcatagtggtgcataccctgtagtcccagttacttgggaggctgaagtgggaagatcgcttgagcccaggaggtagaggcttcagcaagctgtgatcgcaccactgcactccatcctgggcgacagtgagacccttgccttaataataataataataatgatagaaagaagagcagtgagttatacccagtagggagctagaactaacctattaacatcaagcatttaccttaaacatagagtgaatccaattaagaagtactactcatataggcacctccagggctggtaggtacttgcagggtaggaaaaagttactctgagtgaatcttctaattcactgactcttcgccatagcttttgcagagtatgcccaagagatgagtcagaaccagaagacgtctggctttctgctcagttttttcccaagggagaaagtagttttctgcttcccctacttagcccttttccttgctgtctccatcatgtgacaaatgtttgctcatgtctcaagagtagccattttagatctgcctggaaggatgtgtggaggctccccattccacaaaggacaagaggtttatatgaattctagttcaagaaaatctgacacttcctcaaagcatacacacaaagaacacaattgtagatatcaaagagttcccatcatttttcatttcaaaatactataaagcagaataagtatttcagaagtgaataaagactacaaataggaattccttagttcacaatattactacgtagaccaccgctgtgtctcatcactcagatgatgacaacttcagaatatgtttggaaattctacacacataaatgcaggaagtagaaattataggcaagctgcaaaaaaaaaaagtacctaaataaaattggatttcagaataaatataagtagattattaagggaaatagtttttcttccgttggaaataaaggccctcatgtaaacaaggcagactactagtaaagaggaagacagaaaaagagaataccataaattggaataatacagagaaaattaagaattaaaaccaaacttgcaaatgtgaaggaaccttggaagtgattttaattatagactctctggattttatttggccagtatttgatgaacttttgaagataaagacaggatttacagaaacatttttgccaatttaaacaagaggggaaaggtagtgcttttacagcaaaactgtaagatgaaatcagggatacaaactgtcaaagttgaaaaagtaaaaaaagaacataactggatcataaagaaataagattatgaaaatctttataataaacagaaaatgagcagaaaccaagaacctgttttcaaattgatttgccacaaaaaatcttgattgacatttccactggaggaactaaaacaaaccaaagatataaaagtaatgctacttttacagatgcctgggtgtgaagacagtaaaacaggcaaagatagcagaatagataaaattctcactgataatagtgtctgcagtggtggaggcatcccaaagaaatcatgagaataaagattcaactaactactcattgaagccctgagcatcctagcctagaaaaacaaggaatttccctggtgccaaatacaaattagcaaaaaaaaaaaaaaaaaaaaaaacagtgaattaaatcaatagttggttggacaaaacatatgtttctttagcctaagttcactattaaagcttttataacttaatatagtatgaattttagtcacactctggagatcaacactaaagacacaagtaactaagaaatcatttatatgagtggaatgtttgatgtttgcaatgctagaaatatctttgggtgaattacagaaaaataaattaagtatgctaatttggaagaatgctatgcagtagtcagttctaagatattatcgattttaaaataatttactttaaaagtttctaacactgaaattgttccttcccaccaaaattaaattgttacaaaagtttagttttaaaaaagatttctcttctttcattatttataagtcaaagctatttgggaatgtgtgttaaacaacgactgaaccaaaattggttgtaataaaaatggctaccatagtaaaggaatatgaacataaaatatcaaactatttgagaacttctggtcaagattttttttgttcccagattcaagttctgaatcctttggtatggttcacagttgatagccaccttggaaccttcttgtgaatgagctgaatgctaaggtaaaagctgggtccacaataaaaacagctgttttcaattgtgggaaatacagaaagcaatacattttatctgatgcaccaactaaatgcactacaagagagtatgactcagagcctgttctggcgatttttaagctataaagtctgttttggccgggcgctgtggctcatgtctgtaatcccagcactttggaaggccgaggcaggcagatcacgaggtcaggagattgagaccatcttggctaacacggtgaaaccccgtctctactaaaaatacaaaaaattagccaggcgtggtggcgggcacctgtagtcccagctacttgggaggctgaggcaggagaatggcatgaacccgggaggcagagcttgcagtaagccaagatagcaccactgtactccagcctgggcgacagagtgagaccccgtctcaaaaaaacaaaacaaaacaaaacaaaacaaaaactctgtttttttctctaactaggctatttttcataatgcccaaatgacatcattcactgaaatggaattcttctggaaattcccctaactgcactaaccacaccacaaacaattttctttcatctctgtaggttcacacttcctttataggcatatcttttttctatcatgttttaaatctttttaaaattgatacataatagttgtacatatttattgggtacatgtgatattttgttacatgtatagaatgtataagaatcaggtcagagtattttgggtatccatcaccttgcgtagttatgatttctgtgtcaggaacatttcaagtcctctcttctagctatttttgaaaaacacaatattgtgctgtcacctatagtcaccccaccctgctactgaacatctgaacttattccttctaactgttgcataggtgtgtcttataaacagcactagagaaattgtttgagatcagtatattctgatcaaagcttatactcttcagttaaagagaaaactcagtattctttgcttcaatctatatgcttgtacagtgaatatactttttccaaaaaaaaaaggtttaagcctcacttattcttggaggacaaaatattcatcatcactgaatgcaccaaataatgtatataatttacatgtagtaaatcatttataataatgttccattgtctgcttgttctatgacttgtaagctataaatgctaaatgaaaatactccattctactgctctgccaattttagaatccaggtttgtaagttctgtcatgtgtagccagccatgagtcacatatgctgaaaaacagggatgaaataactgacattccaggtcagaaactcttgctcatccaagtcagaaactcttgcccatgagacctatttcatgtctacctaacatacatacataaattaaatagaatcactatcaggattgggagaaaccaggaaacctggccttacttaagtgtgtaattttactgtaatttcacttgcatcaagctgattttatagctgttagtctgtacagtacagaacagtatatgttagaaaaataagctaactaccatatgcacataatttataaaagtgattatagctgttattccttttaagtcttcataagatttaattttacagtgaatatacttgtttactttaaaaatgctcaaagtgataagtcagtttgattccccatttttgaaacaaggagagaagggttaaatgccttggtccaagctacacattccagtgtccctaatctggtttcatttatttttcctgaaatttatatcaacatgatttatcaaatatgcctgttttacccccaaccaacacttatgaggaatccactcaatacaaatagtaaataacctttatttcttatttcatcaattatcagtttgagatatgttttacttaacaatttgtattctgctgtattaaaaaaactcattattctggaataaattcagatttacataaaagttacaaagatagtacagagaatactcgtatgtcctttacccaacatcccccaatgttaacatcttacataactacagtacatttgtcacaaccaagaaattaatattggaataatactattaacaaaattccagactttgtttagatttagccaatttttttccactcatgtccttttttcactgtcaatctgggatatcacattgtatttagttgtcatgtctccttagtcttctctgttctgtaaaagcttctcagactttccttgttttttcaggtccttgatactttttagtactggtcaagtatttgtagaatgccctttattattattattattttttttttctgcttagatttaacacattctatcagagagtacatgatatcaccatgccttatcattggtgaagttaaccttgaacttggttaaggtgctgtctgccaggcctcttcactgtaaagttactgcttttccctcttcatactctgttctttaaaagtcagcagtccagtccatattcaagaagaggtaaattaagttccacctcctgaaagtgtgttctacatatattatttggaatttttctgtaaggaagatttgcttcttttctgccaagtatttatttagtcaatcatttatttaaatcaacatggatttatagatattgactttattttttaggttataatccaatcctctcatatttattttgttgctcaaactgtcccagcttggaccactgggagacatttcaggataataatatcctgaaggtgatcaacaatattgcaatacctattatacagtaggtagttttgggagcattttaacatgataccaaatgtaaaatgaatctaccttaaatttatatatggaaaaaatcaactgaagaccgagaagatcacttaaaaatcatatgtaattatgtatttcttaaacctttatacttcaaaaagcaacctgacatcacagattgagaaaatgtaattacatcttcaacagaatgctatagaataacaatgtcattgtaaggaaaaagcaaataataaaccagtcagaagtgctacaaaagaaaacactgaggaaaaaatagcaaaatgtaaaggtgtaagaattttaattgtctgcatttcctaacttccattcctcagcctccagaaatctaacatttgccactatacaaatggctctcagacacaagacaaactaaccgccaaagccaatcatccactttcagtacttacctaaccaatctcccataacacttgacactcttttttttaattaattaattttttttttttgagacggagtttctctccttgcccaggctggagtgcaatggcgtgatctcagctcaccacaacctccacttcccaggttcaagcaattctcctgcctcagcctcctgaatagctgggattataggcatgtgccaccacgtccggctattatttgtatttttagtagagatggggtttcgtcatgttggtaaggctggccttgaactcccgacctcaggtgatctgcccgcctcagcctcccaaagttctgggattacaggcgtgagccaccacgtccacccacttgacactcttgactataataaactcacttaagaaacccactgaattcaccataaatattgtcattccttctcatagccttaataataaagtatctataattatcttcaggttttacctctcctttgagctacagatccatctgtcctacaaaacaggcttgaaatccaaatttattacctatttccaaccttatccttttgcatatctcatttcacttaatcacatcatctctaccttggctcagagcctcataataagagcctcataatattttgtgggagcagtttccaaactgatctacctgatctcttttcactaatccatctatcacactgctgtcaatgtaatctcaacaaattattccccatcttaaaacccttaacttctcataccttataaagtaaactctatactcttgggagtctcatataaacgaggactttatgatctgcctatctttccagtcccatctcttgggtcccatatcaaaccattaacacttaactaagcacagtaacacatccccatgcccttgcaaagctgatatctagtgtaagaaacacgtgtcacacattattcttcgctgctaaattcaaaactccctcctccttcccaagacctttaaagtcagtccctcacttctctgctccccaaaatgccttgtaagtatctcaatattaagaaccgtcaggctgtgcgcggtggctcacacctgtaatcccagcactttgggaagccgaggcgggtggatcaccataggtcaggagttcgagaccagcctggtcaacatggtgaaactccgtctctactaaaaacacaaaaattagctgggcatggtggcacacacctgtaatcccagctactcaggaggctgaggcaggagaattgcttgagcctgggaggcggaggttgcagtaagccaagattgtgccactgcactccagcctggccaacagagtgagtctgtctcaaaaaacaaaaaacaaaaaaaaacaaaaaaaaaaactgtcaataactattcatatacatgtctaaactataaatcaactttaaagcagaaattacctttttttttttttttctgagacagagtctcgctctgttgcccaggccggagtgcaatggtgcaatctcggctcactacaatctccacctcctgggttcaagtgattcttgtgcctcagcctcccgagtagctgggactacaggcatgtgccaccatgcctggctaatttttgtatttttagtagaggcagggttttaccatgttggccaggctgatctcgaactcctaacctcaagtggcccacccacctcggcctcccaaagtgctggaattacagcatgttccttctcctggcacacaataggcacaaaataactgtttgctgaaagaacagctaccatcataagggaatagttaagaataaaaatcaaatacataaaatactcctaaacaaaaccagttctgactttcaaagggatcaaaacaaaagatatctgagcctgaattaatatttttatttagtattctgcttaactaaaaacttttcctcgactggtttttgttaagacaactaaacctattctcacatctacctgaaaaaagtatattaagtttctattagaaaatcaagtcacatctccatgtacttatcaacagtaattgtgaagaagatggagagattccaagatagagaacaattaacaaaagaatttagacttatgatcaagtaaagaatatagctggtctttgtccctggttcctggcacagagtttcaaaaacccttgtaattacccaagtgacaggaatgtctctgttacgacagtgagatgaaagcctgaggtaacttcaagatgggggccggtgaccagaaagaccaaatcacataattaaaaatctgaaactttgggtcaccccaacctcaagggagtggagaactgaaaattgaattaaaaaacatggccaatgatctaatcaatccggcctacctaacagagccccaataaaaactctggacactgaggttcactggagcttccaggttggtgaatatagtgatgtgctgggagggcaatgtgcccggattccacaaggggaaaggcatggaggtctgtggacccttcttgcaccaaacactgctctatgtatctcttcaactagttgttcttgatctgcatcctttgtaacaaaactgtaatcatactatagtgctttcacaagttctgtgagtccttttaacaagttaccaaaattgagggggttgcacgaagttgcaaatttttagcaggccaggcagaagtatggatgtctcaggaacaccaaaatttgtgactggcatctgcagtctcatgatgaactctgctcttaacttgaggtcttcactagcttcaggtaatttgtattcagaattgaactaaattgtacaacatccaattggtgatagagaactagtgtcagagcagtgacttcagagaggtctttgtggtttctgtatgttattttataaagaagaaaaaaagccaagtgcagtggctcacacctgtaatcccagtactctggaaggctgagacaggtggttctcttgcggtcaggagtttgaaactagcctggccaatacagtgaaaccccgactctacaaaaaattcaaaaattagccaaatgtggtggtgcacttctgcaatcccagctactcggaggctgaggcaggagaacagcttgaacccaggaggcgggttttgcagtgagcctagattacgccactgaactctagcctggatgacagagagagactccatctcaaataaataaagaaggaaatttttaaaaagacaaattcgtacttaacacaggtacttttgcataaacttccctgctatctttctcattccccaaggaccctgaaaccaggttcacatccaccattttcaccccaacttctgtaactgtcctcttgggtaatttcaatgtccatgtagatgatacattcaacatcctaacctgtcatctcatatcaccttcacctcaatttactcatcctttataatctccttctcatgactctgaaattagggatctcaaatccaaaagttccctctttaaatagctgaagagggccagatacaacacacaacagaaaacagtgaggactgtggcgaacaaaagaatacaagcagcaatgaaaaagggcctgccaatactgagccccagccatccctattatccacgaaatgtggactaattgttgccagatgttctgatttttctgagaagcagaattccacatttttatgtaaaattgctacattttttaatatgagcaattttttaaaaagtgtagagatcatcacaaagaatcacatgtgggccaaaagctgacagttttttaagcactactttaaatactgcagttcctcagagctacccaaggctgtttgtttttcactccctattctctcccaaggaaaatatcattactctcatgattatacatataaaaattcacaaaggtatacagtatgttttgttattgtatgtgtttctatatagttaaatagctcttgtatcattgataaatacaagaatgataccagaatatggaagttgtattggttaatacatgacttttaaagcacataaatattttgcaggacaaaactagcagctgaacgaaggagtacaccaacacaaactaaatgaagaaagccataagcaatgtagttctgttcaaaatgtacattcatccacattcttcctcttggctcctactggcaacagacttttctgcaagtgtttttattgtgtggcttctctcaatgtttgtacaaaagaaacaaacaggtacaatacactagaaccagctatgtctggcattgctacatttatctaccaatgacatccttctgtgcctacagttgagcagcttcaacccttctttatatccctacaagcgaccttcatcttttcctggaaggttaatgcctatatttattgtagtatttctattttttttttttttttttgagacagagtatcactctgccagcccaggctggagtgaagtggcacgatcacagcttacagtagcagccttgaactcccgggctcaagtgatcaacttgccacagcctcctgagtagccaggactacaggcgtatgccatcatgcccagctaatttaaaaaacatttttctgtagagatgggaggctcctatgttgcccaggctggtcttcaactcctaggctcaagtgatacttcaacctcacctctcaaagtgttgagattacaggcattagccaccattcccagcctctttatttattaagacatttagtcttaacaatatatatacatatattttttttgagacagactctcacactgtcatccaggctggagtgcagtggcacaatttcggctcactgcaacctctaccttccaggttcaagggattctcctgcctcagcctcccgagtagctgagactacaggcacataccagcactgctggctaatttttttattttagtagagacaggtttcgccatgttggccaggctggtttcgaactcctgacctcaggtgatctgcctgccttggtctcccaaagtgctgggattacaggcatgagccattgtgcctggtctagtatgtctttttaactgctgtttttgaaaattattacttttcttgatgctctgcttataaagttgcacaggtttttgagagtctgttcctaacttttatttcacccagaagccctttttagtgaatgatattgcctaacacaatttttcaaatactcagaggaaatgctcttatctccaggtcaagcttctctactaagcctgagaactagatacccaacgaccttctcaaatcctccgcttcaacgttcagacacttcaaactgtatgtattaaaaagtggctcagagtggtgactcaggcctataatcccagcactttgggagggcaaggtaggagggtccctttgagcccaggagttcaagatcagcctgggcggcatggcgaaaccccatctctacaaaaatacaaagaaattagcctggcattggtggcttgcacctgtagtcccagctactcaggaggctgaggctggaaaatggcttgagcccaggaaacaggttgcagtgagccaagatcgtgccactgcactccagcctgggcaacagagtgagagcctgtctcaaaaacaaaagaaaaaaaaaaactgtgttctcctctaaatctgctcctcctatagtcttctctctcttagtgcatgttatctccaatctcccatatgttcagacataagcctgccactaacctaatctaagcaccatcatgttatctagactactgcaattgcctattaaccagtttccttcaaattatttttatcctctccatccagtgttcatgcagaaggcaaaatcatcatttaaaaatgcaaacctaaaatcaatactcctttgtcttttgttcttaatataaaatccaaaattcttaacacattgtttggtctcttcttttgccacatttctcactactctctctgtatttcctctttcaccacgatgaagcttttttcagtttatccaatatctaaactccttcccaactgagaatcttaaaacatgttcttcactgtggctttttttttatttttattttttgagatacagtctcactctgttgcactggcgtgatctgggctcactgcaatctccgcctcctgggttcaagcgattctcctgcctcagcctcccaagtagctgggactacaggcacgtgccaccatgcccggctgatttttgtatttttagtagagatggggtttcaccgtgttggccagctggcctcaaactcctgacctcaagtgatctggccacctcagcctcccaaagttctgagattacaggcgtgagccaccgcgcctggacttcactgtggcttctcatcctttaagtctcaactttttatcctcagccataactagtaactatctaattagatccccttctgccagccctttaatctgtatcataacactccatggtattaactttatagcatttttctcaattaagccattatttatttgcttatcactctatggtttgtcttccttcactaagctgaaaattatgaggtcagatatcaggcatttactattgtatatgccagtgactagaatagtcctgtatgtttcaggaattcaacatatgaaccagtaaatgaatgaataatgaatgagtctgtttatccagttaaatgttgcacatctgccaggtctcagtttaggatcaccttctcaggaaagacttctctgggttaggctccccatttcatgctgtactctctcccttttacagtccttatcacaattttaacaacacgtaatgtgattttttgtttattatctacctcctctactataatctccatgactcaatgaacctgtgtgcctcattctctattatataacaagggcccacaaagtagaatgcctggtaaatacctgatattcagtaactattactgattaaataaactatttgttgaatggacctaagcataagactttttctctctttacgttgttaaaagctggccgggtgcagtggctcaagcctgtaatcccagcactttgggaggccgaggtgggcggatcacgaggtcaggagttcgagaccatcctggctaacacggtgaaaccctgtctctactagaaatataaaaaactagccgggtgtggtggcatgcacctgtagtcccagctactcgggagggtgaggcaggagaatcgcttgaacccgggaggcggaggttgcagtgagccgagattgcaccattgcactccagcctgggcaacagagcaagactccgtctcaaaataaaaaaatgaataaataaataaacactgttaaaagctaaggaacactcagattctccactaagttttaatttttcaaaagttcatgaataatgaaaatcaggaacaaaaactctttgtattcgaggggtttatcttttccctaatacacaagtctttttttgttttttgttttttttttaagatggagtctcgctctgttgcccaggctgaagtgcagtggtgctatctcggctcactgcaagctccacctccagagttcacgccattctcctgcctcagcctcccgagtagctgggactataagcgcctgccaccatgcctggctaattttttttgtattttaagtagagatggggtttcatcgtgttaaccaggatggtctcgatctcttgacctcatgatccgcccacctcggcctcccaaagcactgggattacaggtgtgagccactgcgcctggcctaatgcacaagtttttaatcttttaggggaataataataataactaatatttgcatgcttactatgtgattacttttcataatacccctacaaatcccattatataggaggtttagagaatatactgaggtttagagaatttacttggaaaatctgatgaaatttttctagattatcactaaaaaagatgcacaaacatatatacccgtaattttacttacaacatcagagggtttatggacttcctagagttattttacaaactcttaggcttaagatctctcacaaagaacttctaatcttttattcgagtggcaaatgcttactctttgttttctatcttctcaattcttaaaaggtgtataattaagagagaaaaagatgtacaattctttctagatgtacaaatgcattttccagatttcttttttttctatctaattgaagcagcttttatgaaaacatcaaaaggtatgctgcaaaatgaagtctgtctgaatgaatattcagttaaattttacaatgctgaaaatgtccaatgtttgaatttttattatgagacatacagtattaataacatattcttcctgtaacaaagatgcatttataactactggattaatatacattaaaaatccttccagcattaccttttacctcttggggtggtgggggcagggggtggtgggagatcctgcatactactaacagacctatgagccatttgtctttataaaaattgtgtaataacctgtctacataaaaaagatgaatgatttttcctggtttccaaaagttatgtatatttctttctttttttctttttgacaatagctcttctcaaaacaaaaaaataatatagacattccctacttcttaaatcttaaggaaaaggaatactgagatttcaaaatacacttattaaaaaacaaaaaaagatatatatattaaaagttcatctacatttatcaggcacctgtggaaaataacctatttctttaacaaataacaggtaacaaaataaccctcttacctgccaaagtctgtactgccctttcgttagaaggcagtgactcctttctgtgaagccgatttagtgaagtgtcctgtgcagaaaagagtccagggctgtcagttaatttcttccggccactggagttagggtttgaaactctgcagctgcctattgcacttgtgaaaaggtttgtatgttcatcactgctggctggctcagagttgggagtgaatcctccaagggataagcttggagaactttctgaacagtcaatctgtaaaggtgtctgcaatcccaaggccaatggactagattctgaaggctctcggtggacccactgttcctctctgtttattaagctttttgaaggagagagatgagggcaggacatgtgacaacggtgcttttccttatgcttatatcgctctccaacagcatcctttccaaatctatagcgcttcaaagattccaggacagatcgggaagagccagtgtccatagaaacctggggttgttcagaagaacggtgttctctgtgtttgtgacggtgcctgtgtttgtgctcaaccatccaaccataggccatctcaggaggaacactggggtaggtactcatggaaaggaggggagtcctgctggttgtaagaaaggcctcctgtcgaagtagcttatgctttttcttatggtatttggcaggattgagaagtaaatgaccagcatgcatataggaaggaggtggaagtggcgtggtgaaagaaggagatggaggaggtggataaagagtgggaggataccttccatagtaacctaatcctatgggagcagctgtaaggggtgaaggagagtaaggcataccataagatggatagaatccagtactagaaagaggaaaactaaggctgtgcataaaaggcatttcagccattgcctccctcatcttagggggtctccctcttttcttttttaagtcaggttttcgaatgtagtgcaaagggtctaaggggaaagaaggatgtgtatagaaactattaaagttgattcgaaagatagttggcagaagatctcgggggataaaatgatgacttcgatgagtgatccgaatttcacttaggcgacttattagttcctccagctctgcaataaagtctggatcctgtctatttcgaagctggggatatttctttttccgttttcgtttctgccttttcatcttgtcatagctgaggtaatcatgattcctgcgcttacatttgtgtttatgtttttctttaagactgcttagcactgtagaggtttcagggggaatcagagaaacatgctcaaaagaatgcctcctctttttttgcccacaaaatttctctgccctgtctgatgtgctgttattatctgttccaattccactatcactgggaatggtctcatcactatgagactcactgattggggaaggagtagcttcttttagagatgtgagttcactcaagtgcgaaggagaatttggcaacaaagtaggaggagataaccgcctcctcccctttgaggccttcttcattgcaagagtctgaatcatactgccctgtctggagtgtaaatgcaaatatggcactgaactgggttcaacaaaacctgcatcactacttacagggctctgacctccactagtcccagaagactgagagcaaataggtgatggaagaatctcagaactactagcagatgaaggcagtaatgggggaagaatctgtcctaatgctgacccagctgcctgttgagctgtttgctcaagaacagcaaggctagtaggactaccagaaagaataccatttaagacagtttttggtttgcgacctcttctctttcctatataaatggttcctttcttgctgacatttatctgttggcccaatttagagccaaatgtggcagcaagacttgataccgtattatggagtttggattgcactttccctttattacttgattctacagaacttgaaagaatctgattcaacagtttctttctctttaaagtcttcattttatttattttgcggataattgttttcattaattgtccattgtttctcttggtaatttttttatctggttccatctcaaggtcactcatactacagacacttggcctatgactgtcatctaggtcatctggatcctgaagttgatcctcgctctcaaagaaatcactgctacttctatggttgtcactttcagattctagcttgcttggactttcagtggcaacaaatggagccactgacagtacaggtggcttcatcttgactggtgacctcatttgcctcttaggcctgcctctcttttttggaaaaggagacacagacagaccttgtttgaaggaagggatttcaatttctggctgtaaaattgggggttcttgttcttccttagactgtaaagaaaacactttagaagcagggatttttaaagtccttttaggtggcccttccagttgaggcatctccttagatttaggccttcctcttttgggcttataaatatcagacaaaaggtcactagagacacacatactggaggatagtttgtgagtagcaaaagacttatgagatggtttttcactatcagctaagagagcaagagatggagctgtggatttgctcaactttggcaatcggcgtttaaggaagtcatgatctacaaatgaagggggtccaatgtttttcataaacttggctggctcagaattactatttgatagtgagctacatgaaacgtttttaaaaagctctgatctttctaattctagcccttttggagaccggcatgtgcttcttgccaccactttagtccaccgaggttttcttccttttcttttttttaatggtttggactgcaaactagtacttaggctttcagcaacttggcagtgtttgtctgatgcagatactgcacccagttttaaaaaaggcttattactaaataaactagtgaagttaacaactgaaggagtaatagtatgaatgctggattcagaagtcaaacttggcttttttccaagggaagagcttattcttggaatatctatatgggtagtttttgaatcatttacctctttatcaatccctttacattcaatacttatactatgaccaactgacctatgaccaacgttcaagtgggtactttcagaagtaaactggttctttccaacagattcagaaatttcttcgattagttctgtagtagaacttaaaagtaatggattaggagccaactgtgaagaagtttcagggggacttctggttaaaggattaacagatacagtaggtgatggggaagggagattgctttctcctactgcactgaatggggatttagcggtagatacatcagaagcacctcccattttaaagtccggagaagtgcaatatacaggaggctgcttttcatgctttgaggtttcataagatcccttttcactggatgagaaactgtcttgctgaatgcatgttccttcattaaacatttctttctccaaattaatgatttcttttcgtactgagaacttttccaatatgctttctttattctgccgtacaacattcttttcaaaagttttgctggtggcactatctttcagggattcagaaagttcctgactttcctgattattgatgtttgtactacaagaagccttaagcggttcctgagtggggagcagtgcttcggctttaaggtttatggcatctttactgatcagacctgccaaaggacaactcattagtttctttccaatgtccttattaaccaatcccattgctgaacttgctacaatcttctttgcacagtccttggccactaggccaacagtagaacccaatttctttcccaaatctttattaaccagtccaaccacagtgccaagtcctaacttcttgccagactctttatgcactaaacctggaacaataccaattcctagcttctttcctgaatctttgcttagcagtcctactgtagtgatagttcctggctttttgcctaagtttttattaatgaataccgctgtagtgccagttcccagttttttcacagagtccttattgaccaatcctactgctgcattaaacactggctttttcccaggatctttagttaccaatccaactgctgtgctgatggttggcttttttattaagtccttatgtattattccagctacagagccaacacctgctttcctgatcaaatccttgctaaccaatcctgctgtagtgccagttcctaacttcttcggttttgtcttggaagacttggaaggaggacaggtagcaatcagctgtgccaacttttctgttacactagttcctccattaagtaatgctctgtcctttaaatcaggatcccggctaccaagaagagtagatggcgttgcattaatataatctgccatttctgagtgtactggagacagcttcttagacaaaggattgttttctccctgtgaatgaagacggatgacttcttcagactggcattcaatggctgcaacatcatctgctttcttgtacaactttgaagggtcctaaaatttgaacaagaaaaaagttaaagagggagtaaaccttacaccactttagcttagcttaacaatccaacaaactaatggatcacatatcagataaacaataggcaacagtggtttttaaaaaacctaatattatacttatgtcacagtatgttagctcatctgctgctatacgagaggctatcatggtatattatctttgttgactttcaacacgataaaactatacattagagggtctttagaaatatccctgatatttttgacattttttaaatggcaaatcaatagtctactttcatcttacttttgactgggtaaatataaatgaagcatatgaagttaccatttttgaaaagaaaattatttttagttacagtatcctatggtcgtcatctaaaataatagtttactgcctacctccttcattgacttaaatgattctaaacctatagaagacaatccctaacctacttctactcttttataactcattctcaattatggtcttgagtgagcagtagagctctctcttaatgtggaataggaaagacaatttaaaaattcatattttcatcagaatgtgtttttatataaaatcttagaatgggaagtaacatttaagtcatttaccgtaaaatgctaattcatgaatcctcactatatactctagaaatgaattcactacttcacacaatagtctgttttacttttggataaccactaaagagttcttcctaaatataaaatactcagaactgaacaaatgtaaagttatactgtgtttgtggataggaagacataaagacgacaattttccctaagcaaatttataaatttaatgcaatctcaataaaaataccaacagatttctttggcatttagaaaaattgattgtgatgttcaatggggaaaatagatatgcaagaatagctagaaaaacctaaaatgtagaaaagccagggaataaccataccaaatatcatttttcaaagccccaatcattgaaacagtacagaagtgacaaatgaaaagacaaacaaaccaatgaaacaggacagaaaacataaaaccaaattcaagcacgtatgaaaatgtactgcatggaaaacgctacaatctagttataaactagaaaaattccatatgcatttaactacatcctttgacccagaaatcctactttgagggtctacccaagatacactcttaaaaatataatgtctgcacaagggtccaaaatgcaccactattttaatataaaaaaaaaaaaccctaaaaaaatccaaacaattatctacagaaaactggctgaataaagtaaggtacatctgtacaatggaatattgagaaattgtcaacaaaaacaaaagtaggaggagtaggaagagatatcaatatagtgctatggagtgatttccaggatatattattaaatgaaaaaaagcaaggttgagaacaatggttataatatgctatgctatgctatgccttatacatataatataccttctgtataagaaaatggggatgaagaatatgaatatatatatgcctaccgattatattttaaaatggaatgaaccaaagattagcgaaaatagtgacttatgggaaagtaaacagggttagaaactagacccctatgcatctaactttatggttttcagtttggaagtgttttacatagttatgaaacaaagttatatataataaaggaaagcatcccagatctccaaatattaaaagcaataggccgggcatggtggctcacgcctgtaatcccagcactttgggaggctgaggtgggcagatcgcctgaggtcaggagttcgagaccagcttggccaacatggtgaaaccccatctctactaaaaatacaaaaattagctggggctggtggcacgtgcctgttatctcagctaccgggaggctgaggcaggagaatcgcttgaacctgggaggcagaggttgcagtgagccgagattgcgccactgcactctagcctgggcgaaagagcaagactctgtctcaaaaacaaacaaaaaagaaattcatctattcaatatatagaaaattagttatataagtatatgaaaagtaattattttgaattactataaaacacaatattgagaatctacatcctaaatctcaaaacattacccaaaaaacaaacaaacaagcaagccagccaggcgcagtggctcatgcctgtaatcccaccacttttggaggccgaggtgggcagatcacctgaggtcaggagtttgagaccagcctggccaacatggtgaaaccccatctctactaaaactacaaatatcagccggacgtggtggcgggcgcctgtaatcccagctacttgggaggctaaggtatgagaattgcttgaacctgggagggggaggttgcagtgagccaagatcgtaccactgcactttagcctaggtgacagagtgatgctctgtctcaaaaaaaaaaaaaaacaaaaacaaaaacaaaaacaaaaaccaaccaaccacccggtgcagtggctcatgcctgtaatcccagcactttgtgaggccaagacgggtggatcacctgaggtcaggagtttgagagcagtcgaacatggtgaaaccccatctctggtaaaaatacaaaaaattagctgggcatggtggcgcatgcctgtagtcccagctactcagcaggctgaagcaggagaatcacttgaacctgggacggggaggttgcagtgagccaagatagcaccactgtactccagcctgggcgaaagagcgagattccgtctcaaaaaaaaaaaaaaacccaaaaccaaataccaaagaacctctacctctctattttttatttttatttttatttttttttaagagatggggtcttgctctgtcacccaggctggagtgcaatggcatagtcatagctcactgcagccttgaatgcctgggcttaagccatcctccccccgctcagccttctgagtagttgggctaacaggcacaagccatcttgcccagcaaaagaaagtggtaaattgccctcagtgagcatattactggtaatacatatagtaattttgaatttagacagatagatgactaacagatacatagataaaataggtaaccatgtgaatatcactaggaaccaaaatgttagaagcaaaaaacgtacaactataaaatcaaagaagtaaaaggctatacttttaagatagaattaaaaatatatgaagtctatctacctctctatccattaaaatgcctacaaacatcgacaacccattagcaatgaacacctcaagaccgtggtctctaaaaccatttcccattaaaatgaatcagggctcctgcagaaatgactgtttccaaatattagacaagaaatataaaagatgatcctagtgacaggtatctaactctagtatcttcactttgaactagtcactatgtttttgtattaaatttcccataatgaaatgtgtctattgaaaaaaaaaaaaaagttcttcctaagagtaaagtgaaatatatttttttgcaactttcagttactggtccaagtctcactttctaaaaatcacagagtaagtctaattcctcttcttcccaatggctgtcagacatttgaactcaaccaaaatatttaacttcctgactcaacagtttcacttctttctggtcattttctgatgcaagtgttttaagtttgtaaatatccctctttacatgtggcacctttaaatgaacacaatacatgtggtacttgattgactcagaataaagggaactatctcttcttttggactggaccttataattttgcccaagggcaaactggctttgacagtctcatatactcagacttatgttaacttgaaaattaaataaaccccacacactttcttcacattatattaaagaatcccggggaggtggggaaggttaatgggtaccaaaaataaaaaaaaaaaaatagaaagaatgaataaataagacctactgttgacagcacaacagtgtgactatagtcaataatcatttaattgtacattttgaaataactaaaagagtataactagatggtgtgcaacacaaaggataaatgcttgaggggatgaatacctcattctctatgatgtgattattacacactgcatgcctgtatcaaaacatctcatgtatcccataaatacactatgtatccacaaaaattaaaaatgaaaaaacaattcccattcattacttttatacttttaaaaacaaatattaagcagtttgttttaaatatttttaaacatatttatgcctgaaaatgacacttccaattttaaaacttatccttaaaaatgtgaactatgattacacgcaataccatgtattacagtttaaaaaaaaaaaaagaaaaaaaaagctctggctgggcacagtggctcacgcctgtaatcccagcactttgggaggctgatgcgggcagatcactcaaagtcaggagttcaagaccagactgaccaacagggagaaaccccgtctgaaatgaaaatacaaaattagccgggtgtggtagcacatgcctgtaatcccagctactcggaaggctgaggcaggataatcgcttgaacccaggaggcggaggttgcagtgagctgagatcatgccattgcagtccagccagggcaacaaggatgaaactccacctcaaaagcaaacaaacatacaaaaagcctcacgaacaacactgaattaatggagccagaaaaacagagtacctattctgacttcatttatataaagaccacaaagaggaaaaatttattatgatattaaaaataaaaaaaattattactcatggtaaggacagtaatgagaaagaagcccaaggggttcttactgggtgctagcaatgtcatactacttttttattttttttaagacagggtctcactctgtggcccaggctggagtgcagtgacctgattctaactttgaacttctaagcttaagtgatcctcccacctcagcctcccaagtctgggactgcaggcacaagccaccatgtctggctaatttttttgtgttgttttttgttttttggtttttttgtagagatgaggtcttgctttgttgcccaggctaatctcgaactccggggctcaagtgattttccctcagcttcccaaagtgctgggattacaggggtgagccaccgcacctggcaaacacatttcttaatctgaatgttggttgtcccatatggctgagttcatgaaaattcgctgagctgttacatttatgatgggtatttttctatatgtatgttatacttaaataggaagttattttttaaattctgtctaaaagtaaagtagaaacatattcagcttccttaattggctaatgaatgtgttcaagcctggtttttcactttttttttttttttgaaatggagtcttgccctgttgcccaagcaggagcgcagtggcgccatctcggctcactgcaacctccgcctcccgggtccaagcaattctctgcctcagcctcctgagtagctgggattacaggagcccgccagcaggcccagctaatttttgaatttttagtaaagacggggtttcaccatcttggccaggctggtcttgaactcctgacctcgtgatccacccgcctcagcctcccaaagtgctgggattacaggcatgagccattgtgcctggcctggtttttcacttttacctgaaataaatatctgagagaaattaaaagcagtttaaaacagagttcatatcccacagtaaatggtctatgactaaataaggcacacagataatttgatgttggtttcaaaaatcttttcttccaaatcctgatactatataaaataaatgaatgagacaacattaagattttgaagccgggtacggtggctcatgcctgtaatcccggcactttgggaggccgaggtgggcagatcacgaggtcaggagagtgagaccatcctggccaacatggtgaaactcgcctatactaaaaatacaaaaaaaaaaaaaaaaaaaaaattagcagggtggcgcatgcctgtggtcccagctactcaagaggctgaggcaggagaatcacttgaacccaggaggcggaggatgcagtgagccgagatcacaccactgtactccagcctgggcaacagagcaagactctgtcacaaaaaaaaaaaaaaaaaaaaaaaaaaaaagattttgaaaactgtatttggtactgatgatattatcctcttacacttgtaagaacactttaaaatgactgataagagttatcactttaagagagcatattatcaattaggcactgaaaaagatgctgtattaaaacatgatattaagcatgtaattttttccaacagaaaaatagctttagtccacatataaaatactctcatttaaaaaaaagaaccaaagtataaataatacctttcatgaataaagactttacatttcagatattttaccatatacatcaaaataaacaagtgtacattcttttatacaaatggagccaacaatgcttgctgttttgtagcccatttgctttaaatgatatgacacctttatgtgtaaataagagttagatgttaaattcaacagtttcacaatagttcataattcataaaatcaaccacctactgactgtaattaaatagtttctggctttttgttactataaataatatgtgggcgcggtggctcacacctgtaatcctagcactttgggaggccgaggagggcagaacatcaggtcaggagtttgagaccagcctgatcaatatggtgaaaacaccatctctactaaaaatacaaaaaaattagctgggtgtggtggtgcgcacctgtaatcctagctactcaggaggctgaggcaggacaatcactagaactcgggaggcagaggttgcagtgagccgagattgtgtcactgtactccagcctgggagacagaccgaggctctgtctcaaaaaaaaaaaaaagggctgggcacggtggctcacacctgtaatcccagcactttgtgaggccaaggcaggtggatcacgaggtcaggagatcaagaccacagtgaaaccccgtctttacgaaaaatacaaaaaattagacgggcatggtggcgggtgcctgtagtcccagctactcgggaggctgaggcaggagaatggtgtgaacctgggaggcggagcttgcggtgagctgacattgcaccactgcactccagcctgggcaacagagggagacactgtctcaaaaaaaataaataaataaatggggagacactgtctcaaaataaataaataaataaataaataaataaataaataaataacaatatggtaaacatccaattgcatttttctttccatacttgttcaattacttccttcaggtaaatttttaaaggtgaaagtacaaagctgaagggcatatgcattagttacacactagacaatgacatgtaagactttttttttttttgagacggagtctcgctctgttgcccagggtggagtgcagtggtgccatctcggctcactgcaaactccgcctcccaggttcacaccactctcctgcctcagcctcccaagtagctgggactacgcccgccaccatgcccggctgattttttgtatttttagtagatatggggtttcaccgtgttagccaggatggtctcgatctcctgaccttgtgatctgcccacctcggcctcccaaagtgctgggattacaggtgtgagccaccatgcccggccaaaaaagactttttatttccaattgtcagtatgtaagatgtcacaaccttatataaagacatccagggttgggcgtggtggctcatgcctgtaatccttgcactttggaaggccaaggtgggtggataatttgaggtcaggagttccagaccagcttggccaacatggtgaaaccccatctctactaaaaatacaaaaaaaaaaaatccagctggaagtggcagcacatacctgtaatcccagcttctgaggtaggctgaggcagaattgcttgaacccaggagacggagattgcagtgagcaaagatcgcaccacggcactccagtatgggctacacagccagactacgtcacacacacacacacacacacacacacacatacacacacactctctctctctctttttctggccaggcctcgtggctcacacctgtaatcccaacactttgggaagctgaggcaggaggattacttgaacctaagagtttgagactaccctgtgcaacacagggagacccccttctctacaaaaaataaatctccaaaattagctgggcacagtggtgcatgcctgtagtttcaggtacatgggaggctgaagtggagaatggcttgagccaggaggtcaaggctgcagtgagccatgagccatgatcacaccactgcactctaacctgggagacagggtgagaccctgattccaaaaaaaaaaaaaaaaaaaaaaaaaaaaaaaaaaaaaaaaaaaaaagacttcctattgcatttgtttatatttgacttatctattattctaaacgtcttttcacatgattttgctggccatctgtatttctcctgcagtgaaaagctgttcaagatcctggtccatatttttctaaattgtggaggtcatttctaatttagatgggcccttaatataatacttctttctcacatgttgcacatttttcccaatttaccagctctctttcacctactattcttcttgaagttaaaatcttaaacaaaaggttttaaaaatttttattaaaaagtgaaaggcccaggctggtcttgaacgcctggcctcaagcaatctcctgcctcagcctcccaaagtgctaggactacaggtatgagccactgtgcctggccaaaatcttttatgtattcaaatacttatgaaaaactgtactaattacctcacatattccttacaaccaccatatagtgaaattactataactatcctcatttaaaagattaaagagtggtttagacattggctaacttgctcaaggtcacttaaccagtaaatgattaagaaataatttaaacatagtctgatttcataactaaagtgcttaatcactgcattaaataaaatagtctctttaactttataggtttgttttggggttttttctctctctcatttttttgagactgagtttagctctatcacccaggctggagtgcagtggctcaacctcggctcactgcaacctccgtctcctgggttcaagcaattcttgtgcctcagcctcccaagtagctagctggtttacagggacccaccaccacgtctggctgatttttatatttttagtagagatggagtctcaccatgttggccaggctggtctcgaactctggacctcaagcgatccactcacctcagcctctcaatgtgctgggattacaggcgtgagtcaccgtacccagctctctttttttcattcatgaaaaaatatattccagcctaaggtggaatatagttttgtttacttttttttttttttttttttgatggagtttcactcttgttgcccaggctaagagtgcaatggtgcaatcttggctcaccgcaacctctgcctcccaggttgaagtgattctcctgcctcagcctcccgagtcgctgggattacaggcatgtgccactgcacatgcacagaatgcctggctaattctgtatttttggtagagacagggtttctccacattggtcaggctggtctcgaactcccaacctcagccgccagcctcggcctcccaaagtgctgggattacaggcgtgagccaccacgcccagtcttgttttcttatacttggaaaaatcatgtccttctagacgacaatcttcactacactttcaattaattatttttcggtttcttttcgtttttcctttatttgccatgttaaattctaaaaatataatctgggggtagggaagcagcctttattccaaaaggtttgctcattgttctaagaacattgctcattgttctaagaacattactcatttcatgcccattgattatttataattaatgtaatgtaataacatacttattacatattcttattcgtatttggatcttactctaaattcctaaggttttgtttcattcatatttatgattattattgtgccactaatatatggatattataacttcataataacgtttgaatatttgaaaacaagtaggttttttttttttcttgtattcctatagaaattctctattttatttacaacattactgagatttaactcacatgccataaaattcaccttgtttttgtttgagacaaggcccggttctgttgcccaggctagagtgcagtgtcaatctcagcttgccacaacttttgcccccccaagctctagccaacatcccacctcagcctctcaagtagctgggatcacaggaatgcaacaccatgcctggctaattttttctagagataagacactcactttgttgcccaggctggtctcgaactcctgagctcaagtgatctggctacctcagcctcccaaagtgttggaattacaagcatgtgccactgcacccaaccaaattcacccttttaaagtgcacaattcagtgggttttttttaactatagttacagaattgtgcaaatatcaccactactttaataaccttttcatcggactgtttttccatacgtatacttcctcacaaacttgagatatgattgaagtttttaaaaaacctcacatggctttaactttgtatcttaatgtagaaaaacatatctcaacattaactttagctctacaataacaaagtaaatgtatttagtcaagctttttcgtgtttctgggtatttatatctatataaatcctaaacatgtgctgttaaatatatttctaagtatttcatagattctgctgtttcttttattaataaattcttcttgctgttacagaatactttctaactataactgatagtattcaagaacacttgatttcattttataatattaaattcttgcttcatcaataattcatttttcagggggggcatggcggttcacgcctgtaatcccaacactttgggaggctgaggcaggaggatcacctgaggttgggagttcaagaccagcctagccaacatggtgaaaccccatctctactaaaaatacaaaaaaaaaaattagctgggtgtggcagtgtgtgcctgtaatcccagctacttggcaggctgaggcggaagaatagcttgaaccagggaggcagaggttgcagtgagctgagatcgtgccactgcactccagcctgggggatagagcaagactccatctcaaaaaaaaatttttttttcattttttcagcaagtatttactaagtacctactattgagcactgaggataacagcagttaaaaaaaaatccaaaaacatcttcctccatggagatgtcattgtaatgcatgagcaaagtagagaaaataagtaaaatatttggtatatcagatgataaaatgcactatggagaaaatcagagcatggaggaattgaaaaggccagggatggaaagaatttacaatgttaaaacgggctgtcggaaagttctgattgaaaactcaattgtgcagaaatgaaaaggaggtgaaagacaaagatggatccatgtaggtatgtgggaaaaaacaggaaccaagaaagcaaaggccctgagccaggagcttgtctgtttaaagaacaataaagaatccatgtttgcagtactagagtaagcaagagaagagtaatgttgcaggtggtaggaaaatggacatttttcagtccaagaaagaggaagccattcgaagattttatgaagaggtatatgacttgaccattcattcaacaatatttatgggtacttactgttgtggatatgtcaaggaaaagacagacaattgcagagaggacagtaaagaaaaaacacaaaaaacttttaaagattattatttgttagaaggtggcaagtgttaggggataaacagcaagtgaatactaggagagggcttgcaaaattaattaggcaattaggttatgctgcgatgatcagctaacattttagtaacgacagaagtgaggaaattattaactcacttagaggaagactgaaaatgatgatcaggagtttagtttgagacatgttaaaattgaaatacttactaaacatcaaagtagagaagcctaagaagaaagattcaaatttagaagtcaacagcatattgacatttaaaagcttgagactggacataaccgagtgagggtgaatgtaaaccgaacagtaaactaaggactgataacaccaaggtattgtaacattaaagatcatgaagattgagaagccagaaaagaataaggaaaaagagagagagagagagagagagaatgaatgtgtggtatcttggaacccaaatgaagcacatatttccaggagcgacaaatgctgctgacaagtcaagtagaaatgagaacatacatttgtttgttggattggagtcactggtaatcatgcaacagcagttcctttattaaggagcaaaaacctggttgaaatgggtttgaaagagaatggaaagagaaatctaaaaagtaagtaaagaatagcaagggaaacagtgaagtggggtgacagctagatgatgaagtagaatcaaagtacggtgtgtgttacctaacaatggggataaattctaagaaatgtctctaagaaatgtgatttttgtcattgtatgatcatagtgtgtaattacacaaatctagatgatatagcctgccacacacctaagctgtatagaataacctattgctcctaggctactaacctgtacagcgtggtactgtactgaacactataggccactgcaaaaaaaataggatttttgtatataaacatagaaaaggtacagtaaaaatatggtataaaagataaaaatctacttatagaaaatataagtacacctgtatagggtacttatcatgaatggagcttgcaagactgtacgacactctgggaaagtcagtgaatgctcagtgactgtgaagggctaggacattactgtacactactgttgactttataaacactgaacacttaagctacattaaatttttaaaaatttcccttcgtcaataataaattcatctggctgggcacagcagctcaacgcctgtaatcccagtactttgggaggctgaggccagcggatcacttgaggtcaggagtttgagaccagcctggacaacatggcaaaactgtgtttctactaaaaatacaaaaattagctggtcatggtggcaggagcctgtaatctcagctactcgggaggctgaggcaggagaattacttgaacccaggaggcggaggctgcagtgagccgagatcgtgctattgcactccagcctgggcaacaagagcaagactgtctcaattaaaaaaaaataaataaataaaacaaaacaaattaaccttagcttccttttttactttattaccttttacatttttttactttctgactcttttgtagtaacagcttaaaatgcaaatataacatacagctgtacaaaatcttttctttgtatctttacaattatttatttaaaaatttttaaatttgtttttaccttttcaacttttttgttaaaaactaaaacacaaacaaacattagcttaagtctacacagggtcaggatcatcaagacatcattaggtgacaggaatttttcagctccattatactcttatgggaccaccaaaatgtgatctgtcattgatccaaacatgattacgcagcacgcgactgtagtttcttttgaatgtggaaaatgacatctttgtcttctcaaagtaaatgtagccataaaaagaaaaaagacatgcactcatgaagtttaatatatatgtatgcatgtatatgcgtgtatggtaatataaaatctactacagaactaccggttctaatggaattgactgaataattccatctttcatcctctgatttgaaatgctacacttcccatgtactaaatcctcacgtatacacgagtctactactagtttttcttttcttcttcctttttctttttgaggtggagtcttgctctgtcacataggctggagttcagtggcaagaacgtggctcattgtagccttgacctcctgggctcaagcaatccttccacctcagcctcctgagtagctgggatcacaagcatgtgcaatcacgcttggctattttttttttttaatttttgtagagaggtgggggtctcactatgttgcccaggctggtctcaaactcccgggctcgggcaattctcccgtcacaacctcccaaagtgctgagattacaggtgtaagccaccccacccagccaattattagattttctattcggcgtcagtgattttccgtctgccagtccaccacaaccacaatattctaacccttttaatttctgttttattatctaataagcctgatttctagttactgttcttttcagaaaagttgtggctactcttgcttatttttccatacaaaccttacaagtaacttatctagtgccaatttgatttgtttaaaattttgattcttaaacttgcagacacccagaagaagtgaaagcaggaactggaacaggtatttgtaaatccatgttcatggaagcattagttagtcacaacagccaaaagcaggctgcttcacagttcatcaatggatgaataaatgaaatatggtatatacaactgattcttgaacaacaaaagtttgaactgtgcaggcttcatagcatatggagattttcttccacctctgctaccccttagacagcaagaccaacccctactcttcctccttggcctattcaaaatgaagacgataaggatgacaaccttatcaacttcaacttaacgaacagtgtaaatatttcattttctattctcttactttaagaatatagtacataatacatataacattaaatatgtgttaacaggctatgttatcgttaaggcttctggtcaacagtagactattagcagttacgttctgggggagtcaaaagttatacttggattttcaactgtgtgtggagttggtgcccataacttcagcattgttaaagggtcaaatgtacacacaatggaatattattcagccataaaagaagaaaattctttttttttttttttgagacggagtctcactctgtcgctcaggctggaagtgccgtggcacgatctcggctcactgcaagttccgcctcccgggttcatgccattctcctgcctcagcctcctgagtagctgggactacaggcgcctgccaccaggcatggctaatttttttttgtatttttagtagagacagggtttcaccgtgttagccaggatggtctcgatctcctgaccttgagatccacccgcctcggcctcccaaagtgctggggttacaggcgtgagccaccacgcccggccaaaagaaaattctaacgaatgctaaaacatggataaactttaaagatactatgctaagtgaaacaagccagtcaccagcagacaaatattgcatgattccacttacatatgaggtaaccagaacagtcaaattcataaagacagaaaacagaatagtggttgccaggggcttctaggaggggtaacaggggagtcactgttcaatagatacacaatttcagttgcagaagattaaaaaaaaactgtagagaagaacggatggtgagggctgcaaaacaatgtaaatgtacttaatgttacctcagcctcctgagaagacgggactacaggcacacaccaccatgcatggctagtttttttggtttttgtttgttcatttttttgttttgttttgttttttgtattttgagacagagtttcgcttttgttgcccaggctggagtgcaatggcattatctcggctcaccgcaacctctgcctcccgggttcaagcgattctcctccctcagccttccaagtagctgggattacaggtgtgtgccaccacgcctggctaattttgtagttttagtcgagatggggtttctccatgttggtcaggctggtcttgaactcccgaactcaggtaatctgcctgcctcagcctcccaaagtgctgggattacaggcataagccactgtgcctgaccagccggctagtttttaaaaatgttttgtagagacagggtctctctatgttgcccaggctggtcttgaactccttggcatcagccactgcgcctggcccagaaaacactttcaagaaaagtacgcttcagtttgtggcatataatcaaaagagaaccaaaacatctgagaacaggagtaaaaaaaaaaaaaaaaagccaaaaagaaatattaaagaaaattaaacatataggtcaagaatgcattttaatagaaagtcaccaaatattttcttttcaaaagcagaccacaatgggcttttcttaaattacaaaaccattagatgctgaacttgaattttatattccacactgaagccccaaattctatcctcattatatggccctcataggatcaagagtaagccaaaacatgttactagcataatttcttaaataaattatgataaaataatggcaatactaatatagaaatcatcatgtgatgtaaacttccaccacccaagaagttcttcttgctatataatttaaggaatagacataaggtgtcaatttgtcccagtggcagaggacaaagtcttcagggtctttttaacacctcttttattcccaacatgaaaaaccactgcaaatctgacttcatctatagtctttctcacaggatttctccctatccccatctaactagttacgaaagaggtacaattttgaactatgtactcagtgattttgactcacaaagtgaggtcagagaggaaacttttctttcatcattaagtttcatcttgtcttcctattaatgaattttcataaaagttccaggttttgtcatcttatcatataggacctttaattctgatgtctctcaaaaagctttcattcatttccatacagctgtagctcagaattaattagtaatgtgtaattattgagcagccgtatgtgaggatctctggagtgatttacaatcattaaaatgaaatcaaagatatgagcagacaaccataaaaagcagtatacgaattagtgagtgaaagtaatgatatttaggcttaattctctgggactaaagaagatataccttctaacaatttggttcaataatgattttttttttccattagcaagatcaacaatgaaatgagaaacattcacattcaccatatatacaccattaaaacaaaccacaatacagactccagcagatatcctagctatgaaagtgaactcttcaatcagccaaatgcagtactgattagggaagttcctactacataatgaaagcaagaattgaggatgaacctgattaaactaattacggtagttttaatcttcctggcacatttatagcagaggctgcagagcccaatggcagggatttgctttgcccttccatttaagggagctcatgcttccgtaatagaagtcattttgagaaaagagtgacatcctgttttatctccaaggctttaggacagatcacagccccttagctgtctattttgtgtatgtaaagggggaagaaaggttttactgaaatgtaaagatccaggataatttgcataattgctgctgccatggagaagctgggctctgtgccaactgttctcttctctaccataaaaatacctctagcttaagcagcttttaaagtaaacaatcaagatgaaggtaagactacagaatccatcatagcaagactcagagatacctacatacaatcgggtcttcttgcttgaatagcatttgtcaacaagaacatggaagtgaaaacgcagcagtcaaataatgtagacatgcattctggacctcttcataaataggcataaggaaaaaaaaaagcactctgagatggcacgcagcccatagggcacaagtaagatgacagaatgtgcctatcttctcctattaacaagtcccaaattctctggtaagagctgaggagcctagactgggcgtggtgtctcacacctgtaatcccagaattttgggaggcctaggcgtgcagatcacttgaggccaggagtttgataccaaactggtcaacatggcgaaaccctgtctctactaaaaatacaaaattagccgaacatggtggcacatgcctgtaatctcagctactcaggagactgaggcatgagaatcgcttgaacctgggaggcagaggttgcaatgagctgatattgcaccactgcactccagcctgggcgacagaatgagactctgtctctaaataaaaagaaactatatttaaaaaaaaagagctaaggagcctaaacacaaagaattggtttaaaaaataaaaacaaaacaaaaggcaattggaaaaacacaataccccatagtattaataataaaattgtttgacttgggttcatatggtaccacctatttggggtaagtcattaagatgtgttaaactctttcaaaaggtgtttgacatctaaaaatgttttgtctttcttccttatttttaaaatcagaaatggggtcttgttacgttgccaaggatggatttaaactcctggcctcaagcaatcctcctgcctcaagtcttctgagtaactgggattacaagcctaagccaccatgcccaacttcaaaatgttttcttaaactaagattactttcagatgttcctaattatttattacatattgtctcactctatcacctaggctggagtgcagtagcacaatctcagctcactgcaatctccacctcccggtttcaagtgattatcgtactccatccctccaagtagctgggactacaggtgggtgtcaccattcctggctaatttttatatttttagtagagaccaggttttgccatgttgactaggctggtcttgaactcctgaccgcgggtgatctgcccaccttggcatccgcaatttcttaaaaatagcaatctacagattgttttattcattcatttttttgagacagagtctcgctctgtcaccaggctgaagcgcagtggcgcaatctcggctcactgcaacctccacctcccgggttcaagcgattctcctgcctcagcctcccaagtagctgagactacaggcacacgccaccatgcccagctaacttttgtatttttagtagaaacggggtttcaccatgttggccaggatggtctcgatctattgacctcatgatccgcctgcctcaacctcccaaaatgctgggattacaggcatgagccactgcactcggcctagagattgttttaaataggcatgaaagttttactatatatttttagcaaatgagagaagaggaaatatttgagtaatacagttatgacagttttcttttcttttcttttctttttttttttttttttgagacagagtctcacactgtcatccgggttggagtgcaatggcgcgatcttggctcactgcaacctccgcctcccgggttcaagcaactcttctgcctcagcctcccgagtagctgagattataggcacgcaccaccacacccagctaattttttgtatttttagtagaaatggggtttcaccatgttggccaggatagtctcgatctcttgatcttgtgattcgcccgccttggcctcccaaagtgctgggattacaggcatgagccaccgcgcccggcagatagtgtattcaaaagcaaaatcttaggaataaggaaataaatactcacattctcaagctatattttaagcactgaatttttggtaatgatgatggtatttgttttatgcttacagatcttttcttcagtcttactgaactgtttttaaagcattttctgtgttgctcataaaaagcacaaacttaaaagatcaccctgacactgaaggagccaaagaaatagagaaatcaattaataattattatacaatgtgctatatgttaaaaacagaaatatatgcaatggaaacacagaggatagagtaacctcctagaaaggttcagggaacgtttcacagaattgggggatgtctaagctgagtctttccattccctcatcctccttcctttctccttgcacagtgaaacttttttatcctttttgctttttatttagaaatttagtgattaaatttgcttttctaatttttctcatttatcttaggtaattttagttatcgaggttgagacaaatagaatttttaagagttaccaagtatgcttaggagaatttccatatttcataattcctaaccttcataattgccctaaccgttataatcaacaaacagcttagaaagaaaggttaccaagctcccctgccttggcttataattttcagcatctgcttttgatctcctcagcaatcttttggagcccccagcccgtaaaatcaaagactaggcaaggaactacacaataatcacactcagtaattttgctaagaaatgaaaaagtgaggctgagaagcaggtgccattttgtttcactgtttttactgtgagagttactatcaaatcctacagaaagatgttaggatcatttttgtgccttcatatatatcctcagatgttagtaattcaatgtagcttcactcaatacagctaaaatattctagtgtatctaccatctgtgcatttttgtcaaaatgcctttgtgtacctcctaaactctgacttcctaatatagtagaactttttattgcaagcttgtatactttgatatgttttccaaaaataaaagtaaaatatacatagtaaattaggacttggctgttaaaaaataaacactagttcagtacctgttttgtttcaaaagtgagttctggttacaatttcaccttaataacatttctgacatctttgttgacattatcttcttttaataatcagtattctctcaatttaggtcattgattttagagaaactaaagcattagtatgcataatccagattatagaaagatccgtatttacattaagcagttccagggaagccacagttaatatgtaaactaccaccctcttccctgtaagtccttatccaatcatatattccacttcatctctctatcacctaggctgcagtacagtggcatgaacacaacttactgcagcctcgacctcctgtgctcaagtgatcctcctgcctcagcatcctgagtagctgggacaacaggtgtaagccaccatgcctggctaacatttgtattttttgtacaggggggtttcaccatgttgccagactggtcttgaactcctgagctcaagccacccacccaccctggcctccctaagtgctaggattacaggtgggagccaccatgtccagcccataactcttgacataaggcatctgctggtgcaaaatgacattcatttgtaaagaaaaggtaaacgttattaagtaggccctggatgacaccctcttatttttcaactgtttagtttgggatatggaaaggtaggtattagacataaaacattattttccctttcttcttggaaggtaattcttaattgctatattttttagtggttagtttaaaaaaatatatacacatacggagaatcttctaacagatcagcaacacccaagggtcaagctgagctttgccagttgtaccctgaatccccaatatgtgttacttcccttcctaatagtggcaactattaaaaatacgttgcaactcacccttaaacctgatctctaatgccacctgctgttgcagttctgtaagataaagaagctctacgaatctgccccaatattatatagcttgactttcactctctcatgaagaccagggtagttcactattaattatgcacatatttgtaaaataaaagtcaggtacttatctgactttgttagtatttactggctgggcgcggtggctcaggcctgtaatcccagcactttgggaggccaaggcagtcggatcacctgaggtcaggagttcaagaccagcctgaccaacatggtgaaaccgcatctctactaaaaatacaaaaattagccaggcatggtggcacacaactgtaatcccagctactcgggaggctgaggcaggataatctcttgaacccaggaggcagaggttgcagtgagctgagataacaccattgtctccagcctgggcaaccaagactgaaactccatctcaaaaaaaaaaaaaaaaagatttaccattacagctataaatgacagggcccctacttaccaaagcaaacccaaatttctgaaacagaaaaatagtccaaaaaagtggttttatcttttaatttttcctctaagaggaatcctactacaaagtaggaccacaaacttaaaaacaaacaaacaaacaaaaaaccaaagaaaaatcctaagaaaaaataagtatggtcatgcaattctttttgtttttttccactgcgcccggcctcattatttatattttcttactatttacctacagtaaagaactgtcaaattcttgttttacagcacaactgagaaaaccctgtgagacatcctaagtgtgcattttccctttattatttactttgtcccaaaagcctttctctttccagcaaattctgacaaagttgtcaacacctaattttaagcatgagcccttctttgcatattctcttgctcaccaccttctccaatgattctgcgattcacatatacactccgtatgtatttctatcatggcagttatcatgtcatagcacaatttttttttacagcacgtggaaaaacaaatcaaagaatgttgtgactctgcactagagactatgggcaaagttaagtgatataaaactgtaacctcctttgtgaaagtataaatcaaaatattagtccttttgatcagttattttaagtataaaaggcacacgaaagatacaaatttaagatgaaaatgtttattaagatgacaatgtttaaaattattaataatggtttcgtaactctgtatacacttaacatactgaatatactaaaaacactgaactgtacattttaaaaggataaattttacagtatttgaattatatctcaatttaaaatatatacattttatagaaaactgggctaacttaaaatagggtataatttaaaggaactattattatctagaaaacctaacacactattattatcattattttttattatactttaagttctagggtacatgtgtacaacgtgcaggtttgttacatatgtatacctgtgccatgttggtgtgctgcacccattaactcgtcatttacattaggtatatctcctaatgctatccctcccccctgcccccaccccacgacaggccccgatgtgtgatgtttcccaccctgtggccaagtgttttcattgttcaattcccacctatgagtgagaacatgcagtgtttggttttctgcccttgcaatagtttgctcagaatgatggtttccagcttcatctatgtccctacaaatgacatgaactcattcttttttatggctgcatagtattccttggtgtatatgttaatacactattattatctaacaaatacaaaggaaaaaaatccaaaacctaggtaatgtcataccaatttttttccaacaactctatttcaaaataattggaacttgtttgcagcactttaaaaactgccaggcaaataatctctaccgagcaagaactaaggcactattattatccatttttcttatttaagaaacaacattaggctgggcacggtggctcacgcctgtaatcctagcactttgggaggccgaagtgggtggatcacctgaggtcaggagttcaagattagcctggccaacatagcaaaaccccgtctctactaaaaatacaaaaattagccaggcatggtggcgtgtgcctgtagtaccagctacctgggaggctgaggtgggaaaactgcttgaacctgggaggtggagactgcagtgtggccaagattatgccactgaactgcctgggcaatggaccgagactccatctcaaataaaaaaaagaaaaagaaacattaatctaccagttatatagcattataaaattttaaattccaggacaggctttaagtctaatacttggattcatgtgggttttaataattctcagccgggtatggtggctcacacctgtaatcctagcactttgagaggctgaggtaggaggatcgtttgaccccaggagttcaagaccagcctggccaacatagccagactgtttctacaaaaaagaaaaatatttaactttatcaaattttgtttaaaaagtaataataattctccaaaaaaatcacttaggccaggcgcagtggctcacgcctgtaatcccagcactttgggaggccaaggcgggcaggccacctgaggtcaggagttcgaaatgagcctgaccaacatggagaaaccctgtctattaaaaatacaaaattagccagacatggtggtgcgtgcctgcaatgccagctactcgggaggctgaggcaggagaatcgcttgaacccaggaggtggaggttgcggtgtgccgagatcgcgccatggcactccagcctggccaacaagagcgaaactccgtctcaaaaaaaaaaaaaaacgcttcactgaaattcaaaattatttcttcaacgaactgcttcttaaatctattaagatggcatagaattttcttttctaaacagaaaaccatttttggactggaaattataattatggctataaattttacttgtaattcattgtgctcatgaaatccactcatctagactaaagtaacatcaaataaactatccaatgacaaaaatgttagtcaacaaagcaccaaatttcaatgctatttgactaatacgtaatctgctcatcataatcatgagacatggtataatgatatgaccaaatgcagtggctcacgcctgtaatcccagtatgttgggaggacaaggcaggaggatcgattcagcacaggagttcgagaacagcctgggcaacacaacaagacactgtctctataaaaaataaaataaaattagccaagtgcggtggcacacacctgtggtcctagtgattccggaagctgagatgggaggatcacctaagcccatgggagccaagactgctgtgaaccatgatcatgccactgcacagccttgggcaacagactgcctctttagaagaagaccgtgtctcttaaaaaatgttatgtatccaccatttgtgcatttttgccaagatgcctttgtgtacctcctcaactctgacttcctaatatagtagaactttttattgcaagcttgtatacttgactttttttttttttttggctaagcatactaaatgaactacaatcacgtattatgtaactccaaaaacggaattttctttaaatgctggaaagaaatgtaccattgctccatctccttttaagttactgtgtgataaatacaagtaaatattgtgacttccatctctactttcactttctaaaatactgctgtagaaaaatgaatgtaccattctgacagcttatgaaatggcagacaccacatgtaactgcatcaaagccaaacataaatttttagagaaaaattacaagaaagtttttctttccacttgggaggaaaaaagaaaacaggaaaacctgctataaaattaataatgagtccaagcatggtggctcatgcctgtaatcctagcactttggaggtcaaggcaggcagataacttgaggccaggagttcgagacatgcctagccaacatggcaaaaccccatctctactaaaaatacaaaaattagccagacatgatggcattcacctgtaatcccagctactcaggaggctgaggcacaagaatcacttgaaccccagaaggcggagattgcagtgagccaagattgcaccactgcactccagcctgtatgacacagtgagactctagtctcaaaagtaaaaataaaataatgaacattatttcttataaaacaatcaggggctttctacttagagcaatatgctacgctaaatactgtgaagagtcttctattacaacaaaataactcaaaccagcataaaatacgtttcttacactgctgcctcataggagtaagaagaagctccaacaggaccaaaagaaaagaataaaaagggctgacctaaataggcacaataatacagtgggtaagtgcatcaagtcatgcgctaggggcaaaatagagaccccaggaaaggtgtcagtaacgtaccctaactcctggaaaactaaagtcaaagcctctcaaagtagtcatcatcaaattaggctccaaattcaaccacagataaagatgaacaatatacaaactttataatcagccacattctagaaaaaaaaaattattttcactgaaattacattgtttataaattaataggcaaaagtacagggagcacactaaaatacaagttaggaggatggattagtcctacctataaaacaaaatacttaaaactgtatcatggtggccgggtgccatggctcacacctgtaatcctaatgatttgccaggctgggacaggaagatagcttgatccccaggatgatccccaggagttcaaggttacagtgagctatgatcacaccaccgcaccacagcctggttaaaaaagacaagactcagactcttaaaaataaacaaacaaaaaatgtaaataaacagaaacatcattgatactaaaaggaaaatcagactagaaccaagtacataaagaaattcagtgtatgacaaagcagcctctcaaatcagagaagtaaagatggacttcttaaaaatagtgttgaggccgggcttggtggctcacgcctataatccccagcactttgggaggccaaagcaggccgatcacctgaggttaggagttcgagaccagcctgaccaacgtgaggaaagcctgtctctactaaaaatacaaaaattagctgggcatgatggtgtgtgtctctaatcccagctactcaggaggctgaggcagaagaactgcttgaacccaggaggcagaggttgcagtgagccgagactgcaccactgcactccagcctgggcgacagagcgagactccatctcaaatgataataataataataataagtgttgggacaaccatgtagccatttggaaagagataaatttggaaccataactcataaaccataacaaactccaaatggatcaaggatttatatgttaaaaaacaaaacactacaaagatctgcaaaacaacataaggaaatcttttataaacttcgaaggaagaaggtctttctaatgacacgtcaaaaatccagaagccttaaaaagatttataaattacatcaggtaaaaagctaaatatttctgcatggcaaaataacataaccaaagtctaaagacaaataacaaactggaaaaagaaaattatatgctgggcgcagcggctcgtgcctataatcccagcactttgagaggctgaggcggacggatcacaaggtcaggagttcgagaccagcctgaccaatttggagaaaccctgtctctactaaaaatacaaaaattacccaggcgtggtggtgcacacctgtaatcccagctactcaagaggctgaggcaagacaaaagcttgaacccgggaggcggaggttgtagtgagccgagatcgcaccactgcactcaagcctggacgacagagcaaggctgcctcaaaaaaaaaaaaaaaaaaaaaaaaaattatataagccacatttccaagggctaaagaagttctcatagtcttgttatggaaaaatctttagtatatactatttaatagaaaaaagatacagagcagtaggtacagtgtgctactatttacattttaaaatggggaaagaacatgtatgtaggggatgcatactggtttgtaagtgcaaatatgtttctggaagataccaaagatagcaatgttggagttactcttctggaagtttctttgtaccaactttgattcccaacaatttattcttaatgtgatatgattctccaagcgaagatgaacctgaaaacacatttttttttttggagacaggatctcgctctgtcacccagactacccagctaaaattaagtcttgttttttaactaaaataggctgatggaagccacagtaaacatatacagaacaaaaattttcactgaaagtaaactgattagataattaacttttatatagcaaaatattacccagaaaaatgacacctgaacaaatctagaaattgacagttgaaaatcatgttattaacctaaaaattctcaacttttgaacctcaaatatgagtctgacattttaaaataaaaatttccaagtaataaaagtatgaaatatgacataacatactatgcattaaccatccatgatatgtgatacataaatcatcaagcagaataaccttttcttaaaggaaataaagaagacgaatatactgaaaatgtcttcaggtttccctttgtttgcaaaacaccaccacagttaagaactcactggaaccaaagtttatgcaaagaaacattagaacagtaatctaaatgtggcattctatttttgagtctaattcattagccatcttcactacactgaaactacaaaattcccacagggatcactgcagtttgatatacttaacaatgtttttctagattcaggagattctgaggttttattccctctctggagactttccaaacttcaatccactgtcaattattccttaacaaggtattacaattaagagtaggacacaaacaaatcaagattctttcatgaacaaaccaagactgtttcttgtttgtttgtttttgagacagggtggagtgcagtggcgcaatctcggctcactgcaacctccgcctcccgggctgaagtgattctcctgcctcagcctcctgagtcactgggactacaggcgtgagccaccacacccagctaatttctgtatttttagtagagacagagtttcaccatgttggccagcatagtctcgatctcttgaccttgtgatccacccaccttggcctcctaaactgctgggattacaggggtgagccaccacgcccggcaagattgtttctttcttttctttttgagatggagttttgctcttgttgcccaggctggagtgcaatgccgggatctcggctcaccacaacctcttcctcctgggttcaagcgattctcctgtctcagcctcccaagtagctgggattacaggcatgcaccaccacgcccggctaattttttgtatttttagtagagacagggtttctccatgttggtcaggctggtctcgaactcccgacctcaggtgatccacccgcctgggtctcccaaagtgctgggattacaggtgtgagccactgtgcccagccaagattgtttcttattctcttatttccctatggtcagtaaaggagaaaatactatcctttatcacaatcctttatcacaatctcaataggagttccagggctgcttcttttggagcactgaagataaagtagaaaggcaaaagatccgccaggcgcagcacagggcgtggtggcatgcacctgtaatcccagctactcgggaggctgaggcaggagaatggcttgaacctgggcagcagaggttgcagtaagccgagatcacgccactgcatgcaagcctgggtgacagagtgagactctgtcttttaaaaaaaaagaaaggcaaaggatcttagactttttttttttttttttttttgagatggagtctcactctgtgactcaggcaggggtgcagtagtgtgatctcggctcactgcaacctccacctcctgggttcaagagcttctcttgcttcagcctcctgagtagctgggggtataggtgctcaccaccacacccagctaatttttgtatttttagtagagatggggtttcaccatattgttcaggctggtctcaaattcctgacctcaagtgatccacccgcctcggcctcccaaagtgctgcgattagtcttatgtttaaaaaacaaaaaaacacatatcaagctgggcacagtggctcactggcacggtggctgacaccttgtaatcccagcactttggggggctgagatgggaggatcacttgagcccaggatttcaagaccagcctgggcaacataaggagcaacatttctacaaaatataaaaatattagaagtgtggtggcacacacctgtagccgcggcttcttgggaggctgaggcggtaggattgcttgagcccaggaggtcaaggtcaaggctacagtgagcctaatcacatcactgcactccaacctaggcaatagcaagatgctgtctcaaacaaacaaaactatagatatataataataaattataaatataatgagtaactcctacacattaggatggctataattttttaaaaatacagaataactgttaccgaggatgtggaagaaccagaatacttgtgagttcctggtgggaatgtaaaattgtacagcccctgtggaaaacagtatggtaattctttcaaaaaattaaacatagaattataatgccccagccaggcacagtggctcacatgtaaatcctagcactttgggaggctgagacagacagactgtccagcctgtccaggagttcaagatcagcctgggcaacatggtgaaacccccatgtctactaaaaatacaaaaaatgagccaggagtggttgtgcatgcctgtagccggtctactcaagaggctgagatggcagaatcatctgagcccaggaggtcaaggctgcagtgagctgtgattatgccactgcactccagccagggcaacaggagtgagatcctgtatcaaaaaaaaaaaaaaaaaagaattacaatgtccagcctgggtgacacagcgacacccaatctcttaccaaaaaaattgcaatacgaccaaaaattccacttccacatatatacatacccaaaagatgtgaaagcagggactcagatatttctacacacatgttcagcattagtcacaactgttaaaagctggaagcaataccagtggccatccatagatggactagattaacttatctagtaaaatactacccagaaaagtaatagctgaacaaatctagaaattaatagttgacaatcacattaacctaaaaattcacaaacagcttctgaatctgacatatccatagaatgaacaaaatttggtatatacatacactggaatattattcagccttaaaaacgaaagcaactctgacatactccaagatggacaaccttgaggacattatgctaagggaaataaggcagttacctaaggacaaatattgtatgattctacttatatgtggtaattacagtagtcaaattcaaagacagaaagtagaatagtggtttcgctaggggctgcaggagggagaatgaagagttaatagagtgtcagctggaaaatgtcaaaaaaagatccagagctggtgggtgggcatggtcgcacaaaaagtgcatctacctaatgccacaaaattatacacttacaaatggttaaaatggaaaaagttcaggttatatgcagcctaccacagtttatatatacggatatacatacatatacacacatttattttttaaaactatataattgttataaactataaataaaacaggtaatactggtgtaaaagtaactacagtttttgcactgttgaaatttgccacttgatattggaatacgttcttaaatgtggttatgttatatatcattttaatgcgcatttctcactttatgtttttttgctaatgattacttgctgtttattttatatttatatttatatttattttagactatggaaatgttagactaaaagcaaattcaagcgatcttcttatttgggtttaaaatgggtcataaagcagtggagacgatttgcaacatcaacaacgcatttggcccaggaactgctaatgaatgtacagtacagcggtggttcaggaagttttgcaaaggaggtaagagccttgaagataagaagcacagtggctggctgtcagaagctcacaacaactgagagcaatcatcgaaactgatcctcttttaactacacgagaagttgccgaggaactcggcaacttcaaccattctacagtcattcggcattttacacaccaacaaggaaaaatttctcagactgtgatgtgtgacaaaaagtggattttatatcacaaccggcaacaaccagatcagtggttggacccagaagaagctccaaagcacttttcaaagccaaacttgcaccaaaaaaggtcatggtcaccgtttggtggtctgctgccagtctgatccactatacctttccaaatgccagcgaaaccattacacctgagacgtatgctcagcaaattgatgagatgtaccaaaaactgcaatgcctgccgccagcactgatcaacaaaaagagcccaattcttctccaggacaacgcctgactacatgtcacacaatcaatgcttcaaaagttggacgaattggactactaagttttgcctcacctgacatattcaaccgacctctcgtcaaccagctaccacttcttcaagcatctcaacaattttttgcagggaaacagcttccacaaccagcaggatgcgtaaaatccttcccaagagtttgttgaatccagaagcacagatttttatgctacaggattaaacaaactgatttctttttggcacaaacttttattgtaatggttcctattttgattaataaagatgtgtttgagcctagttatgatgatttaaaattcatggtcaatggccggacacagggactcactcctataatcccagcactttggaagactgaggcaggcgaatcacctgaggtcaggaattcgagaccatcctggccaacatggtgaaacctcatctctactaaaaatacaaaaattagccaggtatggtggcaagcacctgtaatcccagctactcaggaggctgaggcaagagaattgccttaacccaggaggcggaggctgcagtgagccgagatcaagccactgcactccactccagcctaggcaacaaaaggagactctgccttaaaaaaaaaaaaaaaaaaaaaaatgcatggcccaaaactgcaattacttttgcaccaatctatatatacatatatatcaatataactcggagattagcctacatactatactagcatggattatggacagaaaactttatcctttgaggtagcctgatggcactttatcatcatcctttcctcttgtttcttacactgccttctatcgttctgttttcctcttcttttgtcttcctgctatagtaccagcaactactactttcagtatactagttgtttaagttcttctaccggtaaggaccactaaagaggttgcttgaccacattcaaaacactgtatgtaacctattcagtaatggccattgggagtttataattttaaaaatatgaaaaaaattatatataatatttcagtagacaaaagaacactattttcagtagctaactcactgaacagaaaataacctactctcatttcacagtaagtaaacctagtgtttcccaaatctgctggaatgtaagaaatacctgaggcatatattaaaatactgaattatctctgttggcagacgacacagttttatatgtagaaaaccctaaaacatcaacaaattgttcaagctaataaatgaattcagcaaagttgcaggatacaaaacctacatgccaaaatcagttgtggccaacacagtggcttacacctgtaatcccatcactttgggaggccaaggaaggagaatcattgaggtcagaagttcaagaccagcttgggcaaaacagcaagaccccatctctacaaaaataatttttttttattaaaataaacaaaaggaggctaaggcaggaagattgcttgagtccaggagtttggggctacaatgagcaatgccactgcccctccagcatgggcagcaagaccctgtctctaaaaaaaaattaaaattaataattaaaaaaactagttgtatttctatatatttacaatgagcaatctgaaaagtaaatttaaaacaattctggttgcaatagcatcaaaaaataaaatacacaggaataaatttaaggaggtgaaaggcttgaacaccacaaattttataaaatattgctgaaagaaattaaggaaatcttaaataaacaaaagacatcccacattcctggatttcaagacttcatattaagatgacaacactacctaaagtgatctgtagattcaatgtaatttctatcaaaatcccaacattattgtttaaagaaacagaaaaccccatcctaaaatccatatggaatctcaaggaaccccaaatagccaaaacaattttgaaaaataacaaagttggaggactcacactttctgacttcaacttactacaggccagccatgatggctcatgcttataatcccatcactttgggagaccaaggcaggaggatcacttgagcccaggagtttgaggctgcagtgagtagcgtagcctggatgacggagcaagaccctctctctttaaaaacaaacaggaagggcacggtggctcacacctgtaatcccagcattatgggaggccgaggcaggcagatcatttgagctcaggagtttgagaccagcctggccaacatggtgaaaccctgtctctactaaaagtacaaaaactagccgggcgtggtagcaggcacctgtaatctcagctacttgggagggaggctgaggcaggaggcaggagaatcacttgaacccaggaggcagaggctgcggtctcaagccgagatcatgccactgtactccagcctaggcgacagagtaagactccatctaaaacaaacaaacaaacaaacaaacaaacaacttactacaaagctacagtaatgaaaacagtgtggtacttgcagaaagacagacatatggaccaatggaatggaaaggaagagtcctaaaataaactctcacatatatggccaataatttctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggtgcccgccactacgcccggctaattttttgtatttttagtagagacagggtttcaccgttttagccgggatggtctcgatctcctgacctcgtgatccgcccgcctcggcctcccaaagtgctgggattacaggcgtgagccaccacgcccggcccaataatttctttaacaaagttgccaaaaccattcaatgaagaaaagatactctcttcaagaaacgatgctgagaaaactgaatatcatgtaaaggaatgaagctggacccttactttaaaccatatacaaaacttaaatacaaaacggatcacagatctaaacataagagctaaaacgataaaaccctcaggaaaacatagggggaagactttcacaacattggatttggcagtgatttctaggctatgacactaataatacaggtaataaaggaaaaaataaactggacctggttttcatcaaaattgaaaacttttttttgcatcagaggacacaaaaggaaattaaaagactatccacagaatgagagaaaatatttttaaaatcctatatacagattatataaagaacctggacaattcaacaacaaaacacaattcaaaagtagtcaaataatttgaacaaacatttcttcaaagaagatacacaaatggccaataagcacatgaaaaattgttcaacatcattagttgttaagaaaatgcaaatcaaaaaccacaatgtgctacagcttgagaacgggggcggtgggggggcggtgggaggaaggaaagagagagaagggaaggaagaaaacaaaaggaaggggagggaagagagggggagaggcagagacagggagcaggagaggtagaggggagacggggagaggaaggaagaaagaaaagaaggaaggaatggagggagggagggagggaagaaaaattaagaaaacctcatgaagactcagagaaatcaaaaactcatgcattgctgatgggatatgaaacagtatagccactgtaaaagtgtacagttcctgaaagcgctaaataaataattaccgtatgacccagcaattctattcccaagtaaatacccaaaaattcaaagcaggaacttgaatagataactgtatggcaacattcactgtagcattactcacaatagccaaatagtggatgtgaaccaagattccatcaagagatgaatggataaaaaataaaatggtggctgggtgtggtggctcacgcctgtcatcccagcactttgggaagcagaggtgggcggatcacctgaggacaggagtttgagaccagcctgaccaacatggagaaaccccatctctactaaaaaatacaaaaattagccgggaatggtggcacacgcctgtaatcccagctactcaagaggctgaggcaggagaattgcttgaaccctggaggcggaggttgcagtgagccgagatcgcgccattgcactccagcctgggcaacaagagtgaaactccaactcaaaaaataaataaataaataaataaaaataaagtggtatatccacacaatggattattcagccatgaaaaggaatgaagttttggcacatgctacaacatggttgcaccttgaggacattctggtaaatgaaataagccagacacaaaataacaaatattgtatgattacacctatatgagttagctaggataggcaaatttatagttgctaaaagtacattagaattttttggggggtgagatggaatttcgctttcattgcccaggctggagtgcagtggcgcaacctgagctcactgcaacctctgcctcctggattcaagcgattctcctgcctcagcctcccaagggctgggattacaggcacctgccatcatggttggctaattttttgtatttttagtagagacggggtttcatcatgttggccacgctgctctcaaactcctgtcctcaggtgatccacctgcctcagcatgccaaagtgctgggattacaggcgtgagctaccacgcccggcaagtacattcgatattaccagtcgctgcagacagaagaaatggaagacattatttaatggttatggagttttaatttgggataatgaaaaaggtttagaagtaaattattttggctgggtacagtggctcacacctgtaatcccagtactttgggaggctgaggtggctggatcacctgaagtcaggagttcgagaccagcctggccaacatggtgaaacctcatctctactaaaaatacaaaaattagctgggtgcggtggtgggcgcctgtaatcccagctactcagggggctgaggcaggagaataggagaatcgcttgaacccaggaggcggaggttgcggtgagccgagatcgcaccactgcactccagtctgggcgacagagtaagactccatctcaaaaaaaaaaaaaaaaaaaaaaaaagaaagaaagaaatgatttcacataaatttttaaagctaataatgaaataccctaaaaatcactgaatttaaatgggcaaactgtatggtatatgaatcatatctcaataaagatttctcttttttcggtcagacacagtggcttacacctgtaatcccagcactttggagttttgcctttaaaaactgcataaataggccaggcgtggtggctcatgcctgtaatcccagcactctgggaggctaaggtggacggatcacctgaggtcaggagtttgagaccagcctggccaacatggtgaaaccccgtctctactaaaaacacaaaattagctcggtgtggtggtgggtgcctgtaatcccaggtactcgggaggctgaggcaggagaactgcttgaacccagaaggcagaggttgccatgagccgagatcacaccattgcactccagcctgggcaacaagagcaaaacttaatctcaaaaaaataaataaataaaattttaaaataattttacaagtacaaatacatacatggttatgctattaacttacatctttgacaagccttggggcttattttaaggctcacaaaaacaaactatctggaaataacatagattaaaatcaaactcccggaaatacatatataggataaaaattaatagggaaatgaaaatattgtcaataaccacatattgttaggaattctacttactcgttttgaaggacagtgttcattcttttcatccgtcatctttccacttttaagtgctttccttgggtgcttaatagttgtttttatggcaggtcgacatacatagttctccaagttctttggaggttttttagttctcttagcctggaggccaattttcaattttaaatttccctctgaaaagtttgtttctttcactgaaaactgttgctgtgcatcagtcaaaccatcatctttcccagcttcgatgtttctttctcgattccgtttgcgaaggtcctcttcctcctttgtgtttttttctagctctacttctctcttactgaccaatgtgccagtactgatggcagaaggactctttcttgaaaaaccttcggaatcagaacccaatcctaacatagcagtatttctagggtccatcacaagcgtatgttattgccaaggaatcttatgaaaattttacagaactgtgttccataaaaaacaaggatctccaaaactcgaaaccagcatctttctctgcagaacagatcataacaaaaatttatcagaaaagaggcaactactgattaacataagtaatgggtataggggaagacaaggaggtcaacaactacccaaaaaaaaatcacagttagatcgaaatgttaattcaaaatagatgtaaatccatttagttataaatacatttaaaattcagaataagtttatcattctacagatatcataaacaagccatagtggtatggtgcaaatgcaaatttaagaatcaccaagaagcttctgaaacttacagtcaagcaaacattgcctaaaatcaaaataactttcatatattttcgcactcatcagttttaaaagaatatattccccactcttctgctgaagtacacttttatttcctacagttttattgaaggtaaaaaatcatctttttttgatactccattgactatgtgattattacacattgtatgcctgcatcaacatatcacgttcaccccataaatatttaaacacgctatgtacctataaaaattctttttaaattatctcttaggctggtttcagtattccaaacttttagaagagattatcaggctttttgaggttaggactctctgatgcaggaacttatgcagatattatctttgttgttaggatacaattcaactctgaatcattcacttgtccattcaaaaaatatttccaaacatctatcatatgccaggcatcatgctacactctgaaaatacagtattcaacaaaatgaacccagttcctaaattttaaggtttatactctagtgagaagggcaaacattaagcaaatatttatacaaataatcactgttgttataagaaccttaaaaatcagcaatttatttttacaagttttcctaatagcaaatagtaggcatgtgtcaattccccaaatacacaaaatgttttaaaactagcgtgctaatttattattttacaataggtgatacacctaatctcagaatctccacaaagcactcccattttaaatataaagatcctcaggaaaccagattaccatataatcattagggagattagtgaattttttttttttttttttgagatggagtctcgctctgtcgcccaggctggagtgcagtggcgcgatctcagctcactgcaacctgcgtctcctgggttcaagagattctcctgcctcagcttcccgagtagctggcattacaggcacaagccaccatactcacccggctaatttttgtatttttagtagagacagggtttcaccatgttggccaggctggtcttgaacgcctgacctcaggtgatccgcctgccttagcctcccaaagtgctgggattacaggtgtgagccaccgtgcccagccagagactagtgaatatattaataaaaccaaaacaaaacaagtcagtattcttgaagactgacagactagtcttcatgtcaaacatatgtctgagtcaagatctagaactagtatctggaaaacggagaacatcttatcccttagaaagttccatttatgaagtagaatattttaaacgatgtgccctgagacttttcattacaacaagagagtaagattcctggccaggcatggtggctcacacctataatcccagcactttcagggactgaggtgggtggactctttgagcccaggagtttgagaccagactgggcaacatggcaaaatcctgtctctaaaaaagtacaaaaattagcagggtgtgatggcacacacctgtagtcccagctctcaggagactgaggtgggagatcacttgaaccttgaaggtcgaggctgcagtgagctgtgatcaagccactgcactccaacctgggcaacagggcaagaccctgtctcaagggaaaaaatagttgtcttatgacttctacaaggaatgtaagtaaaatacctcgcccaatgactggcacatagcgagggctcaataaaaggtactggccgggtatggtgtctcatgcctgtactctcagcaccttgcgggggccaaggcaggtgcatcacttgaggtcaccagttcgagtctagcctggtcaacatgtcgaaacccgtctctactaaaagtacaaaaatcagctgagtgtggtggcaggtgcctgtaattccaactactcaggaggctgaggcatgagaatcacttgaacctggcaggcggaggttgcagtgagccaagatcatgctattgcactccaggccaggtgacagagcaagaaaaaaaaaggtgccaataatttagtagtagtaggagcagcagcagtgtttataagtactcaacaaattttggccgattgggtaactccttagcttgttattgctccattcaatcatataaacagctggaaaactaatcttccaatcatttcactctgatgattcttgtctaccatttcatgtattaacatttcacaatggcattcaaggcttttaataacctcactctcctctaactattcaaacttatctttacttcccaacacacacccactatcatttagtcaattcagttttctttactgtccctaacaaatcatgttcatttctgcttatgtgtcatataaacatacacactctccctttaaacatacaaagtaggctgagcatggtggctcatgcctataatcccagcactttgggaggctgacggggcggatcaggaggtcaggagatcgagaccatcctagctaactcggtgaaaccccatcttttaaaaaaaaatacaaaaattagccaggcgtggtggcgggtgcctgtagtcctagctactcggaaggctgaggcaggagaatggcgtgaatctgggaggcagagcttgcagtgagccgagattgtgccactgcactccagcctgggcaacaaagcaagactccgtctcaaaaaaaaaaaaaaaaaaagtacaaagttagctgtgcacagtagctcgcacctacaatcccagcactttgggagactaaagtgggaggatcgctttagcccaggagttcaaagccagtatggacaacacagtgagacctcatctctacaaaaataaaaaataaaaaattagccaggtgtgtggtgtcatgtgcctataatcccagccactcaagaggccgaggtgggaagatggtttgagcccaggaagttgaggttacactgagccgtgattgtaccactacactctagcttgggcaacagaacaagaccctgtctcaaaaaaacaaatacataattagggaagggagaaaaaataaataataaaatgctgtgtataaaaagtaattaaaataacccaaatgtttttttaaaaataaataataattttaaaagttcaaatcctgcctgggcacggtggctcacgcctgtattactggcactttggaaggctaaggcaggaagatcacttgagcttaagagtttgagaccagtctagcaaacacagcaagaccctctctctacaaaaaataaaaaattagcccagcatggtggtgcacacctatagtcccagctactcgggaggatgaggcaagaagatggctggagcctaggaaatcgaggctgcagtgagccatgttcatgccactggactccagcccgggcaacagagcgagaccctatctcaaaaagtaaattaaaaaaataaactctaaaacaaaaaataaaaagtacaaagtcctatcttctccatgatgggctcacaatcctgaagtccaaaaaactctgaaatccaagttttttcaaaacctagtgataaaacttgacacggacccattttagtcttaattaccctaatttccatgaataatgataaattacaatgcagaagtattaatgggcttgattaagttagtaaaggatgctactactcccaaacaccactgtgccagttcacccaatctacatttctaaaagccaaaaaaaaaaaaagaagaagaagaaaaataagaaaaaagaaaaacgtgtaacacttgcagggaatttttttaaaaagaaaaaaacttacggcaccaacatttgggtaatggattctagacctatgttctcagacctatatttaagcttgcactgacctgatccatccctgaatatttatgatccatataagatcacaattagggcaattaacttttttcttgttctgtatttgtcagctatacccctcaacagattaagtcctcccacctcccatcccaccccctcagataccaaaatctgacgatgctcaagtcacttatataaaatggtatggtatttgcatacagcctatacacatgctcctgtatacttgaaatcatctctggattacttataatacctaacataatgtaaatgatatataaatagttattaaactgtactttaaaattttgtataattttttattattgtattgttatttttaattttttctaatatttttcatccgcagttggttgaatccacaggtgcggaatcacagatagggaaggccaactgtataattaaaatataagcttcatgaggataggaacctcttctggcttgctcaccactgtaaccccagcagctgaaacaatgaatagcacaaattttagtacccaataaatagctgaataaatgaatgagtgaattttaaggttcctgtaacttctaatacaatgattggcatgtagcaaatgtcttttttcctgttttacataactttatcttgtgttacaatgagaaaactatacacaagttttttcttaatatgtttatatttcacataggtggttttctgtaaatttactaaaatatcctaatttcagcactaacatacttccaaatcatattttatacatcttctgtctctgtaccatcacagctagtctaagaaaaacaataacactcaatgatctcattttatattcctgaccactaactccgagtaagcccttggtgctgccaatacacttccctaatctattccctctaccactctcctaaaaaactatttcatcccatctcccctttcttcattgtccctaattttgcttcctatctgatcacagcagtagtcagataggaagcagtaacaaacagaaaagtgccacaagtgcccaccatatatctacctaccttcctacctgtgtctgttcctatagtctgactgccttcctatcacaatatataaacgatctctcctttcaacctcttcatttaggcaactatctcctttctctctcacatcatccatttctcatatttcctctgaataatgccaataagcctgaaaacaaaaacatactataatatctctcatggaagaaaattcctcttagccgagcaagatggctcacgcctgtaatcccagcagttgggaggccaaggcgggcagacctcacttgaggtcagatactcaagaccagcttggccaacgtggtgaaaccccatctctaccaaaaatataagaaattagccaggtgtggtggcgcatgcctgtaatcccagctactcaggaggctgaggcaggagaattgcttgaacccgggaggcagaggttgcagtgagccaagatggtgccactgcactccagcctaggtgacagagcgagactccgtctcaaaaaaaaagaaaaaaaaaaattcctcttgactccacatcctccaccatcttcccatttctctgttcctcttcacaacaaaattgttagaattctctatattgtctattctccctgacctccaatccttgctttttctcttgaacatactgattatactttcactgccacccctccatagaaactgctagtcaaggtcaccaacaacctccacattgctaagaagaatgatcaattctcagtcctctcatcttacctgacctatcaacagaatttggcacagctaaacagctccctcgctacctcacttgacttacgggatacctttttttttttttttttttttttgagtcaaggtctctctctgtcaccctggccagagtgcagtggcacaatcatagctcactgcagcctcaaaatcctgggctcaagtgattctcctgcctcagaccccaagtagctattccaagtagctagaaatacaggcatgtgccaccatgtccaattttttttcactgttttagagacagggtctcactaggttgcccaggctagtcttcaagtcctggcctcaagcaatcctccgacctcagactcccgagtagctgggatgacaggcatgagtcaccgtgcccagctctgggactcctctcttgattgttcttcctcactggctactaccctctgtctcctttgcaggttctttccttcctccatgacctttaaatactggagtgacgcagggtacccggacctcttcctttttctatctacactcagttcccaaatgaccagatccagtcttacggctttaaatttcatctaacattgatgattcacaaatttctatcttcagatagagactagctgagacctctttctggaacttcagattcacatatctaaatgcttacttgacatactgactggattgtgtaatagataggcacttaacatgtttaaaatcaattcatctttgcccactgccccaaatctattcttcctacaggtttcatttcaaaatatggtaattccaaagagaaatatttaggccaaaaatctctacccatccttaattgctttttctctcaaacccctcatgtccatttggtcagctaagtttgtcagctttaccttcaaaatgtatgcagaatctaaccagttgtcattactctgacagctattagatccaagtgatgataaatatgtgaatggattattgcaatagctttttttttttttaaagaaagaggtttatttaaaggaattgctcacatgattatggaagctggccagtcccaaaatctgcagggtgggtcagtggcaggctgaagacccaggaagacccaatgttttcattctgctggcagacttgcctcttactgaggagaggtcaatcttttgttctgttaatgccttcagttgagtagatgaagttcctccccaacattatggagggtgatctgcttaactcaaagtccattgatttattgattttttaatatatttaacttttattctaagttcaggggtacatgtgcaggtttgttacgtgggtaaacttgtgtcatgggggtttatttcatcacccaggtattaagcctagtacccattagttatttttcctgattctctccctcttcccaccctccaccctccaataagccccagtgtgtgttgttcccctctatgtgtccatgtgttgtcatcatttagctcccatttatatgtgagaacatacagtatttgattttctgttcctgcactagtttgccaaagataatggcctccactccatccatgatcctgccaagtacatgatctcattttttttttgtggctccatagcatttcatgatgtatatgtactacattttctttatccagtctaccattggtgggcatttaggttaatcccatgtctttgctattgtgaatagtgctgcaatgaagatacgcatgcatctgtctttatgatttatattcctttgggtatatacccagtaacgggactgctgagtcaaatgttatttctgtttttaggtctttgagggatgaccacagtcttccacaatggcttaactaatttacactcccaccaatagtgtataagcactcctttctctctgcaaccttgccagcatctttttttttttttttttgactttttaatagccattctgaatgatgtgagatggtctcactgtggttttgatttgcatttcttgaatgatcagtgatgttgagcttttcctcatgattgttggctgcatgtatgtcttcttttgagaagtgtctgttcatgtcctttacccactttttaatcattttttttctcatagatttgcttaagttccttacagatgctgacattagacctttgtcagatgcatagcttgcaaaatgcaacatgcttctaactggttccttgcttcaaccctcatatctcttccagtcttctcaattcagttgcagggtgatcctttcaaagcctgattcagatcatgtcactcctctgctcaaaaccctttcgtaggcttcctatctccctcaaagcagaagccaaaattttttaaatggtctaaagatccaatttaatttgtcctaaagtcctctctacctctcttccatcgcctaccagtctcctcacttagttccaagaaggaggtacaaaagtttcccttctggtggagattgcagtgagccgagattgcgccactgcactccagcctaggtaacagagcaagactctgtctcaaaaaaaaataaaaaaaataaaaaaaaaagaagtttcccttctgtttctcaaacacaacaaaaatactctttaccttgggacctttgcacttaccattccgcttgacagaacaccctttccccagataattgcatatcttgctctttcacttccttcgtatctttgtctaaacgtaattttacagaagaagcatttcctaaaaaaaacacctatccccccaccaccctctactcacattcagtatcctattttattctcatactcttcttaccacctggtgtactatatatttgttgtgtacatctttccattgaaatttgaactctaccaggaaatagacttatcagtttggttcactgctatatcccagcacgtagaacactagctggcatatagtaggtgttcaataaatatttgtagaattaattccctgacttatgtgggttatattttacgagcttcaaattgtcccctttctaggccgggctcagtggctcacgcctgtaatcccagcactttgggaggccaaggcaggcagatcacttgaggtcaggagtttgagaccagcctggccaacatggtgaaaccccgtctctactaaaaaaaaaaaaaaatacaaaaattagctgggcatggtggcacgctcctgtaatctcagctactcaggaggttgaggcaggagaactgtttgaacacaggaggtggaggttgcagtgagccaagactgtgccactgcactccagcctgggtgacagaccaagactctgtctcgggaaggaaaaaaaaaaatcaaaaaaattagctgggcatggtggcacgtgcctatcgtcccagctacccaggaggctgaggtgggaggatcacctgagtctaggaggtcgaggctgcagtgagccatgatcacagcactgtactctagcccgggcaatcaaacaataagctgggtatggtgggacacacttgtagtcctagctactccagaggcactccagcctggccaacagagtgacactctgtctcaatcaatcaatcaatattaaaaaattagctgggtgtggtgggacacacctgtaggcctagttactctggaggctgagatgagaagatcacttgagcccaagtgttcaacactggagtgagctagaatcgtgccactgcactccagtctgggcaataaagagagacccccatctcaaaaaacagatgtaacaaaaaacccacaacattttacaatttggaaaaaaaaaaaaagaattgcttttatattcattactcacaaatgcatacattttaaattttcccattacaatttttgtaatgaaagaattccatgtcttaatatgtataactgcaaaatttatatgtataaatgaagaatttcagcatttttccaaagaattctttttttttttgaaacagagtctccctgtcacccaggctggagtgcagtggcgtgatctcggctcactgcaacctccgcctcccgggttcaagcaaagaattcattttttatctgcacttaattccctttcaaaacattacagagaaaggtctgacagaaacatgattctcattttaaaaatgaaaaaaaattataaaacttaatccaagtgacacatattattacataaatagcagagtaccaataaactgaaaagagatttgaaaacatttatttccccccctaaaaatgtatatgagaagagagaaatactacatttccctaacatgatcaaggagaaaaacgaacagtatgcttacaggcatattttgagaatccatttaggtagtaaaactggaaaatcatgattggcaaaccccacataccaaatttaagagtttctagtcaagataaacccaaattctgaagatatttcacaacagagtgctttttatctgctgaatgtaaactgcttgaaaaacagtccctacagcagctgccagaatgctgttttttgaactttcaaagcaatgttcattgagaatatcattctttcagcttttggaaaaatatctaaacaatctaggttttccatccaggggcaaggatgccatgttgtaacacaacttattttggtttctactacaatatattcaacttaaaatacatttccaaggaaaaacacagacctaagattgctagaatctcttcactcaaacaggcaaactcaatattcatctcacatgcaattttgggatttatgttttcaaatctctggaacaatgtgggacagtctggtccaaattcaaaggaaagtaacactgtacctacagcattaaatacttttgcacaaatcattacagcattaagtaaactctttagaaaattactaaccatatgttttttaaaaaggaaattactaattatattaataggacatatacattgtataaaaacaaagtatgataatctaacaatatgttaaaaactacctacaaatttacaaatacatattctctacaaaatgaagacctctatccaccccaacacctgccattctaatcccacatccaagtaacaaacagtggatctgataaaaattaactaatacactgttattaatatagtggtctgggctgggcgtggttgctcatgcctataaatcccagcactttgggaggctgaggcgagtggatcacctgaggtcaggagttcaagaccagcctggccaacatggtgaaactccatctctactaaaaatacaaaaattagccaggtgtggtggcaggtgcctgtcatcccagctactcaggaggctgaggcagaagaatcacttgaacccaggaggcacaggttgcagtgagccgagattgtgccactgcactccagcctgggcaacagagtgagactctgtctcaaaaaaaaaaaaaaaattatatatatatatatgcacacatatatatgtgtatatatatgtatatatatatgtatgtatgtatatgtatgtatgtgtatatatgtgtgcatatatatgtgtgtgtgtgtatatatatatggggggagagagagagagagagagtgtgtgtgtgtgttggtggcgaaggtctggtctgagatacagaactactctggaagacaactatgtttggaaatcattttatatgtaaataccccatctattttcaggggtagaaagggaatagccatgctttgatggaacactattcagcaaaacaatataaaatcaaccaaattttttaaagtactacaaatgagtcctcacagtgaatttagcatcagtaaaagtaataaaatacttactgagttcttagcatgtacaaagctctatgccaaatgttttacatatattatctcatttaaggctcacaatcagcatgcggtagttactattattattccctttttagacatgaaaagacaggctaatggccaataaaaggcagaaacaggtctgtttcgctcctcttaaccactatgctttgctgcctcccaaagatcatctttaggctgggcgtggtggctcacacctgtaatcacagcactttgggaggccgaggcgggtggatcatgaggtcaggagtttgagaccagcatggccaatatggtgaaaccccgtctccacttaaaaaaaaaaaaaattggccaggcgtggtggtgtgcacctgtagtcctagctactcgggaggctgaggcagaagaatcacttgaacctggcaggcaaaggttgcagtgagcccagatcgcaccgctgcactccattcagcctggatgacagagcgagactccgtctcaaaaaaaaaaaaaaaagaaaagatcatctttagtctcgatcttattatttctctctgctacatttggcatatttgctacgtttgaaactctttggtttctatgatacattctactggttctcccaacacctctccaaccatttcatcatttcctttatggattcatcattcttaatctattccttcattcattcaacaaatgttttctgagagcctcaaaatatgttttgagaattgtgacacacactgtagataccgtcatgagtaacacaaacatggtccttggtctcatgaactttaagtgctttctttcctttaaatttttttattattatttttatttatttatttattttctgagagttcccagctgcttgagcccagaaggtcaaggctatagtgagccatggtggtgccattgcactccacgctggaaacaggccgagatccaatctcaaaaaagaaaaaaaaaaaaaatttggaattcacaaagaaggtattaaagggctctgagaaggacaataacaagatacaagcctacattttgagaaacatctgtttgctgaggaaggaagattattccaaagacagcaaaagttggttctggaataccagtcatatcagcatactagattaggatggtaacaatggaaatagagaaaaacgggtggatttaagagacatgttagatatttgtcaatataatgtgagaggatgagggtggaaaaaactgaagacttgaccaaatggtaaatggtatggtggtaccatttggagactcattcaacaaatatttaccaagttatatatcaagaactggagatacaatagtacaaaatatagacaaaaacccttgctttgtggggccaatattctagaagtatgccaggatgagacagaaagggaagatcaaagggttcagtaataagtacattaaattttaggtacctgtgaaacatttaagtggaaagtcaaagagagagctgaaaatatatgtatatgctatatacagagggaggcagtgtaacaacatacaaatgaaaaagttaacggaattttataagatttttagcctggaagaacaatgaagaacaattctttttctttttagataagtaaacctatttaaaattgccatgttatagattaaacaatgcaggtagattgttagcttaaaacaagtaaaatctggccaggtgcggtggctcatgcccataacctcagcactttggcaggccaaggcgggtggatcacctgaggtcaggagcaagaccagcctagccaacacagtgaaactcttttctctactaaaaatacaaaaattagcgggacatggtggcacacgcctgtaatcccaactactcgggaggctgaggcaggagaatcgcttgaacccagaaggcagaggttgtggtgagccaagatcgtgccattgcactccagcctgggcaacaatagtaaaactccatttaaaaaaaaaaaaaaaaagtaaaatctaacttgtcttatctgaggattttttttttttttaagactgggttttgctctgttgccaaggctggaatgcagtggcatcttcttagctcactgcagcctcaaactctggagctcaaatgattctctcacctcagcctcccgcgcagctaacagggggcaagccaccatgcctgctcatctacaaggaatttttgttttcctttgtgatctttattaaacatggctagagactttttatttctaaacattacaacattatttcttaacattaaaaaccagttataggctgggtgtggtggttcacgcctgtaatcccaacactttgggaggccaaggcaataggactgcttgaactcaggaacttgaggcctcagtaagctaagaaaatatcactgcatttcagccttggcaacagggcaagaccccatctcttaaaaaaaaaaaaaaaaagtataaattagcgacacaagattttatttaaaaatgtatagcacattaggccaggcatggtggctcacacctgtaatcccagcacttgggaggttgaggcaggcagatcacccgaggttgggttgggagtttgagaccagcctgaccaacatggaaaaacactgtctctaataaaaatacaaaattagccaggcgtggtggcgcatgcctgtaatcccagctactcaggacgctgaggcaggagaatctcttgaacctgggaggcagagattgcagtgagccgagatcgtgccattgcacgccagcctgggcaacaagagcaaaactccatctcaagaaaaaaaaaaaaaagaaaaaaatttatagcacattattcatttaaatttgtgctgggcttcagactctttaaaatttccacagataaccatcatatttcttaggatatatcaaactagctaagtaatcacatacccaggaaatggaggttctagtcaagccaaaaagtaagtgcgaaggtcttgaggtggaagtatttttgttgtgtttcagaaatagaatggagacctttgcccaacccggcttcctggaactgaatgagtacgcagactgagagggcatgcaggacttatacagagggccttgcagacttataaagactttagcttttactttgagacaggaagccatcaaaatggttttaagaaatgacatgatctgactcaggccttgaaaagatcatctgctactgaattgagatgacaaatttttggcctaataacttgttatcatccttgactccttcctttatctcaaatcctacacacgcagtctgtcagcaaaatctgtcagctttaccttcaaaacatatgcagtcatttctcactactcaacagctcccatatatgaatacgctatgtctgtcaaaagtagaacccatgcttttaatacttctacataatgagggaggctaatccaggatgactgctcaagcccagaagttcaaggctgcagtgagctatgatcatgccactgcactccagcctgggtgacagagtgagaaccagtctctaaaaaaagttaaaagaaaaaagaaagaggccaggcgcagtggctcatgcctgtaatcccagcactttgggaggctgaaatgggcagatcacaaggtcaggagatcgagaccatcctggctaacatggtgaaacctcgtctctaccaaaaatacaaaaaaaaattagccgggcgtggtggcgagtgcctgtagtcccagctacttgggaggctgagacaggagaatggtgtgaaccctggaggcgaggcttgcagagagccgaggtcacaccactgcactccagcctggcgacagagcaagactctgtctcaaaaaaaaaaaaagggaaaaaagaaagaaattcaacacagaaaggcaattatttatcaaatgttatcaaacaaacccaaagaagtcaaaactccctaaaacatgcctgcagtgcatttgctgcctagagtttaaagctgatagactttaagattaagaggtaatttcaagggattaaatattacaatgattatatctgaaaaccaaaagcttgggcattattcactcactgaaacgaatttaaagaaacaaacaagaagagtatttgggtatcctgggagtgtttttcaaactccactaacatttatctatcttagtcctactaggcgccatacactatgccaaagtggtttcacttattgtctcatttgtttcattctgacaataatcttattagatttaactaatcacattttatagatgggcaaacaggcttcgaaacgtgattaactctaagactgtaaaattagtaaatagaagaacttggattgaatgtaatcttctcactccaaatctactacaggatatccatctgcaagaaaagaactcagacccttacctcacatcatacacaaaaattaactcaagtggatcacaaatctaaattcgaaaacgaactataaaattcctaaaagaaaatgtagaaggaaatctttgtgactttgggttaggcaaaatttcttagatatgacagcatgattttttttttttaaaaaaagctggtaaactgaacttcaccaaaactataaacttctgtccttcaaaaaggcagtactaagaaaatgaacacaagacacaaactactacaggttactgtgatagtacacattcctgccacctctctggaagccactcctgagtcttatctgctgatctgatttggcctaccagacttccagatgttggaattccttaggttcagtcagtcttttctttctctaaaatattttggcattttttaaattttttaatttttatttattttttatttttatttttggagatggagtctcactctgtcacccaggctggagtgctgtggcaccatcttggctcactgcaacctctgcatcctgggttcaagtgagtctcctgtctcagcctccaaagtggctgggactacaggtgcgcatcaccaggccaggctaatttttgtatctttagtacttatattttgcattttggagatggggtttcaccattttggccaggttggtcttgaacgtctgacctcaagtgatctgtccacctcagcctcccaaagtgctgggattacaggcatgagctatggcacctggcgtttttttgtttgtttgtttgtttgtttgtttttgagatggagtctcactctgtcacccaggctggaatgcaatggcgcaatctcggctcactgcaacctctgccttctgggttcaagcgagtctcctgcctcagcctcccgagtagccgggactacaggaacgcaccaccacatccggctaattttttatattttcagtagagacaaggtttcactatattgaactcctgacctcgtgatctgcccgcctcggccttccaaagtgctgggattacaggtgtgaaccactgtacccagccttttttttttttttttttttttaataaagacggctctatcatctggcctggggtacagtggcataataatagcttactgcagcctccaactcctgtgctcaagggatcctcccacctcagcttcccaagtaatagggaccataggcatgtgccactgcacctggctcctactctagattctttccctgtgtaatttattatactacttaagacttttaagctccagacagtatatctgaaacctggttcaatatctttacaaagtttaatcctcctccaatctttcccatttcagtaccaccaattgctcaagtcagagctactactagtcaaactactacaggttactatgatagtacacattcctgccacctctctggaagccactcctgagtcttatctgcagatctgatttggcctaccagactcccagatgttggaattctttaggttcagtcagtcttttgcttctctaaaatcttttggtatctttttaattttttaatttttattttttattttttgagatggagtctcactctgtcacccaggctggagtgcagtggcactcatcctgactattctcactcccttattgtcaaccttcaacctaacaccaaaacttctgaatgtcacataaataatctgtgattacatagagttcctctccaattctcccactgacttgtccaaaaaaaccaacaattctcacccagaatatagcaacagccctctaacttctttgtacatctaccttgctctcctccagcccaagctacatccagaaaggtgttttattttatatatatatatatattttgttcttgttctttgagaaaaaatcttgctctgtcacccaggctggagagcagtggcacgatcatagttcactgcagtcccaacctcctgggcccaagcagccttagcctcctgagtagctgggactacaggcacacaccaaccatgcccagccaattttttatttttgtagagacagcatcttgctatgttgcccaggctggtctcgaactcctgggctcaaacgatcttccagcctcggcctcccaaagtgctgggaatgcaggcgtgagccactagagattgtttttctcaaaggcccagtggctcatgcctgtaatcccagcacattgaggccaaggcaggaagatcgcttgaggccaaggcaggacgatcgcttgagcccaggattttgagaccagcctgggcaacacagcaagacctcatctccactaaaaataaaaaataaaataaaaaatcagctaggtgttgtggcacacccacctgtagtaccagctactcaggaagctgaggtgggaggattccttgagcccaggaggtcaaggctacagtgagctatgattgcaccactgactccagcctgggtgacagagcaagaccttgtctcaaaaaaaaaaaaaattctgataatgtaatttccctgcttaaaatctttgaatgttttctcactgcccttcatatataaaagtccctaatcacactcataacttgcaacttacaatctgcagcatggtttggtggttaagaatatagtctctgaagccaaaacacagtctcagaagctagtcctgctatattaattttgtgcaaagtactcacggcctcagttctctcaaatgtgaatagaaattgttgtaagggttcaataaactaatatatgaaaagtacttagaacagcacttcacagtatcactgtttactttttgttgttgttaactgcccctacatatctctggcctcaccattccccacactgttgtgagcagagcaagagcaaataaccaccaccaaaaaaaagcaagcactcagctgggtgcagttactcaaacctgtaatcccagcactttgggaggccaaggcaggcagactgcttgagtctaagagtttgagatcagcctggcaacacagcaaaaccccatctctacaaaaaatgcaaaaattagctggatatggtggctcatgcccatagtcccagctacttgggaggctgaggtgggaggatcgcttgagcctgggaagtcaaggctgcagcgagctaagatcacaccactgcactccagcctgagtgacaacacgagaccctgtcttaacaacaacaacaacaggaaacaacaaaaaagcaaacactcatacatctgtgatacatgtgtttgaagcacttttcagttcccaaataactgttttccctcctttagaacatacagttagttctctctgcctggaactctcttccagcatctttccatatgactacttctcttcctttccatcttagtttaaaagtcattccctcggggagacatttcctattcccctagacttgggaggctgaggcgggaggatggcttgagtctggcagatcaccctgctaagtgcatatccatactataagtctcttaatatgcattataccaattaagttatttaatatccatatcttccactagaccatgcattacatgagaataaaaatcctgtttgctgtattcactgctacatccttagcaaagcacctagaacataaagggcattcaaaaaatatctattgaatgagtaaacaaacattaattctacattttaaaacgtgtatatagataaaagagaataggcaaaatgaaacttaaaatattaaaaattgatatttttctttaaatattatataaatttttcagtttctataatttaaaaaataagcactatatacaccatgtaatgtgctttccaaaggtaaaagagtaacccatgccctaattagtttgaagatattttacatgaaactactaagtcactaatattatataagtcactaaaatcacaaaaaaattagaatagcttcatgaagttaccaacaaaattggaagcaatttctacaatataaactatacttacaaagttagacaaattttttactcaactatagaacccttcactgaaaagatgacaatcagtaaccatttctaactctcaaagtactgatatccaataaatctagttagtttcatatttatgtactctatatatttcttcaatttcaagaagctgctgattttaagaagcttcatgaatcaataaccatatttttaggggtgagggagcactactagattaaatgtaaacatcaattatgttatttcctaattttagaaatattaaactgggaggaaagtatgcatctcatgaccaagaaaatactgtattataccaacaagtccttctagaaacttagaacaggaaagtgaaatagacataaatttccaattaccaagtcacaaggggaaaagtaagccccagaaagcagtcccaaggctaaaaatcttgatggaaaaattatactcagactgccatacagattatccaatcaaaccttacttagcttacctgaatagcaaagttaacgtagatcaaaaatataactgcaattctgttttgttaaaaaagagggggagggggataggaatgtaggattgtgtttccgagaaatatataggaacactgatctcaatctttagggaattctaaaatgacaacaggaagaaagttcaagttgtatcagaaagattttcccattaataaattattacattttgggccacgcacggtggcttacgcctgtaatcccagcactttgggagtctgaggcgggcggatcacgaggtcaggagatcgagaccatcctggctaacacagtgaaaccccatctctatcaaaaatacaaaaaattagccaggcgtggtggtgggcgcctgtagtcccagctacttggaaggctgaggcaggagaatggcgtgaacctgagaggtggagcttgcagtgagcccaggttgcgccactgcactccagcctgggcaacagagcaagactctgtctcaaataaataaataaataattacattttggcgatgattacagcctgtcaactgaaggccactgaacatgcttatattttaaacaaaagagccacttctaagaaggcaaaattcatgctgtaattaattaattaattttttttttttttttgagaaggagtctcattctgtcacccaggctggagtgcagtggtgcaatcttggctcactgcaacctccacctcccaggttcaagtgattctcctgcctcagcctcctgagtagctgggattacatgtgcccgccaccatgcccagctaattttttgtatttttagtacagacagggtttcatcatgttggtcaggctgcctgacctcaggtgatccacctgcctaggcctcccaaagtgctgggattacaggcgtgagccaccatgcctggccaaaaccattaaatcttacaccttgttattactttttttttaaatattttaacggcactgtgtggctgctggggaaaaattgtacactttaaattactatatatgaattatatctcagtaaagccacctaaaaatcctggaagatcaaaattaagtatcttgtagaaggaaatcctttcctattttgcataaaaacaaaatatggattagtggcagtcctgtgaaaatgaaaacccttttcaattaatagatttcagtcagccgggcgtggtggctcatgcctgtaatcacagcactctgggaggccaaggcaggcagatcatttgaggtcaggagttcgacaccagcctggccaacatggtgaaactctatctctactaaaaatacaaaaatcagccaggcatggtggcaggtgcctgtcgtcccagctacttagagggtgcagcaggaaaattgcttgaacccaggaggcagaggttgcagtgagccaagatcacaccactgcactccagcctgcatcacagagtgagactctgtctcaaaaaaaaaaaaaaaaaaaaaagatttcagtatgacaaggagatgatttatttgatatatgtggctatatgttgacataactggatatccgttggcagaaaacaaagttccacccattctttgcatcataaacaaaaataaggctggcatggtggctcacatctataatcccagcactctgggaggctgaggtgggagggtgacctgaggccaggagttcaagacaagcctgggcaacatagtgagaccccatctctacaaaaaatttaaaaattagctgagcctggtgatatgcacctgtagtcccagctacttggcaggggctgaggtagaagaatcaattgagcccgggaggttgaggctgaggctgcagtaagtcatgatggtgtcactgcactccagcctaggcgaaagaacaagacctatctcaaaaaaaacacaacaaaacaaaaaagcaatttcctcatggatttattttttatttttatttttttgagacagggtctttcgatgtcacccagactggagtgcagttgtttgaacatggcttactgtaccctcaagctactgggctcaagcaaggggtgtctcactatgttgcccaggcttgtctcaaactcctggcctcaagcaatcctcccacctcggcctcccaaagtgctgggattacaggtgtgagccactatgactagccctactcgtggatgtaaacactacatacaaaagtaaaagtatctgaatgttcatgactatttctataacctatggtggagaaacccccttttttttttttttgagatatagtctcactctatcacccaggctggagtacagtggcaagatctcggctcactgcaagctctgcctcccgggttcatgccattctcctgcctcagcctcccgagtagctggaactataggtgcctgcaaccacgaccagccaatttttttgtatttttagtagagatggggtttcaccgtgttagccaggatggtctcgatctcctgccctcgtgatctgcccgcctcagcctcccaaagtgctgggattacaggcgtaagccaccgtgcccggccgagaaacccttcttaggcaaatcaggaaactaaaaaccataaagaaaaatagtgacaagtatgattatgttaaagcagtatatatctgtagactaagacattgtaaataaaataaaaagacaaataagattgggagaaaatataaacatgaaaaaggattaatatatcttaatataaaattatcttaaataagatatacaaaaaatatgcataggcaattacaagagagataaaaataacaaatataaaaagatataccacctcattagtatagtcagggaggtgtgaataaaaacaaactattggccgggcgcagtggcccacgcctgtaattctagcactttgggaggctgaggcgggcggatcacctgaggtcgggagttcgagaccagcctaaccaacatggagaaaccccgtctctactaaaaatacaaaattagccgggcatggtggtacatgcctgtaatcccagctactcgggaggctgaggcaggagaatcgcttgaacccgggaggcagaggttgcggtgagccgagatcgcgccattgcactccagcctgggcaagaagagcaaaactccatctcaccaaaaaaaaaaaaaaaaaaaaaaaaaaaaaaaagctatgttttacttatcaatttggttgaaattcaaaatagcaagtaatactgataatgtatggtaaatgggcactagtggccaccatcattttagaaagtaatatttatactatccattacaaacttttacattttacatactctttgactccaaaagtaatcctacttttgagactcctatagaaaaataaaagtaccaataaaaagatttattatatgaagatttccttcatactgaccaaaaatattttttatacacacacacacaaaatatatgtctgctatttcttagttaaaagcaagcaagatctcatatttggaaagagtaggacaaaaatcctatatagagaaaaaattatgaatgattacacaccaaattgatagtgctagtcatttaaaggagaaaggtttggaaggaaaaaaaaaaaggaaaaaaattatatatacacatatatattcctattacagaatttgcattagttttacaataaaacaaaaatccattaaaaacttattttaaaaagatttgaggccaggtgcagtggctcatgcctgtaaccccagcactttgggaggctgaggcaggtgaatcacttaaggtcaagagtttgagaccagcctggccaacgtagtgaaaccccatctccattaaaaacataaaaattaggctggatgcagtggctcaagactgtaatcccagcattttgggaggccaaggcaggcagatcactagatgtcaggagttcgagaccagcctggccaatgtggtgaaaccccatctctacttaaaatacaaaaaaactagccaggcgtggtggcgtgtgcctgtaatcccaactacacaggagctgaggcaggagaatcgcttgagcctgggagatggaggctgcagtgagctgagatggtgccactgcacgccagcttgggcaataacacgagattccatcaccaaaaaaaaaaaaaaaaacaaaaattagccaggtgtggtggcatgcacctgtggtcccagctacgtggtaggctgaggcaggagaatcgcttgaactcaggaggcggagcttgcaatgagccgatatcgtgccactgcactctagcctgggcaacaaagcgagactctgactcaaaaaaaaaaaaagaaattattgcattaccataatggtaaaggggaaagggaggtgaacaggtgacagtgagtaaagatttgcttatatcgtcatctaaccactagcattccttacatgagtttatttccacttttaagagcactctgggttgggcgcggtggctcatgcctataatcccagcactttgggaggccgaggcgggcagatcacgaggtcaggagatctaaaccatcctggccaacacggtgaaaccagtctctactgaaaatacaaaaattagctgggcatgctggcacatgcctgtagtcccagctactcgggaggctgaggcaggagaatcacttgaactcggggggcagaggttgcagtgagctgagatcacgccactacactccaccctggtgacagagcaagactccgtctcaaaaaaaaaagcactctggtaaagaacaggtaaacaacgcaactgtcattccatgattttcataattaagacacttatataacaaagaatattggcctacaatccaaagtgccagtgaaccccttacattcacattttatgtgcatatatacactttctgggaaagactacaaaggtttcatcacattcttttttttttttttttttttttttttgagatggagactcgctctgtcaccagggtggagtgtagtgacgtgatcttggctcactgcaacctctgcctcccaagttcaagcaattctcctgcctcagcctcccgagtaactgggactacaggcatgtgctaccatgcccagctaatttttgtatttttagtagagacagggttttaccatgttggccaggatggtttagatctcttgacctcgtgatctgcccgccttggcctcccaaagtgctgggattatgtttcatcatattcttaatgagggccatgactactcaccacaactaccatttaaaaaaaaaaaaagttaaaatcctctgaagacacatgcacatgtgtttctgtttactgcagcactatttacaatagcgaagacatggaaccaacccacatacccatcaatgatagactggataaagaaaatatggcacatatacaccacagaatactatgtagccataaaaaggaatgagatcggctcggtgaggtgcactttgggaggctgaggcaggcagatcacctgaggtcaggagtttgagaccagcctggccaacatgtagaaaccttatctctactaaaaatacaaaattagccaggtgtggtagcacatgaccgtaaccctggctactcgggaagctgaggcaggagaatcgcttgaacccgagaggcagaggttgtggtgagctgagatcatgatgttgcactccagccagggcaacaagagtgaaactcagtctcaaaaaaaaaaaggccaggcacagtggctcatgaagtcaggagattgagaccatcctggctaacagggtgaaaccccgcctctactaaaaatacaaaaaaattagccaagcatggtggcaggcgcctgtagtcccagctacccaccagaaggctaaagcaggagaatggcgtgaacccggaaggtggatcttgcagtaagccgagatcgcactactgcactccagcctgggcgacagagcgagactccgtctcaaaaaagaaaaaacaaaggaatgagatcatgtcctttgcagggacatggatgaagctggaagccatcatcctcagcaaactaacacaggaacagaaaaccaaacaccgcatgttctcacccataagtgggagttgaacaatgagaacacatgaacacagggaggggaacaacatactggggccagtcagtgggttggggggcaaggggagggagaacctgaggacgagtaactaacgcatgtggagcttaaaacctagatgatgagctggatgcagtggctcacgcctgtaatcccagcactttggcaggccaaagtgggtggatcacatgaggtcaggagttcaataccagcctgaccaacacggtaaaaccctgtctctactaaaaatacaaaaattagccgggcgtgtttggcacatgcctgtactcccagctactcgggaggctgaggcaggagaactgcttgaacctgggaggtgggggttgcagtgaacctagatggcaccattgtactccagcctaggcaacagagccagactccgtatcaaacaaaagagagataaaaaatagacattcattcaccaaccattttacatttgtctctacatcttgactagttagtacttgttagagtttcttagccaggaaggtgttagtcctcaaattatcaaaagattctcttttagttctggtattctagataaatttctcccagtatcaaaaatatttatccagcaactcagtctaagaacttcatcttttctctatctacactcactctctgggtaatttcatcaagttctttggctctaaatagcatcactatgctgctcagctcccaagtttatatttgccctgacctcaagacttgtacacccaactgcctattcaatatttcaactttaaacacttagtagaaatctcaaaccctgtacagtcagccctttgtatccatgggtttcacatacgaggattcaaccaaccacggatcaaaaatattccaggggcaggggtggaagaaaaggataattgtgtctgcactgaatatatatactttttatgtcattattctctaagcaacacagtatatttacatagcatttacattgtattaggtattataattaatccagagatgatttagagtatacaaacagggaggtcgagacgaacctgggcaataaagcatgactctctctctacaaaaaccaaaaaaattacccgaatattgtgtcgtgagcctgtaatcccacctacgcaggaagctgaggtaggaaaatagctttacctgaggagtttgaggttgcagtgagctatggccatgccactgcactctagcctggataacagagagaccctgtctcaaaaaaaaactttttggccagacacagtggctcacgcctgtaatcccagcactttgggagtccaaggcgggtggatcacctgaggtcaggagttcaagaccagcctgggcaacatagtgaaaccccacctctactaaaaatacaaaaattagccaggcacggtaatccctgctacttgggaggctgaggcacgagaatcacttgaacccaggaagcggaggttgcagtgagccgagatcgtgccattgcactccagcttgggtgacagagcaagactcagtctcaaaaaaaaaaaaaaaaaaaatttaagtatacaagatgatacacataggttatatccaagtagtataccattttatataagggactggcacatccacagattttggtatcctcgggggaaccaatctctcacagataccgagggatgactgtatatccaaaccaaatccctcatttctgtactccttataatttgcttttcccacagtgttcctcatcaaagaaaaaagcatccaactgctcaggccatcactgaagtcatccttgactcctcttttaccctgatcccacatccaaaccatcagcaagttattatctccactacctccaaaatatacctcaaatccacccaccagtacactcaacaccacaatcagctgttgcctcaactatcacgatagcctctttttttttttgagacagagtctcgctctgttgcccaagctggagtgccgtggcgtaatctcagttcactgcaatctccacctcccgagttcaagcaattctcctgcctcagcctcctgagtagctgcgattacaggtgtgcaccaccacgcccagctaatttttgctttttagtagagatggggtttcaccatgttggtcaggctggtctcaaactcctgacctcgtgatccacccatctcggcctcccaaagtgctgggattagaggtgtgaaccactacgcccagtccacgatagcctctgaactggtcaacctggttgcattattcatctttcaaagtgcatatatcagatcaagtcatttccctgcttccaatcaaacttgaaatacaaaactagatacctatcaagtctttaagtccctatgttatctggtccctggctacctcttctatctcctatcactattcccccctttactgttttagcccttttctattccttgaacacaccaacaggtactcctgtctcagggcttatgctcatgccccagatagttgcactgggtccttcatataattcaggtatctcctgaaatattagtgcctcagaggacttccctaactacccaacatcccttaccttgtttatacttcctttaccacatctatcatcaaaatgctaggacatatttcccatttatttaatattgtctatcttactcaaaaggaagcactatgaaagcaacaacttttatctgttttattcactgttgtatactctgggcttaatacagtacttgacataaagatccagatgggatctcatcttgttgcccaggctagagtgcagtggtgcaatcatggctgactgcagcctcgacctcctgggctcaagaaatctactgctcagcctcccaagtagctgggactacaggtatgtgccacaatgcctggctaatttttaaaatttttttagagacatggtctcactatgttgcccaggcggtctggaactcctgggctcaagcaatccccccacctcagcctcccaaagtcctgggattacaggggagagccaccatgcccagcctttatttatttgactctttttttgttttgtttttcactttcttcctgcagcattttatttgattcttaacagatgatttaatccactgatatctcaaaggactaactatccaatggaatgcctggatgaaacataggcacacagtatcttttcctcgggggggaaaaatttttgtcacataattgattcactttagcagaaaaataatcatataccaggaatttcttcaggaatcttgagtctatcttaagaatctacggccgggcgcagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagaatcttgcaggccaggagtgttggctcacacctgtaatcccagcactttgggaggctaagacaggtggatcacaaggtcaagaatttaagaccagcctggccaacatggtgaaaccccgtctctactaaagataaaaaaaaaaaaaaattagccgggcgtggtggcgggcgcctgtaatcccagtgacttgggaggctgaagcaggagaatcacttgaacctgggaggcagagattgcagtgagccgagatcatgccattgcactccagcctgggcgaaaggttgagactccgtgtcaaaaaagaaaaagaatcttgcttgaacaacacgtaatatactggctaacagtatgttatatcagtactaaaagatctatatcgaaaaaagaaaatgcccaaattattaagtcctaagacagcaaagcagggatcttgttttgtccatcactgtatcccagtacctagaatagtgcctggcacatagtaagcactaaataaatatatgaaggccgggcacagtggctcacgcctgtaatcccagcactttgggaggccaaagcaggaggattacctgaggtaggagttcaagaccagcctggccaacatggtgaaaccccgtctctactaaaaatacaaaaattagccgagcgtggtggcgcatgcctgtaattccagctactcgggaggctgaggcaggagaattgcttgagcccaggagacggagtttgcagtgagccgagatcgcgccactgcactccagcctagccgacaagagtgagactctgtctcaaaaaaaacaaaaagaagttttgatagaaactacaacagggtggtgtcatgcactggtagtcccagctactcaggagactgaaacaggagaacggcgtgaacccgggaggcagagcttgcagtgagccgagatcgcaccactgcactccagcatggacaacagagcgagaccctgactcaaaaagaaaaagccaaacacgaaaacctaggctaaaatgaagagggaaaatacgaaattggaattcacatgtgagaaaagataaatagtatgctaaaaattgaaaatggaaaaaatatgtatacaaataaggacattgcttatatacacttcaaaagtgtattttacatattcttacctatgagggaagtaatctgctttgctatattcttttttggaaatgaagaaaataaataactaaaataataacaaatacacattatttgcttgctgcatggcacacattatgctaaacacattatacatatcatctcgtagaatccgccaactctatgctataaatattatcattactatatcaccatattttacagtcaaggaaaccaaagattgtaagtattttgctcaaaattacagtcaataagttagcaaaactcagatctgagcctaatcaatctgatttcagagtctatgatcttaatgactatttgggattttcaacaaattgaggggaaatataccaatgcagatgctgagagattcattcattattaagacaactaattatacatttttagatctggctagatacttattataatcaaggcctgattaactagaatgctgagtgggttacattctagtaaaaattttctgagtaactaaaatataaccaaatattttattgacattaatctttgctagaaattacttttataacaatagttttttgtctaagaaaagtattttgaacatatttccatctttatttgatagaagatatctaattacaaaggccaaccttatatagcactgaagacacaggaaatcataagagaatgggttgaaaatttaccgatccaaattacagtgcactcatcctgctgtgtcatacgttcatacgtttgcagatgatctccctctacctagaacgccctctcttaagtctgaatgtctcacacttatcctttaaagcctggctcttcccacttgtaggaagccaccctaacctttcctttctcaccacagattgaataacttccccaccttggacaaaaacattacatagtatgtatcgtagtatgtttgttaacataggcaaatgtattacataatattactgtaatatgtttgttaacatgctcctcctattagaatttttttttttttttgagatgaaatctcactgtcacccaggcaggagtgcagtggcaagatctcggctcaccgcaacctctaccacccaggttcaagcaattctactgccacagcctcccgagtagctgggactacaggcgtgtgccactacgcctggctaatttttgtatttttagtggagatggggtttcaccatgttggccaggctggtctcgaactcctgacctcgtgatctgcccacctcagccactcaaagtgtaagccactgcgcccggcccgagtttttttttttttcctttagagacagggtctcactctgtcacacaggctggagtagagtggtgcgattacagtttactgcagcctcaatctcccaggctcaagtgattctctcacctcagcctcccaagtagctgggaccacaggtggatgccaccacacttggcgaattttttttttttaatttatgtatttactttttgttttggagacggagtttcactcttcttgcccaggctggagtgcaatggcacaatctcggctcactgcaacctctgcctctcgggttcaagcgattctcctgcctcagcctcccgagtagctgggattaaaggcgtgtgcccccacacagggctaattttgtatttttagtagagatgggatttctccatgttggtcaggctggtctcaaactcccaatctcaggtgatccacccgcctcgtcctcccaaagtgctgggattacaggcgtgagccaccatgcccagcctgaattttttatttttttagtaaccaggtctccttatgttgcccccaggctggtcttaaactcctgggctcaagcaatcctcctgccttggcctcccacagagctaggattacatctgagatttaaaaaacaaaaacaaaaacaaaaaaaaacactgtatgtcttttccccacacctaagcacagaaatgggtatggtggaagcactggaaaaatgttagtcagtggagtgaggaatgaatgaatacaaaacaaacaaatgaatggcttgttaaagtaaattaaactcagctgggtgtggtggctcacacctgtaatcgcagcactttgggaggctgaagcgggcagatcacctgaaggtcagaagttagagatcagcctggccaacatggtgaaaccccatctctactaaaaatacaaaaatttgccgggcatggtggcatacaccagtagtcccagctactcaggaggctcaaacaggagaatcgcttgaactcaggaggaagaggtgcagtgagccgagatcgtgccactacacttcagctttggggacagagtgagaaaccgtctcaaaaaaaaaaaaaaaaagaattaaagtctgacctacagttatttgactttcttcctcttaaaattaaacacacaggccagtgcagtggctcacacctgtaatgccaacagtttgggaggccgatgcgggctgatcacttgaggtcaagagttcaagatcagcctggccaacatggtgaaacccggtctctactaaaaacacgaaaattcactgggcatggtggctcgcacctgtagtccaagctactcaggaggctgaggcaggagaatcacttgaacccaggaggcagaggttgcagtgagccgagattgcgccactgcactccagcctgggcaacagagtgagactctgtctcaaaaaaaaaaaaaaaaaaaaaatggaaaacaaaaaaatgaaaatctagggactaaaaactagacattttttagcatcttgtcgctatgactaaaaaactgtaagaaaccctttgtttctctcttgtgcatttgaaaaaagctgataagctattctgaatagcataggaactgttctaaatgttcaatgcaaacatcgaaaagcaatgatgtgaactatttacctcatttcttcttagctggcacagggaattccctactgataagtaatatggattagaagtagatggtgtaagtagtttagttccaactatgatcagatacttaaaagttatataaacctaactatgaaggagtaattcctcacttaacagtgaaaagaatttttaaatacttaagtatttatggatgaaattatacaataactggaagatctgctttaaaataagcaagaggggaaggagggacaggggctggtagatgtggaaacagtgtgttaactgtgttgataactgctgaagctggatgttgagtacatgaaggctcattatactattctctttatttctatatatgtttgcaatttgccacattaaagaaataaaaagctgactgggcattgtggctcacatttctcagcactttgggaggccaaggtgggaggaccacatgagtccaagagttcaagaccatcctgggcaacacagtaagactctacctgtacataaaatttaaaaattaaccagatgtggtggcacatacatgtggtggcacatacctgtggtcccaaacacttgagtggctaaagtgggaggatcaactgagcctgggaattcaagttcagtctgggcaacacagccagaccccagctgtaaaaaattataaatataaatatacatatatatacgtgtgtgtgtgtgtgtgtgtgtgtgtgtgtgtgtgtgtatgtgtatatatatatattttttgagacagagtttcactctgtcacccaggctggagtgcagtggcgtgatctcagctcactgcaacctccacctcccaggttcaactgattcttctgccttagcctcccgagtagctgggactacaggcacatgccacctgcgcctaattttttatatttttagtagagacggggtttcaccacgttagccaggatggtctcgaactcctgacctcgtgatctgcccacctcggcctcccaaagtgctgggatgacaggtgtgagccactgcacctggccaaaaatatttttaaatgaacaaaattgcccaggtgtggtagctcatgcctataattccagcaatttgggagtctgaagagggaggactgctgaagttcgagaccagtgggggcaacacggtgagactccatcgctacaaaaaaattaaaaattagccaggcgtggtggcatgtgcctgtaatcccagttacttgggacaatggaaggactgcttgagcccaagaggtagagcatgcagtaagttatgctcgtaccacggcaccctagcctgggtgacatagtaagaccctgtctcaaaaaaatttttttaattagatggaaaaaagtatacaaccttgtcatcaacttgtgtatgtctgagggcaaatgactaaagactatgaaaagcaaatataatactacaataaaaatttcatagatttccaaacatgaaaacttagctgttcaatgaaaaaatacaactctgaaatagcagtaagattattggttaaatttctgtcatcactagaagtcattattttatttatttattttttttttgagacagagtctcgctctgtcacccaggctggagtgcagtggcgcagtcttggctcactgcaagctccacctcccaggttcacaccattctcctgcctcagcctcctgagaagctgggactacaggtgcccatcaccatgcccggctaattttgttttttgggttttttttttgtatttttggtagagacagggtttcaccatgttagccaggatggtctcgttctcctgaccttgtgatccgcccacctcggcctcccaaagtgctgggattacaggtgtgagccaccacgcccggcctagaaatcattattttaaagttaattttgataaatatcacattctgccaattacaggcctgatgaggcagtcactaaaaaagcgatttctaaaacgtgaaatataagactattattaactatgatgacaagcaataagaaaatctagcctcttcatatgaaaaaatataaatgaaaaaacactaaaattaattttaaggaaaatgataacagaaactagcagcatacctcaaaacaaaacaaaaatgaactagttgcatttccacctcttgcggcacccaggtttaaaatactacatgctgctgaaaaggctggcctaagcagatctcacagcagattatagtgaggttgtatactacctttaaaagactcagatcaatacacattattcaaatagcaatacaaagttattttaaatggagaccaccaccaccacaatcttacacatagtaagacttctccactgtgtgcttccacattgtcttgggcagaaatgaaggtggccaattcaatattaataaagcatggaggaagactcagaataaagactcaagtggaattgctaatactataaagacacagtacctagcaagttattaagaagtgatgtgcaggtgcggtggctcacacctgtaatcccaacactttgggaggccgaggcgggtggatcaccagaggtcaggagtttgagaccagcctgaccaacatggcaaaaccctgtctttactaaaaatacataaaaaatagccgggcgtggtggcacacacctgtaatcccagctattggggaggctgaggcaggagaatcccttgaacccaggaggcagaggttgcagcgagctgagatcgcgctgttgcactctaggctggacaacaagagcgaaactctctctcaaaaaaaaaaatttaaaaagtgatgtgctgtattctatttcacaatataactcaagagtagaacatgaaaatccttttcctttttttaaagagacagtgtttcacgctattgcccaggctggagtgcagtagcaccaccatagctcacagcagcttccaactcctgggtcaagtaattcccctgtctcagcctccagagtagctaggactgcaggtgttcattctaattttttaactttctgtagaaatggggtcttcctatgttggccaggctggtatcaaactcctgggcacaagtgatcctcctggctcagcctcccaaagcactgggatcatagggataacccactatgccaggccctaggcccctttttcttttcttttttttttttttttgagagagtcactctgtcgtccaggctggcgtacagtggtggatctcggctcactgcaacctccacttcagggattcaagagatcctcctgcctcagcatcccaactggctgggactaccggcacacacaccatgcctggctaatttttgtacttttagtagagacggggttttgccacgttggccaggctggtctcaaactcctgacctctggtgagccaccctcttcagcatcccaaagtgattacaagtgagagccaccatgcccagcgacatcaaaacctttttacataaacgcactgtagaaatatatcccaaaagaaggtaagaaatataaatgtttgccttcttctcaaaccaatagttcctttatacaaaaacaccagatgaggccgggcgcggtggctcacccctgtaatctcagcactttgggaggccgaggcgggtggatcatctgtcaggagttccagaccagcctgaccaacatggagaaacgctgtctctactaaaaatacaaaattagcagggcatggtggcacatgcctgtaatcccagctactcgggaggctgaggcaggagagtcacttgaacccaggaggcagaggttgcagtgaattgagatagcgccactgcactccagcctgttaacaagagtgaaactcagtctcaaaaaaaaaaaaaaaaagcacaagatgatacaaaacatatttttttaaagtacaaagctgcatacagagtataaacactttatgcttattcaaagagtaagtagtggcaaaaatctctttgcaattgggtaacaaaatttcaacttctaggaatgtttccctcttccttgtccttttgagagctgccaccatcaaacaattcagactcaactgaattagcatctcttcaagcacagagaccatatattattgatttttgtgtctcctgcataggattaactcagtgtttgttataactaagctaaactccaagacaggagcttcaaatcacctcaggcccaatccaaaactgaaaaaagacaaacccacttctcagagtttaggaacaaaaagatactgacaaagaacaaagccatagatacttgtgctatattatattcccttatcaccaaattcagagtcctttactaatactgcagaaataagtttgcagatgataaaaagaataaaaaacatggaccctaaagttctcctgtcaacatgttcaaataccatagactctttcatcttaaactcatactaacatccacacacccgaacaatgaaaatgaaaggttttcaaatgagacctaaatataaattggctctattttattacattttaagttcctaaaatcatatatataaatcatgtgattgtgcttatgctcatcttctaacttgagggcccagtgtctttcatcagattctcaaaaggataagtgaccccaaaaaattttaagaaccactcatctagcctatcaagaaacatcccatttttcagaagaatacggttaagtggcttagtttatgcattctttcttcatattcatagaggggattcttactatatgaaatgagtctttcaaaggattccttcagcccagccaagaagttccaacatccacaggcacatgtattaacaattaccagaacccaaaaacagttctctggttttaattccacaccgcctccctcaacttaatacccaccactgtcaaaacaactcccctcacgttgtacccaggctatttacagagacaccttgattatcctcacgccaaggcatggaccatttattgaacaggcagtcaacaaatatttgttgaatgaatgaaaaaggatccttcctcccacagatttcaagttaagctgtcagcacccatgcagctgctctggtacaagttaagctgtgaaagccttctctccctcacacatacaacctcaagtgtcagaaatgctctgcttcctccataaatccaaaataatatagtcatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaaaaaactgaaagagctttcttattgtattgtaaactattactataaacccgcgacaacaaataaggccacccattctttacaactttgtagtaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacttacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctctcagagatccaggtccgggagatgacagtggctcccagaaagcccaggattcaatcgctgagagagtgcttaggcccgaatgccggcccaaatcgttctactcaccgtgtcggaggccgaggccgaggccgagagcgatgagagtgcagggaagtggggaagagggggtggccgccaggctcctccgcttccctgggtccacggcggatccctcccgcttgtcaggaggcggccagcgggtaagctgactggcggaaatgcgagagaggagaagggaaaggtggaaggctaaagggggcaaactgaggggaggcgggtcccgcaaccgagactgggatcgtctcccctccgcaaagcgaacccaaaatggcggcgggagcggcggcggcggcggcggcagcagcagagtggcggcggtggcggcggcagctcctccagagggagggagcgaagggcgcctagcgcccccctcaaccttccactcct

SEQ ID NO: 1535 - DNA, 82404 bp, Homo sapiens
  source 1..82404: mol_type = genomic DNA
ttatatatacaacaaatttttaattatgtactgaaaataaattacaggaaataactttaaaatgcaacagaggacaaagtcacaataaacattcccattgaattcccttggtgggcggggggggggtgagattgcagtgctcaagataaatatcacaaatatatcaaaaacttcaaattgtctatgcattcacacactgacatgagccacaaacattcctttcacagggacagtacttatttagcctaccacaggaccagattttgccataaactacaaaacttttaatacaaaatcgtatttatatatttataagtcatatacatgccctatctgtgattttagaaaataaaagctacacactgtacagacactcttaactcatagctgtaggcaacatttttggatggaatttcttccccaataaaattaatggcatattttatatacatgaaggctaaactgcaaaaagacagttcagtttcccagatatgcatctccttttagggcaagtttataaatttaaaaaggcaagacaaatgtacacctcagaattactttcttagctacaagagttgccatgtaatttctgtgaagtttctgatacatgcattgatgtaatactggtattgaaggcagtaaagcaatatatacttttaatgtagtggctcaataaaggcttcattgtctttccaatctggttcttgaaacagtgattcataaattctctaaaaattaaaatttcaatgggacactgtgttaaagagactctaaatagatttctgaaaatatttccctgaaatatccttttacataagacaaattcactaacattagattaagtaaaaagaaataaaagagttaaacatggcacaaaggtgcatgattaaccaatgctcctcagtccatctgcatgtcttaggagccattaaaagaatgcttaaaactaacaaacaatcttcacactctgtggcagccatctgtgaagccagttacactaaactacttctacagttgattgtaaactttggtttatttttatttgagttctcattgtacagcaagcatgaaaaaaaaagagagtggagtccgtgaggagatgaactgtcagtctgtctttaatctggcatgatgagacacctggtcagtcaggcctgctttgatagagtttgttacagactgccttatgttttcctccatcaaattatcacccaggggcttcaatacctgtggtatgagaaatgtgcaaaacaaacaaaaacatgaggtaaaaaaagagttacatataaaaatagatataaaaattcaattcaaagcaatgatgaaaataaccaggaatatgggaaataaaaagatgcttctctcaaaaaaacttatgatgctactagacattttataatgcaacaaaaattactttcctcttattcaaaccatttacaattcctatgagatggatgtgcaattccataccctatatgcagcatcaaatctggtatgtatacagcatttatgcagaccggcccagacggtcctgcttattgtcctacatgtgtaagtgtgaacacttcagatagagaaaaaggttaaaaatactgtctaatttttcttcttgttattgttggatgacagtctctgtcgctgtgctgatgaaagagcacggtgaaccattcgacgtctagtaacttcaaacagtttggaaaacacctaaaacatgaagtgatttgttaggagaatgaatcagagtgcctcgaagctaaagagtttaagactacaagaatttgagactgtaggtttctcaccttcctgggactcctctgaagcaaaagaaaagagaaatgcaaagaaatttagacaaggtttgttgacacagcacagatctctgactagctgattaccttacctaaactatactgaaaatgattttatacactttagattcttccatttaattgttttgtaataatggtacctccaaaatcctagaatcaatgctgtttaagagatgaatatttctcaaaagaagatattgtacaattattgaaaattatattgcagaaaatgatccaaaattttaaaatagctaattttttcttaaaagtgaagttgcgatagctttgcatccatcttctattagaagatatcaaagaaacatcaagtagtgagattgagataaaaatttaaatagaataaatatccaaacataaacttcccaatcggatctgaatagagcatttctctaaagagtaaacacaaaatccaaattaatatagtgggtcactttataaaataacatcattacaagaaaagtcaatatccaatcaactttcttcaaaaaaaatggtctgcttcttcggtcttcaagtttatagccaaaacaaacatggacctgcatatcctagatcttcaaaataagctcaatatttcatgagcccaaaaatggcatctcaaatgcctattatagcgttcgtcattaataaccgtagctttcattctggtccttgacatgatgttcaagtatttcacgaagatcatcttaatgacatccataagcggtccacaggtaattccagcacaccggaggcagatacacaaaatggctttccttagcagatacttgcaggcaagagttcacagcctggggctttgaattctggttcgaggtaaaagattacgacggagcatggttctctgttcatggcgctttgctttactaattaatatttccaaaacacaaaggtcaaagtttccttggtaagaaatccctacgggattgttcctcatagtacatcaggaaatcactaccatcttcatggaaggcaatgaagacctgtctaccatccagcatttctcctgcattgctgcttgccaatattaggaagaaacttcttttgctttccgaaagcaccacttccaaacttcttttccttaccttgaaaatcattcattgtttatattttctttcctcaaagaaaaaaatcattacagactctgaccctgcccaccgtctgatacaatcaggcctacaactaagaatctatccagaggatagtacagatttaggctaaccaaagtacattaaaattataactttaaagaaaaaatcttcaattcataaagattctacatctgaacaaaacagaagacatccttttgacattcctcacatgaaggcaaagtcggagtacaaatactgcaaaggatggaaagtcacaggaaaataagattagtcactaaaaaaccaaaagatagataccaacctgttcccatagtgtttcagcaatctgatcaatcactgttccaatttctctgaactccccagagtatttaacatatgcccaagtacaaagaaatatcagtgctaaccccatgacaaggttacacaagacagctatagagtttaggccaatgaagccagtcagtcctgagattatatacatagcaaacatgaccgcaaacagtgtggctggggtacgagcagcatagaagatatttttgccatcattgtgctttataaaatttgcataggtttcttcaatttcagcttcaagctggtcctgataacgacggcagaactcatctccacccatcttttttactgaacgaaattgttttatcgccacttccttgagatccaagtgttttcgctccagatctgaaggtgcaatgtaaggcttgtcccctccacatacctggacagacagaattacagtattacatgctagaaataattaacacttgaaagaagttcctgttcatagtttttagtctcagaaagtcaaaccacttacatgattgagtcagttttaaactcacttacaatacctcacaggttatcataatctagttattgtttatatgttgaacctactcaagcaaaatcattttccaaatatgactaacggaaactgaagacaaaaaaattttacactgtgctctgtatctgccttcacttgaccatcatataccataatagcacacaaaattgctggcaagagaacgggtaaaagatgataatgccccaaaaagatattttaatgtttgagcaagcaagtacagaaactgctactggccttaaactaatgctaccaacatcagaagtcaccaataacagcactctgaatcacacatttgtcagaagatatttcagtagagtttatataataatttactaactcaaattctgctctcaaataatgtgaattattttcttatagtttatttccagcaaagaccataaaggggaattagggaataatgtaccataagctgcacaaattcgctcaattatttaaaaaatttttttaatttttttttttttaatttaaaaatcttctcactccagcatcaaatttaaattttaggtacaaacctgttccatacttttacaataggtatctcttgctcctgctactgcagcaagattattagcttcagctgttgcctaaaaaataaaatatgccattattatgcaaaaaatactctatgactctaaaaattctgattaacacaataagttatgtacaataaacaagtctgaaaatgaaccagagaaagtaacttccagtttttctttcctatgcaagggaacgttggtataaaggatataatggtaagtggttctaataggactgcctgcctgattttgttttgcttaggttgatgttaaagtgtgtctgcagaaaacaccacatatgctcaggaaatggataaagataaatagatataaccctaaaatatgtggatctccaggtgttaggaatcgagaattacccatatggttctctctctcataatcagtattatacaagacattttcaaacccacaaaccttactgcacgaagttttatcggcaaatactgtttaatctactataaaatggaaaaatagcctaaagtagtaaatgttttaaaatatgaatggggtaaaatgacactgtcccaaaagaccaccatttgaaagacagaaaaagaagtgagactatattcactagaagtagctctaaatcattaacaccaaataaaaataagacttattccaaacaacattcattgtcaaagactcagaatagaagcagcttagttcagagaggcccacatcaagccatcttatcaaatagaaattttcctatactttgagcatctgaagagaaggtactgaggactcttatttctggtggcctggacacatggaaggcctacaatctgcagttacaaaaaaaaaattgtatgaaaccttaggacccacgacacatacggccttaagcaaaatgtgtttgcatgcaaaaaagcaccccccattttcagcatttctctctaaagcaaagatttttattctccctcataaataagtatatgtacaacacatatcactctctctctctctacctgaagcatggactttggatgtggaagttcttctccttgatagattttgatgtaagcctaaaaagggagaagatttgttagactgacggattatgcaatttggctccacatccccaaagaaagaaaagtcattaaatataaaaataattaacaccattaaaagtaaattctaggctttaaaaatcaccttattccaacaaagttaaccctattctcaatattattaaattatatgctgctaaataatatcctaggtatttctataacaaatataacataaaagttataactcaaagttagatataaaatgccatcttctttatgaaaagaaattcacaattaccccctattgccagtgttttaatatttttaaaaaacttttttttctctttctttagagatggggtctcacactgacactgaggctggagtgcagtgggatgatcacagcttactgcaacctcgaattcctgggctcaagtgatcctcctgcctcagttttccaagtggctgaaactacaaggtgtgtgccaccacatccagctgaagaaacaattttatccagtattttactttgaccagcttaaattgtatttcagctcaagaaggaaaaaaaaaaaaaaaactaatttgtggtttaagagtaagaaggaaaagataagagtttgttagaagtccatatagggtctttcatctcaactttcttttttttttttgagaaggaatttcgctcttattgcccaggctggagtgcaacggcacgacctcagctcaccacaacctccgcctcctgggttcaagcaactgtcctgcctcagcctcccgagtagctgggattacaggcatgcgccaccacatccagctaatttcgtatttttaggagagacggggtttcaccacgttggccaggctggtctcgaactcccgacctcaggtgattcgcccactttagcctcccaaagtgctgggattacaggcataagccaccgtgcctggctcatctcaactttccactgacaagattcattcataactgggaaggaggcagagcaagatggccaaatagaagcctccagtgatcaccacctccaaggaatatcaaattgacaactatctacataaaaaaccaccttcataagaaccaaaaatcaggtgagcaatcacagtacctggttttaacttcagatcactgaaagaggcactgaagaggatgtgaaaaacagtcttgaatcacctacaccacccctcccccatcctctcagcagcaaccacatggtgtggagagacaatctatgtgcttagggaagtcgaaagcagtgactgtggaatttttgcattgaaactcagcgctgccctgccacagtggaaagaactcagccagcacccatggaggaagaatttagaccagccctaggcagccagtcctgccaccatgggctacagtgctctgaggtcctgaataaacttgaaaggccatctaggccacaaggactgcaattcctgggcaggtcctggtgctgggctgggctcagagccagtggacctggggtgcatatgatatagtaagactccagctggggcagccaagggactgctagtgtcactccccctacacaagctcaggcagtgtagttcacagctctgagagagagtctttccttctgcgtgaggagaggagaggggagagtaaagaggactttgtcttgcaatttggataccagctcagccaaagtagaatgcggcataaggcagagccctaaggccccaatttcagtccccagttcccagacaagatttctaaacacaccctgggctggaagggaacccactgtcttgaggggtatgaccaagtcctggcagggttcatcacgtgctgactcaagagcctctgggctctgaataagcagtagtggtagccaggcagtactcactatgggccttgggtgagattcagaaatgtgctggcttcaggtgtgacccagcacattcccagatgttgtggctatgaggagagtctcctgcttgagtaaaggagacaaaggccaggtgtgatggctcacacctgtaatcccagcaatttgggaggccaaggcaggcggatcaccagagagcatctctggacccacccaaggccagagggaacttgctagatttgccacctgctgattgtagaacctctgggccttgactgaccacaggcaataaccacacaatagtcacaatgggccttgggcaagacccattgctgtgctgccttcaggtctgacccagtgaagtcccagggatggtggccacaatggtgcttgtgtcaccccctcccccagctccaggcagctcagcacagagacagagactccatttgtttgggagaatgtaatggaagagaacaagagtctctgcctggtaatccagggaattctcctggatcttaccgaagagcaccaaggcagtacctctacaaatctgcaagagccacagcattatgggcttgaaatgtccctaatgcagatacagctgcagtgaccaagatcacaacacccaagtcccttcaaatagttagaaagccttcccaaggatgacaggtacaaacaagcccagactgcaaagactataacaaatacctaactcttcaatgtccagacaccaacaaatattcacaagcatcaagaccatccaagaaaacatgacctcactaaacaaactgaaataaagcaccagtgaccaatcctggagagacagagataactgacctttcagagaattcaaaatagcagttttgaggaaactcaaagaaattcaagataacacagagaaggaattcagaatcctttcagataaagtgaacaaagagactgaaataattataaagaataaagcagaaatcctggatccgaaaaatgcaactgacatactgaagaatgcatccaaacctcttttttattttatttttttgagacagggttttgctctgtctcccagactggagtgcaatggtgcaatcctggctcactgcaacctctgcatcccaggctcaaaggatcctcctacctcagtgtcccaagtagctgggactacacgcgtgcgccatcatgcctggctaatttttgtattttttgtagagacaaggtttcaccatgttgcccagactggtctcaagtgatctgcccacctcagcctcccaaagtgctaggattacaggcatgagccacctcacccagcctcagagcttaacacaagacctgaacaagcagaagaattagtcagcttggagacaggctatttgaaaatacacagctgagacaaaagaaaaaagaatgaaaaagaatgaagcatgcctacaagatctagaaaatagccccaaaagggcaaatctaagagttcattgccttaaagaggagtagctaaagagacagcggtagaaagtttatacaaagcaataacaaagaactacccaaacctagataccaatatttaagaacaaaagattatagaacaccaagcagacttgacccaaataagactacctcaagacatgtaacaagcaaactcccaaaggtcaacggtaaagaatggatcctggctgggcgtggtggctcatgcctgtaatcccagcactttgggaggtcaaggtgggggaactgcctgaccctggagttcaagaccagcctggacaacgtagagaaatgacgtctctgttaaaaacaacaacaggccaggcacggtggctcacacctgtaatctcagcaccttggcaggctgagatgggaggatcacttgaggccaggagttggagaccagcctgttaaacacagcaaggccccatttctattaaaccaccaccacaacaacaacaagaagcacgaatggattctaaatgcatcaacagaaaagaaacaaacaacatacaaaagagttccaacacatctgggagtagacttctcagcggaaaccttacaggccaggagagagtagcatgacataaagtgctgaagaaaaaaaacatttttcctagaatagtatatccagtgaaaatacttcaaacatgaaggagaaataaagacttcctcaaacaaaagctgaggaattttatcaacatcagacctgtcctacaataaatgttaaagagagttcttcaatctgaaagaaaaggattttaatgagcaataagaaatgatttgaaggtccaaaactcactgggaatagtaaacacacagaaaaacagaatattattaacaataattgtggtgtgtaaacaactcatatcctgagtagaaagactaaaagacgaacctataaaaaatattaattaacaaccacaacttttccagacatagacggtatactatcaatagaaacaacgaaaagtttaaaaagtggggggatgaagttaaagtgtagaatttttattagttttctctttccttgttatttagtttgtttaggcaatcagtgttatcagtttaaaataaatatattatagttgcaaacctcatggtaacctcaaaagacatacaacagatacacaaaaaataaaaagaaattaaaacataccaccagagaaaatcaccttcactaaaaggaagacaggcaggtaggaagaccacaaaaccaccagaaaacagtaacaaaatgacagaggttaactccttacttatcagtaacattgagtgtaaatgggctaaactctccaattaaaaggcacagagtggctgaatgggttttaaaaaatggtgatacacacttcatctataaagacacagactgaaaataaaggtatggaaaaagatactccatgcaaatggaaaccaaaaaaaaagagcagaagaagctacatttatatcagccaaagaaggtcattatataatgataaagggatcaattcagcaagaggatataacaattgtaaatatatatgcacccaacactggagcacccagatatataaagcaagtattattagaaactaaagaaagaggaccgggcgcagtggctcatgcctgtaatcccagcactttgggaggccaaggcaggtggaccacttgagggcaggtggaccacttgacgtcaggagtttgagaccagcctggccaacatggtgaaaccccatctctactaaaaatacaaaaaattagctgggcatggtggtgcgttactgtagtctcagctactcaggagactgaggcaggagaatcacttgaacctgggaggtagaggttgcagtgagccgagactgctccgctgcactccagcctgggcaaaacagcgacacttggtctcaaaaaaaaaatcaaaaaaattgaaattatatcaagtatcttctctgaccacaatggaataaaatcaataacgaggaattttggaaactatacaaacacatggaaattatattaatacaataggctcttgaatgaccactagatcagtgaagaaattaagaaagaaataaacacattcttgaaacaaatgaaaacggaaacacaacataccaaatatatgggatacagcgttaagcagtactaagaaactatatggtaataagtgcctacatcaaaaaagaggaaacacttcaaataaacaacctaaccatacatcttaaaaaaacagaaaaggaagagcaaactaaacccaaaattagaagaagttagcgaaattgaaataaaaacaatacaaaagatcaatgaagcaaaaagttgattttttaaaaagataaacaaagtcaacaaacctttagccacactaagaaaaaaagagatgacccaaataaataaaatcagagatgaaaaaggagacattgcaactgataccacagaaatccaaaggatcattagaggctaccatgaacaactatatgccaataaatgggaaagcctagaagaaatgtatcaattcctagacatatacaacctaccaagattgatccatgaataaatctaaaacccgtacagaccaataacaagtaacgagatcaaagccataataaaaagtctcccaacaaagaaaagcccgaaagctaatggcttcattgctgaattttatcaaacatttaaagaactaataccaatcctactcaactattccaaaaaccagaggaggagggaatatttccaaaccaatactacaaggccagtattaccctgataccaaaaccagacaaagactcagcaaaaaattacaggccaatatccctgatgaacactgttgcaaaaatcctcaacaaaatactagcaaactgaattcaacaacacattaaaaagatcattcatcatcacctagggtcaggcagggatgcaaggacagttcaacatacaccaatcaatcaatcaatcagtcagtcaatgagtgtgatacatcgttatcaccagaatgaagaacaaaaaccatatgaccatttcaattgatgctgaaaaagcactggataaaattcaacatcccttcatggtaaaaatcctcaaaaggtacagaagaaacagatctcaacataataaaagctgtatacaacagacccacagctagtatcttactgaactgggaaaaaattgaaagcctttcctttaagatctgaaacaaaacaaggatacccactttcaccactgctattctacacagtactggaagttgtacttcagtacaaactttgagaaaatgacagtggcttcaataaatggtgctgggaaaactgaatatccatatgcagaggaatgaaactagaccccatctctagccatatacaaaaatcaaatcaaaatggattaaagacttaaacctaagacccaaactatgaaactactaaaagaacacattggtggccaggtatgatggctcacacctgtaatcccagcactttgggaggcagatgcaggcagatcacctgagatcaggagttcgagaccagcctggccaacatggtgaaaccctgtctctactaaaaatacaaaaatcagctaggcatggtggcagctgcctgtaatcccagctacttttttgatgtgcaaaaccttttaacttgataatgtgcttgcagggtattactgaagaaatcttttcccagagcaatgtcctggagggtttccccagtgttttcttttctttttttttttgaaatggagccttgctctgtcgcccaggctgaggccaggcgaattgcttgaacctgggaggcggacgttacagcaagccgagatcacgccactgcagtccagcctgggtgacagagcaacgctccatttcaaaaagaaaaaaagaagaaaacattggggaaaccttccaggaaattggtctggtctgggaaaagatttcttcagtaataccctacaagcacaggcaaccaaagcaaaaataaacgaatgggatcatatcaagttaaaaagcttttgcacatcagaaaagtgaagacgcaacccacagactgggagaagacatttgcaaactactagtctgataagggattagtaaccagactatataaggagttcaaacaactctacagggaaaagaaaaaaaaatcaaatgatctgatcaaaaaacgggcaaaagatctgaacagacatttctcaaaaggagacaaacaaatgggatacaggatatgaaaacatcactgatcatcagagaaatgcaaatcaaaactacagaaagatatcatctttctccatttaaaattgtttttatccaaaagacaggcaataacaaatgttggcaaggatgtagagaaaagggaatcttcgtacactgttggcagaaaggtaaattagtacaaccactatggagaacagtttgggggttcctcaaaagactaaaaataaaacgaccatatgatccagcaatgctgctgctaggtatatacccaaaagaaaaaaatcagtatatagaagatacatctgcactttcatgtttactgcagcactagtcactacagctacaatttggaagcaacctgtgtctatcaatatacgaatggataaagaaatgtggtacatatacacgatgaagtactactcatccatataaaagaatgagatcctgtcatttccaacaacatggtggaactggaggactttatgttaagtgaaataagccagacacagaaaaaacaaacttcacatgttctcacttatttgtgggagctaaaaatttaaacaactgaactcatgcgatagagagtactagaaagatggttactagagtctaggaaaggtagtcagagggtggaggggaggcagagatggttaatgggtacaaaaatatagttagaataagatctagtatttgatagcataacaatgtagttacagtcaataataacttactatacattttaaaataacaaagagtataattggattgtctgtaacataaggaagggatacaggcttgaggtgatggacaccctatttactctaatatgattattagacattgtatgcctgtatcaaaaatatctcatgtaccccataagtatatatactacgtacccacaaaaattaaaaattaaaagtaaaaataaattttaaaaaattcattcataactaaacaaagataatatgagagtaactatcaagtatccaataagtgaacaaaatacactcttagttaaaactactacaaataatacaaccttccacagcggtcttgttctggcaggcaagctataaagactagagaagaacagagggaaaaaaaaaaaacctaagagtactttacttgaaccaatataaatactttcagctgttcttatcaagtcctcagaactctgagggagtgtttttgtgagaacttaggatgtaaaattatgctttccattcctattatcattcactaatgacagagtagtattagagtatgatgaatggcttgttctctccatatctgagatggagaaaaagtaagataattctgtaaataaattaaatcactgtctaggagacagaaatctgctataatcttttaaatatccttaaatacagatacatctaattcaaggcagaaagataaatcacaaatcttactcttttttgttttaaaataaagacaagaaatttcttatacatacagatgagttttaagtcaactacatttctatcttagacaaaactgtttaagagctcacctaccttaaaatattctacaagatctctacaagtgactttagatccacttatctctttttctaccaaattttcaggggcaagcagcaatggaaccagatttcgaagctctcgtttaaagtcttcatcaatatctagaaaacaaaaaattgagcaacatattagtccaaaaaaaattaggtccccactggtacgatttcataaaattctgttttatgaaataagaatacatagtatctattactgaagtggattcattttttaaaaaaaagctcatccaacatgccatatctcataggaaaaaatataatcccccttactctactagcccattttccccaaccccctagtaacactgccagttcaaataacaaataaaacatcaataaatttgtggactaccaagacaaatttcacatttagtattaacgaaaatgtccttttcaagaggcaaacaattcataaaattgtattaaattttactactagattatgttttaccagccatactgtaaaagttttgtcaatccccaaatgttttgccaacacactcaaaataatcctacaacatacataaactgtactatcactcctgaaacagacacttatatctgatttcatcaatataataaaatgataaagccttttagcagactgcaatcaattgaaaagaaatgctctcagccttcagaattttcaggacatcactgctgagcaacagacattataaaataggttaatcaatatgctagacagctgcaaacaaatcaatggaatgctagagaaacaacacagagcattacaaccacaacatgaacaatgcatccaaacattctccagtataagacaggacatttaaggcgtcatgtattttcttaaaaaactttccacctctaataaataagttcagattttagcaagaatgggaattcccacctttcaatctcccatcaaaactaggattagttgcaactttaagaccaggatgtggcaaaaggaagcaaccaagatttgagaaacaattgtgtatgtgcttccttacattctgaagctcttcatgttgattttgttttacctgagggcggagagagacaggtgaaattgtaaacagaagaaagaaaatttttttaaagaaaatgcacacagactcgcatgcacactatgcacacttaactcagatggtactcctaaggagtcttttttgacaatacaaaaaattatgaaggcccatttctgaccactttgttaagaccccacttttttttttttttttttttttttaaagacagagtttcgctcttgttgcccaggctggagtgcaatggtgcaatctcggctcaccgcaacctccgcctcccaggttcaagtgattctcctgcctcagcctcccgagtagctgggattacaggcgtgcaccaccatgcccggctaattttgtatttttagtagagacagggttggtcaggctgatcttgaacttccaacctcaggtaatccacccgcctcggcctcccaaagtgctgggattacaggcatgagccaccgcacccagccaaccccacattttcttaaaccacaaaagatgtttttcccaagtaagctgcctggaacagcaaaaactacaaataaggtagttaatcacagtatctaataaccaaataacaaattatggctgtgacttatacaccagtaaataaattaagaatttacctttaaagtacttacaacagcaacaaaacagaacaaaacaaaaaaaaaagtataaatttgcctacaaataaaaagtttagcccctgaacaaagtaaaagctaagataaaaaaaattacagtgcagtacaaagaccttagaaatgtgttagaatttcaggtccctctctacatgattatttatgatttatgctagttaccagaattttgagaagggaaactgccatgtattagggggaaaaaaatcttaaacttagaaacattttagataattactcatttatcccaatataactcacacagtctcctaaacactcttctggaaaacaattttaacaaaatatgcgctatttataattaaaacctggaaactacctaaatctcccatcaacagcagaatggaaaaactgttgtctattcattcaatagatactatacagcaatgagaataaataaattaaactatatgcaacatggattaacctcagaaacataatattgggtaaaaaaagctagactcaaatacattctgtatgtgattccatccacataaagtacaaaaacaaagcctgtgagaagtcaggatactggtagagggttttgggggaaggttgctgtatggaggtgagtgcttctaggtgctggctaaatggctatgttcattttttataaattcatcaagctacacacttatgatttgagcaattttctgaatatatgtataacatttcaataaaaagtttaaaaactttcttgtctttgagttacataattctgagtttagttagtatgtctattgtgctttgtgttaatttcttctgaacaaaccagaaacagaaaatgctgatgactgaaattatttccaaaagtggggtctggaaatgcctttcaaataatctaagaatgttgaattggttttaatctcattttaaaactaaaagaaaattatatcataccccaagtctttaatgcagttgagaaaccaaatgcatcattcccatagacaaataaaatcttatcaatgaaagacagcaccctcctaatgaataaaggggtctttatgtatcctttgtgtgtgtgagtagatgggtagcctgtaagtatctgacctgcaggtttcccaaattgatatggtttggctctatgtccccacccaaatctcatctcaaattgtaatgcccatgtgtcgggggaggggcctggttggaggtgattcatgggagcagaaatcccccttgctgttcttttaacagtgagtgagttatcacgagatctggttgttaaaaagtatgtggcacttcccccttcactctctctctcctgccatcttgtgaagaaggtgcttgctggctgggtgcggtggctcacgcctgtaatcccagcactttgggaggccgaggtaggccgatcacaaggtcaggagttcaagaccagcctggccaacatggtgaaaccccgtctctgctaaaaaatacaaaaaatatgccaggcgtggtggcgggcgcctgtaatcccagctacgggaggctgaggcaggagaatcgcttgaacccgggaagcggaggttgcagtgagccaagatcgtgccattgcactccagcccaggcaatagtgtgagactgtcttaaaaaaaaaaaaaaaaaaagaaggtgcttgcttttcccttcaccatccgccatgattgtaagtttcctgaggcctcccagtcatgcttcctgttaagcctgtggaactgtgagtcaattaaacctcttttcttcataaattacccagtctcaagtagttctttatgctgtgtgagaacagactaatacacaagtacttccatggggggctacctttaggaataaaggatcatgatccttaattttgattcaaggacactgtcttctttggtaggaatgcaaccactttacttttcatcaattacaaacagagtcacttgggctaacctggaatactttattccaacgacacgtaaatactggtaatgtgaccagcagtccggacagcccacccgtttgcctagcttggtgcttatgttctcctctttaagcattagggtcttacctgtaatctcttttcaagaaattgctttccaccttccaaaccatatgaatgttcataaggatagctccaatctcgaatcaaaaacattaatgtctatacacagaaaaaataaaaattgtttattttacaataaagaaaatttacgaaaaaatcacaactcttaacaattgaagcctctcttactctcctaaacaatccttatcaaaagttatagtaactaaatggtcagtactggtcatggttatatcaaggacccacttaaacaacattctcaggccctataccaagcaatcgctgccactgaagaacttcactaaatataaagaaagagtcaccacaagcagtaatacaggactttaaaaatgaaaaatgggtgtatcaggacacacggatcataattttaaatcatggttgtgtaactacaagaccaactaattctagatggctatctagactgattatagatctggggtcaataaggacattttcactcacagaggatgtttttactcatatagggttagatttctcaaatgctgacattttgggtcagcactgctgacattttgggtcagttaattcttagttgtgtgtggctgtcctgtgtattgtagaacgttgaaccatatttctggcctctatatgctagataccaagaggcactaagctctcccacaaaactgtgacaaccaaaaatgtctccagacattagcaaatgtccccttgggtggcaaaatgatcccagttcagaaaaaactgatataggccaaatagggtatatttcacctatatatccaaaaacgaaggcatcatctgctcaactacttaataaaagtgaccatactagccagacaagagtgaggcagaatcaatgtaaacccattaagattaacaatcagtagcaatgctgtcataccggaaaggcttcacacacttaggagcaaacatggtagagtcatgctctcctactgtaactgcagctcaccaaacagtattaatggcaacttacaaattacacttgcttcaaaaaataaactatctggaacttttctatatgaaaccaaaataaagagtaacagaactaatttcaacttgtagtaaaccacaaaaaagaaacctgtaacattctgtagttaccacgtataaaaaaaaaatggcatgactgtcatatatttcctattgtcttaagtttagaataacatctgttaagagaaacattactccccttaatctaagtgaaagcattaagaattagcctagattcatttattctatttatcctgttcgcctactgataagtatgctgatgatactaccaaaggttagtttcgattgcactgaatctgttgctagcaatgagtctattgtaatatcctggtgtctccaaaattacaaactgaggtggcttcacaacttctcataggctaatctttaaaatgttagaataacttttttacctgaaatggtttctggtagatttcttccatcgcaagtcttccatactctgtaaataactattaaatagagttagttaaaataatgcctctaaagagattgaaagaagacatgtgtaaacctgttccacaccaaagctccaggtaccagaacctttaaaatcatttcaaagccaaacatttaattttctaacacactaggtatgtacaaaatttcttccagttaagaagtcatacaccagtttaaacccatataacattcaatcgtgttaccagtattataggcttccaagtgtaaattcataataaagtgagaattaaatttcaatagttggcacattttctttaagaaatatgtgctcgcagacgggcgcagcggctcacgccgggtaatcccagcactttgggaggccgaggcgggcggatcacccaaggttagaagttcaagaccagcctgaccaacatggtgaaacttcatctccactaaaaatacaaaattagccaggcatggtggcacatgcctgtaatgccagctacttgggaggctgaggcaggagaatcccttgaacttgggagggggaggttgcagtgaaccaagattgtgccaccgtactctagtctggggaacaagagcgaaactccatctcaaaaaataaaaattaaaaaaagaaatacgtacttgcaaatgttgaagatcatcttcttgaatattctgagacagattatatacctgttgaaacaaaatttattttgttttttattagtgttttgttctgaatacccagcttctgtataactttacttgtggaaaaaaggttattttgtatctcagcgcaaaggaatcatttaactactatcttgacaactgacatgtgaaaaggattttctcttttttcctaacaatagtcaagatagaatattaaggaagaagcagtggtggtaaaatatgcaaaaagcatgaatatatgtatactcatggcctaaaagtggtagaagaacaagtgtggtatctagtaggtttcttgtactccttctctaagctctttaatgttaagatacgatcattttttaaagagtgtaggttatttccaccatcatttttctaaattagtgaatataaggggcaacagtttacaaagataaattcttccctggtacaatcagagtatacagttactcaggggtacctccactactactgactctagtgtggttctctttttactcacactcctcagtttacttactcatcagttttcacttacactcaacatgacaattttactggcctgtggaagctaataaaagtaacagtaggtggcactcttgccctttccagaattttttggaggagactagagttgataaaggagggtctaagtatcctcaggaaacggggattttcatccattaattctaagacagatctttagacagtaatctacactgccacaggagaaaagtggccatcaacaaatatcacctctgctaagaaataacttacatcttaggaaccagggtgactccgaagagagaacaatctgttctaggagcaaataagtgatactctggctaaaccacttggaggtcaagaatatagtcaatttaggccagcaaacctaaaatgatattcttagctactaattccaaacaaggatttaaaaagtaattgatgactgaggtgattaaactttagattttaacataaaccctgacaccatgaccaacctatgtgggcctctgcttttagaaaataggtctggatcctttcattgtcagggccaggttgcaaacagcaaacagagaaagagatttatttaacttagatcattagtacttagcatactgtcttgtatgtaacaggtgctcagtatgtatttgttgaaggaataaatgacaagaagatcaaattatcatttatctatcagccagatatcttacataaggaaagaaaactaccccccccacccaaaggcaaggaagaaaataatcataatcttaatcttcttggttatttatactttacaaagcactttcatatgcattatctcatttagctctcatttctgactgcacacaacaaccacatccaagataggcaagatgagtaaaactcattttacagacaacaaagtggctgcacagctttaagtggctgtctaaaaccaggtctcttactatcaaaaagttgaataaataaacaaaaaaagactaagggataagttttaggacagagaactcgagaactccctctagagccagctaacctgaggggcttctgcttgcttcaagggaatcacagctgtgccatcttgcaagatcagagaaaaaaagagacttagagggtccccaccagcgtcacttagtgggtaatgacaaatatcccaaccctataataaactgaagccaagctgaagagtattcttcttttagctcaggttaacagccaaccttctttccactctgatggctaggtacttcaaactgaggaaggaggaaaatgggagcttagagagacgagtcatatgttccagacattactggaaagcataaaaaaatccaagacactgtgacagcatcacctatgatctaccattgataagaacaatttcttatcttgggaggatcacatacccattttaaaaaaatatttgcaaatatacttcttgatacaccatcaccagctgggcctaaccgccatacttcaataattcatttttcagagatgtatcagccacagatgatctcagaaaagaaaaagtaaagaaacaccaaatgacatgtggtagtttaattcagtccaatccatctaaattatacagaaaagaaatggcctagcctgaagaaactagaaccggatagaacaccaaacacaatttgaatataagtgaaaaagagaagggattttatcccttcctaaatgaaggtgctaaaaatcctcagtttattattacataagccttgtctgggtttcctaaattaaacattaagtaattactctgcttttatctcctttagttcaaataactgagtaccacttgtcatagatacagaataaaaaactagacttctaagcttaattacctgggttttttgtttgttttagccaaaaaaacaaaaatatactctccatattactgtgtctggtagccatctatctgatttcaattacagataacatgtgatatcttttcctttaaaaaaaaaagtatgtattccataatgaaaaactaaagagactggttgttggtttattgcatcctttgtaactatccaaagtacaaaatttcacatcataagccagaaaaccatgcatggaaatgtaaataaccaataagaaatgtaaatagctctcaagaaatgtaaatagcttccttttttttcccttcaatcaaaaggcattttgccagcacaaggtggcatatgctgacagtcccagctactcaggaggctgaggcaggaggatcacttcagcccaaaagctagagtgtgcatgatcacacccatgaatagccactgcactccaacctgggcaacatagtgagaatccatctcaaaaaaaattaaaaaggcattttcaagaggggcaaatgccaggctcagtggctcacgcctgtaatcccagcacttggggaggccgaggtgggcgggtcacctgaggtcaggagttcgagaccagcctgcccaacgtggtgaaacccgtctctactaaaaatacaaaaaaattagctgggcatggtggcgggggcctgtaatctcagctactcgggttaggagaatgaacccaggaggcagaggttgcagtgagccgagatcacgccactgtactccagcctgggcaacaagagtgaaactctgtctcaaaaaagaaaaaaaaaaggggccaaatgattacgtgaactgatcgcaccacttaatcttgtgtctcacctggacagagctagtcatagtgctcagagcaaacaccgttgcacagtctttgatagttgactggctatcaaaggcaccctgggtatccataagcagcacagcaacctaggaatttgagagtttaaaatatttagtaaaacagttgccaaaaatgactataaaaaaaatcaaatgataaatttgaaaagcagtaattaaatcaagaaaagtacttatatctcatacatttgacataataatccgtatgttaaagttatcaaacattaatagttctgtgttgttttgatttttaatactggaaaatagcccaagaaagaatacagggtagaaaagtataaacagaattttactttagttccattaggtctgtcaatcacaaatacttcattccaaacttgtatgcctgttgtttctctttcacagccacctcgccatgtaaagcctgtcaatggttcattgtttccaccaatccaactttgagaatcctgttaaagtcaaggataaatgtaaaatacaacacaattaagaaataaaagaaaccaaaaaatcacccattctttattttacagatggggaagctaaacccggaaagacaaaaaaaacactgtgtaacaaacaagtagttacaaagcagtccttaaatcccatgtggggttctttttcttatagagacgtggtctcctccaaactcgaatcttctcaaatcagctcacactactactctctaggcttctaaataagtggggttatactcactttcccccttttctgaaagatatcctggctgggcatgacagctcatgcctgtaatcccagcactttgggaggctgaagtgggcatatcacttgaggccaggaatttgagaccagcctggccaacgtggcaaaacgccatctttacaaaaagtacaaaaattagccaggcgtggcggcacactcctgtagtcccggctactcagcaggctgaggtaggaggatcacctgaacctgggaggttgaggctacagtgagctgagattgtgccactatactccagcctgggtgacagagtgagatcctgcctcaaaaacaaaaaaaaaaaagagagagagagagagagacagagaaatatttcctaaaatgttaaaaatcataaaaaactcggcaccaattattttaacatgttgttacacagataagcaaaactaagttccaggtagaatgactgtcaaaacagcactgctttctcagaatagcttacagtaagttttcatactgccttcatttcctctttaaaaaataatcaattttaggctgggtgcagtggctcatgcctgtaaccctagcactttgggaggacgaggcaggtggctcacctgaggtcaggagttcgagaccagcctggccaacatggcgaaactccatctctactaaaaatacaaaaattagccaggtgttgtggcatatgcctataatcccagctactcaggaggctcaggcaagagaatcacttgaacccgtgggcagaggttgcagtgagcagagatcgcgccactgcactccagcctggccaaaagagcgaaactgcgtctcaaaaacaaaaacaaaaaaaatcaatttaaaaaataaccccaagacttgtttggagcctgatttaaacaaaccatctatttaaaacgtcttttttaaaccaacaggaaaatatgaacccaaactggttatctcattagatggtgttaaattagggtaaggaagattgtttggtgtgctaatgatactgtggttaggaaaaaaaagagtccttatctattagatactcaagtatctgcagtgaaaggatatgcctggcatttgctttaaaatattccgggaggtaaggaaaaaagagaacagataaaacaagaccagcaaaatgttgacaaatacattggagttcattatacaattctctttattttagggtatgtttaaaattttccataataaaagtttttaactagaaccacagggctaaattgttattatgaaataatacaaaagttaacatataaggtaatttttctagaaaattaaatgtgggacataataaatgaatacctttgacagacgtcaagatccctaaagtttagtatacttaaagcccacatagcctttactcaatgtaccccacaggaaaaacgcctttgtttcagaaatacttctaataagcttggatatctagtctaaaacaaattacaaagcgtgaattaggagtggagagatggttaagacaggaccaatgagggatgaagcaatttatgaaaagcagacacacagtggcaaaaacaaaaacaaaaacaaaacagtgtcagccaggcacagtggctcacgcctgtaatcccagcactttgagaggctgaggcaggtggatcacttgaggctaggagttcaagaccagcctggccttggtgaaaccccctctctaccaaaatgacaaaaaaaaaaaaaaaaaattagccaggcgtggcggcacatgcctgtaatcccagctacttgggaggctgagggaggagaatcgcttgaacccgggtttcaggtgggttgtgggaggtggaggttgcagtgagctgagatcgcaccactgcgctccagcctgggcaacagagagagactgtctcaaacaaaacaaaacaaaacaaaaagacagtatcattcagaccatcacctaacatagccttaaacttcaaaccatctttaattattattattattccacaaaactcccatccccagtaggccaccaatcctatcaattacaaacttctcttggattcatttctttttcttcagttttcaatacctacaacttaaagacctcatctatgctggtcagaaggggctgccacctgagacaattccattcacagtatatatgatggacttgtgtttcaggaggcacccttcacaggaatcagaagattattttgacactccccggacaagtaaaactggtgatcctgccccttgactacatatttggatacttcatattggtctctatgcaactcctgctctatcctctaacccatttttccatagtcactgaatgttcacaagaaatgtaatcgtgccactgtcctgctgaaaagtcatctgtggctccgcactaccaataagaccatctggagatctgctgcataacaatccttttttctctttttcttttttttctttttttgagacagggtctcactctgtcacccaggctggagagcagtggcacaatcagaactcaatgaagcctcatcctcccggactcaaaggatcctcctacctcagcctcctaagtagctgggactgcaggtgcacaccaccacacctggctgattttggtattttttgtagagagggggtttcgccacgttgcccaggctgataacaatccatctttaatttactcttcttgtctgtgctcctgatactccccatagatctcaacacacatcttcctgattctaccataccaaaaaaagttaccatttataaggagttacctttatatggttttgcagtttttttgtgagtctcttgagagcaaaggctacaaacaatcatctttgttcaccaaactgctcctatcaaagtgccttgcactgttgtaagttctgacatggagaatctcattcccccacaatgtcaaaaaaaaaaaaatctggtacttaatgaatttattatttgtaaaagttacaggctacacaaataattcctctaagagaactctggttttactctacattttacttatttctatctcctctacaagaaggtaagtttcacaaaagttttgtttgtttcattcttacaagtattcccatcacagagaagtgtgcctggcttgtagttggtactctaagtatttcttaaacaaacaaaaaagtttacttataagcttcaatgtactcccttttgagcatgggtaataaatccagaagaaatatgatctttgttattattcctagaaacaatacaatcataaaaagacagtaaaaataaatttttataagtatagatgactgaaatcataggcttatatgtttgccagccccctcttccaaagaaactttaaaaagaattggtgtctcataaaaatctactatgtatcatctcttcctaggttaccttgtaatggaaatgtttaaaaaaaaatactaaactgattagtcagcaaaaggatgaaagaagctgagtgtggtggctacacctgtaatcccagcactttgggaggccaaggcaggaggatcacttgagcccaaaagttcaaggctgcagtgagctatgatgatgccaccacactccagcctggatgacagagtgagagaccctgcctctatttaacaacaacaacaaagatgaaaaaataaatcagagaactaatcagattctttaaaacgtgtaaaagtgtataatttctctaacatagtgaacactgacagctttcataaaatacagtcattcattcattaaatatttgtggaacctctaccatgtgccagccatttttctagggatacagcagtgaacaagaataaacattcctgcccacaaagagaattttagtgggagctaaaggcagccttgctgataacagaccctatttgctgtgataatttactaaaagcaaacctaaaaactcaaaaacactaatctgatactatttactactatggagacaaaagcctcaaaactcagaaatgcaaaagtaatcctattccaccagacatataaagtaaataggaaaaaaagaagtatttatagaataaaactcaactgcaaaaggcaatctgaaatcaccagaagttttttttttttttttttttttttttgagatggggtctcacttgctatgttgcccaggccggtcttgaactcttgagctcaagcaatcctcccacctcagcacctcagcctctcaaagtgctgggattacaagcatgagccaccatgcccagcctgaagtttaagtataatcaaatagtgaataaatacagcccttgccaaaaagacgttctacataatataattatcagcaattaagaaaccttacctattctaaacagtaagaaacaaattcatattttaccaaaggaaaggtatactccctagcaacaaagtgaaacaactatgtaaccatttatttagttagttagacagagagaaagaaaacgagacagacagacacagacagggtcttgctctatcacccaagctggagagcaatggcacgatcatagctcactgtcctcgacatcctgggctcaagtgatcaaagggttggttgtcctgccaggcctacatgtatcagagcacacccgctcctgactgctggcaagctgactccctttcacaatggataggctggaagaataaaggttcatacaaaagccataaatcatcacaactgggagtaaaaggaataaaaagaatgaaattaagatccaagtgggccggtaaggtggctcacgcctgtaatcccagcactttgggaagccgaggcgggcggatcacctgaggctgggagtttgagaccagcctgaccaacatggagatacccagtctctactaaaaatacaaaaaaattagccaagcatggtggtgcatgcctgtaatctcagctactcgggaggctgaggcaggaaaatcgcttgaacccgggaggcggaggatgcgatgagccaagatcgcgccattgcactccagcctgggcaacaaaagcgaaactcagtctcaaaaaaaacaatccaagtagtgctacaataataagcgagatcctccctagttgcatgacattccccacaccaccacaaatgaaaatcttcatgtgtataaaactagtacctaatcaggagacaggttatgaacactcagcacccaaagtgatggacacaataaatactgtacacattctaaccaccaattgtatttactgttttcatttgaatatgtgagaatactctgcaagtcctggaacaaattataaaacatttaactttaaaacagtttaaaactgtctaacatcttatccaaccccattcccaccccatgcccaactcttcccatctggggctggacaaatcaatgaaattatgactgacccaagtcatgagcccagaaaaaggacaactctaactacttaggtacatgctgaagaggaatttaacatattttgataaaaggttctgctcaaaaggtgtctttgaccttgaagacactatgctaaatgaaataggccacacacaaaaggacaaatattctatgattctactcatatgaggtgcttagtcaaattcatagggacagaaagtagaatggtggatgccaggggattggggagagaaatggggagttagtgtttaatgggcacagagcttcagctggggaagatgaagcagttctggagatggatagtggcaatggctacacaacaatgtgaacagacttagtgccactgaagtgtacacttacaaatggttaaagaggtaaattttatgttatgtatatcttaccacaattttaaaaaaagttgcccttgagggctaacaaaacggaaggggcagacacgtcttgtaattaaactgagatttgactttagagtcttccattggacttccagtgtcagctttctcatgtaaaaagtttagaagtcatcagacctatctttacaacaagagaaaagcttagcaaactgaaaaatcaataaactctcctttcttagatcaaagaattgagatcacaggtcaaaccatccctgcaaaatcacaagagacaaactaacacaaaggatcaggagttgaggtcagcttaccagcaactgctgcagcaactggtaggaacacttaaatggcaatttcaatgaattgtcagaagctgagagtgaactagtttaagcactaaaaaccctagaggctcagtctaagaaaacaccccactttcctgaatattatctcaaagaactccacaaaattctcaaagtaattacggaagaaagtttccctcatgactgacaaggggaggggaagtaacactttttaagttcaccctgggaaagtaaccactatctacacacacaccagtacatacacacacacacacacacacacacacacaccagtacacacacacacacacacacacacacacacacaccagtacacacacacacacacacacacacacacacacacacacacacacacacacacacacacacaccagtccccacaacaaaagcctgccctcctgagaaaactactttaccagagctttatctgaccctagggaggagcaattaaattagccaactccagccccatctaggcttcctgtctagtttaaggttttgtttgtttgtttgtttaaaaaaaaaaaaaaaaaaaaaaaaagagggtcatagaccaggactcaggcccactaaaaaactaaggagccaggtgcagtggtgtctgcctgtaatctcagctattcaggagactgagctcaggagttccagaccagcctgggcaacataaggagactgtgtctcaaaaaagaataaaaataaaactaagatttaaccataaggtggcatacgatgcttctgctctcctacactttaccacctcatcaacaatgctccaatataatgacagtggattacaaataaaaaagctgcaagacacagattttgagttcaataaaagttcttgggaaaccccaaagacagtgagagaataaggagaaactgaagcctctaggacctgcagctaaaaaacacgttaaacacagcccatctcccaactagattaacatataacctcataatagaagcctaaatcttcagtctttattacctgatacttcatgtctggctttcagcaaaaaattacaagccatgccaaaaggcaagaaaaaaatagactgaaaagacaaggcaaacaacagaaccagactcagatatgatatatttcagaattagaaaataggaaattgatccaggaagaggacagaacaccaagcaggataaataccaaaaaaatccacactaggtatatattatagcctagctgcaaagtaacacaaaaagaaaatcttgaaagaagccaggaacaaaacacttttacctacagaggaacaaagataagaattacactggacttcccattacaaatcatgcaagcagctgggagcagtgactcatggctataatcccagcactcggggaggccgaggcaggtggatcacttgaggtctggagttcgagaccagcctggtcaatacggcaaaaccccatctatactaaaaatacaaaaattagccaggcgtggtggcacacacctgtagtcccaggtacttgggaggctgaggcaggagaatcacttgaacccagaaggcagaggttgcagtgagccaagatcgcaccactgcactccagcctgggcgacaaagcaaggctccatctcaaaaaacaaagcaaaacaaaaatcatgcaagcaggaaggaaatagggtgaaatgttgacaaagctggaaaaaagaaaaaaaaaccccaccaaactagaattctgtatccagtaaagttatcctacaaaagaagtaaagactttcttagccaaaaaccaaggaatgttgtcgccaatacgtcagcaaaaaggaaaatgatataggtcagaaactcaaatctacataaagagaaagagtatcagagaaggataataaggtaaaataaaatcttttaggtggttatagtatatagataagggaaacaaatgacagcaatgtataaaagagaggaggaattaggaatacgctaaggtaactgcactatccatgaagcagtataatatctgaaagtggacttagcttagttgtaaatgtacattgcaaactccaggcagccaccaaaaaacacgtttaacagatatattaagagagtacagaaaacgcaatcaagtaaaatgttcaattaaaattggagaaggcagaaaaagaggggaatataaaaaaaaaaaagtacaaaaaaaaaaaaaaaacaccagaaaacaattataagcatggcagctacaaatccaattatatcaacaatcactttagatgtgaatgacctaaatacaccaattaaaagaaactgttggccgggcacagtgcacatctgtaatcccagcactttgggaggcagaggtgggtggatcacctgaggtcaggagttcgtgatcagtctggccaacatggggaaaccccgtctctattcaaaatacaaaacttagcggggcgtggtggcgggtgcctgtaatcccagctactgaggaggctaaggcagaagaaccatttgaatcagagaggcggaggttgcagtgagccgagattgtgccaccgcactccagcctgggtgagagagtaagattctgtctcaaaaaaagaaattgtcacagtgggtttttaaaaaatagagccaactatatgctatctattttaaaaactccactttacaaagacagacacaggttagaagtaaaggtatgggaaaaacataccatgccaacactaatcaaaagaaagctagagtagctatgttaattacagacaaagcagttttcaaaataaggaaacataaaaaccacttcagaacaaagattaagagttgcattacaccaaaatatgtgaagcaaaaattgaactccaaagagtaacagacaaatccactattatactgggagacctcacacctctttataggtagctgacacacccagcaagtagaaatccaataacatagtcgagctgaacagcatcaacaatcaaatggatctgacattatagtatatttcatccaacaacagcacaatacatactcttctcaaactcacaaagaacattcaccaaggtagaccatatcctgagccttaaaatacacctttaaaaattttaagggatagataatacaaagtatgctctcataccacaacagaattaaactattactagaaatcagtaacagaaacacagctggaaaactccccaaatagttggagtttaaaacaactcacctcaaaatgacacaggagtcaaggaaatctcaatagaaattttaaaatatattgaactaaaggaaaatgaaaatactacctattaaaatatatgaaatgcagcaaaaaccatgattacagaatttatagcattagatgcatacagtaggaaagaaaataagatctaaaaccaatactctaagctgccatctcaggtaactggaaaagaagagcaatataaacctaaagtaagatgaataaaatcagagcaagaactgatgaaattgaaacaagaaaacagaaaatcacaacagaaaaaacaaatcagtgaaacaaaaaactgatccttcaaaaagatcaatataattaactgaagagagaggggagaaaaaagataagacaaactagtatcagaaatcaaagaagaatcttcattactaattccttgaacattaaaaaaataaaagaatactaagaactctatgcccacaaagttagtaacttagttgaaatggagcaattcttggaaagaaacaaactaccaaactcacacaaggagaactagatcatctatttaaaaaaaaaaaaaaaaaaaggccaggcgtggtagctcatgcctgtaatcccaacactttgggaggccgagatgggcagatcacctgaggtcaggagttcaagaccagcctggccaacatggtgaaacccccatctctactaaaaatacaaaaattagccaggcatggtggtgggcgcctgtaatcccagctacccaggagattgaggcaggagaatcgctggaactcaggaggcagagggtgcagtgggccaagatcatgccactgcaccctaggagacagagcaagactccatctccaaaaaaaaaaaaaaaaaaaaaaaaaaaagatcaataaataaccttccaaaagaaggatttacaaagcccaactgacttcactggaaaactctaccaagcatttaaggaagaaatggtagcagttctctacaaattcttttagaaaataagcagagggaatacttcctaattaattcaaagtattaccctaataccaaaaccagacaaagatactacaaataaaggaaaactgcagaccagtatatatcatgaatataaatgcaaaaatccttgacaaaatattagcaaatcaaatctaacaatgtacaaaaagaattacacaccatgatcaagtgggatttactccaggaatgcaaggctggctcaacaacttaaagtcaataaatgtaatccatcataacaatagtctaaagaaaaaaaatcagctgggcatggtggctcacgcctgtaatcccaacactttgggaggccaagtcgggcagaatacctgaggtcaggagttcaagaccaggctggccaacatggcaaaaccccatctctactaaaaatacaaaaattagccaggcacggtggtatgcacctgtaatcccagctactgtggaggctgaggcaggagaatcgcttaaacccaggaagcagaggttgcagtgagccgagattgtgccactgcactccagcctgggtgacagaacaagactgtctcaaaaaagaaaagaaagaaaaaaaaaacacatgataatatcaataaatacaggaaaactatttgacaaaatccaacattcattcaggatttaaaaaaaaaaaaaaaactcccagcacactaggaataaagaaaaacttcaattaaaaaaaaatctacaaaaaatcctacagctaacatagtagtgagaaactaggtgctttctagaaactaggttagaaaacagacaaggatattcattatttatcacttgtactcaatactaccagaggttctagctgggaccatcagccaagacacagaaataaaaggttcccaggtaagaaagaaagaagtaaaacaatcatcatttgcagatgacatgatgttgtatatagaaaactcgaaggaatccgctaaaaaaattattggaactaatgaacaaattcaatttgtttcaaggatacaagatcaatatgcaagtcaagtatatgaactatacacttgcatgaacaattcaaaaatgaaattaagaaagcaattccattcatagtaacatcaacaaaaggaataaattgaagaaaagtgcaaaacttatactcaaaaactataaaaaaatgtttggatctaaataaatggaaaaatatcccatattcatggactgttagacttaatattgttaacacagtagtatttcccaaattgatctttcagattcaaccaatcactgatagaatcccagctaacttcttgtagaaactgagaagctaattctaaaattcatatgggattgcaaggaacccaaaatagccaaacaatcttgaaaaagaacaaaatgggactcacttcctcacttcaaaatttactacaaagcaacagtagtgaagacagcgtgatactggtataagaacaagacatggccgggcgtggtggctcacgcctgtaatcctagcactttgggaggcaggcagattgcctgagcgcaggagttcgagacaaacctgggcaacacggtgaaaccctgtctctactaacatacaaaaaaaaactggccaggtgtggtggctcatgcctgtaatcccatcactttgggaggccgaggtgggcggatcacgaggtcaagagatggagaccatcctggccaactcgatggtaaaactcgatctctactaaaaatacaaaaagtagctgggcatggtggcgcacacctgtagtcccagttactcaggaggcggaggcaggagaatcacttaaacccgggaggcagaagttgcagtgagctgagattgaaccactgcactccagcctagcaacagagtgagactctgtctcaagaaaaaaaaaaaaaaaaaaaaaaattagccgggcatggcagcgcatgcctgtagtcccagctacttggaaggctgaagcaggagaactgcttcaacccaggaggcagaggtcgttgcagtaagccaagatcgcaccactgcactccagcctgggcaacagagcaagactccatctcaaaaaaaaaaaaaaaaaaatagaacatgtatacagatcaatggaatagaactgagagtcaagaaataaattcatatatctataatcaactggttttcaataaggtatcaagagcattcaatagtggaagtgttgaaaagtctttccaaaaatggtgctgggacaaatagatacataaccaaaaaatgaaggaagaaccctctttcacatcattattatgacatatacatatataaatatattttatgtaattaacattatatattaatatgattatagcattattcctaatagtcataaaattgcaaacaaaccaactgtccattaactgatgaatggataaagtgtggtatatccacacaagagaatattattcagccataaaaagtactgatacatgctataatatggatgaaccctgaaaacattatgctaagtgaagccagtcacaaaagaccacattttttaagattcaacttacatgaatgtccacagagacagaaaatagattagcggttccttcaggttgagggtttggagaaaggatctgggggtaacagccaaagggctgtcacagggattcattttgagatgatggaaactttgtttctttttgagactgtgacttgctctctcccagactggagtgcaatagcacaatcagggctcactgtaacctcaacctcctgggctcaagacatcctcctgccttagcctcctgtgtagctggaactacagatacacaccaccacgctcggctaattttttgatttttgtagagatggagtctccctatgttgcccagactggtctcaaactcctgggctcaagcaatcctcccacctcggcctcccagagttctgggattacaggcacgagccaccatgccccgccaatggaaacatttttaaattaattggggtaatagttgcacaactctgtgaatatactaaaaaccactgaaccgcacactttaagtgaatgacttatatggtaagtaaattatatctcagtaacactgttaaaggaaaaacaaaaaatcaaatacctttagtgtacaagttcaacaaagactcctagtcacacaaaacccacttgtataacactaccagagtccaggggagaatgaatggcccactcaagtttctgttgactgtccatatactagtacaatgtgacataaatcttatgccttgaacttgcttcttgatgaaagaattatggtatacattctccaatctatacaaaatgtatcctattaaaggaaagaaatttgtgagaacaaagaaattctgaagccaggctcaatggcacatgtcttgtaagtcccagctacttgggaggctgaggcaggaggattgcttgagaccaggagttcaaggacagcctgggcaacagagtgagacttgatctgaaaagaaaaagaaaaagagaaagaaaagaaattctgaactaaaatttataagctgggccacgcacagtggcttacacctacaatcccagcactttgggaagccaaaacaggaggactgcttgagcccaggagttcgagaccaagctgggctaaaaagtgaggcccttcagggtcgatcacctgagcccaggagtttgaggcttcagtgagctgtgattgtgcctcttcactccagcctgggcaacagagcgagacgatatctctaaaaaagttaaaataattttttaaaaaatgtacaagctaaatagcaaaattgtcctggcagagtgagggaaggaggtagggagttaattaccttaaaaaaaaagtctcctccaaaaacagttagtattaacacaaaaggaacttatattatacaagatggcttaactccctaaatgttctaaaactggtggttgagtagtcagtgtttatgagtaacagtttgttgcttgaggtatttttcaataaatagcctaaataaaaccagttactttagaaacagttaatgtaacctactggaacaaagagtttggaatgaaaaaagatctgtaatttatgttctctcaaatccaaaatggaaatatgtgatgataggggtgccataatatttatgatactgcaaaagaggcaatacatacatttgggacttaaagctggaaaagctgcaaaggacagagtattttcaggcaacaggttcaggaacgtaaccaagaaagtctctcctaaaatgctgcaataaggacttcaaacaatattgtaaacacttccatctcgtttatttctgattcctctagctttggtaacatttgatgaagcttttctgactcaaatctaatccaatttaaaacctgcatagggaagaattaaaacttagttttgattccaaaatcaaagtctcagcagcagggaccccaatatgctaaggggaagatagtccacataacctctgtatccaatcctctttttttttttttttttttgagacagagtctcactctgtcacccaggctggaatacagtggcatggtctcagctcactgcaacctctgcctccagggttcaagaggttctcctgcctcagcctcctgagtagctgagattacaggcacctgccaccacccctggctaatttttctgtttttggtagagacggtgtttcaccatgttggccaggccggtcttgaactcctggcctcaagcagtcgacttgcctcggcctcctaaagtgctgggattacaggcatgagccaccgagcccagcccaatccccttatcttatattcaggtaataataataagcagcagcagcccacaatttttatttccttattgactcttaaaaatctggtcaaggccgggcacggtggctcacacctgtaatcccagcactttgggaggctgaggtgggcggatcacctgaggccaggagttcaagaccagcctcaacatggagaaaccccatctctactaaaaatacaaaattagccgggcgtagtggtgcatgcctgtaatctcagctactcaggaggctgtggcaggagaattgcttgaacctgggaggcggaggttgcggtgagccaagatcgcgccattgcactccagcctgggcaacatgaacgaaactccgtctcaaacaaacaaacaaacaaaaaaatctggtcaaagtttgcctgcttctcacattggcaaaaataataatataaaattcaaattatcagcattttgttacataagttctatagtttcaataataatattcaacattatagttataatttatattcaatatttatatattatataatatatattatataatatataatatatattatttataatatataaatatatttatatattataatatataacatttatataataaatataattaaataagctaaacttctacattaaatctggcaaatagtttatgagcaaatgaacttgtatacagacgtatacagataattttaaatcaacaaaatacacatcagaatagctaacattaaaaagattgacaatacagttcacaagatatacagcaactgtaagtctctcacactgctgatggaagtgtaaaattaatgaaaccacttcggaaaaaaattttggcaatccctactaaaagtaaacgggtatttccccctgtgacccagcaattctactcctgggtataaacccaacagaattcagtgcttacatcacaaagactttacaaaaatgttcattagcagttttattcataacagaaaaaaactagaaacccatatgtctatcagtagaaagggtaaattatgacatattcatccaatgaaatatcactcagcaataaaaataacatacaacatatttctgacacatgtaacaatgtgcatacaccagccttaatgcttagtgaaagaaacaagacacaggagtacatactctatgattacatttatgtgaagttctatagtaggcaaaactaatctacattaatacaagtcagaacaaaggtggcccttgagagccggagatagcagtaactgggaaggggaattagagagcctcctagaatgcaggaaatgctgtcttgttctgagagacagtggttactataacatatatatatataaaaatgcactggctatattaaggtttatacactttatgtatgtaagttacacccaataaaaaataaataataggccgggcgcggtggctcacgcctgtaatcccagcactttgggaggctgacacaggcagacaatgaggtcaggagatcaagactatctggctaacacagtgaaaccccgtctctactaaaaatacaaaaaactagcagggcatggtggcgggaggtacttggcagtctgaaacaggagaatggtgtgaacgtgggaggcggagcttgcagtgagccactgcactccagcctgggcgccacagcgagactctgtctctaaatacataaatacataaataaacaaataaaaataaaaagacccaaggaagcagcatttaaaaatattgttcctcctccaaatacatttcagtcttgagaaagaacataagacagtttttcttcatgtatttgcacatttcccatgaaatctcagacactgttatccttaaagaggaaggtaaaatcaagttcaacatcccatagggctcattctgagatatttgtgcttgtggcaagttatatgtagcagtgcgtatgattcttaaagatagttttttactcctggtctctggcaacagtttggggagcagctctttaaatagcaaagaataaaaacataaaggacagtttttttaaaatgccattaccaaatatgctgtagaaggagtcaaaactcttgagtagcaaatacagcaaggatcctttatttattgagcttagataccagtgcatagcaagaaaagttacatttgtactcacacatatcctcccatcagtctagttcaactctgaagtaaaccaaagtaaatatttataaaagaataatttagtgtaggtatatcctataaagtaacctgtactttacttattgtagatatatgggaaaatgaccaaacataattttacataatagtttttagaataaaggctctggcatcaaattgcctagtctcgaatttaagtcttgccacttactttgagtctcgtttcttcaactaccaagttgaaatataattatcactgcacagggttatttctgaatactaagtaagataatgcctgctaaatgcttagtaatcaaaataccaagaattcagtaaagattcaaaaaccgttacatcacaaaatagtatgtgcttcctaatggaagaatacgtcatcatctatgaagtactcttgccaaaagagcgtcaaacttgagtctgatgaagtctctagattcaactaacaacttacagaagattcacagaatgcagaacatgtaaaactacaccaacgggatgtaatctgcaaatccagagtgggaaaccctataaccaacaatcagtatcttcaacaaataaattgccaagaaaaagagagggagggagggaaacctaaaatgcattaaaacactttgaagacaaccaatcacaatgtggactattaaaaaaaacaaaaacaaaaacgaaaagcagttgaggtggccaggcatggtggctcacacctgtaatcccaacactttgggaggctgaggtgggaggatcattagaggtcaggagttccataccagcctaaccaacatggtgaaacccctatctctattaaaaatacaaaaattagccaggtgtcgtggtgcgcacctgtaaacccagctacttgagaggctgaggcaggagaattgcttgaacccaggaggcagaggttgcagtgagctgagatcacatcactgcactccaaccttggcgacagaacaagactctgtctccaaaaaaaaaaaaaaaaaaaaaaaaaaaaaaaggcagttgaggcaacttgaaaattgaacacttaaaagacattaatattaagggattattatttctatattattgtaatgttcaaaaaagtccttatttttaagagacacatactgtaatatttataaattaattgatcacagggatttacttcaaaataatatataaggtgtagactgagttagattatagatgaaatgagattggaattgataagtgctaaaaattgtttagtatatgggcatttattatattattgcctacttttacatgtatttattaataaaattcttcataataaagttttacaaagaaaaaacaggaaatggtataaaagtagaagcaactccatagagaattaagaatccttatctaggagaatttagtaataatagctatcaccattacttagcatcaatatcgtaagcactgtgtttagtttcatgtatattatataattctactaaattaagttttgaccattgtaaactgattcctagatttcaaactacaacagcgagacgtgacaatctaatcagcatttttctaacagttcctacagacactggaataatctatttcactttgaaaaggtttaaaatcatgcagccataaaaaaggatgaaattatgttctttgcagcaacatggatgctgctggaggccattagcctaagcaaattaatgcaggaacagaaaaccaaataccacgattttacttaaaagtagaagctaaacaagggtactcacgtacacaaagatggcaacaacagacaacggggagtactagaggggagagggaggaagagggcaagggttgaaaaactattggttactacgctcaatacctgggtgacaagatcaattgtaccccaaacatcagcattaggaaacacaccctagtaacaaacctgcacatatagcccctgattctaaaataaaagttaaaattatttttttaaagtaaacactttggattgtaactcaagtataaatgagcccacactgatataaaggatggaatgaataaataaataaatagggagaagatacacctcttcccaacagaagaatcctaaataatatatttagatgtcttcctcctatcagaaggtagagcttaatcctcctctttccctgttctttgaggttggggtggaattaatgactaaaaaatatcaagtctgcagtggtgaaacctggcaaacactagcttaaccaacaggtgaagagtaccattcctagcagtaccacgtgactatacatacccccagatacaatgtgatgagaagggtacttgacctcaggagtattctttccaaaatcccatcaccccagtctaaccatgacagaaatgtaagacaaacttaaattgaggaacgttcttcaaaatagcttaccagtatgcctcaaaatagtcaagatcaccaggctcacacctttaataccagcactttgggaggctgaggcgggcagaatcacctgaggtcaggagtttgagaccagcctagccaacatggtgaaaccccatctctattgaaaatacaaaaattagctgtgtgtggtggcaggcacctgtaatcccagctactcaggaggctgaggcgagataatcgcttgaactcaggaggcggaggttgcagtgagccgagactgcgctactgcactccagcctgggcaacgagggaaactacgtctcaaaaaaaagtcaagatcatgaaaaaagggaaaggctgagaaactcacagaccagaagaaactaaggagacatgacagctaaatctaggaatcgtattctgtattagagatcctggaatagaaagaagagcaccaatggaaaaactgcagaagccggaacgaagtcaaggacttagttaatagtaatgtaccaatcaatattggtttcttagttttgcaaatgaatcacactaatgataacattagaagaaactaggtaaaggattcaggtatacaggctctctttgttatattccaatataaaaaatgtgtttgaaaacttaaaaaaatatgacctctaatattgtgttaaaaatgaaaaaaacacttctaaaaaatcagctgacaaaaaattgtagtatcaaagcaaaaacccatcaacagttaaatggataagcaaaatgtggcataatcatacagcagaatatttatttttattttatttatttatttttgagacagagtttttctcttgttgcccaggttagagtatgatggcacaatctcggctcactgcaacctccacctcccaggttcaagtgattcctctgcctcagcctcccaagtaactgggattacaggtgcatgccaccgcgcccagctaatttttgtatttttagtagagatgggttttcaccatgttgccccagctggtctcgaactcctgacctcaggtgatctacccacctcggcctcccaaagtgctgggattacaggcgtgagccccaacaccctgccctcatacagtagaatattaaagcaacaaaaataacgcaaaaacatgagtacatctcaaagttataatgttaacaaaataagccaaacacataatacctatggtatgatttcattcacgtaaagttcaaaaacagtgaaatgaacctgtggtgaaaagttcagaacagcagttagttttggtggggggggggggggggtagacattaactgagaaggaacacaaagtgggggttgttctgtattttcatctggatggtggtagtaagggtgtatacctatgtaaaatttcatcaagctgtacacttaagatttgtgcaccttttctgcatgtaaattatacttcaaaggaaaaaaatttttaaggaaaagatacatttatctaaagcacacccctaaataagcaaataagaattagaagtggggggggcagggcatagaatacttgagtgtaacatttatttaggaggggaaagccaacatcccccacaccataaccatacccaccaattctgtctttgattacagattttaatctcctcttataaaactactcactactttcatcaactgcatacttacatacattgactcaagtcaacactgaaaacttaaactgtcagtatgtcactactctacttctttcagctagcatcccacctgtgcaggcatacaggttaataaaataaatccaactaccccattatttctccttctttactttcatctcataggaaaagcatgacccaccacatgatcagtttaagtggaggcacattatccaaaaatcagataccatttaaatgcaatttttgattgacagaataaggtgatttatatcaggaattctatagggcaatactataaatgaaagccaataaagacatttcagcttagaagccactaactagatgtataacctcactcaagccatcataacctttgcatggcttctgcaactcccccaggaaaagagagttccgtttgtgcagagattgcaaatacacggcaatggggggctgctactccactctgaacagccactactaactgatcagagatggaaacagaaatggcacctgaggtgaaacttatctgtcattcctagataagtgatctaagcttccctccccttctaactttctactgtctgtgacctacttggaacaaaatacatttgcactaaacagcttagacacagatagatacaatatacacaagctaacttaaggacttaagaggacctcaaaatatagaaatcctttatcatctttaaatgtacagtttttttaaaaaatatgccactacttaaacatttctctatttcagatgtaaaattctagatcaagtctaaataggaaaactttagctgagcatggtggctcatacctgtaatcccaacacgttgggacgctgaggtgggagaatcacttgaggccaggagttcaagaccagcctggacaacatagtgagaaccccatctttacaaaaaatttaaaaatcagccaagcattgtggtgcatgcctgtagtgccagctacttgggaggctgaggtgggaggatcacttgagcagaggaggttgggctgcagtctactaaactgacactaaaagccatgttcacaccaccgcactccagcctatgtgacagagtgagatcacgtctcaatcaatgagacaaactttaaaatgatgtacctttctcaatgtcccaaacatgtaaaacaaagttttctaatataaactatgctattgatactcaggtatatttgagaaagcctgaaatgatcgccatgaaaaaactttactgaaaagcttcctggaaaaccaaatgagaatgtttaccttatttcttacctcgaagagaatgcacacccaattacaaatgtcacagaactcataaaggtgagcaccctgacaggtgtttagacaattacctaattctgtcaaagtattatttctaataattcatgtggcttctgaatgtcaaaagttccctatatagcaattccactaagtgctccactccaaaatttccaattccttctcctgttccctttcaaactcccattccctcagtccaacttgcaattatcagaaaaacattccaactcgagtgaaaaaattttttttgcttttttttttcaggagagaaagtcagagtcagggagagataggtaagtagcaattgtctggtaccatctcaaagtgaaaatgtatagaagggaaagagattcatcaattaaaatgtaagtatctcctaagacccagttcttgtgccaggtgcttgataatcaacagagggcccacccatgacagagattaaagtagccagaaaaaaataagcaactaaagtaatatcaataaaacatacaacctgtaccatgagttaggaagaggatgtaatatagtcctagatgtcagggaaggcccccatgaaaagatgagccaagaataccataatatttgaggaaaaaacatggcatactcaaggaacagcaaaaactatagtttatttgacatatgaagggcaagagatgagattcagagatcatggatggctgcagaagccactctaaggaactggactttatctccaaaggtaatagtcactaaaactgacttgtttgaggaacacagatatactttttcaaaggtctctatccacctactttactcactgtaaaggtggccaaaaggaaagtgtgaagaagtaacaaaaagggaaagaagataaacagtacttcagagacttctaggatatactcagacaacttgggttagagccacaatgcctggaacacagatgctcaattatatgtttccatatgcagtatatgcagaagggaattatggcgatgaagaatcaagagctcaaacttacattactgtattgaccaggaagtcctataaagaattatatttctatagaattaaaaatgcagttctgtcagcctggacaacaaagtgagacccccatagctacaaaaaaaaaaaaaaaagtttttttaagagttgggcatggtggcacacgcctgtagtcctagcttctcgggaggctgaggtgggaggattgcttgagattgggaggttgaggctgcagtgagccgtgatcacaccactgcactccatcctgggtaacagagtgagaccacttaaattaaaaaaaaaaaaaaaaaaaaaaaaaaaaagatatagttctggtttttgtctatttttttaacaggcatggttggtacttttttctttttaattgggttcaatttaaaagactattcaccttgttatacatgtatctaagcatgaagtccagtagaaatgacttccctttacgaaaagctcctgccacagataccactactatgttaagatctcgtatgtgctcctgtagcaatatctgctccaaagcttcttcatcaagttcaaagttatggtcatcttcatgagcaagaacaatctgtactggacatggtttcttcataacctcatcagaatttactaggtcatcatcttcataattctcacctagaatttaaaaagaaagaaactggttactttaatccctatattacgaactttcattaaggaccacaactaaagcaaaatttcaagtaagtaattgccccctccccccattatagatcattataatgttcctttggatttctcactccctctgtgacaggacaaagaatgctgataagatttcccacttgatatggttggctgtgtccccacccaaatctcatcttgaattgtagctcccacaatttccacatgttgtgggaaggacccagtgggaggtaactgaatcatgggggaggctctctcctgtgctgttctcatgatagtgaataagtctcacgaaatttgatgattttataagaggtttccctgcacaagctctcttctcatctgccaccatgtgagatgtgcctttcaccttccgccatgattgtgagacctccccagccacgtgaaactttgattccattaaacctctttcttttgtaaattgcccagtctcaagtatgtctttattaccagcatgaaaatggactcatacaccattatacatacagataaacaataatactaaatatggcctctatctcaatgaagtcttaacttcattgagaatgttcatgtcaacagcacctgtttctgagccctgtattattctgtaaataacttttccaactgtatgcacacataaactaaagaggggaaaaatcaatttcacctgatacttcaaatcccaattttccctgtaagcatcacctagaaaattcacaaacattactctactttacaaacattaaaaacatatattaaaattgttcatgtggctgggtgcagtgggtgtaatcccaacactttgggaggccgaggcaggcagatcacctgaggtcaggagttcaagaccagcctgaccaacatggggaaaccccgtctctactaaaaatacaaaaattagctgggcatggtagcgggcgcctgtagtcccagctacttgggaggctgagacaggagaatcgcttgaacctgggaggcagaggttgcagtgagctgagattgcaccactgcattccagcctgggcaacagagtgagtctcagtctcaaaaaacaaacaaaaaaaaattattcatgttatttttcattctgaaacttaaaggggaaaattagggttctaacaagtttccaaaaatgatacttacaatgagtccctaatttaataacagtaacctagtactactacagcctcctcattaaagcaaagcacaggattaatgtttcattaaagaagagtcagtgagatgcatttatatctcagaatttcatctcccactggagctctttctcaccaaacactacagctgttatagctcccgaaaacagccatataaacccttcctttgttcaccacaacacattaaaataaggtaacctttgcagacataactttactgaatagtgacgaagaagtacagagaatgtaaatagcagagataaacttccaaagtctaggtttctgttcttctttaaaaaaaacacctagcttcagaggacacataccttgtctgactttcttctctaccaactgcttgatcccacgtagcaactagttactcctggggaccttatcttctcccacatcaaaatttctaagagatcccctccttgagcctgtctactaagtgtcagtttccactctaaggacacatacggtatccactgttttcaatgcaatcaatgactgtcctactctgaggagaaagccagtccactaaggcgtggtacattattagtgaacagttcagtaataccttatccacataaccaatattcacagagcaaagattatataactacattagtggatttttaatcttattaccaaaagaagcatctcacttatctgatttgcaaagactattagagcctctacctccacatcacgaggcacctttaactgtatatagcaaagtcaacagcactatttcaaaatgtgctgaaaacaatgacaatgcattataaagagcaagccacttcaaaggagaatctttgaaagtaaaagcaatcaatatttagttaaaggggacattatcactgcctgtatcaatggtatatagcaatagtcaggtatgctatttgaatgcatgcaaaaagtgaactttccaggaaaagttgcaatacagttaaattctaaattaacgtctcattaggtaggtccagataaataacaaaacaggatgcaaacggtataagtttctaagcttaattagtggtttaagaccatgaagtagggagcaaactgcctcgatgcatgtcacttaacttctctgcacctgttttctcatctggaaaatgggtgtgtgtcaaacaggcatagcattacctaactcatagggttgtcatcaggattcaatgagttgaaatatgtatgctacgcagtaagcaccataggtgtaagttaacagtaatttcaaaataaccaatccaacaggagaagcttttattttccccttgaaatgccaaaatgctatggtgattttcacttgaccagtgtagctgcgtactgacactgccatccacccatctgctctggcacagacttgctggctgtccttgacatatagagatacgtctacgtgtcttttacttacccctaaatctaatcaataaccaccttcttaatttgtcttcatttctgaatctctattgataatattcctgcacttgtcactgccacagtacctcacactgtagcatctaactggtttcccttcattaatactcttgtcctcttacccaatccaatctaatctccacagagtagcaactaaataatatagttacatgtaaagttgaccaggttaccctccttaaaatcactgttacagaggactaatgactaaaatcctacacatgctctataaggtcccgtactcaccgccaatctctgttgcctcttttggtgctattcttctctttaaaccagcggtccccaaccttcttggtaccagggtctggtttcatgaaagacaagttttccacagaagggggagcagtggtttcaggataaaactgttccatctcagatcatcaggcattagttagattctcataaggagcacacaacccagatccctcacacgtgcagttcacaataaggttcgcgctcctatgagaatctgatgtcaccatgggtctgacaggaggcgaagctcaggcagtaatgctcgctcgcctgctactcccctcttgctgtgcggcccagttcctaacaggccacggacgagtaccagtccacggccctagggttgggaaccccaggtttaaactaggtagccaaactaacctttcatcagatcctcatgctgctaagctctttctagactctgctttaatattcctctgcctagagtactctttcctttgttgtttcctaataaattcacacttactccttaaatctcagcttaaaagacactttccaggaacaagaatcttccctgaggcttccaaccaagtttagtcattctatactccccaaattttaatctatcacttgaatatttatgtaagtacttatttattaaatgtctcccctcttggattgccaatttaccacttagtttcccatcataagcagaaaatagacaaacaaaagaagaaagcccttaaataccttaccatggcttctatagtcgtatgcgatctgggcccagcctcctctccatagcagagggccttataaagcacatgtcatcttacaacacactcctattcattcccaaagcctggacaatctggccttcttgctgttccctgatgaagctaaccctgtttcccaccttagaatttttgtcctgtgttgtcccctatctggaatgctctgtccctagaaattcacatggcttatgtctccatcatccagctcttcagctcaaatgttatctcctcagcatggccctccctgaccactcaatctaaatcacagatccctttccttaacactttaatgaaacaggtttattcatagtttttttcaattcctaaaacaaccttttttcattcgtttaaatgtgtacctgatatctcccactccacagaatgagtgtgccactaaagtaaggatcccaatcaccctgttaaccattctctaccagcacctacaacagtgcctgacacctagcctagcaggttccttgtaaatatttcctgaatgaatgaaatttaagcattttactcaggagtcttacatctgcccttaccttttttttttttttttttttaaggcagagcgctctgtcacccaggctggagtgcagtggtgagatctcgactcactgcaacctctgcctcctgggttcaagccattctcctgtctcagcctccagagtagctggaacaacagatgcccaatgcctcgccaagctaatttttgtatttttagtagagacaaggtttccccatgttggccaggctggactcaaactcctgacctcaggtgatccacccatctcagcctcccaaagtactaggattacaggcatgagccactatgcctggccctgcccttacctagtttataagcaaatatgataatcaaatagcttggggaaatacctccgacaactcaagagtattaagtatacgtaacacaaaaattccataaaaattatgaagcttggctaggcgcggtggctcacgcctgtaatcccaacaatttgggaggctgaggagggcggatcacctaaagtcaggagtttaaggccagcctgaccaacatggagaaaccccatctctactaaaaatacaaaattagccaggagtggtgttgcttgcctgtaatcccagatactcaggaggctgagggaggagaattgcttgaacccaggaaacggaggttgcggtgagccaagattgcgccattgcactccagcctgggcaacaagagcgaaactccatctcaaaaaaaaaaaaattatgaaccaagtaaaacactttaaaaaagaactcaaaagtaataactgctaaaatatcacaatgaccaagtgtggaggttggtgattttgctaaaacaaacaatagttttgctcttattgtaaagaaagcattagttggttttttagaagtttaagaaaaaaaaaaaacccaaaagccaaaattgacaaatggtatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaattcacaagaaaaaaacaaacaaccccatcaaaaagtgggcaaaggatatgaacagacacttctcaaaagaagacatttatgcagccaaaacacacatgaaaaaatgctcatcatcactggccatcagagaaacgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagtcatcccattactgggtatatacccaaaggactataaatcatgctgctataaagacacatgcacacgtatgttcgttgtggcactattcacaatagcaaagacttggaaccaacccaaacgtccatcaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaactgaacaatgagaacacacggacacaggaaggggaacatcacactctggggactgttgtggggtggggggaggggggagggatagcattaggagtatacctaatgctaaatgacaagttaatgggtgcagcacaccagcatggcacatgtatacatatgtcactaacctgcacattgtgcacatgtaccctaaaacttaaagtataataataaaaaataaataaaataggaaaaaaaaaaccccactgggcagaaaacctttgttaactcgaaaattcacctatattagttggccagtcactatgcaaccaagtttattagcacagacaaagacaggcctttcaaatagacagaatgtgtctacatatttgtcaccatatctagtctacagccttttacagagaagggtagcaaatagatttcaaaagtataatggagcctaacaatgatgtgatacacctgcatctatctacttactccccatggtgatttctctaccaaatatggactaaatacagataaagtactccatcaaacactgatataagcaaatgaataaaagagaattgtatgtaaatttcattaggatacctgtaaatactgtactagcatttagtgattgcctacaattaaaagtctctaaattccacaccactctaagattttaaactgaagttacgtcctgtgtatagaatagtgattttatttccattcttcaatgccaaaaatttactaagacaagtagatttcagccccccaacacatttttgtgattcacagttccaagtcagttttccctacgctagcccccagatgggtctttcaaggtcaaagctaaaagacacctaaagatgatcacctgcttctcaaacatctctccacacattaacactaaggtacctacctaatatctatttgccacacggcctaacaaaagaaaggtgtcttagtaaaaggacctgtgattgccaggggttagggggatagggagggatgaacaggcataacacagaagatttcttagggcagtgaaactattctctataatacgaaattggttgatacctgtcattatacatctatgaaaaaaaccattgaatatacaaccccaagagtgaaccataatgtaaaactatagactttggatgataatgatgtgttagtgaaggttcattgattttaacaaaagcaccactgtgggtgaaacgctgatggcgggggacagtgtgtatatggagtggcagggagtacgtgaactacaatttcgcttcatattgctgtgaagctaaaattgctctaaaaaaaaaaaccaaaaaagtctatttaaataagacacctgtctttttgttgtctaatcacacattatcttaaatctgccaaattcagacactcagcatgtattccaacagcaaaatttacacttcagggctgacctagatcctcagcaaatttcaagcttaattataaactaagataataaaaaagtgctacaaatcttcattataataaaatgtagcattaatgttagattacatcaacccaaaactaaacttataaaaagagaacaaagaataattcacctttcaaaaggaatgaaaagtatattttattattcacattccaaacaaaaacttgaaacaaattttcatggaaagtaaccttgattcagtctattcagtctacttataaaaaaattagttatcccacaaaagctaagtaacgtgttagtgcctagtacttgaacctcaacatttatatttcatacccaagtgaaaacagtatctaagtattcaagtttattctagcacatattttttaagagccttaaagaggttatacgatggttaaatatatttctagggatttattataaggaaataaggacactaattttattctggtggcaaaaattaatgttgcgtacctcaaaactggaaagtggccgaacagttattttagccatatactgacatattatgcagcctaaaaaacacatttacactctaaaaaaattatacatatatatatttaatttttttttttttttgagacagagttttgctctgttgcccaggctggagtgcagtggcacgatctcggctcactacaacctccacctcccaggttcaagcaattcttctgtcacagcctccagagtagctgggacaacaggcacctgccaccacgcctggctaattcttttgtatttttactagagatggggtttcaccttgatcaggctggtctcagactgctgacctcaggcgatccacccgcctccgcctcccaaagtgctgggattacaggcgtgagccacctcacctagccaaaaaaatctatgtattattttaaacagcataaaattggccgggtgcagtggctcacgtctgtaatcccagcactctgggaggccgaggaagtcagatcacctaaggtcaggagtttgagaccagcctggccaacatgatgaaactctgtctctactaaaaatacaaaaattagctgggtgtggtggcaggcccctgtaatctcagctactcgggaggctgaggcaggagaattgcttgaacccaggggtggaggctgcagtgagccaagatcgcgccattgcactccagcctgggcgacagagcaaaactctgtttcaaaaacaaacaaaaacaacaaccaaaaaaaaaaaaaaaaaaaaaaaaaaaccaccataaaatcaagtgggaaaagggcagactacaaagtagtaaaaatcacccccaattctattttgcattttttaaaacacaggtatttgggggagggaggatatttgagacttctagtcattagagtaactggtatcagactggccctcgaccgtggctataaaattagacaaaatacatgaagcattgtttttcaagcaatggacaacaagtagcacaaggacactttcaaggtgagtgccatgatcactcccagctctctgcctgggaacaatttcctaactatagagtgaagaactagagcacaaagatctgaattcaagattgctagagcagtaggaatctgtgaggcaggataccagagaaaaaggatctatgcagaggtggagcccagaactccttggacaaggacaacaagcatcacaggtgcaggggaacacaacactatgcaatgcttaacagaaggaagctactacagggttgagagagaaacagaagtcaaacattactgagacactttggagttctggcccagccagagtggaaagaaacatctataccttaggcatcaagctgagacactagaatcgacatatcttagaattaagggtcaagttctagagtaaggcctactgacaatccatccaatcaaagcctaaataaaaccaagacttgaaaagatctgcaaggtacacagtttggaaatttagtcccactaagttagggagatttcctctaagctttccacagacccacactaacgaagtatgaagcaaagccaaggtcaagatccatcagtaattaacctgcttgccaaaccaaaaacaagctaagagaatccaaaatctctacaatgcataacatttaatatacagtatataaatcagaaattactagacatacaaagaaagaaggaaatgtagcccatagtcaagaaagaaaagcagttaacagtaccaattctgccatgacccagatgctgaatttagcagacaaatgcttttaaccagatactgtaaatacgttcaaggacttacaggaaaataaagtcttaataaataaatagatgaggagtctcagccaaaaaactatagaaactattaaaaaacaaatgaaaattctagaactgacaagtacagtaattaaaatgaaatactcactggatggacaacagcagactgtaggtaacagaagaaagtttgtaaacttgcaaagagatcaaaagagattttctaatctgaagtacagagagaaaaaagaataaagaaaaactaagagagtctcacgaacctatggaacactatccaacctgcatttagaatcccagaaggagaacaaagtgaggctggagctgaaaaaatatttgaagaagcaatagtcataatgttaccaaaatttgatgacagagatttacaggtccaaaaagctcagcaaacctccagtacggtaatacaaagaaaaccacatcagccagactgctaaaaaccaaaaaccaaagataacaggacacagagcagaatattcaagtaattattgtatagttatgtaataattatacaattatacagagcagaataattcaaataactgctgcttatcacatcatcactgaagcactggaggccagaagacaagggattgatagctttagagtgtttttaaaagaagtgtcaacctagacttttatattcagtgaaacgatcattcaaaaatgaaagcaaaataaagacagcaaaagcaaaagtatggccgggtgcggtggctcacgcctgtaatcccagcactttgggcggccaaggtgggcagatcacgagaggtcaggagatcgagaccatcctggccaacatggtgaaaccccgtctctatgaaaatacaaaaaattagccggcgtggtggcacgcacctgtaatcccagctacttgggaggctgaggcagaggaatcacttgaacccgggaggttgcagtaagcgaagatcgtgccactgcactccaacctggcgacagagcaagactctgtctcaaaaaaaagcaaagagtatctgtcattagcagatgtgcattacatgagagctatataatgttcttcaggctgaaatgaaacattatcaaatggaaagtctctttattccttcctattgatctgaatccaaaatagtaaacagatacaaatataaaagactggttctttcttccaactaatctccctaaaagataattgatcaatgtggggtttataaagtatgtagaagtacaaaattttaaaagacatgttatgaggcaaagtaaatgaaattacaccctaaggttatgattttaaagtggaaagtggtaaaacattgattctaaataggcagatatattaaagatgaatatcattagccctagagtaacggctttaaaacaaacaaaaagaaaaaaggtatagcttaaaaagccaataaggggccaggtgtggtggctcacgtctgtaatcccagcactttggaaggccaaggcaggagaatcacctgaggttgagagttcgagaccagcctgaccaacatggagaaaccctgtctctactaaaaatacaaaaattagccaggtgtggtggcacatccctgtaatcccagttactcgggaagctgaggcaggagaatccctttaacccaggaggcggaggttgcagtgagccgagattgtgccattgcactccaacctgggtaagaagagcgaaactctttctcaaaaacaaaaaccaaaaaaagccaataagaaaccaaaataaaatagtaaaaaatattcaatgaacccaaagtaaaaaataagaacaaaagacaaaagagatgaatgaaaaacacgcaagatggcaaccttaaacccaactaaattcaataattacatcaaatataaatacactaaacactccaataaaaacgcagagactgccagactgggtaataaaagcaaaactatatactgtatttctttgttgtttttgagatggagtttcgctcttgttgcccaggctggagtgcaatggcacgatctcagctcactacaacctccgcctcctgggttcaagcaattctcctgtctcagcctcccgagtagctgagattacagtcgccctccaccatgcccagctaacttctgtatttttagtagagacagggtttcatcacattggtcaggctggtcttgaacttctgacctccctcatcggcctcccaaagtgctgggattacaggcgtgagccactgcgcctggccatactgtatattagagatgtccttttaataaaaagacagagcttggttcaagtaaagtttcaaagtaaaaggggaaaaggtatactatacagacattaatcataagaaagctaaagtagctacataaacatcaaagctggcttcaagactaaaagcataccacatataaaatgtgtactcatcagaaagacataacaatgccaagtaagaaactcaaaatacacgaagcaaaaattcagagaactaaaaagaaaaacagataaatgcatagtcacatttgtttggttcttttttttttttttttctttgagtctcgctctgtcacccaggctggagtgcagtggtgccatctcggctcactgcaacccccgtcttgcaggtacaagcaattctcctgcctcagcctcctgagtagttgggattacaggcacgcaccaccacgcctaatttttgtatttttagtagagacaggtttcaccattttggccaggctggtcttgaactcctgacctcaatgatccacccaccacctcgccctcccaaagtgctgggattacaggcatgagccaccatgcctggccacatttggagagtttaacaactctaagtaatcaatataataagaaaacaaaaaattactattaagaatatagaatagacaaccctacccacaagaaaaattagccacatatgtaattttaagttttctaagtcacatttaaaaaaaatcatttaaataatatttttatttactaacccaaaatattagcatttcaacctactcagtattttttacttttctttcttttttcttttttttgagacagggtttcactctcatcgaccaggctggagtgcaatggtgcgatctcggctcaagcaattctcctccctcagcctcccaagtagttgggactacaagcgtgagccagctaatttttttttaaattttttgtagagatagggtttcaccatgttgcccaggctggtctcgaactcctgggctcaagtgatccacccacctcactcagcctcccaaagtgctgggattacaggcatgagccaccacgcctggcccattattactttacatacagtcttctaaatctgctgtgtattttacacctacagcacatttcaacttagacactaaatgcttatcagaaacacataatcatttaatttcataaaacttacaactgaaaaagtagacatgtataaaagttgttccaacaaagttttccagtataaccaaatcaaatattaatcattttccactcatatttgtatccatactaacaaaactgttaatgtaaataaaattaaataaaactgaaaattaagttcttcagtcacaccattcaaactgctttaatactcatttctttcactaacaaccatttctatacatgtttcctcttgtatgaacggtctattcacaatctagatagttttaaagaaatgtttaaattaccaccctaaagtccctttaattctacactaaatcagatgtttaaacagtattttacgacaggttttttaattcaaaaaactttgtgtttgctgtaaactggagtaccttgtatacagtacataatttaatgctggaaatctaatttaaaaggtttagccggctgggtgcggtggctcacatctgtaatcctagcactttgggaggccgaggcaggtggatcatgaggtcaggagatcgagaccatcctggccaacatggtgaaaccctgtctctactaaaaatacaaaaattagctgggcatggtggtgggtgcctgtaatcccagctacttgagaggctgaggcaggacaattacttgaacccaggaggcagaggttgcagagagccaagatcacgccactgcactccagcctggcaacagaggaagactccgtctcaaaaataaataaataaaataaaaagtttatagttactatatatatgtttgtttaatatacttatgatttacttcctacagaaccctcagtcagaaatgtttcctatcacatttgggattaaggaaaaaaaaaaaagaagtagcatggtgaaacctcatctctactaaaaatacaaaaattagctgggcgtggtggcacacctgtagtcccagctattcaggaggctgaggcagaagaatcgcttgaacccgggaggcggagcttgcagtgagccaagatcgcaccactgcactccagcctgcgtgacagagcaagactccgtctcaaaaaaaaaaaaaaaaaaaaacctctagagatacttttttatattggggaggaaaagcattttccaagaactacaaggttttaggcattaatagaacatacatatacaccctagaatatatatcaagatacatgacaacattcaagttctagtacatatgcttaaaaattagcctcaatacttaaaattaaaactattacatcactcccacaggctttatagattatgcagcccaatttactcattttaaaaataagaaaaacatacaattaaaccactgtttggggggaaatcaaggccaggtcttatttagtgttatttcctccacagcagtgctagtcaagcttaacatgaatacacatcacctgagtatcttgttaaaatgcatatcctgattcaataaaactgggattgagcttgaaactgcattattatcaatccaagatgatgccaaaattgctggtcctcaggatatatggactaacaagggtcactctatttcacaagtgtttaggatgtaagtgtcattcatttaattctatttcatgtagtttctaacaatattaaaataaaattttcaaggaagaaaaaaagttttcaagctaaactgtaatgctctatttttcctgggagactgctaatactgtgatacaactaaccactccagggttgctatcaagggtttgatataccaaagttcaaaaaagtcgaggtacataaaacaatctctacttaaaaaaggaaaaagctatagaaattattttaaaatggctgggcgcggtggctcacacctgtaatcccagcactttgggaggccaaggcgggcggatcacgaggtcaggagatcgagaccacagggaaaccccgtctctattaaaaatacaaaaaaagtaagccggacacggtggcaggcgcctgtagtcccagatactcaggaggctgaggccggagaatggcgtggacccaagaggcggagcttgcagtgagccgagaccgtgccactgcaccccagcctgggcgacagagcgagactccgtctgaaaaaaaaaaaaaattattttaaaacgttaacatgatatacggctaggattgaaaactatcagctagtttagctctattaaactattagtctagctcatccaatcacctgggtgagcttttataacagtgctgggtctcccccacaagactattgcagcctgggatacaagtattacaagtactgacaaagacacaaacttggacttcgataaattttttttgaaggaaaaaaacagctactagtcaaacagatactacaagaaaatattttaacttataatctggtcctgtaaaacattaagaacttataaactcatatttctctcatataaaattagaactacaatgcaaattacaaaaacaaaaattttaaagactccaggaaacgacttattaacaatttcagttatcaaatattttctcccttagacttgtccctttctagccaacaacaaaagaccatcctaaaatagacttttaaaaatgctttaaagagggcagctgcagtggctcacgcctgtaatcctagcactttgggaggccgaggtgggtggatcacctgaggtcaggcgttccagaccagcctggccaacatggtgaaaccctgtctccactaaaaatacaaaaattagccaggcgtggtgccacacgcctgtaatcccagctatttgggaggctgaggcagaagaatcacttgaaccccagagcccgggagagggaggttgcagtgagacaagatcccgccattgcactccagcctcagtgacagaaccagactccatctcaaaaaaaaaaaaaaaaatgctttaaagagtatataataccattcatctccttccttcattactattaaatcaggaaacaaagagttgtttttcctataggattcacatactattttccacttgaaatgtaccccgtttccatagtaactaccactgatgtcacagaatttttgctgttcccacttaaagaacactaaggcaaaaaatacttttatgcatttattaaaatagacgaagaaaaatgtaaaatggtttataaatgtataaactcaaaagtatttttccccaaagtttgtcatcaaatattacccagttcttaaaagcatacacctgaatatgtaagtgtacttaaaaaaaatactaaagttggccgggcgcggtggctcacgcctgtaatcctagccctttgggaggccgaggcaggtggatcacttggggtcaggagttcaaaaccagcctggccaatatggtgaaaccccgtctctactaaaaataccaaaaaaatagctgggcgtggtggcagatgcctgtaatcccagctacttgggaggctgagacacgagaatcacttgaacctgggaggtagaggttgcagtgagatgagatcgtcgtccactgtactctagcctgggcagagcaaggctccatttcaaaaaaaaaaaaaaaaaaaaagaatactaaagtaaatttaaatttggtattttaaatgacgttaaaatttaggaagtcaactttgttagctagtcaggagattctagaataagcgatggctcaggggattcttttttttttttttaagattttgggtgttttgcttatttgttttgagatggggtcttgctctgatgcccaggctgcagtacagtggcacaatcacagctcactgtggccttgacccccaaggctcaagacatcctcccatctcagctttctgagtagctgggaccacaggcatgcactaccacagtcaactaatttagtttttgtagagaccaggtctcactatgttgcccaggctggtctcaaactcctggactaaagggatcctcctgcctcagcctccccaaagtgctgggattccaggagtgggccaccacacccagcctcggggaactctataatcaacaagacagaaattcagacattttattcaggttctgcaagtctcttcattttcttctacagagaagtcttgaagaaaatctcacctcaagtcaagaccaaaaaaaagggtcttagacgggctcttaggtacttttttggggggaaatgagggagaacatacttttgttatgtggaccagatttttaaagaatgagagtacacaatattgaaactttcttactttaatattttttaggtaagttgtttatatcctagagaaattcctgcatacatatacaagaagaacgaaacatggttccttgttcaccaaagtattgttggtaactacaaaaaaaaaaattggaacaacctaaatacccatggataaataaaaaataagtcagagaattgaaattaatgcataagatctaaatatttacatatggataagcttccacaccaacgtggaatgaaaaaaattaaatcaagcagccaggcgcggtggctcatgcctgtaatcccagcactttgggaggccgaggcaggtggatcacgaggtcaggagatcgagaccatcctggctaacgtggtgaaaccccatctctactaaaaaatacaaaaaattagccaggcgtggtggcacacacctgtagtcccagctactagggaggctgaggcagaagaatggcatgaacccgggaggtggagcctgcagcgagccgagatcgcgccactgcacgccagcctgggtgacagagcaagactccgtctcaaaaaaaaaaaaaaaaaaaaaatttaaattaaatcaagctacaaaatacagtctgaaccactcaccatgttttaaacacaacacaatactgtatattatttatgaaatatacaaatgttataagctatttaaaaaccagaaagcatacaccactttcaggacaggtgcatatctacgaagaaagggtaaaagagaaaggttattgggtgaaccattcaactgcacagtaacattttctcttttaaaaaggattcaaaatcaatatggcaaatattatgtattagattaatgcaatggctacttgggtatctattttatctttctctgtcatttttgtaagtttgaaatacattacaattgtttttaatgaaacattttaatttgcctcaaaatttacttccacagacaggcaagaaaacttacctttactgaaatgactcaatgaaataatcctctcaacaacccagtaacttagctattagtcccatttcacagagaggaaatgtggatcttcgaagatgtttttttaaaaattatttaagattctacagttaaaaggtaatgcatgcatcaagatttctatcttttaaacccatgctgtttccactataccaaactgctattcgatgttataggataattcttaaacagatcaatcactgttccccagtgatacagccatagaaaggagactcaaatcagtccacataatgatgcttatcatttaaaataaatccctagtattagctaatcgactcttatgagtaaaaaactacaagcgcagaataagaataggtttaaagggcttgtttttgcttgggaaaggtggattcgctaacatctggtatttgagatttctagctccctaaagttccagattaaactagatgtttaggaaaaaactagagcaaccaaaataatcacaattacaaatacacataacccttccttaccagacatatcacggggcaaaaaactgcttactaaagaatggtcaacacatttgtaattcaattatttatcatgggcctatgactgagttaatactgtcaatatttaattagccacagccacaccgtacaacagtgagtctcacacccactagagtttaagaaccatctgggtaactggctcagaatacagattcttagaccccacctccagagtctgattcagctgatccatggagtccagaaatctacatttttaacaagcaccccactaaccagcaccatgctaattctgacacaaggggtgaaaggtctagaactggaggtgcataaatctttattctttcaatagtcactgaacacctacaacacagttctgagaactacagattcagtagtaaaacaaaattaagaacaacaacaaaaatcctgcccttaggagtttacatcctaaagacagagcaatagaaaacatatgtgtgatgtcagctagtgttaagtgctacagagaaaagtaaagcgagccaagggaaatggaggcaggagttgtcattgaagacagtagtcacagataacttctcctacaagatgacatttgagcaaagaactgaaagacatggacatctggaggaaaagaggaaaacattattagtaactttctcatccctcaaaataattcactgtatgaaataattttaggtgttgtagcttttactacagaagagtgaaaaacacagagtgccgactatgtgcctattatctctttaaacctcaaaatcactttgtggagtagctatgagtttccttgtttccataaaggagtacactgaagctcagataaagcaatctgcgaggatacacattttgtaagtaatcaactgaggatgcacaaccaggtctttctaattgtcaaaatgcatcatcctccaactaagccaaactgttagcatctttattatcaaatgagcatgtctgctgaataaactcagatctgaattcttatatgctcagtacttctagaaacctgaaaaaagctaccaaaaatacaagttgtttattaaaaaggtgggggggggggttatttatcatctttataacaaatcttggcatacagctatttttccaaaaattccctagttaatatgtatttatacagtcagcaaatcatttacacagtctcccaatatttggggaacaattttttcttcataaactttctagaagggcaagtattaaattgcatacctttaaaatataagatgcaataaaagtatatttgcccatctttggcaagataagcacatatatttaaatataagtaaatgtgtaactcactgtttcctattcaccaactccaacaattctcaggacacctactatccaatctgtcatgaattacgaggaagacctcccatcctacctacttcacactggtaactagagagcaaggcactatactagacagaagtataattcaataataacagtctttactcttaacggttctaacacaaaaagtataaaaggatactgtaaaataaaggaaatgctatttgagtacaaaagtagccctttttggattatctaaactagggttatcaataaagacattctgaagacggctgcacctcttaagccctgaggatcagattaaggctaactttaaaaatgtagtctaggccgggcacagtggctcacgcctgtaatcccagcactttgggaggccaaggcaggcagatcatgaggtcaggagttggagaccagcctgaccaacatggtgaaaccctgtctctactaaaaatacaaaaattacccgggcgtggtggcggatgcctgtaataccagctactcaggaggctgaggcagaagaatcacttgaacccgggaggcagaggttgcagtgagccgagattgtaccactgcactccagcctgggcaacagagtgagactccatctcaaaaaataaaataaaataaaataaaaataaaagtatagtctgagaatgttggacatcaaccctgaggaataccactgacaatttcagagcagaggagagagagtcaaagctgtgttgcagagataaactcaaagtgatgagtaagaagtgtaatgcgcaaatcagatataaggcaatttcaagagcccgaatataaagtgagaagcccaaagtcaagaggtgacagtaaaaatggaagagctagttcttaaacatcattctctgtggccttaggccaaattattccatatttgttatatgaaacactcacttttcttacatgccttataaaacgacaatgtactacattcctatttccggaagtatttttagtacaatgactctaagagctccaagattttgtagcacacggatcaagaattaatcgaaaacacagaaggtttccttgactcaggcatatagtttaagaattctcttttaggctcaaaaaataactttgttggctaggcacagtggcttgcgcctgtaatcccagcactttgggaggctgaggcgggtggatcacgaggtcaggagattgagaccatcctggctaacacggtgaaactccgtctctactaaaaatacaaaaaattagccatgcgtggtggcacacgcctgtagtcccagctactagggaggctgaggcaggagaatggcgtgaacccgggaggcggagcttgcagtgagctgagatcacgccactgcactccagcctggggtacagagcgagactccgtctcaaaaaaaaaaaaaaattactttaagagttgtaaagtatcaagccataaaagaactctgaaatttgggatagccagttagcaagggaatcatacacacacacacacacacacacacacacacaaatacacacacacacacacacacaaatacacacacacacaaatttagaatatttaaatttagaatagacacttagatcgaatagggctactatgacaaatttcaaaaagctttaagccaatactctggaaatttagacactaagttccattctgccacatctctctacctcagatgactgttacagcagcagtttaaaaaaagagaaggccgggcacagtggctcacacctgtaatcccagcactttgggaggccgaggcaggcagaacacctgaggtcaggagttcaaggccagccttggcaacatggtgaaaccctgtctctactaaaaatacaaaaaattggccaggagcagtgactcacacctgtaatcttagcactttcggaggccaaggtgggtgaatcacgaggtcaggagttcgagaccagcctgcccaacatagtgaaaccccatctctactaaaaatacaaaaaaattagccaggcgtgagggcgggtacctgtagtcccttgggagtagctacttgggaggctgaggcaggagaatcacttgaaccctggaagcagaggttgtagtgagcagagatcattcctgggtgacagaatgagactccatctcaaaaagaaaaaaattcgccaggtgtggtggtgtgtacctaaaatcccagttactcgggaggctgaggcaggagaatggtttgaatctgggaagcagaggttgcagtgagccaagatcgcgccattgcactccagcctgggcgacaagagctaaactctgtctcaaaaaaaaagaggtaagtattcactcaaattccagacttggctcaatacagacaaaattcctactacaagagcagccgtgaaaagaagggaatggtgccaaaaggagacaaataaacacccctccaactagataaaatgtgactaatttgaaaaaaaaaaaaaaaacaaagataaagtcagagcttcgcactatactctccttttgtcccctcttagtttggcaatttgagggtacatgacaggattccttgtagtaaataaacacacacgctcaaaaacaggatgaaggaaggagatgttagcacagtttttaagttgcattttgagctcctcagataatttttccaggaattatccagttacttaaaccaattatttgctctatttggctacaggaaaatagccccattcctttttttattaaacatactctaataccatttggtctttcagttgcctctatctaattgcttttaagtattttttaagcatctcttttagattgaaaattctcagaaatcagggtcaaatgtttaaattatgtcataaaaagttaccaaaatactgcctatcttttttatcttcaaaccagtggcatagcctacactttgctctctaagatctacccattcttcaaagcacgacaaagcctccctcttccatgaagtattcctcaacaactctagcacacggcaatttctacttcagaacatataagcttaacgataaacttaactcacaaatatgcataaagtctctatgatctacgtgaaagcttagaacaagcatctgtctacattattttttgtaggtattcactataagcagctcaaaagcccttttataaggtaggtacacagtatgtcaactaaaactatcaagggaaaaaagctaattatttgtctaagtatggtcctctatttgcctgtcccattccggcctctagtcccaaaagaaaactaaccccagccccttcatgtcctaccctcaagagaagagatgataactttgtgcacttagtacatgccaaacactttaagacattatctttattactattattattttttttagcaacagagtctcactatgtcgcccaggctcagctccatcctgcagcctcagcctcccaaagtgctgggattaaaggcacgagccaccgcacacagccaagacattatcttttaatcttagaacttttcaggtaggtttttttttaggttttaagaaactaaaacttatttgtagagatctgaacctagcttctaagcttgcttttcttctaccacgctactaggcactgaaacagatgcccactctccgacaataaaaagagatacgaataaacaatcaatatatgattaacaatttaaggccgggcgcggtggctcatgcctataatctcagcactttgggaggccaaggcgggcagatcacgaggtcaggagatcgagaacatcctggctaacacggtgaaaccccgtctctattaaaaatacaaaaaaaaattagccgggcatggtggcgggcgcctgtagtcccagttactacagaggctgaggcaggagaataccatgaacccggaaggcggagcttgcagtgagccactgcactccagcccggggaacagagcaagaatccatctcaaaaaaaaaaaaaaaaaaaaaaccgcccatttaaaacaactttttttttttttttgagacggagtttcactcttttcacccaggctggagtgcaatggcgcgatctcggctcactgccacctccgcctccagggttcaagtgattctccagcctcagcctctggagtagctgggattacaggcgcttgccaccatgcccagctaatttttgtatttttagtagagatggggtttcaccatgttgtccgggctggtctcgaacttctgacctcaggtgatcctcccaccttggcctcctaaagtgctgggattacaaacgtaaaccaccacgcccggcctaaaacaacttttttttttttttgaggagtctcgctctctctcccagtctggagtgcagtggcgcaatctcggctcactgcaagctccaccttccgggttcacaccattctcctgcctcaggctccccaacagctgggactacaggcgcctgccaccacgcccggctaattttttgtatttttagtagagatggggtttcactgtgttagccaggatggcctctatctcctgacctcatgatccacccacctcagcctcccaaagtgctggcattacaggcgtaagccaccgcacctggactctaaaataaggactttttttttttttttttaatttgagacggagtttcactcttgttgcccaggctggagcgcaatggtgcaatctcagttcacctcaacctccacctcccaggttcaagcgattctcctgcctcagcctccctagtagctgggattacaggcatgtgccaccacgcccggctaattttgtatttttagtagaggcggggtttctccatgttggtcaggctggtctcgaactccccacctcaggtgatccgcccgccttggcctcccaaagtgctgggattacaggcatgagccactgcacccagccataacaactttttaaaagcactccaatagcatgcctaaagactaagactaccactaataagttcaaaaaaattgccaatttatttaagaaaaacatgaaagaaaccaacacacacaattctcaccaaaaaaatacaaaattaaaaagcaaatatgaaaaataatttcctgcatgcaaacaggcttttacaaaacaataaaagaaatactgggaaatgctcaaaaaatattaaaaagcaattaataaaaagaagtcagagctgggcacagtaactaacgcctgtaatcccagcactgagaggtggaggttggaggatcgcttaaccccaggagttcgagactagcctgggcaacatagtgatacctcatctctaaaaaagtaaataaactaattcacattttcaatttccatatcactattccaacatcaactacaatcaaaaaattgcaaattaaactgtaatatgcccatttttacctatatgttggcatttatttttaattaacacccactgtgaacaaagatacttgcaaacaagcacaaacctaaccctgatgaataaatgggtaaaacctttctgaatggatctagctttttcttgaaaatgtacatgtcaggccaggtgcagtgcctcacacctgtaatcccagcactttgggaggccaaggtgggtggatcacctgaggtcaggagttcaagaccagcctgaccaacatagtgaaacccccatctctactaaaaatacaaaattagctgggcgtggtggcacatgcctgtaatcccagctacttgggaggcagaggcacgagaatcagttgaactcagaaggtagagtgagccgagactgctctactgcactccagcctgggcgacagagtaagactctgtctcaaagaaaaaataaataaatttttttagtagagacggggtttcactatgttggtcaggctggtctcgaactcctgactttgtcatccacccgccttagcctcccaaagtgctgggattacagtcgtgagccaccatgctcggccaattttttttttttaattagccaggcatggtggcacacacctgtaagtcccagctactcaggagactaaggcaggaggttcacttgagcccagaaggtggaggctgcatatttgagaccctatctcaaaaataagtacataaataaaaaataaaaattaaagtgctgataaaaagaaaacagcaatttatgaagatgctattaatagccatcttgaaaaaattctaagaacaggggtgttttcccgtcaaaactcctctcggatttgtcattaaaaaaaatcaaagccgggcgcggtggctcacgccagtaatcccagcactttgggaagccgaggcaggtggatcacgaggtcaggagattgagaccatcctggctaacacggtgaaaccccgtctctactaaaaaaaatacaaaaaattagccgggcgaggtggcgggcgcctgtagtcccaggtactcgggaggctcaggcagaagaatggcgtgaaccccggggggcggagcctgcagtgagccgagatcccgccactgcactccaacctgggcgacagcgagactccgtcaaaaaaaaaaaaaaaaaaaaagaaagaaaatcaagaccgggcggtcgctcacacctgtaatcccagcactttgggggccgaggtgggtggatcacctgaggtcaggagtttgaaaccagcctggtctgtctctactaaaaatacaaaaattagccgggcacggtggcgggcacctgtaatctcagctgctcgggaggctaaggcaagagaatcacttgaacctgggaggcggaggttacagtgagccaagatcgcgccactgcgctccagcctgggagacagagtgagactctgtcccaaaaaaaaaaaaaaaaaaaaaaaaaaaaaaaaaatcaacccagccagcacagtggctcatgcctgtaatcccagcactttgggagcccaaggcgggcggatcacttgtggtcagaagtttgagaccagcctgaccaacgtggtaagacccgtctctactaaaaaatacaaaaattaggcgtggtagcgggtgcctgtagtcccagctacttgggaggctggggcagaagaatctcttgaacccagaggtggaggttgcagtgagccaagactgtgccactgcactccagcctgagtgacagagcaagactcgatctcaaaacgaaacaaaacaaaacaaaacaaaaaaatcaacccctggcccagcagggtagtgcaagcctgtagacctagctacatagtaagctgaaatggcgggggtggggggtgcaccccagaagttcaaggttgcagcgagctatgattgagccactgcactccagcctgtgcaacaaggctagcccctatctcgggggggaaaaaaataaggaaaaaaatacaaaaagataaaaaagattaggaaatggcaaaaatcaactcccccattctgataaaggtgaaattaaaccaacttttggcatcccacaaattcattcactgaaatttttaaaaagctctccatttaccatgccaactttcctcctttgaggagtttctttatagaaggctttcaaatttctaaatggcatttatagggtttatctctttaattaaaaaaaaaaaaaagaaagaaagaaatggctgggtgtggtggctgatgcctgtaatcccaacacttgggaggcagagatggaaggatcacttgagtccagaagtttgagactaacctggacaacacagggagaccacatctccacaaaaaattttaaaaactagccaggtgtggtagcacactcctgtagtcttagttactgaagaggctgattcaggaagattacttgagccagggaggtcaaaaccgcggtgatcacgccactgcactccagccttggcaacagggcaagacctcgtttcaaaaaacatagaaacaaaacaaaatttttaaaaaaattactgtaagtttgctagggtagatattaaccactgggaaggaaaaaaaaaaatgttacagaaaaacattacagacccaggcagggtgcggtggctcatgtctgtaatctcagcactttgggaggccaaggtgggtggatcacctgaggtcaggagttcgagaccagcctggccaacatggtgaaaccctgtctctattaaaaatacaaaaattagctggacgtggtggcacgcgtctgtagtcccagatactcaggggctgaggcacaagaatcgcttgaacccacgaggtggagattgcagtgagccaagatcacgccactgtactccagcctgggtgacagagggaggctctgtctcaaaataaataaatacataaaaataaaacatcatagacctagtattaaaatccaagcctccattctaaatccatttcaaaaatcataggaagtttgcagaactcaagttaaaatgttaaagatggatgtagttctaatcactgtccatgactctattctaaaggattaaatgaagggaaaaataaggtttttatgagattcactgttagtatggtttcatgttaattgtttttttttttttttttggcaatcctgtgcataacagacccaagttagattttgcagatttactgtttgaaaagccaatgcactatacagtcaagtcagccctccatatctatgggttctacatccatgaattcaaccaaccaggaatagaaaaattatttaactgcatctgtactgaacatgtacaattttttcttgtcattattccccaagcatacagtataacaatgatttacattgtattaggtattatagtgtagagattcaagtgtacgggaggatgcacataggttatatgcaaatactataccatgttccagggactggaacatccttgaattctgtcatcagagggaggttctggaactaatttcccatggataccaagggacaactgtacttggaaactgccataaccttaaactatgaaattaactcatatgaaatcctgcaattgaaataaacaattccagaagaactactttgccacaggattgtctaaaatgcacatttattaaaatgaagatagctaagaagcatgaatgatcacatcttatgttaataactgaacaaacaccttccaagttgcctattttgaaaattactttttagttcaaagtctcatcttaaataaccacccattatggtaataaccacctccgacagaatatttggcagtgggttaagcacttttaacacatttgatacttacaataaccctatcatgaacatattatcagcattttacagctaaaatttaaaacttgcctaccacccttgcccaaactaaatctctgtccacaggaaaaaattataactttttattgcaaatatacacattatatataatagcataataacacaagtagtcacactggtacattcttacatatatgttactgtgccttaagacagttttacaaactttaaagtactacaaaacacttgcaccctatcatctgtttcccacgacagccttgttacggattatcactaccttatatgagggctccaggctctgagagcttaagtgaaatcactcatttgattcctcattcttttcccactacattatcctccctatgattaaagaagcattgccgccacaatcagagcatctttgcaataaaagataaaatgttactagagaacctagataagtattcttcaccagttacatacttctccaacaagttattagagttactggccagcaggatatccagctagcctctaagtggttgtttggggaccaatcataaagttgtatgaacaggagttgtatgaatactttttattaagctagtagcttagcaagggaatcccctacattctacttgtactggtccgaagaccaaatccaaggtcaatcaaaagtacatattatctccttgggaaaacagaggatgttagtcttttatgacttaaaagttgtttctagtaactatcatccgaccatacaccacacagccatttgtctcagagtaggtagtgaaggtggctacttaaatacacacatttttaaaaaactgtatccaagtttagcaatatgtgtatatacccaagcacacagagacacgttccataacttggaaaatcatctgtaaaagttattttggctttgcacttctgaatacttcatgcttctccatgaccataacaaacagaattgttctacttcctttactaattgttctacttctttctataatatctaccaagtattatcctattgccatcatattttcaggttggtactttcttcctgctatcctttttatgggggagacagagtttcgctcttgttgcccaggctggagtgcaatggcatgatctcggctcacggcaacctccacctcccaggttcaagcgattctcctgcctcagcctcctaaatagctgggattacagccatgcgccaccacacccagctaattttgcatttttagtagagagggggtttctccatgttggtcaggctggtctcgaactcctgacctcaggtgatccacctgcctcggcctccgaaaagtgctgggattacaggcgtgagccaccgcactcagcctgctatccatttttaaagccatagagaaagccctcgagtgttgtgtatcatgtgctgtgtggaggactaacggataggaagaaaactactaaagtaatgaattcactgtggaatcaagttcagttattctatgttcacatctacattccttaaagtaaataactctcaaattttctagaaagtaaataatacacctggactttgaaaacccaaaatgtctacaaaatcagaataccattacacgttaaaaacaagaaagaaaagaagaaagctgcttccctgcacctatctggagaaaatctttgcgctgtaaagctctaaaccaccattaccaaaaagtttaacttctactcctatgccttacatttctggctcttaactttttaagggcctgacaaacagctttgctgacaattgtgtgtgtcaaacaggtcttccaaatgaccatcaacaattttttaatacatcttgctatgaagtcccaaaatttaaaaaatatatgttgaactccatccagcattatcaaactagttaatcagtctccccgtactcttagcagctagctgcctaataccaactgtggaaaaagcctaattttggaaaaggtctaacaatttcaagaaagttacttatacttgtgaatattccaaaactttaaagttacaatacagtcacagaaaaacgaatcctgaaatacacctatgtgcactcgacttaaggccataatcttattttcactcagggtttcttttccctataatatctttactgtaaggcagctacttctccctaaataatttcgaagaatttcaaaacactttactaaatagatttaatcatatctacagaatcctatcaacttaaaaagccaataaaatgagtacttatttgctttctaaagatcctacattcctaaaagaataaacacaaagcctctccctaacactaaactactcaagtgacacttgaccccaacttggtttttgaagctatttctccaggaagcagagggagacaaagagtttctacacagtcaaaaatagatgagtccttttcattcagtctgtttcttctcactttaaacacaaatcctaccaagctcatttagtttttaactcattaatgagtgactcggagcaaattagcaggtacagggactgttttaggcaatcatttgctaggaatggctatcaagtgaaggtcttgctgatccgtcctaaaaaacaaaggacaaaaacctatgagtagcagacaaaagcatttattaaataataaatggtgggccctatttcaacaacaatctgaagagtatcatctcttctcaagataccacagcacaacaacgttcacaaccataactgaagtataaatttatgtttcttctaataaggtaaatacatagaatattttgaaactgcatctaaaactcttacctcaaaaaaaggaaagaaagaaagagaaagaaagaaaagaacacacacttcttcccctagggtccaaccaaaagagcgaaattaatccatccgcattccaaaacaattaattacttaagaaatccaaccagcacacatctaaggcgaagctgcttctttggtagttttttattctacagagtgctaccactgtacaaacagtcaagcgttttggttggcagacaataataaaataagctttatttccttttcttcttcccttagcaaaactccagtctgtcatcacctctgacatgcgccaagaactaccaggaatgatgaagtatatttcaaataaactttcctattaaagtgagtccttgtggttaacatcataccaaaatgctttacattttatccagcaaaacctttacacaccgtaaaaaaagaaatcttaagacacgagctcgtatctgtatttaataataaactcttatcttggccgtacttaccaaatcgtaggcttttactatttataagcctttgaaaaaactttatgcctttcttaagtaccatcaaaattttcaatcaggatttcatgcgatcaattcgcaccacagtgagagatcaaacgctaaactcctataaataggggtgttatgagtgagagggatacactgcgctgccaacgcaactgcgtcttcgagggggcaggggcgctcctggtacacgtacagtaggagctcacattcagcaaaaccagggagccaaggatcaggtgacttcacactacagacactttcagagtgatcaggccttactatcgtccaagtgactcgtaaacggctcataaccccagtttgacacgaaaatctagacttgcaccctagccacgcacaacccgcgcgaatgggttcgggagccgaggagccccgaaacgcgagcccggggacagagccctggcctgcggactgcggttccctccaggaagggtgtctaaggagctttcggacccggcagcaaggtgtctgctccccgcgcgacctcctcctccgcggggcccatcatgccctggccaccccttcctccctgtccgcgtaagggacagcgaacgcccaccagctaacgggtcgccccgccgcgtccggagctcgccggacggagcggagccgcagccgacctccccgcgccccgggcaggcggccacggctcaaggccgccccctaaggtcggggcggacacggcggcagccacgcggcgggctggcgggcagggggccgggccggtcgcagacgcgcgcgccactggttctcccagcagctactggagccgcggcccacgagccgccctttcaggccgcgcgctgcgggagcgcggggcgcggctgaggctaggcccggcgggcaggcgcggcggcgggaggagacctgaaccagccgcggactccgaccccgccgcctgcggccggtgcccgcgagcccgagcagcgagcgtctctccccatcagggccccgcggcctctgcctcgctggcccgtacctagggaggtcgtggacgagacgtggttaaccgcggcgcttgggtcgctggtccgtcgccggcgccacagcccctggtgcggttgctgccctcgcgctgcctcgtccccctccgccatcttgtaccgatttaaaattaactccccact

SEQ ID NO: 1536 - DNA, 82404 bp, Homo sapiens; identical to SEQ ID NO: 1535
  source 1..82404: mol_type = genomic DNA

SEQ ID NO: 1537 - DNA, 82404 bp, Homo sapiens; identical to SEQ ID NO: 1535
  source 1..82404: mol_type = genomic DNA

SEQ ID NO: 1538 - DNA, 146268 bp, Homo sapiens
  source 1..146268: mol_type = genomic DNA
ccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtggtaggggcgcggaggcaacgcagcggcttctgcgctgggaaattcagtcgtgtgcgacccagtctgtcctctccccagaccgccaatctcatgcacccctccagagtggcccttgactcctccctctcctcactccatctttcctggcctctctccgggtgcttagcggacttggccaataacctcctccttttaaacgccctgaattgaaccctgcctcctgcgcatcctctttttgtgtcaccttagggttcagatttaactacgcgacttgactagtcatcttttgatctctctctcgtatttagtacttttagtcagcgagcatttattgatatttcaacttcagcctcgcggttaagagcttgggctctggaatcatacggctggaattggaattctgtcagtcgtgtggccgctctctactgtcttgtgaagataagtgagataatcttgacctgtggtgagcactcgtgagcgttagctgctgtatttaccaggtacagataagacaactacagtggatgataatgtatgtggtgataggggagtactctgatggtagaggagtgactttggttctctgcaaactcagcctgagactatcaattcagtttgtggtgagacctcgcagtgttaccttggcagatggtagaagccttccagatggaaggaaaaatgcgtgtaaaggcacaaagtgtagaaggaccctgaagctccagcgtgaggcctggcattgaatgaaatatattttgtgggttttcagctgctgaagtcataggaatggatgagaccaagaaaacaaagctgtttttgaggtatgagcggaagaagagatatcaggagactttcgaaacagtcataacggaagttaatatgatcattgctaacatttgctgtgtttcaggcactgtaagcatgtatatgggtccttaaagggactcatagaggtaggtactagtattgtttttccttttatcattgagaaactgaggtttgaagagattagtgaacttgctctagattatacagtttgtaagtggctgaaccaggatttgaactaatacaatctgactacagaggccacactccttagcactagaaaagaatggcatgccaagggcagagttatttctaggaagatgggatataagcgtcattgtcaagttgtgcaaaggggtcaacttggttgagatctaaaaaggaacactgaattcgtcaattcagaggctcgtaggaagtaggaaatccttatcttttcgtttgaaccttgagtggaacctagatattctggattaatgtataaatgaagttcatctttatatggtgacactcatactctagttgactacctaatagttcctctgccttctttcagttccgccaacatactgtgttctttaacattgtagaaccctttggctatgctagtctccttccctgaagtgttggtcctctagccctttttttgattggcaccagttagttcagatcttggctttattataaactcctctgagatatatgttccctgacagtttatctaaaatgattctctctacagttattttctattactgtgtttttgtttcctcagaggcatacatcacaatttggaattatgcattggtttatcaatttacttgtttattgtcaccctgctgcccagatatgacttcatgagggtaggatttgtatctgtttagttcattatttgtctagctataagtagtaaatattgtttgcatctatcagtgaatgagcatcttctgtttatgtagataatactgaactgttttgttttcttcaaagtaatcattaagctgaaggtaagaaaaacaagttcaaggaagtcacaccatggggaaaaaaaagtcaagtttagggctgcctcttccgggaagtgtcaaatctttagtatatttaggaataaaggtgccaaaccttatggttctttggatattgctaaggtattttcattggttagattaccagtttcattttccttattgactcaagagggctttaaactgagattgaagaagtaagaagattcctagataaaaccataaggaatggaaaaacaaaaatgataatacttgtccacaggaagtatataatcaaatgaaaagaactcaaataacaatctgtaatctatagcagagtaaagcggaagttgtaatagtgttgggggatgggggaagtcagaagaaccaccagtgaatataaaaggagaagagaatcagagccatctgctaataaaatgggtagtcagctctttttgttttttttgtcttgttttgttttgagacagtctcgctctgtcgcccatgctggagtgcaattgcgtgatctcagctaactgcactttccgcctcctgggttcaagtgagtctcctacctcagtctccccagtagctaggattgcaggcacatgctaccacacctggttaatttttgtatttttagtagagacggggtttcacgatgttggccaggctggctggtctcgaactcctgacctcgtggaacgcccacctcggcctcccagagtgctgggattacaggcatgagccaccacgcctagccccggtagtcagctcttactgagaatattcaaagacagggcattcattttgtaagagacattccttccttcataggaagattggacctggtcttttagttcctcccaattttgagattctgtgagattgaatcggggcagagaaacatacttaatcttgaaagattaagtagaatttagatggatggataggagaaggactttccctacctttttacttcttgagatatagttatttgtaggtataatatacataaatatatgtattttttctctgtttacagacattcatagtttaataaaaaacttctttgtattatataaaggtttagatcagaactagtaaaacagaatgctgtttctttttttttcttttctattttactttaggttctgtgggtagatgtgcgggtttgttacatgggtaaattgcatgttgctgaggcttggtgtacgaatgatcctgtcactcaggtagtgagcatagtacctgataggtagcccttcaagccatacctccctttctttccaaccctcaaacagtccccagtctctgttcttcccatctttgtgtccatgttgaaatgctgttcttactacatttttttgaaggacatcaaaagagagtttgattatatcagaagcccccaaaagaagagagctactcagtggaatcaaggcatagtaaaatatagttgatccttgatatttgcaaaggataccaccatagcatagaatttgcttcatttccttttaaaacagaaatgtcattttactcctattgttatgtgttaaataagaaccttaataccagttgagatggaagtggtagacaaagcttactagctctgataacctcctacttatcagctccaaagcatgttttaagcctttggctcagcaaaatgacatgtctctccatataagcaagagtgcttttttttttttctttgagacggagtcttgctctgtcaccaggctggagtgcagtggcgcgatctccgctcactgcaacctctgcctcctgggttcaagcgattctcctacctcagcctcctgagtagctgggactacaagagcacactaccacgcctggccaagagtgcttttaaatagttcattgtcaatgttaaatccttgagtgctcatttccttatttacctggctgttttctattcatctttcatgtctcaatttaaatgtcatgtttctttggtctcagagtaataaaaagtaaatatacttcccccatctcccgccccgcagagccttcctctgttgcccaggctggagtacagtggctcgatcttggctcactgaaagctctgcctcccagattcaagcgattctcctgcctcagcctcctgagtagctgggattacaggcgcgcgccaccaagcccggctaatttttgtatttttagtagagacagggtttcaccatgttggtcaggctggtcgaactcctgaccttgtgatcctcccaccttggcctcccaaagtgctgggattacaggcgtgagccactgcgtccagtgtaaattatacttttattttaatcctgctactactgcaagcaaggcaaacatttttgtgttacagcattacttgtatagattttaagaaaatctcattttaaatacggaaatgttaagaaaaattattgtgcctttgaccagaatgtgcctctaattgtacagttaaatctaactataaatactgcagtataaaataattatatacacattttttcacacctctttctctctatatatgcatatatacatatacatatatatacctatatgtattttttttacagacagtgatgtgtgttctgaaattgtgaaccatgagtctagtacttaatgatctgcttatctgctgccgtcaactagaacatgatagagctacagaacgaaaggtagtaaattacttaaattcaatttttccttgaaataagtgtgattagtaacccattattatttcctttttattttcagaaagaagttgagaaatttaagcgcctgattcgagatcctgaaacaattaaacatctagatcggcattcagattccaaacaaggaaaatatttgaattgggatgctgtttttaggtattctattcaaatttattttactgtctttatttttctctttcatatttatttctgttgtgatattacttttgtgtgtaagtcttaacatttatctttgcttcctatatatcattatgccttgcatatgaatttggcatttaatatttatccaaaacataatttttaaaggttgttcatatagaaacttaaaaattataaattatttcttcaataaaatgttttagacatatctcactcaaaattgagagagaatttctttcattttagttagttcacaagacttcagattagaggaaaaaattataataaatgttaggatattattttcacacctttaaatattactctgattataagtaaatgctgtgtgttaaattgtaataaaacaagtaaaaggaagattggaatacttgtgtatgaatttggttaaaaacaaaaaatacctcgaacaatgaaaaaacacaactgattgctggacaggagtggcaaacagggttgatgcatttttacattgagacatcattttcaaccgtgaaatccatttataactagaaacagattgtaaggattaggaaagatgaataaagtattttaaatactgagagtattaaataaactagaaataacatttgtagtcaagaggaagtgtgtatttagttgtccttcagtgtttatgacagattctgttttatttttagctcctgtttggtattagattgactgttacagatttgaaagcatataaaatgaaacatgcatgctgtttttcctctgattttctagtttattttaaataccacaaatataattacaacctgaagatgaatactattttgtataagctgatctggtaggtcaaatatgcacccagcattcctggctagttatgaatatcttctaggcaggcttaatttattggctggcaacattaccaactgcctaagaaacaggtagatcctgtacagaataacagaaggagttgagagaggattgagagggtccttactagcattgtaagcttttaatgacaaatttagaaaacaggcagtaaagcaatagaaagtcatagaagattaagagctttgcagaccagatattaaattggtcttgtaggagttaggccttgaaagagagatttaattgttttatttgtttttttcagctgatgtagtaatctaagcaaggtggtttaaaagttgctctttgtgatggcatgaacagcttttgaaattattataatttaagtattcaacgagtttctgaaattgcattttgttttcttgaagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagtaagtgatgttataaattataaataaatggcttaacagattactgtcgcgtgagttttttttttttttcagatcattttaaggacttaactgttgcataagtttgttctaaatagaataagataaaagttgagtgtaagtacatataatgatttttatttttattaaaaggtttttttttagggctagtcaagtgaagcagtgggagtttagaaggaacaaagaaatctgtaactggttgtgatcaattcgttgtaaacaccactgcactcaggccagcctgatttttaatattacaagttcaaatatttggggaaatttatgcaagcatagaatgacagaaatctgaggattgaagggatttatttatttaagagatagggtgtcactctgtcacccaggctggagtgcaatggtgtgatgatagctcactgcaggctgaagcttctctgttcctaagtgatcctcctgtcttggcttcctagtagctaggactacagaagtgcatcaccatgccaggctgatttttttttttttttttaagaggtgttatttcactgttctgcccaggctgatcttgaactcctggcctcaagcagtcctccccctgctcagcctccctagttattggtattacagatgtgagccaccatgcccagtgaaggaattaaaaattactgtttaaactacccagtcttggatgccctctctacgtccctagcctttaggtagaagtgcagtcttcatgattgaatatactttcaaggctttcttttccatctttgaatagcattaacagtattaaaaactggccaggcgcagtggctcattcctgtaatcccagcactttgggaggccaaggcaggcagatcacctgaggtcaggagatcgagaccagcctgaccaacatggcaaaaccccgtctctactaaaaatacaaaaattaattgggcattgtggcgcacgcttgtaattccagctacttgggaggctgaggcactagaattgcttgaacccaggaggcagaggttgtggtgagctgagattacgccactacactccatcctgggcgacagagcgagactgtcaaaaaaagaaaagtattaaaaacctgtcttttgttactgcttctcccttctgagagtatatcaaaaactcctatttatgtttttagtgtgacatccttagagatgtttgaaagtagccacaatatttcctaagtcctcatctctaaagttcataatctcactttcttcagctcacgtgacctaggttttatgctactctcctctgaatattcttcactttaattgtctgtcttaaagtgtgggcctctacttacagggaagaggccagaaaaacaaacaaaaaagtgtgggactcattttttttaatacaggctcttgctctgtagcccaggctggagtgcatgcagtggtgcaatcttggctcactgcagcctccgcctcccaggctcaggtgatcctcctgcctcagcctcccaagtagctgggactataggcatgggccaccatgtctggctaatttttgtatttttaatagagacagggtttcactgtgttggccaggctagtctcaaactcctgacctcaagtgattttcccgccttggcctcctgaaatgctgggattacaagcgtgagccactgcacctggccaggactcaatcttttaggtatattctgattagtacagagtgaagcaattcttgcttatctttcattctgtactcttactgattaattctaagatcatgtgagcttccttggctgtcagaaccaacacttaactgacattttacttgctatgatttgaggaaaaaaacaacccccaaaaatatttttttctcctgatgagccaaatagttcccatctttaacttgtacaattaatattgtgaagagttgatttttcggaaccaaaatgcaggatcctggcaagcttttgtaaggaaatgggctttacacatactgaaaagctagaggcagaagtgtgtgttcagggactcctgggctcttcacagataaggatgttgctttgtgataccaactcttaatttaagaatcaggagtgtgaggcgcggttgctcacacctgtaatcccagcactttgggaagctgaggcgggcagatcacctgaggtcaggagttcgagaccagcctggccaatatagcgaaaccccatctctactaaaagtacaaaaaatagctgggtgtggtggcgggtgcctgtaatcccagcttctcgagaagctgaggcaggagaattgcttgaacctggaaggtggaggttgcagtgagctgagattgtgccattgcactccagcctgggcaacaagagtgaaactctgtctcaaaaaaaaaaaaaaaaaaaaaaagaatcaggaaagcccccaaattggtaaatatttagtagaagtatgcagattattagtgaatatttcagattggtggtatgagacttgagtccaaagaataatggtttagtcaattttctacctcctctgagatgcgagttcgtgtggatagcttcaaccccttgtcagagactccagcagagacaaaggaaaactacaccaaaatattctgcactcacttttgctctgtgtagtagctttgtatccagtaaaatattttatttgctaataatgctgggatatagtaggtacttactgaaagagtgaatgagagaaagataacatgtcaattttgtagcccaccagaaaagtttgcaatgtgtacagtagttttgccttgcagtgaacaaaccttttaattgcaacattaacaatggagattacgtttgaaaatgcatcagcctgttggtttataagaaatagttggtgaaattatcaatgctggtcatgtaagtagttgaaaatttgtttttttatttacggcttccttttctttcaaatttgactttgttacttaaacctttttaatattggggcaaaaccagggagttactattccctcaccccacttcagttgtttttgtttgtttgtttgtttgttttttacgaaaagattggagggttgatggaaatttaacatatgtctaaactttgccattcttgcttagcattggtatccaaggtatgatgaaagaaatagagattagtaaaaaagaagtaaaaggcagctgagaagaaacaagtaagcaaatattgttgatttctctccttttttttttttttttttttttttttttttgagacagagtcttgctttgttgcctaagctggagtgcagtggtgcagtcttggctcactgcagcctcttcttcctgggcgcaagcgattctcacgtgtcagcctctagagtagctgggactataggcacacgccgccaggcccggttaatttttgtatttttagtagagacgagggttttgccatgttggccaggctggtctcaaactcctggcctcaagtgatctgcctgcctctgccttccaatatgctgggattataggtgtgagccaccacactcacacacccagcctactgttcatttcttttctttttttttttttgagacagagttttgctcttgttgctcaggctagagtgcaatggcgccatcttggctcactgcaacctccgcctcccgggctcaagcgattctcccgcctcagcttcccaagtaactgggattacaggcatgccccaccatgcccagctaattttgtatttttagtagagacggggtttcaccacattggtcaggcttgtctcgaactcctgacctcaagtgatccacctgccttgtcatcccaaactgctgggtttataggcgtgagccactgtgcccaccctgttcatttctttatgttagcatttgtctgcttttgtacaaagcttaaatagagtctagatagtgcaaaactcagctgcgaaaaatgttaagttccataagattcctgaaagtctctgtaagtaggctgggcacagtggctcatgcctctctaatcctagtactttgtgaggccaaggcaggcagattgcttgagcacaggattttgagaccagcctgggtaacatggtgagacctcatctctacaaaaacacaaaaattagccaggtgtggtggtgaccacctgtagtcccagctacttaggaggcttagggaggaagattgcttgagcccagggggcagtggttgcagtgagccacgatcatgctattgcactccagtctgggtgacagagtgagatcctgtgtccaaaaaaaaaaaaaaaaaaaaagtctctgcaggcaacttagttgtacttttaagaaagatttgatcccagaagtttgagaccaacctgggcaacatagggagaccccatctttaaaaaaactaaaaaaattagctgagtgtagtggtgcttgcctgtagtcctagctacctgggaggctgacatgggtagatcccttaagtccaggaggtcaaggctgcagtgagtcataatggggccactgcactccagcttgggtgacagagcgagatattctgtctcaaaaacaagcaaaactatgaaaaaaaagtcaacatttcttgaaatacttctcatatttggtagaggagggagatatattgggataaaggacataggaagataggattttattataatattaatttctgtagttattcaacacaaattaatttttattgagcatttgctattagggcagtcactgggcttttacgtcagaatatagagattaattcctttccttaaggatctaatcatacaatggatgttttagattagaaaaatgttacaaggactataagagaaatgcacagggtactagaaaaaaggatcacatggttgtgcatttcataactggacaatgcctaaaattatgaagtgagccataagtgaagatgattttgcagttatatcagtgtatatttgtttaccatagcctgtgaatataactagtttcatcataggaaaaccctaatccagaatatattcatatttacatgagttgtgttctgctcatagttatggcaataaatatattcaattttaagattgtcagtatggaaaaatggcatttctgctgtgacgtaaatataatttactgaaaatgataattaaattatttttaaatgtaattttgttaccttcaagaatatgtgtgtagtcatgccaagttttcagaatctctagtaagtaaataacatgctgttaaaaatgacacaggtacaggggtcaagcacagtggctcatacctatagtctcagcactttgggaggccaagacaggagaatcccttgagctcaggagttcaagaccagcctggggaacattgtgagagattctgtctctatgaaaaatttaaaaaattagctgggcatggtggcacaacatctatagtcccagttgctcaggaggctaaggtgggaggatcccttgagcctgagaggttgaggctgctgttgggtgtgatcatgccactgcacaccagcctgggtgatagagcgagaccctgtcttaaaaaaaaaaattacaacctgaggtgtttgtatgccataaatgctattataggacttagaactaattttgctttccaaggtaaatattctccttgtaatcttatgttattctaataaattcattcttcataaagagtgccaaaaaacttgggatcatttttggtctaacaccagaaattgtgaattattaaggttataattgtttaagaatgattgcttttcgagatgagcagatcacttgaggtcaggagttcaagaccagcctggtcaacatggtgaaaccctgtctctactaaaagtagaaaaattagcagggtgtggtggtgcacgcctctagtctcagctacttggaggctgaggtgggagaattacttgaacccaggaggtggaggctgcagtgtgctgagtttgtgccactgcactccagcctgggtgacagaccaagattccatctcaaaaaaaaaaaaaaaagaatgattgtttttgctatatattcctataaaagaggcgttggcaaacttactgtgtaaagaggccagatagtaaatgttcttgactttataggccatgtggtcacctctgtcttaattacaaaagcagccataaacaataagtaaatgaatggttgtgactatgttccaataaaatgttatttgcaaagaaaaaaaaaatgaattttgcttggggccataatttgccaatttcttctctacaaaagaagtttagttaatagtaatttcccaaatggaattatttaaatagttgccattccaagtgtcttatttttgttcaaatttatgtttttctttatttgtttattttgaaataggagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttaggtatgttttgaaggttgttgtttgtgaatttttcctcatgaaatgaaacttcaccaaagaaagcactctgtctgtatctgtctatatcccccaagtgacctgacagtttaacagtactttagtaaaattatatggttatcgaactgacccttaatttttatttattatgtagcttttgaataaagtcatgaataatatatcaggtgcctgatatcagagccggaattacagttgaaaaataccatctccatcgtcaaggagttgacagtggcagaagaaaacccaagtaaaccagagttcataatgtgctgtgatacagacatatttgggttcagtaggtatacaaaacaatgacacctaaactcaaccatgatttaagtagaaagggagaaaaccaagagagggaagtaccataaaagtgaaagcaggcagggtgcagtggctcacgcctgtaatcctagcactttgggaggccaaggccggtggattgcttgagctcaggagttcaagaccagcctgggcaacatggtgaaactctgtctttaaaaaaatagcggaggtaatggctcttgcttgtagtcccagttacttgggaggctgaggcaggaggatcacctgagccctggaggttaaggctgcagtgagctgtgatcacactgcactccggcctccatgacagagtgagaccctgtttccatttaaaaaaaaaaaaaaaagtgaaagcaagagagttgaaagttcaaaggggcgtggccaacattttaagtgttgtagaaaggataagacacaaaagtatccattggatgaggcagttagcacgctacttctaaggtaatggaaatcaaatatattagaatagaatgcattagaagacaatgtacagaacccagtgattcattagatgtgtagagtgtgtgctagggaggaatctggtgttgtttcctgtttatagctgggaggtactgagagaccacaaaggaaggaagttatggtcagagattgaaatacttcagtttgttggtttcaaagatggagcatttctgggtttgagaataagtgaaagtaggatttgacattaacaagatgattttaagtcaggtgtcaaagtcttctaatacacgaactctaaaagtttagaagcttttttttttcatggaaagtatttaagctaaattttgctagctaaattaaaagacatttgtccatattctttattgccattttattatttcaaaatgagatacatgtgaaccacaaaactactacctaatcagtaccctcactcctgcattacactctactgttcccctgagaataaatgccttctcagctaatttcttaggagtcatttgtagcctttacgttactctgaacacaagataggctgtgtctgtaacagggccctcaacaagcctagagacagcctttgggaataggctggtgatatctaggttacctaaccagatctttccccagtatggctggtcatatttaggtcattttacattatcacttacaaccatggctgtcactgaaacaaaggcagtctttcccctagtctgcttactatattctgtcatctagtttgttctctgaaaccccctttttatttttaaactaactactcttacttctttttttttcttttttctttttatttaagctaacctttgccacttcttcccggatgttacttcttataattagcttttttgtcaaagtatttttttacttagcttccttttaaaacttgcttagatgaggactctgtggaagaagcgaagtctgtgctcaaaatatatatttggtacaggtggtgactgaagccatgactatggatgagatttgtatatagagtttagtgtgagatgagaagaatggcctaagattgagtcagcatttgcatataaattttggaatcagcttactgatttctacaaaagatcttgctgggattttgatactaattgcattgaatctgttgcacaatttgagaagaatagaaatcttaacaatgtggagttttccaatccatgaacactgtatatctctccatttacttaggtttttttttttttttttttttttttgcttctttgtttgtttttttgagacagagtctccctctgttgcccaggctggagtgcagtggcacgatctcacctcactgcaacctccacctcctaggttcaagcgattctcctgcctcagcctcctgagtagctgggattacaggcatgtgccaccacacccagctaatttttgtatttttagtagagacagggtttcctcatgttggccaggctggtctcgaattcctgacctcaggtgatccacctgcctcagcctcccaaagtgctgggtttatagacttgagccaccgcgtctggccacttgtcttttttgatttctttcattagtgttttataattgtcagcatatagattttttgttgtaaattgacaattttttttctttaattttatatattaaaaaaaatagagacaggatctcactgtgttgcctaggctggtctcaaactcctgggctcaagtgatacccttcccttgacctcccaaagtgttgggattataggcatgagccaacatgcccagctgcaaattgacatttatttataattgtataaacataaagattttgtatatgttttgttagatttatactgcagtagtttgtaattgcattgtttttaacattttgattttcaaattgttcaatgcacaaaaattatacagaagtccagttaatttttgtatagtgaccttgtattttgggaccttgctaaaatcacttactaaatctagtagctttctttgaatgttcttttggattttctttgtagacaaacatgtcttctgtaagcagtaatttttttttctttctttctgagccatgtggcttttattttatttttgtgctttattacattggctaggacctccagtgtgatttattgtggtaaaatatatataacatttataattttaacttttttaagtgtacagttgtgtagtattaagtgcattcatattgttgtgtaatcatctccaccatccatctccagaacttttttttctatactcagtaaacaatgatttaccattttcccctcccctatcccctggcagctaccattctactttctctctctatgaatttggctatttggggtacttcatttttatggattgaatgttgtgtcccaccaattatgttgaaatctaactcccaaagggatggtatttggaggtgtgggatttaggaggtaattaggtcctgtgggtccagccttcatggatgggattaatgcccttatgaaaagaggccagagagctaacttgctgtctttctgccatgtgaagatacagttcaaagtcagtagtctgcagccccaaagagggccctcaccagaaacccacaatgctggcacctgagctgctttcagcctccaaaattgagagaaataaatttctgtggtttctaagccacctaacctataatactttgttatagcagcctgaagtagaggactcctataagtatttgtccttttgcaacctgcttattacacttaccaaaatgtctttgaggctcatcagtgttacagcttttgtcagaatttcacccttattaaaaactgaacactattctgttctgtgtatatgccacattttgttaattcattcgtccattggtggacatgggttgtttctaccttctgattattgtgaataatgctgccgtgaacatgagtatacatctcctgagtttcctgctttcagtcttttgattatatacccagaagtagaattgctagatcatgtggtaattctatatttaattttttaaggaaccaacatcctgttttacacaggagctacgccattttacattctcaccagcagcccacaagggttccagtttctctacattctcactagcacaactaatagaaaatgaggattcctcttctaggccttgaaagtgctgcataattttgcttcttcctacctgtctaacttaactaaagcgcttctaatttctgtgctcaagctacactgtcaattattcagtttctcaaacctagtggtttccatttttttaaattgacttttatcttttagaggaattttaaatttacagcaaaacggagtggaaagtccactggacacacacagcatgccctactgtcaacatcttgcaccagtggtacatttgttaccatcagtaaacctatgctgggacacatcattattatccagagtccaaggttcacttttggtggtacatatgctatggattttgacaagtgttttgacatttttaaagatctttttctgtatctaatgagatggtcatatttttttttcctctgggagagaatggtaacaatttttcactattacagaatcatacagaatactttcactgtcagaaaaatcctctgtgcttcaccttttcatctcttccttcttgtaaactgtgggaaccatggatctttttgctatctccatggtttagccttttccagcatgtcatatacagttgtgcgtctcttaacaatgtggatatgttctgagaaatacatcattaggcaatttctttgttgcgtgaacgtcatagggtgtatttatacaaacttagatggtataacactacgcacctaagctatatggtattactgctcctgcactacaaacctgtgcagcatgttactatactgaatactgtaggcagctgtaacacaatggcaagtatttgtgtctctaaacatatataaacatagaggaggtacagtaaaagtatagtataaaggataaaacatggtacacctgtctagggcacttaaccatgaatggagcttgcaggactggaagttgctctgggtatgtaaatgtgtggtaatgtaaaggcctgggatactatatactactgtagaatttgtaaactcttattctgtaccaaatttaaaaatttatgtttttctttcttcaatactaaagtaacattagctactataacttttttactttataaactttaaaaatgtttaaactttttgactcttttgtaataacacttagcttaaaatacaaatgcattgtacagctgtacaaaaatattttttccttatatacttatagatgttttttcttttgttctataagctttttaaatgaaattattattactctattttttcctttaaacttttttgttgaaaacaaagacacaaacacacacatgagcttaggcctacataaggtcaggatcatcagtatcactgtcttctgtccctgcatcttgtccccctgggagatcttcagggacatgcacagagctttcatctcctatgataatggtgctttattctgaaatacctcctaaaggacctacctgagactgttttactgttttgttttgttttgttttttaagaagaagaaggaggaatatagtataaaatggtgataaaaagcatagtagagtaagtacataaacctaacattttaccagtaacttagtcatttattatcattatcaaggtttatgtactatacatgattgtatgtattatacttttatatgactggcagtgcagtgggttttttttacacaagtatcaccacaaatgcttgtgagtaatttcttgtgctatgacatcactaagtatttaaataggaatttttcagttctgatacaatcttacggtaccaccttttcatattgccatttgtcattgaatagaatgttgttatgtagtatgtgactgtggttggaatcataacagtatgtatcattttcagattgccttctttcatttagtaatatgcatttaaggttcctccatgtctttctctttctttctttctgtctttctttctttctttttttttttttttttttttttttgagatagggcctcactctgtcacccaggctggagtgtggtggtgagatcatggctctgcagcttcgacctcctgagctcaaatgatcctcccacccccttccaagtagctgtgaccacagacacaagccatcacaccctgctaatttttcatttttagtagagataaggtcttattatgttgcttatgccagcagcttgaactcagcctcccaaagtgttgggattacaggtgtgaaccaccgttctcagctcctcgatgtctttttatggcttgataggctgaagtgggaggatcacttgagcccaggagtccaaatctagcctgggcagtgtagtgagacttccgtctcttaaaaaaacaaaaaacaaaaaaaagaggaccaaagttactgatattagaaatgaaatgagatctaattgcagatcctatagatattcaaaggataataaggaaacactatgaacatctattaatttaaatgggccagttcctcaaaaccatacattatcaaaagtcatccaatataaaatagataatttgactagtcccataactattaggagaataaattgaatccataatttaaagcctttcataagacaaattgggaacaagataaggatgtgcactctcaccactccttttcaacattatgttggaggttctagccagggtagttagacaagaaaaataaaaggcatacagattggaaaggaagaaataacactcccctttgtagatgacatgattgtctatatataaagtcccaatatacacaagtataacattgtgaataatgttatttggggactgggcacagtggcttacacctgtcatctcagcactttcggaggctgaggcaggtggatcatctaaggtcagatgatggcttcctctaaaacaggacagatttacttgtagcctattgattataaaaagcttgaggtttctctgttataactcagtccactgttttcgcagtgtcaagtgtcccatttcaccttgcctttggtactggggaactgatgcaaaaatgaaggtagtctggctaccatcattactgggagaaataaactgtcctttttctcttatcaggaatctcaggtttcctgctagcacccaggaaactgtcatgctaatttgttaggttacaagtagataaaatctcagccaggcacagtggcttatgcgtgtaatcctagcactttgggaggccaaagcaggtggatcacttgagcccaggagttcaagaccagcctgggcaacatggtgaaatcctgtctctacctaaaataccaatcagttgggtgtggtggtgtgggcctctagacccagctacttgggaggctaaggtgggaggattacctgagtctgctgagattgaagctacagtgagccgtgatcttaccaccacacaccagtttgggtgacagagtaagactctacctcaaataaataagaaacaaaccaagcagagtaaaatttcatacccttcataggtctcaacacattttttgcatattattaatcaaacagtattattattttaaaaaactgtggaggccaggcccagtggctcatgcccataatcccagcactttgggagaccaaggtgggtagatcacttgaggccaggagtttgagaccagcctgaccaacacggtgaaaccccatctttactaacagtacaaaaattagccaggcatggttttgtgcgcctgtggtcccagctacttgggagactgaggcatgagaatcacttgaacccaggaggcagaggttgcagtgagccaagattgcaccattgcactccagcctggacgacagagcaagattctgtctcaaaaaacagaagaaagaaaaacccatggagcatgtactgtaagtgctttcttaggcctagatgatggaacagaggcttagagaagttaagtaatgtttctgcgacctggctcttaaactggtgctctcacagcagtttatagttattcctgtcttaaaggcattttatataagataaaattaaatactgatggagtacttttactatgttaaaaataaattagtgcagttttaaaatcctttttctgtatgggattatggaatatttaagttaaattgtaacatttaatacattttgatttttaaaaaatcatgactaataatttttttttttttttaagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgaggtaatctaatctctttttcttttgttttgtattgaaatacttttgatcttgcaagaccatgttttagactcagtaactaaaaattctaccttaaaataaaacattgatccatcataacagaactagtggattcctaaagagacaaccaagtccaacactttctgaatatccaatatgcagaacactacgtgaagttttcaagggggagatgtgtcttgctgatgttctgttgaccaggaaagttaaatatcctctaagtcattgcatttcccccattttgaggatggttttaatataccgagaataaaataaaataggaaaatattttggaagtattactgttgtacattagtatggcagtactcaatgtataatgtgaaacattttataaatggtgttacaaatcagttttgtttatttttatacaatgttttagcaggagggagagctaacagaagtggtctcttaacaccaaataagaactaattttttgtcagtgtgaagtaatgctgtgatttttttttttaatgaatagttttgaaattaagactactgtttgaaaattagggttttgtttttttttctttcagcataccacttcataactgttcagtttgtacagtttgttccccctgttatacccagttgagcttgtttgtttcttcacagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtataaaggaaatgtttactgttttgaatttgcttcttcattcaaacatagaagtctaagtataaaattagtgttctttaggaggatatgactttcctctggatttctctggttgataatgttacttagccatgagaatgtttttcatagagtttttagaatttgaagcagtggtagcagattctgttatgcctttctatttgttcaatacaatattaggtattatgggaaatacaaaaaaatctgagacattgttccctctaggagctacttatgcatcaatacttagatactaaggggtctgacacagactgtagggcaaaagaatttaaagaaagcaggatcttgtttatccacctattacttttattagaagataaaatacgtaaattggactaaaaccagtcagattattcagctcctgaggaagatacatacatattactttaataggaatttgaggcagaaacagggaaattgctgccttaagcctcatagttactctagggccctgtttgccctagagtatcacttgttaaggagaatcacttattctccttaattccttcatatatgtcctataccaagagagtattgcccagaaggtatagtgcttttctgtagttaggaactttattggctggaactggagtttcctcttgctctgtctatgattgcctttgggcttatactagcctttggaccaactcatcatggctagtatagtgactttcttaaaacagcataccacattgagtaatagcagctataatggaggaaatgtcttgtagccactttttttttttttttttttttgagacagagtctcactctgtcgcccaggctgaagtgcagtgacgcaatgttagctcactgcaacctccgcctcctgggttcaagcaattctcctgcctcagcgttctgattagctgggattacagatgcctggcaccatgcccagctaatttttgtattttaatagggatggggtctcaccatgttggccaagctggccttgagctcctgacctcaaaccatccacccgcctcagcctcccaaagtgctgagattacaggcatgagccactgtgcccggccgtgtagccactttttatcaaaagtagctgtgtatttgttttatgggctcttctaataagtatatctagataatatgtagcccatgaaactactataagtgaaagaatagtgacttttaatagtttttcatcttttactcacctcttatctccaggatgaagatcaggcttattaggaggtgatatgatatgtttagggatttagttaactgcatatttagggtgaatttaaaattggcaggatgatgaggatgccagaaaagctaatgtagtttcagactactttaatagattttgtagtaccttgtttgtgagaaataatagaccttttgtttcgcatactagtcaagccacagttggattaccatgttcaccagattttgtatagtcagcattttaagttgactggaatgtgtcttgggaaagatgactgaaatggtgagaagtctgaataatatgtcatttttacactagttgaaggaactcgtaatatttttctcttaggccagaaaaaggcatacggagaacttggtcctcatatgaaagagggaacatattaattgtatttgcctcaggtgggagaataaattggagaaagacagattttaggtcagaatatggaagaaatttataagaaacacagttatctaaatgtaaaatggacagttatgaaatagagtttgtcaaggatcttgtcagaagaggcattagtactgaatggaaggttggaccaggtgtcttctaacgctgatgcagcttgacagctgaataattttgtgggagctagcagtgtaaacagagtacatacataaaaattacattttaattttttggattacaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtacagtaagtaggtcatgtcacatttagaaatttcctgttaattttttttttaaactgggcattttgggcttttaaaacctgtgttctcacaaaaagcctataaaatgactctgtacatgcaactattcctttcaaactatcagaaatatttggaattacccttttaacttaaaagttaatgcttttgcagatatttgaaaactaacaatgaactttttcattcttaaatgattgtctctaggaaataaggtgaccctaaccctaatgattcgattcgactcgactgtattctacaaagtgctgggattacaggcatgagccaccaagcccagtctgtttcttttttgcaattaagctagagttcacatagcataaaattcacgattttgagttgtacatttcagtggtttttagtatttttactatgttgtacaaccatcatcactaattctggaaactttttttattttatttttatttttttgagatggagtcttgctctgtcacccaggctggagtgcagtggcacaatctccgctcactgcaacctccctttcccgggttcaagtgattctcctgcatcagcctcccgagtagctgggactacaggtgcctgccaccacgcccagctaatttttgtttttttagtagagactgggtttcaccatattggccagcctagtctcagactcctgaccttgtgatcctcctgcatcggcctcccatagtgctgggattacaggcgtgagccaccgtgcccagcccagaacttttttatcatcccaaaagaaacctcatcccttcttagcattcagtcccaattccctgcatctcctagatcctggcaaccagccactaatcaatcttggtttttgtggattttcctgtttgggacagttcgtttaaatggaatcatacaatatgtgagtcttttgtgtctggtttctttcactaagcataatgttttcaaagttcatgttttaccatgaatcagtacttcattcatttttattgctgaataatattcagttgtatggatatactccattttacttacccatccatcacctgatggcctaatgtttcttaaataaaactctgttccccagagatttggttaacatcctgagtagtaatttcactctgtcaaatattttcttaatatttcttaaaatttcttaaatttaaaaacttgaatccctttgaaagtaaaggtttttgctttacttttagatttcttagtgcttttagtaaatgttcccaggaaataaaactaatgcattacttggtaatacctgctttctaaagtgccattactgtcatgcaaaatgtttgtttcttactatgttatcagatttatatgtttctgtaatgtattactcttgctttatgagttccctgtatcttcatttcagaaagaattttttttccccctaatgaaatattagaagacaatagcaatgaaaaaagtgtatttggccaggcgtggtggctcacacctgtaatcccagcactttgggaggccaaggcgggcagatcacctgaggttgggagttcaagaccagtctgaccaacatggagaaactctgtccctactaaaaatacaaagttagctgggcatggtggtgcaagcctgtaatcccagctactcgggaggctgaggcaggagaatcacttgaacctgggaggtagaggttgtggtgatacgagatcgtgctgttccactccaacctgggcaacaacagcgaaactctggctcaaaaaaaaaaaaaagaaaaaagtggatttatttttattttacaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggtaaagtgttaccattttctcattcagtgtcattttaatctcttgtatgttatttttcagaaaactttcagtggaatcctttcatctcaaccagaactaagtcatttgtctacccccaaacctattactagcaaagggatatgtgattgccatgacaaatgagatcaatcattaatggctcatttgcttgggccaagtgcagggccacctattttaatcatattgtcatagcaagttaagaaggaggactggctctctgataggcaattagaagtgtgcacctcatggaattcactgaattgtacgcttcaacaatagattttagcatacgtagcaccttctaatagaattaggaagaagttaaagataatcttaagaaatcacagaataattttgaccttatgccatgataaaaagttattttctcttattttctatcttctttattctcatgtaacgttcacatatatttaagtaatcaaataaattatggatactttggaatcccaaaatattagatctggtaaggatgtttagaatttatctagttcagcctgtttgctttactgaaaagaaactgaaacccagagaggttaagcaacttctgtagggacagagatttatagattatagtcaaactcgtgatcagtgctcttttgattaccatgttgatggaatgtttaagtgtaagtgacttctggggaaaagcatattgatttagatacctattgcttaagctcatttttatatagttaagagtagctatttaagattcttaatttgtccttttagtcaagagtaatttattgaacacctgttatgggctaagcgttagatatacagagatgaataacataagactcctattcttaagtatcacacattctagagaatacacagcaaatgtttattggattaactgaattaatgtaaaggaaaaacagttttttgggtttctttgttttcctgttttagaggaatcgtttggtgactaaagagcaaggatgtacaagataactcagaaataaaatattgctaaatatatatatatatatatatatattttctgagacggaggctcactctgtcacccaggctggagtgcagtggcacaatcttggctcactacaacctccacctcccaggttcaagcagttatcctgcctcagcgtcctgagtagctgggattccaggcatgtgccaccatgcccggctaatttttgtatttttagtagagactgggtttcaccatgttggccaggctggtctcaaactcctaacctcgtgatctgcctgccttggcctcccaaagtgctgggaaaccacctggcccaaatattgctaatttaatatcctttaaaatatttgtttaagggaaacttaacagcttacccagctagccaaacgttgacaattttcctgccaatttaggaagtaggacatagtaactattaacagccagtttatttttagagtactatggaaatgatggtgattctctaattaggatattgtaagagtaccatgtctatatatttccttttagtttgttaatgtgatggaatagttttcaaattatcctttttttttttttttaggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatggtaagttcagcatgcattatgtctgacttacagataaacacacacagacacacacacactcacatatccctgatcattttcatagtttgttacttcagttaaagatgtcaaattctatttcagatgcttttcttgtttggccgagaagacttaataaatgcataagtgaatttagtttcaaatgttgacaaattattaaagactaatgttaaggaatttcttttttagttaaaaaatttttaattgatctataatagagttatatattatcaaggtacatgtgataatttgacacactcatatgacacactcatgtagggtgatgggatatcagcaccctacgtatcttttcttcatgctaggaacgtttgaattattctcttcttgctgtttggaaatgtacaatagattaatgttaaccgtagtcaccctactgatgtatcggacaccaggtcttattccttctaattgtatacgtgtatccaaaagactttctttaaagaattatgaagagtttaaatttcttttatgtgcaatttatcattatttattaaatagccatgtttaaattgtagtactatgcactgttaataaacgagctattttttaatcaagaatcttcccaaatgtaatcagacttttaacagtttttatgttcatttagtcaccttaactaaatgtatgtgccaggcactgtcctgatagataaagtctttgcccctccaatagcttgcttttcacaattgtcctttgttttgttatagtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacaggtaatttaagttcattagcatgctgctgttttttttgtttgttttatcaggctctctccacttatttgatgccagatggctttattttataataataatgcagaatttcccagatctaaccttaattattaaatattatgtttgtttttacagttatctgtgtctttatgcctgattgcttctgaaataaagggttgtctcactgtgagaatatgggggatgtgcatgaaaaatgcacatataattctttgagcatttatgtgttcctttctgattttttaaataagtaagtccatatatttgagtcatgtagatcctggatcctttctcataatgggagtgtcttttgggtaaaagatgttttatgaatgaggtgaggaaacgaggaagacaaaacaggatgtaagcactaggataaaggaatggagtccctcgtccacttaacctttccacagattggtaattggaaccaaatgattggagagcagacctccgaatggatccaattaaagtacttttgctttaattttacaaccttttatttatttcagaaataatgttaaacatgctgtttctaaacagtattggaaatgataataacaatggttgtcctccttaaattgtccttttagatattaagaaatttagtatagatgaaagcaattttaatctaggatccaaattttagaagtcaagatttatagctaaacatggatgttaaagtttaaagtattctttacatggcttttggtcttctaagtgaagctttttgtttttctttgtagtaattttcctcatcttgtactggagaaaattcttgtgagtctcactatgaaaaactgtaaagctgcaatgaattttttccaaagcgtgccagaatggtatgttatctaataatgctctttatcattttaagctatagctttaattacaaagatgataattttagctgggtagtagctgcatcttaataattgtaaactaaattggtccaaaaaaattgcaactgttagccagggaagaggttgttttaattcagtgattgtaatctatgttatataacattagaccaagcttactattttttaatgctgtatagtataatatgtgacaagtgccaatgagaaaaactgaatggttatgctgggaaattaagaatataaaatttatatgaaataagttcttaaagatgttacccatttctgtacatcaactatgatttgactatttgttagctttaaaaactaatgataattgaaaacaaaaataaatctaaacctgagtttagttgattgactcaagagacttagattgtattgctgtgactgaaaatgactcactggcacaaacattccttatctccctcaagagggcaaaaggatgcgtaactgcttacctataccagatgttaaaggtttttaaacctatgctctttacttcctctgcttggtgaaaaaagggatatgtttgcagacaatgttatgcttaacatttatatctggtgtttttaaaaatactttctgaatttgcctttgagattgtaacttgtattttttctctatctattagtaaaatttgctactgaataatgacatttgatataagtaggtctcaaagtccgaagaagagaagcatttaaaagaataatctattaattatataagtagtctttgaatgatgtagatactaggttaatgttttcctttgtaatatattgctaatacatataaggcaaagcattaggtacttggtttatatattaaagatcttactttcttgaagtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgaggtgagattttttaaaaaaagaactaagcttatatatgattcaactttggtaaactgttaggaaggagaaataggggcaggaaaaacagcaaggatggtgggaggcttcattttaaaagcaaagtggcagtaaagggctctaaattggacaacttagcataattaaaggaaaactcaagaataataatttgagtacttcctttgtactggaaattatggtagacataaaataattccttgtgtaggttagtgaggaatagtaagagtttgagcatagggattatatgatgaaaaaaacctctaaatacaaaggagggaaatgttacagtaatagaaaagaacacgatgtaaacaaatctaatagattttggtggcatctgaagagagatgagtgattagtaaagacaataaatggactagcaattattttagacgtcatctaggaatttcctttagcctcaaaatcacgagttctcttcatgtatactattctcttgccaaaacttgcattttttaaaatgtgaaatgtctttctacctatttctgtgtattcagatcatccacatgtgaaaatccttgctaacgcctttcttagaatctcagaaagtaagattctaagaatttttatttttgagacagagcctcgctctgttgcccaggctggagtgcagtgacgtgatcttggctcactgcaacctccgtcttccagttcaagcaattctcctgcctcagtcttccgagtagctgggacaggcgagtgctaccacgcccaggtaatttttgtatttttagtagagatggggttttgctatgttggccaggctggtcttaaactcctgacctcaggtgatggacccgcctcagcatcccgaagtgctaggattacaggcgtgagccacggtgcctggcctaataatttttcatcttttaatttcatagtacttaatgtttcacatttttaatggcagttagcatcttctttataccatggatatttacatatggtttgtatacaaatatctcttgaactataactcttaaacataaactcttaaaagggcatacatgtttttatttatctttatatcctccacagtgccttattacatggtaaatgattaaataaagcctacaatccattcaaaggagtgaattcggtagccagggaaaatgacttgaggacatgagaggggacagtgtgcctctttatgatctttactgacattcttctgcaccacaattgtaaccactttcattacaaagtaatttagttttgtatattttctcctaaaatgccgtttcctaccctgtaggaacaaaaaaaatctgaacattttgtgtgtaacttagcagattcttagtaattctataaaattgtctaaactttttttttttttttttttttgagatggagtcttgctctgttgcccaggctggagtgcagtggcctgatctcggctcattgcaaccttcgcctcctgggttcaagcaattttcctgcctcagcctcctgagtagctgagattataggtgcctgccatcacgccctgctaatatttgtatttttagtagagacaaggtttcaccacgttagccaggttggtctcgaactcctgacctcaggtgatctgcccgcctcggcctcccaaagtgttggggttgtaggcgtgagccaccatgcccggccagctgtcaaaacttgtatctactagaaaaaatgttttatgctattctgtggagtctaaaaagctgaataagtcaaggttcctattcttcagaagcttaaaatgtcattttaatgtctctttatatgactgtaatttctacttgtgttctaagacttacagtcatttatttgcctgtgaagctttttttcttttctttcatccctacctcaaatatttaagggcctatgtgtacagtacaccctccaccctaagatgatatatcctgcttggccatcaggagatacttaggctatttttcttgagaatcctggttataattctacagtgatctcctagttgtttttagagctatccaggatatgccacctttaactcagttaactgaacttttgttttttaatatgtatgtagaatttgttcttacaaaagatagagtatactaaattatttatgaaatatatatatttttatttgtggtttactttaagattacaaattcagaaactcttgtccggtgttcacgtcttttggtgggtgtccttggctgctactgttacatgggtgtaatagctgaagaggaagcatataagtcagaattattccagaaagccaaggtaggagaatttatactaataaagtttcggataaatttgaatgaaatgtattcctgtgaaaattattacatttgtttggaagacattaaattttatgcaggttaaccctttctcttttatttatgtaatgtgagaagaaattatactatgtattttttaaattgttttaattgtttaatttttaattattattatactttaagttctggggtacatgatgtagagcatgcaggtttgttacatagatatacagtgccatggtggtttgctgcacccatcaactcgtcatctgcattaggtacttctcctaatgttatccctcccctagcccccgaccccctgtcaggccctggtgtataatgttcccctccctgtgtccatgtgttctcattgttcagctgccacttatgagtgagaacatgcagtgtttgtttttctgttcttgtgttagtttgctgggaatgatggtttccagcttcatccatgtccctgcaaaggacatgaactcatccttttttatggctgcatagtatatcatggtgtatatgtgccacattatctttatccggtctatcattgatgggcatttgggttgcttccaagtttttgctgttgtgaacagtgctgcaataaacatacgtgtgcatgtgtctttatagtaaaatgatttataatcctttgtgtatatacccagtaatgggattgctgggtcaaatggtatttctagttctagatccttgaggaattgccacactgtcttccacaatgattgaactaatttacactcccaccaacagtgtaaaagcattcctgtttctccacatcctgtccagcatctgttgtttcctgactttttaatgataggctgtaagcatgaaactctttcttatctcttggtagtactctgtcactggtatgatttgcaagaacagagtataagatttgccattttaaaaaattgttaatgagttttgcttatactgtatgactacgtggaacttctaaaaacatttcattttttctcttaagtgcactttattttttattttatagtatgtccaagatcaaagtacactgtaaaaagcaatactaaactataattttaactggaatttgcatttttccttctattcacaatagtctctaatgcaatgtgcaggagaaagtatcactctgtttaaaaataagacaaatgaggaattcagaattggttccttgagaaatatgatgcagctatgtacacgttgcttgagcaactgtaccaaggtaagattttcttcttcttgttttgttttttgagataggatctttctctgtcacccaggctggagtgcagtgggattgtcacaactcattgtagccttgacctcctggtttccagcaattctcctgcctcagcctcccaagtaattgggactacaggcatgtaccacctagctaaaattttctttttacttgaaagtgtagcctatgcagggaattgatcactggttggtgttactgttttggtgtccactcgtaagtttattttttacttttatttttcttttttttgagacagtctctcactctttcacccagagtgagtgatcacatcactgcgatccagcagcctcgacctcctgggctcacagcagcctcgacctcctgggctcaagtgattctcccacctcagcctccttagtagctgggactacaagtgtacaccaccatgcctggctgatttttgtatttttgtaattttttgtattgatggggttttacacattgcccaggctagtctcaaaccctgggctcaagtgatgcttacatctcaaagtgctgtgattacaggtgtcagctaccatatctgttcacattcataagttatacaaattgatttaaaattcagttgaatggtacataaaggtaatatccagacaaataagcaataggaatctgagtttctcatgaaactaattttataatttcaggaatttttctgagattgccttatgacttttatatacaaccatatagatgactcttttattcctgggacactttcattcatttaataaaaattttttgacccaaactatgtggtatgcgtagcggggctagtgagcaacacaacaataactccagcacatagtttactttcttttgctcagatcaccttacataacatttggtagaaagagtgctactgtgtttaatctttgtttttatctgcagcagcctgtgggatagccaagccaggccccagagtattgataataattggaaatatatttcaaacctagtattaggtacatggccatatagcaatattatcaacatatttcttggttttgtaatgtgtttttcctcctttttggtgtaagtggggaaggagaaaagtagaataaactctaacctataattatagctcacttatctttagggtcaatagctgttactttaatgttgttaaagcacaatgaaagatgtacagtatagttattataactctaagaaaagatgtgtttttgaagcagcatatatattggccctaatagtaaactatttatctacattccattcaagatagagaaaacactgtctgccaagaataattgtttttatttctttgttgcttggttctttgtttgtcttaattgcagaagagtccaaataagattgcatctggctttttcctgcgattgttaacatcaaagctaatgaatgacattgcagatatttgtaaaagtttagtaagtatgcttcctgttttgctatcatattttgattctaataggcataatttttttgttgaaatatctttgtaaataaggatgcatctcacaacatatagctcttaacatttttacaaatgtggaaattaaggccaggtgcggtggctcatgcctgtaaccccagcactttgggaggccgaggtgggtggatcacaaggtcaggagattgagaccatcctggctaacacggtgaaaccccgtctctactaaaaatactaaaaattagccaggcgtggtgacatgtgcctgtagtcccagctactcgggaggctgaggcagaattgcttgaacctgggaggtggaggttgcagtgagcgaagatcgtgccactgcactccagcctaggcgacagagcgagactccatctcaaaaataaaaaaatttaaaaaattaaataaaatgtggaaattaaataatttgtcttgtggggaaatatacctgattgcttcttaatatcaatacctagcatagtagtgcctgcctttagtttctcaataaataatacatttaaaaattgggaacgaatcatccaggctcacagctatatctgcgcaacattgtaccaaaatttaaaataattatttgttctttaaaagtgaccaaaaatcttgccaggcaagcaacatattcttattgtagtatttatttttcttccatacaaatgggcttatgccacatacattcttttttctggaacactgccgggcatacaaagtagttattgaaatatctattgagtgaaaacatattctgtaacttatttccattttatgacacatcttaatcattttccatgtcactgtacttattttataagctatctgctgttatactttatttatttagcagtgcatggtattctattgtgtggtgatagtgaatagtatatatgtatatgaaagcttatctgctcttttttttttttttttttttttgagacaaagtcttgctctgttgcccgggctggagttcagtggcacaatctcggctcactgcagcccccacctcctaggttcaagagattctcctgcctcagcctcccaagaagctgggattacagatgtgtgccaccacaaccggctaatttttgtatttttagtagagaccaggtttcaccatgttggccaggctggtctagaattcctgacctcaaatgatctgtccaccttggcctcccaaagtgcttggattacaggtgtgagccaccacactgagccaaaaagcccatctgctcttaattaacattttaagtggtttctagttttttgggttacaaagacttctgtggtacagattattgtacttttgtctatttgtatttgtgtgtatgatggatgtaggataatttctagcagtagacttgcttgttcaaaaggaatgtgaattttactttttgatggatattgtcattgtcctccaaaatagtcataccaatttaggcattttcctacaccctctttgggtaacactttaggtgttacaaaacttcttaatataagaaataattttgagggaggagccaagatggccgaataggaacagctccggtctacagctcccagcgtgaacgacgcagaagacgggtgatttctgcatttccatctgaggtaccgggttcatctcactagggagtgccagacagtgggcgcaggtcagtgggtgtgcgcaccgtgcgcgagccgaagcagggcgaggcattgcctcactcaggaagtgcaaggggtcagggagttccctttctgagtcaaagaaaggggggacggacggcacctggaaaatcgggtcactccccgaatactgctcttttgcgacgggcttaaaaaacggcgcaccacgagattatatcccgcacctggctcggagggtcctacgcccacggagtctcgctgattgctagcacagcagtctgagatcaaactgcaaggcggcagcgaggctgggggagggatgcctgccattgcccaggcttgattaggtaaacaaagcagccgggaagctcgaactaggtggagcccaccacagctcaaggaggcctgcctgcctctgtaggctccacctctgggggcagggcacaaacaaaaagacagcagtaacctctgcagacttagatgtccctgtctgacagctttgaagagagcagtggttctcccagcacacagctggagatctgagaacgggcagactgcctcctcaagtgggtccctgaccctgacccccgaacagcctaactgggaggcaccccccagcaggggcacactgacacctcacatggcagggtactccaacaggcctgcagctgagggttttgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctccaccaaaggaacgcagttcctcaccagcaacggaacaaagctggatggagaatgactttgacgagctgagagaagaaggcttcagacgatcaaattactctgagctacgggaggacattcaaaccaagggcaaagaagttgaaaactttgaaaaaaatttagaagaatgtataactagaataaccaatacagagaagtgcttaaaggagccgatggagctgaaaaccaacgctagagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgggaaaagaccaaatctacgtctgattggtgcacctgaaagtaacggggagaatggaaccaagttggaaaacactctgcaggatattatccaggagaacttccgcaatctagcaaggcaggccaacattcagattcaggaaatacagagaatgccacaaagatactcctcgagaagagcaactccaagacacataattgtcagattcaccaaagttgaaatgaaggaaaacatgttaagggcagccagagagaaaggtcgggttaccctgagagggaagcacatcagactaacagcggatctctccgcagaaactctacaagccagaagagagtgggggccaatattcaacattcttaaagaaaagaattttcaacccagaatttcatgtccatccaaactaagcttcataagtgaaggagaaataaaatactttacagacaagcaaatgctgagagattttgtcaccaccaggcctgccttacaagagctcctgaaggaagcattaaacatggaaaggaacaaccggtaccagccgctgcaaaatcatgccaaaatgtaaagaccattgagactaggaagaaactgcatcaactaatgagcaaaataaccagctaacatcataatgacaggatcaaattcacacataacaatgttaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccactacaggagcacccagattcataaagcaagtcctgagtgacctacaaacagacttagactcccacacattaataatgggagacttttaacaccccactgtcaacattagacagatcaacgagacagaaagtcaacaagtatacccaggaattgaactcagctctgcaccaagcagacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaccgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagcaatacaaactaccatcagagaatactacaaacacctctacgcaaataaactagaaaatctagaagaaatggataaattcctggacacatacactctcccaagactaaaccaggaagaagttgaatctctgaatagaccaataacaggatcagaaattgtggcaataatcaatagcttaccaacaaaaaagagtccaggaccagatggattcacagccgaattctaccagaggtacaaggaggaactggtaccattccttctgaaactattccaatcaatagaaaaagagggaatcctccctaactcattttatgaggccagcatcatactgataccaaagccaggcagagacacaaccaaaaaagagaatgttagaccaatatccttgatgaacattgatgcaaaaatcctcaataaaatactggcaaactgaatccagcagcacatcaaaaagcctatccaccatgatcaagtgggcttcatccctgggatgccaggctggttcaatgtacacaaatcaataaatgtaatccagcatgtaaacagaaccaaagacaaaaaacacatgattatctcaatagatgcagaaaaggccttggacaaaattcaacaacccttcatgccaaaaactctgaataaattaggtattgatgggacgtatctcaaaataataagagctatctatgacagtcccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccactgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcatccccatcaagctaccaatgactttcttcacagaattggaaaaaactactttaaagttcatatggaaccaaaaaagagcccgcatcggcaagtcaatcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgctgcatatctacaactatctgctctttgacaaacctgagaaaaacaagcaatggggaaaggattccctatttaataaatggtgctgggaaaactggctagccatatgtagaaagctgaaactggatcccttccttacacctgatagaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacagaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaatccttttacactgttggtgggactgtaaactagttcaaccattgtggaagtcagtgtggtgattcctcagggatctagaactggaaataccatttgacccagccatcccattactgggtatatacccaaaggactataaatcatgccgctataaagacacatgcacacgtatgtttattgtggcattattcacaatagcaaagacttggaaccaacccaaatgtccaacaatgatagactggattaagaaactgtggcacatatacaccatggaatactatgcagccataaaaaatgatgagttcatgtcctttgttagggacatggatgaaattggaaatcatcattctcagtaaactgtcgcaagaagaaaaaaccaaacaccgcatgttctcactcataggtgggaattgaacaatgagatcacatggacacaggaaggggaatatcacactctgtggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtgtaataaaaaaaataataatttttaaagtttgcatattattttgttatgtagacatattacaggttatatatccattttactattgttggacatttagtagaaaaagtactgtagttttcatacttacacatgaaccttgaattgtttgattaggtaaattttttttttttttttttttttgagacagagtctcgcttcgtcaaacccaggctggagtgcagtggcatgatctcagctcactgcaatctctgcctcctgagttcaagtgattctcctgcctcagcttcctgagtagctgggattacaggtgcccaccaccacacccagctaatttttgtattttaaatagagacaaggtttcaccatgttggccaggctggtttcgaactcccgacctcaggtgatccacctggctctgcctcccaaattgctgagattacagatgtgagccactgtgcccagcctgattaggtaaattttgactacagcatgctcctgcaagaagccatcttgaacatctttgtttctcttccttgaaggcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtaaatacatatttactacttgggatttcttttacttctttatattgatttggcagtataagaggcctcattgatatcaattttgtgcttatttcattttctcttagtatagccttttaggattgttcctttcttatatactttattttttttttatttttacttgaatttattagtttcatattttattcttcatagaaggaacttaagataactattaaagaaataaaaccaggccaggcatggtggctcacgcttgtaatctcagcactttgggaggccaaggcgggctgatcatgaggtcaggagatcaagaccatcctggctaacgtggtgaaaccccatctctactaaaaacacaaaaattagatgggcgtggtggcgggcgcctgtagtcccagctactcgggaggctgaagcaggagaacggcatgaacctggggaggtggaggttgcagtgagccgagatcatgccactgcattccagcctgggcgacagagcgagactccgtctcaaaaaaagaaataaaatcatatgataggttatttcctcaatagaaagcaggaaatgaaaacacacctgtaatgccattgcttttaacctttttctattatttctctgtagaaacattcaaaattgtagtcaacatcaacattcacatgttatgaatgcctgtttaattataagtatttttccaggtagttgcttttcttgatagtcatactttttaatggcttcaccatttttctgtcataaataccataatttacttgacattttttattgtcagaaatttagattcttttctattttcctacaataaacattattgcaatgatcatttgtctaagggtttttttttctcatattttaaattatttcttgacaacagaatcttggataatttttcaaaaagacttttgaagctttcagtatataattaatttcactataattttgcttttcatatacttttttttgtgaagaggaggaaatttgagttaatatgactatatatggctgttgtgcccttctcttagtgttaatgagtgctttttatttttaggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatggtgagttacgttaaatgaagaagctcttggattttatctgatgttgctgactaaatgtaatgagttgacatgtaagaatcacatggtgtctttgaagaattgaaattgctttcttgagaaatgaacctgagactagttggaaaataacacttttaacgtgctgtgagcaaatttaagtggatgctgaaatattaaaacttagatgggttttggatagatttattctctttaggtttaattgttataaattattttaattaggctaagaaacatagaccctgaatgtaaaaatattacataacattgtgtttgaagttggaaccttgcctttgaccttagtttatatattttcagttttttggatttgatttcaaaatgatagtgaagttacaagaatactacagttaacgttttaccatatttgcttaatcattccctctctccacacacacactcatacgcagatacacacatcattttctctgaaccattttgagatgaaatcgcacacgtgatgctccttatacttcagtgtatatttcctaaaaacaaggatacacttctgtttagccacagtataatcatcaaaatcaggaagttaacattttgtcattgcatttaggtgtgtagtctgtttagtctccttcaatctggaacagttcttttttttatttatcatgaccttcatatatttgaatagtacaggtcccttgctctgagtttgtctgatgtttccttatgattaaatttatactttgacgagaatgttgcaaaagtaattcctcttctgccttcaccctgtccatttatctgtctgttgatagatatcttcaaatccaagccaacatcacacagtttatctttttttctgtccaaatttataaattgctttactagcagttaaaaaaaacaccccaaaacctgactatccactcaacctgaatgcatttacttatttgctcaacaaccttatatataactaatctaaccatgtgggccattttcttagccctagccccagtgtatgtggaggtagagcctctggcctagcgagtagcaagttgggtcctaggtcatgtccccagttccagcaaattgtcacacatgcctggtgagtccctaattagaacctctgatcacagtaaattgtaggctgagtcattggtggaatccctggtcatgtttcccacccttggtgaaaatgcacgtcaatcccttagagtgagaagacaagtttggttgtgccctgtttgggcccctggtttaggtcctcgcagatactcaagtctctatccctgaccaagaggaagttacatgcttttcttgaagtattgatgtttcaagtcacttcagaacattcagtaacctcatgtacatgactctcatgtcaaataatgaaaaggatcatttaatttcctttgttaatatctgaaaaggattaagaaatatattattctatatgtaaataggaaaaaaaatcccttattatttcagtatagccagaaaattatttggtagttctcggaaactggctgcccagataataactaccattataactggtcgttgcagcagccctttctgtgcatagtaccataaagagccttacaagattgccttatgggaagataggtcaaggtttttgacttcttccctgcccatgattatctctgctttccaaaattcattaatagttttcaaccactggtctattatccccaagcattattttgggagagtggagacttacagtttcagaatcttgctcaagctcttaactgcaacagtggtaataatgatcatttattgaattccacaatagaagctagacttttacgtttattttctctaatcctcacagttatctggccaggtaagtgatatatcttcactctactgatgagggtacgaaggccctagatgacataaggcaagttttttaccagaaaagttaaggctgtggtactgggatttgaattttctgtttgacttcaaagccttttgtttttactatacacctcttaaatatttacagctgtgtgtgtgtgtgtatgtgtgtgcatgtatgaatttatgtttatatacttaaaaaaaatttttttttgagacggaatctcgctctgttgcccgggctggagtgcagtggcgcgatctcggctcactgcaaccttcgcctcccaggttcaagcgattctcctgcctcagcctcctgagtagctgggattataggcgcctgccaccacccctggctaatttttgtgtttttagtagagatggagtttcaccatattggccaggctgttctcaaactcctgaccttgtgatctgcctgcttcagcctcccaaagtgctgggattacaggtgtgagccactgcacccggcctatgtttatatactttttaaagtaaatgatttgtggataaacctgatttttttccctcctaccatcttagtatctaatgcttttaaaggagcttcctggagaagagtaccccttgccaatggaagatgttcttgaacttctgaaaccactatcgtaagaaattaaaaccttatgttatgttcactttaaagttataaaataactgatgtgttctgttaagcttataaagttgaactttttttttttttttaccacagcaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggtaggtacagtctattttgtggtcctatttttcttttgctatctgtggatacgaatgcaagttttgtatccacatcagtgatttcttctgatcttcctacatagctaatacatcttttaagaatagcagaatgtaatttgtgtttccctcagtcgcttgaagaactacattgctttttgtttaaggcttggctttctaaaccgtttaactcatttctctgcaaattttgaatcacttaataatttgacatgtatagtgaataaaggataacaagccaaaatcagttgaattgttcatgttccctaagtgaacaaattggccttgtccttatctggttattttatgcatattgtcacattccaagataacaccctgatacttacagaggagcacatacatataatttagaacccttgtactatctgattgctaagtaattctaaatcaatagactgttttttgtttttgtgtttttttgagatggagtctcactccatcacccaggctgcaggctggagtgcagtggtgctatatctgctcactgcaacctccgcctagtaggttcaagcaattgtcctgcctcagcctcctgagcagctatgattacaggctcccaccacaatgcctggctaatttttttgtatttttagtagagatggggtttcaacacgttggccaggctggtcccaaactcctgacctcaagtgatctgcccaccttggcctcccaaagtgttgggattacaggtgtgagccagtgcacccagcctgaatgtggttttgaaatcttcaatataccaaacaaagaaatcttcaatataccaaacaaagaaatttctttctaaagtaagtttactgtaatgtagtttagccattctatggtagcccccaaaaaaggacataatggtataaaacaaataatatacgctaaaatgaattcttttacactaatttcttttagcttgaatttttggcaaggtgagtatgttggcatattccacataatgacaaataagtttagcacagaaagacatattggaagtaacttacaataacctttcagtgagttttctgagtgcttttatcagaatgattatttaactttggaaaacttacttgatttcaggcatctaacaaaggagaggaaatatatattctctgtaagaatggccctagtaaattgccttaaaactttgcttgaggtgagtttttgcatttttttagtaagatctccattgaaaattttaaagcagtctttgtttgttaatgagtaatttttctctatttcatatttaaccacagttcttttcccgtaggctgatccttattcaaaatgggccattcttaatgtaatgggaaaagactttcctgtaaatgaagtatttacacaatttcttgctgacaatcatcaccaagttcgcatgttggctgcagagtcaatcaataggtaatgggtcaaatattcatgaagtatttggaatgctgcagatggcagtagaatgtcttacatagtaacagctcacagttgcaatattaaaaatagctaacacttgttgagtatatacggtgtgcctggcatttatgtttattcttaattcttatacttctgtcacttagattctattatttccttcaatttataaatgaaaactgtgacttagtgaggtaaagtaacttgcttatgccacagagctaacaagtggttgactcgagtgaggtgtgtctactatcatgtacaggagatacggactgtttggaaattactgtgattttatgtgagtttatgaaatgataattagcacattttacattgtgctaattacaattatatttacttgagtgaacatccagtgaagcactggaaggattctatcatgaggatcttttatatttgagtactggaataaacatatattaatttcattctttttttttttttttttttttttttttgagatggagtttcgctcatgtctcccaggctggagtgcaatggtgtgatctcggttcacttcagcctctacctcctcggttcaagcaattctcctgcctcatcctcctgagtagctgggattacaggcgcctgccaccatgcccagctaatttttttatttttcgtagagatggagtttcaccatgttggccaggctggtcttgaactcctgacctcaggtgatccacccaccttgtcctcccaaagtgctgagattacaggcgtgagcctttaatcatgtagtttttgtcattcgttctgtttatgtgatggattatgtttattgatttgtgtatgctgaatcagccttgcgtcccagggatgaagctgacttgatagtggtggataagcgttttgatgtgctggattcagtttgccagtattttatcgaggattttcacatcgatgttcatcacggataatggcctgaaattttctttttcttgtgtctctgccaggttttggaatcaggatgatgctggcatcataaaatgagttagggaagagtccctctttttctattgtttggaatagtttcagaaggaatggtaccagctcctctttgtacccctggtagaattcggctgtgaatccctctggtcctgggctttttttggttggtaggctattaattactgcctcaatttcagaacttgttattggtctattcagggattcgacttcttcctgctttagttgggaggttgtatgtgtctaggaatttatcactttcttctagattttctagtttatttgcatagaggtatttatagtattctctgatggtagtttgtatttctgtgggatcagtggtattatcctctttatcattttttattgagtctatttgattcttctctctttattagtcttgctagcggtctgttttgttaatcttttcaaaaaatcagctcctggattaattgatttttttgaaaggttttttttgtgtgtgtgtgtctctatctccttcactcagctctgatcttagttatttcttgtcttctgctagcttttgaatttgtttgctcttgcttctctagttcttttaattgtgatgttagggtgttgattttagatctttcccactttgtcctgtgggcatttagtgctataaatttccctctaaacactgctttagctgtgtcccagagattctggtacattgtgtctttgttcttattggtttcaaagaacttacttatttctgccttcatttcattatttacctagtagtcattcaggagcaggttgttcagtttccatgtagttgtgtggttttgagtgagtttcttaatcctcagttctaatttgattgcactgtgatctgagagactgttacgatttccattcttttgcatttgctgaggtttgttttactttcaattatgtggtcagttttagaataagtgtgatgtggtgctgagaagaatgtatattactctgttgatttggggtggagagttctgtagatgtctgttaggtctgcttggtccagagttcggttcaagtcctgaatatccttgttaattttctgtctcattgatctgtctaatattgatggtggggtgttaaagtctcccgctattattgtgtggaagtctaagtctcttcgtaggtctaagaacttgctttatgaatctgggtgctcctgtattgggtgcatatatatttaggatagttagcacttcttgttgcattgatccttataccatcatgtaatgtccttctttgtctttcttgatctttgttggatgtttgttttatcagagactaggattgcaacccttgctttttttctttctatttgcttggtaaatattcctccacccctttattttgagcctatgtgtgtctttgcatgtgagatgggtcccctgaatacagcacactgatgggtcttgactctttatccaatttgccagtctctgtcttttaactgggacattttagcccatttacatttaaggttaatattgttatgtgtgaatttgatcctgtcattatgatgctaactggttattttgcccattagttgatgcagtttcttcatagtgtcaatggtctttacaatttggtatgtttttgcagtggctggtaccagctttgcctttccatatttagtgctaccttcaggagctcttgtaaggcaggcctggtggtgacaaaatctctcagcatttgcttgtctataaaggattttatttctcctttggttatgaagcttagtttggctggatatgaaattctgggttgaaaattattttctttaagagtgttgaatattggcccccactctcttctggcttgtaaggtttctgccgagagatctgctgttaagtctgatgggcttccctttgtgggtaacccgacctttctctctggctgcccttaacattttttcattcatttcaaccttggtgaatctgatgattatgtgtcttggggttgctcttctagaggagtatctttgtggtggtctctgtatttcctgaatttgaatgttggcctgtctcgctagattggggaagttctgataatatcctgaagggtgtttccaacttggttccattctccccatcactttcaggtacaccagacaaacgtagatttagtcttttcatatagtcccatatttcttggaggctttgtttgttccttttcattcttttttctctaatcttgtcttcatgctttatttcattaagttgatcttcaatctctgatatcctttcttctgcttaatcagttcggctgttgatacttgcgtatgcttcacgatgttctcatcctgcatttttcagctccatcaggtcatttatgttcttctctacactgattattctagttagcagttcctctaaccttttttcaaggttcttagcttccttgcattgggttagaacatgctcctttagctcagaggagtttgttattacccatcttccgaagcctacttctgtcaattcgtcaaactcattctccgtccagttttgttcccttgctggtgaagaattgtgatcctttgcagcagaagaggcattctggtttttggaattttcagcccttttgcgctggtttttcctcatcttcgtggatttatctacctttggtctttgatgttggtgacttttgtatggggtttctgtgtggacatcctttttgttgatgttgatgctattcctttttgtttgttagttttcctttttacagtcaggcccctctgctgcagatctgctggagtttgctggaggtccactccagaccctgtttgcctgggtatcatccatggaggctgcagaacagcaaagattgctgcctgttccttcctctgggaaggttcgtcccagagcggcacccgccagatggcagcgggagctcttctgtatgaggtgtctgtcgacccctgctgggaggtgtctcccagtcaggaggcacgggggtcagggacccacttgaggaggcagtctgtcccttagcagagctcgagcgctgtgctgggagatccgctattctcttcagagctggcaggcaggaacgtttaagtccgctgaagctgtgcccacaaccacccctttccccaggtgctctgtgtcagggagatgggaattttatctataagctcctgactggggctgctgcctgtctttcagagataccctgcccagagaggaggaatctagagaggcagtctggctacagtggctttgtggcactatgttgggctccacccagttcgaacttcctactggctgtgtttatactgtgaggggaaaacatcctactgaagcctcagtaattgcagacgcccctccccccaccaagcttcagtgtcccaggtcgacttcagactgttctgctggcagcgagaatttcaagccagtggatcttaacttgctggtctccatgggggtgggatccgctgagctagaccacttggctccctggcttcagccccctttctaggggagtgaatgggtccgtctcgctggcgttccaggtgccactggggtatgaaaaaacactcttgcagctagctcagtgtctgcccaaatggccgcccagctttgtgctttaaacccagggccctggtggtgtaggcacccaagggaatctcttggtctgcgggttgcaaagactgcgggaaaagcgtagtatctgggcaggaatccaccattcctcacagcatagcccctcacagcatagtccctcacggcttcccttggctaggggagggagttccccgaccccttgtgcttcccgggtgaggctacaccccaccctgctttgactctccctccgtgggctgcacccactgtctaaccagtcccaatgagatgagccatctacctcagttggaaatgcagaaatcaccaccttctgcgttgatctcactgggagctgcagaccagaactgttcctatgttgccatcttgctgttcccttgttttatttttctctagtatttatgataacgtgaaacatattttaatatatttacttctccgtattccactagtatatatgttcctaaaggcactggtttttgtctgttctgttcattgttgtatttttagcacctaaaacaatacttggcatgtgataggtatccaataactgttttaaaataaatgaatgtacttgaaaaaaaattacatgatgcttcaaaaacatcaaagctgaaaatcatttgagtaactttaaaatgtaagcaatcaataataaaagattactatattgttcagcagtcacataaagtattaaaactaatatttcagtatttgaatatgccgacagtaatgttttcataaactagattttgtgtctaactcctcaggtttggaactgtttttagtaagaccataatgcattgcaaggatttctaatgaatatgtttagtagttcaagcccttattaaatttcacagataaaagcaaatgtatgctgaactttaaggactgaggtaatataagactgaattgaatgtaataaggcggcagtgtagtggtggcattaaaaaaactgaagattcaaaaagtataaattcaagaataacatgcaagtagcattcttttttttaattttacacttgttagattttgtcttagtccctttgtgttgctataaaggaatacctgaggctggatatttacaaagaaaagaggtttatttggcatatggcgtctacatctggtaagggcctcagactcatggcagaaggcaaagaggaatcagtgtgtgcagagatcacatggtgagagaggaagcaagggtggaggcggggaaggccatgccaggctcttttttttaataaccagcccttgtgggaactgaatagtgagaactcactcattccttaccctcaggccttaatctattcgtgagggatctgcccccatgactccgacacctcccattaggcataacctaatggggatcagatttcaacatgacatttggaggggttaaacattcagacaatagcagatatctaatgttcagctattttaagagcagtgagtgaaactagaagaatcagaggaacataaacaattataaaagcttcgattactaaaaaaggataaaagacaaagttgattaaagagttatccttaaatatgtgggtgttacgcaaaaggtgtactgatcaacttttttccatcacataaaacaaaatttaaatggtacataaaaacattaacttacccgctttcagagtgattaaatgttagagcaggttgacattggaatctgtggactcaactaattggtgttcggccagagaacagtttatcttttctggctagtttgagttcagtgctgttcaaatttgagcaatagttaaaatatattttgagaccctcttcagttctaggagaaaatagattttgtattcaagaccttaatactaagctgctggtctgaacctctttaaataaactcaggttttgttagtctttaagaaagagctagtatgttattatgtctcacagagtgatttatttttgttctggaatatgctttggaaagtagggtttgaaattagaaaattatttcactttttgtttgtttgtttgcttgcttgttttaagattgttccaggacacgaagggagattcttccaggttactgaaagcacttcctttgaagcttcagcaaacagcttttgaaaatgcatacttgaaagctcaggaaggaatgagagaaatggtaattttaagtaacatgtatttgctgttatcatatgcttgctatgaatatcccataaattacttcaccaagtttggtataagagagtttataatccagtagtttacagtataaagctgctctaaaacaactgtatgaattgattgaaactgcattctttctgggtcacaatgggtcaaatcatagcaatttcttttggtttagcatttttatggagaaacccaaaatttaactgagtttttatgggagtataaatggctcccttttttattttaaaaatccttttatatgtgatctgattaaaagctaattaagggaacaggtgacaatgggaagaaatggattgaggagaagaatctcacacaaaatcaaatcattgtggtgtttacagtgaaacttgtgatatttcacgtttctgtagaataatatattttttatggtaatgattatcttagagttcaaattttttcatttatttatgccctggtttgtttcttacaagtatttaaggtagttaaataactgtcaagtctgtgatagcaggaaattgaaaggaacaattgaaagaatgtgagtttagaaaagaatttcaatagattagaaagataagtgtaaataacataaaatctaatgagataatgtatattatacattttaaatcagcctgtcatctgcaaaaagggaaaatactgatctgacagcaattcatttagaaaaagacctaggaagttttgtatcttgtgattatagtatgaatcaacattgtattacagttaccaaaaaggctaactctgtcttacactgcattaatagaagcatattgtcatgaacaaagttaatacaagaacttggatcttttatactttttgctttatttttagatcttttaatttttatgggtacatagtaggggtgtgtgtgtgtgtgtgatacgggtatacaatgtgaaataatcacatcatggagaatggggtatccatcccccaaacaaatatcctttgtgttacaagcaatccaattacactgttttagttattaaatgtttctgtattttttagaggataactataatgtttggtttggttctgagtaaagtaaaagatttttagccagaatgttatagatctgtgtcttataaaaaatggatgaaggaattgacttagtggaaagctcacatttgtttttaaacatgtcagtgcttgtgatttagcaaaggtattggtccttactctttcttgtaccaaaagacagaactaggattagtgagtaggaggtttctgaaatgtgtatagcttgtcaaaaaatctggagttcagttgggattttataattgattgttaaacatttacattttacattacattttttttttaatttctttttaagtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggtatatatggatgagtattttattagaagcttccttaggtcactgtgaaataatttaaaaagttaaagctagattttctgagtggcacttatttaagactaggaaacaattttattttttaggttgggaatattggaaagcagttatacaaaaactattcaaatggtatatttatggtatgcactgtttcttacattccatttaagagcatttcacaaggctttcattgtactaacaagagtgaatgacttgtccaccagactgaccaggcttttggaaatagtatttattgagggaaacacatggagacaagagcagcataggtgttttgcccggtagattctggggcagcacattgggatccagcagggccagaagtcaaattttagagctatcaggcttttaagttcagttatcaggggagaaggactagggtccaagccttataattactacatcagcacagtattatagaatgttggccccgtctcttttccatcacctcagcatttatggtttaggaagttccagacctttccattgcaaatttttatgtgataaatcagtggtaggtcagtggactgatattatgccagttaacattctaccagcatagtttccatggtgctttggagtaagccagcctataatcagttagccttttacctctcagtataagacttgttcggtgtttcttaaaagtatacaaatacattacctaataatcataagtgttatgtattgtttggatttttcttatttggatttaagcctaagagaaataattttactttatatttatttatttattttgaaagacagggtctcactctgtcacccaagctggagtgcggtgatgtgatcatggctcactgcagtcttgacctcctgggctcaagcgatcctcccaagcctcctgagtagctgggactacaggcatgtgccaccacacctggctaatttttttttttttttttgagacggagtctcgctctgtcgcccagactggagtgcagtggcatgatctcggctcactgcaagctccgcctcctgggttcatgccattctcctgcctcagcctcccgagtagctgggactacaggcgcccgtcgtcacatccacacacctggctaatttattatacagacgggctcttgctatgttgcccaagctggtcttgaactcttgggcttaagcaaccctccctcctcagactcccaaagcgttgggattacaggtgtgaaccaccactggccagtaattttacattaaatcttcctttaagtataaccaaatgttggaaactcttagcatatttttatatttttatttacttaacatttattaagggtttgctatgtgtcagatactgtgccagttgagtacattttcttaattattattcccatctcatagatgaggaaatcaagaaaagttgaatgaatgttgtttctaggtcctactctaaataatattaacaagcatttaaatgatttatttttttcatttttcttaacacattgactttttggttcgtgcaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctataggtaagtttatacatgacatatgtgaaatttgtttaatttaaaattagttaacaatacttagcaagtcccctcaccagcaacacacataccatacccatacacatgtgtgtgtgggagcctacatagtatgagaagcaggacagcttcttttaataagaatgtattgaagggagtcactggacttcagatctggtcctagctgtgccaacaaccagctatctgactttggtcaaaccacataaagaccctctatgccttggttttttaatatgtaaagtaagcaagttacacaaggagatctttcaggtccttttcagctttaatatttgatcatctttcctttggaaaaaattgaagataaattactagtagctggttatttctgccttgtttttcttttctgttgcttgactataggcctcttagttattacttctattagatttagaaacttaatgtaaaactttattttgctaactttaactctgtagaagaaaaatttgaaaatggagaggtttgaaacaactaaaaagtaatgtttaggtatcaggatgatgggaaggcatctcatatttgttgaacatgctctgtgttatggactttgctatgcattttacatgtagtgtatcacagatctgagtttcagacttatcctaatagagttttctaatagattatgagttgtatgtaggtagtttcctttaagaaggatattcctacaaaagtaaatttagtggtccttatagttcattcattttggcaagaacaatatagctatatctctgtatatgcgagggattcattccaggatcccccatgtatgcctaaatttacgcgtactcaagtcaccaagttggccctgcagaacccacgtatatgaaaagtcagtcctctgtatatacagactttcacatcctgtgaatactgtttttctatctgcatttggttgaaaaatatgcaagtataagttcaaacccatgtttttcaagggtcaactgcatttatgttagttgattatgcagaagaaataaatataaattcaagtctccatttttatttgtttattgttttgttttttctttttgctaagggtgctactgaacaaggtcccatttttaaatcccataattatggtggtggtatgttctaagctttctaatttttttaatgtgactatttagaatttacttaatttttccatttataaaattaaagaatgtttaataatctggataaagtatgatactttaatgctgatggtattaaaacagtttttaagaactattttataaaattttacttggaaaagttatatataacctgtattttaaatttttctatttttagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacaggtatggcttcaatttttatgtacttttcattccctgaatgatatgagatataacctttaagttttaaggctatttattcgatttattcgtatttatatattgaaacttagcttgtggtaatcattatctagcatagccaacccatgaatttttttggttatgtcgtgttgtctccctctgattggcttttaactaagtagaaatgttttaaattagaaataatccaaaaaaccatttgaataattttcttctgccatttaaaaatttattttaactgttgtaatacacgaatgcaaactggttgttaaagtcaaggaatactaaacagtgtacagaaaaccttcactccctcttcaatctcaccaagctttccacttttcaagaaaaacaaccgtccctcattcctatagttctcataccctgctgtttgtttttttgtgacacttattaccttctaatgtatgatacaatttaccttttttttctgtctttgcttttgtttttgagacagagtcttactcttttgccaagactggagtgcagtggcatgatctcagttcactgaagcctctgtctcctgggttcaagcaattctcctgcctcagccacccaagtagctgggactacagctgcgcaccaccacacccagctaattttcatatttttagtagagacggggtttcaccatgttggccaggctggtctttaactcttgacctcaggtgatcttcccacctcagcctcccaaagtgctgggattacagatgtaagccaccttgccagaccataatttacttttgaattatgtttattatttaccagtcttctccagtatacatttttctctctttttttttttttggctgatgtatctctaatatattttgagtattcattaaatgtttgtcaaaagaaggagtcaagtaaggaaggatttaaaaagcttcgtttgttttataatcatttatatacatttccaaaattttttgaagcaacttatattaaaacatacatacaaattttttaagataaaaaagctgtggtcaccccacatttatgtatgtatttatttattttggatataagtaagggataagtaaccaaacttggtcaatattagataaacttcaagggaccttttttttttttagtttcctagttatctatattgaaccaagaaatggaacagcaagttccttagttgcttaggtggacctattcagaactggttgtaagtctgcagtctgaagggaaatggtgagcagaggactcctttcccaaagacagctggaacagaaataggcactccagaggttatggaatttgagagagatactcagcctctagccactcccattcaatctcccagcttagtcttctgagcattcttaatcttactattcttttcttaatgtattcaaaccaaaagacagcaatttttagagcctgaataggttttggagggaaaagtaattacgttcaacttcgattgaaactcttgcctcaagaatgaagaacagcaaaaattaaatcacagtttcttagctttttggttaaagatgtaagttaaattcttggccgggtgcggtggctaacgcctgtaatcccagcactttgggaggccaaggcgggtggatcacctgagatcaggagttcaagaccaacctggccaacatggtgaaaccccatctctactgggtgtggtggtgtgtgcctgtaatcccagctgtttgggaagctgagtcaggagaatcacttgaacccgggaggtggaggttgcagtgagccaagattgtaccactgcattccagcctgggcaacagagcaagatttcgtctcaaaaaaaaaaaaaaaaaaaaaaaaaagaattgtataaaacacacaaacaaagcaaggaaagaatgaagcaacaaagccagagatttactgaaaatgaaattatactccacagagtgggagtgggccctgagcaagtggctcaagggcctggttacagaattttctggggtttaaatacccttcagaggttttccattggttacttggtatacaccctatgtaaatgaagtagtggtctgtaatcagtctgattggttataggaggggaccaatcagaggtactttcaatttcttatctgccacagtaaaagggagggggttgcaaagggagtagcctcttgtccttttgttacttgagcatggaaagttggggttttccttttgatttcgttctaggaggtcagcatggattgaccttaggttccctgcctccagaccttattgccctgcctcatttacgttaggtttctttcttgtcaccttctaaaatattttttgttattaggaagtatgtttttgaacttccttatgcattaagtaaattagccatttatcactgtaattccttatttggaaagttgttatattcacccttaagacttcacaattctcattcatttaactaaagtgcaacatagcagacttattctttatatttagagaatttgtgtcttttgtgaagctacctgtctatagtgggaagtagattaatgaaaagtccaaatctgttggggagggttttattctactattgatgaaaggggatgtggatcgcagctagccttagaatttgggatggcactcaagtagaagtctgggaagaagttacgcagggaacaaagatgacattgttcgcagtccctgggaattcttaacagtaaagttctgtaattgagacagaattcccaaataaagtcaagagtaaaattcagatagaggagcagttatacatcagtgggaaatttggttggcagaaaaattaccaggtcatacaacttaatgatagacctgaagtcttatttaaaatgattctctaaaattgaagaattggattaagggggccttgtttggctgattttcatactttttcctcttagtctacaggttggctgcatagaagaaaaaggtagagttatttataatcttgtaaatcttggactttgagtcatctattttcttttacagtcatcgaatacttttggaaataaggtaatatatgccttttgagctgtcttgacgttcacagatataaaatattaaatatattttaattttgtgcccttgcagattgatcacttattcattagtaatttaccagagattgtggtggagttattgatgacgttacatgagccagcaaattctagtgccagtcagagcactgacctctgtgacttttcagggtatgtacattttaaacttagagaactagctctaacttcacaagtttttaaagaagtttattggttgacaccttcaatgtctatttcaatttatagacatcactctttttaaaaaattttctttaaaaatagccacctttgaattgaggtaattacctatcctcttttaccatagtctccccacagtaattactctttctaaattgaccacttggttggccaacccaataaccttttcttagtctttctgtaatatttgaacattgtgccatctgttggcccttgaaatttttttcttcatacacattattcctagttctcttctctttatctaggtcttgcctttctagatcaccttttctttttttttttgagatggagtctcactctgttgccctggctggagtgcagtggcataatctcggctcactgcaacctctgtcttccaggctcaagctatccttccttccacctcagcctctcgagtagctgggacgacagatgcacatcactgcgcctggctaattttttatatttttggtagagacggggtttcactgtgttgcccaggctggtcttgaacttctggcctcgaatgattcccccgtgttggccaaccaaagtgctgggtctacaggcatgagccgccgtacccagcctcaccttttctttattgtgcgttattatctgtacaatttaatttggatgtgaatgtctctgagttgtatatgaacatcagagttgtttccctggcttgattgtaagctacttgaaaatatgctttacttttttttttttttttttaatgtgccctactgtgctgggcatataaaatagtaataatatctgagaaagtactttcacatatgtaatttcatgctgtctaaataagtgttgattgccatgtcttaaagtactgcttttacagtactggcatagagctttgattctgatctgaagtaatactgaggctcatttattgaactgccttttaactttataagattttttaagaaaatcattataagatcatttaagattatttaagttactgagggtgaaaggtatttagataatctgatttatatatctggactgtgatatgtcatttgtgattttattgaaagtatagtttttcagtagaaaaatggtttttgaatttgggggttattaaaatctaaattttcattttggaagttcactggtctatgaacaaaactttttaaaacgatgactgtattttttcccttaactctgttagggatttggatcctgctcctaatccacctcattttccatcgcatgtgattaaagcaacatttgcctatatcagcaattgtcataaaaccaagttaaaaagcattttagaaattctttccaaaagccctgtaagtatacatgatgagtttaataatagaacattccttcttttttagctaaaaaaactttgtaaatacatcttaaagaggaaaagtaaacaaatgaaaaatttatctcataattaaaaaggaaaacattcatttacaagtttaaatggtattttacttgtcagcattaattgaaatatgttacatatgagaacagaatcttgtgacactttagtgatatattagctcagggaatatatctactttttcataggaatatactatttaattgtagtttactttctgaaaattaaataaattggcaatagtttaagatagtaattttcttaatgtaacattttgtacttgatatcaaacccaaatctaaattctgttatttagttattttaaatataaaatgtgtaggtattcaaatatttgaagaaaaaatataaagtgtatttattgtagccgagtatctaattaaacaagtttttactaaatctgtttattttctaggattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggtaaataacatatttagaccaatatataagcagtctttctatcctgttcttcctgtttttttgctttgttttgttttgttttgagacaaagactcactctgtccgcccaggctgggtgcagtcacggctcactgcatcctcaacctcctgggttcagattatccttcctcctcaccctgccgggtagctggggctacaggagcataccaccatgcctgactaattttttgtgttttttgtagaggtggggtttcaccatattgcccagggtggtctcaaactcctgggctcaagcgaactgtcagcctcagcctcccagtgtgctgggattacaggcatgagctactatgcccaacctatcctgttcttttaattgaaagtttatatgcttctaagaggtagataccagaatgttgctttctgaattttgctttttaagatgtctattatatttacttattagtttttaaaaattgcgctacttgcctgggaaacatagcagacctcgtttctactaaaaattttttaaaaaagaaaattagggcaaggtgtggtagctcacacctataatcccagcactttgggaggttgaggtaggtagattgcttgagcccaggagttagagaccagcctgggcaacatgatgtgaaaacccatctctacaaaaattttttaaaaaataagccagggattgtggcatgcacctgtagtctcacctactccagaggctgaggtgggaggatggcttgcgctcaggaggcagaggttacaggttacagtgagcaaagattgtgccactacactccagcctgggagacagagcgagactcttgtctcaaaaaaaaaaaaaaaaaaaaaaaaaaaaagaaaattatccaagtatgatgatatgcgcctgtagttctagctacttaggaggctgaggtaggaggatggcttgagctcaagagtttgaggctgccagtgagccttgattgcaccactgcattcatgcctgggcaacagagtgagactttcactcaattaaaaaaaaaaaaaaaagcactacttctccaattctagaaatcttaagaaggatcttcaacattttaatactaatattctagctattgatggcctcaaataaatgttactatagaattggggttgttcggccgggtgtagtggctcacgcctgtaatcccagcactttgggaggctgaggcgggtggatcacaaggtcaggagatcgagaccatcctggctaacacagtgaaaccccgtgtctactaaaaatacaaaaaaattagccaggtgtggtggcaggtgcctgtagtcccagctactcaggaggctgaggcaggaaaatggccagaaccaggtaggcagatcttgcagtgagtctaattcgcaccactgcactccagcctgggcgacagagcaagactccgtctcaagaaaagaaagaaaaaacaaaaacaaaacaagaattggggttgttcaatttagcatctctgatcttttccattgattttaatgagatttctattttttaaggtcttttttattgtggtaaactatataacataaaattttttattttcgccattaaatggccagttcagtagcatcaattacatttccattgttgtgcaaccatcaccactgtctatgtccaaactttcattatctcaaactgaacctctctactcattccacaataactccacattcctcctccccactggccattgagaaactaatctattttctgtctcaatgaatttgcctattgtagatattttaatctagagttgtacaatatatgtccttttgtgtcttgccttgtgtggtcactgaaaactttgtaccttagcttgtgtttagatagtgtttgatagagatttccttggataccaagagtgttgggatgaggaagcatgagaggagaaaacttttcctagtgtttgcagattggctttatgctaggattcttcttcaacacttagccatgcttgcattgcttgggatcagccccaaatacaagcttagggtcttctctggtcttttctgagcaagagtcttatcttgagcatgtgtgtggctttctgaattccccctaatttgtgggtgcttttgaatatactaatttcccaaagaaatacgctccccagctactcctaggctttaggcagcctcttgtatgtctcaacagtaatcttttgccctatgcacctgcaggttgttggtctgccttacaaagtttcaagcaacacccatatcttttgtagctggtatgaagttaaacaaaacagagctacgcactttacatcagtccttggttccagacaggttagaatagacatatacaatagtttgcaactaatctacttagctccatgaactaccatgagccagtgtctcacaccgaggatataggccactgcttttgtgattgttgccacgctggggtaggggtgggcaaggacaagtaaagttaccacaaagctttcctgctgtttttcagttggatttttcttgattcaatattttcctgattactgtaaacctttgactattttacagaattctaacaaaattagttctgacaattttgcctgtttttcaatgtttctattaaaggatggaagcttagagctgcctattctgcattttgctgatgtgacttctctttttggcttataagccattaaaatatttatgtcaaggcatataagaattagagatgctgaacaaaaggacttctgaatgaatttatttcagagtaattttccagaacttactggttgttgttgtttttttttctccctatattaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtaattttctgactcatcttcaaaatggtatttaaaatatataaagtattgttagaaggatttgagtgttttatgtttatttggtataattggtgattttattgagaatattttttgtaaaatgattggaaaaatattcttaatgaattaacctttgtaatcaattacagagcacttggtacttttgatagttttatctactgtgctgaagtagagaggtagtcaaaactagggatagcagttcgcaacgttatggtggtatttgagttactacttatataaactgtttcattaatattggcattttttttaacctcagtacccatcttgtagtagtaccttacatagttattgaattatttgaaaacacagaaactaaaagctgggtatcttagacgtaattagaacatttaatctgatctaggttaatagattttatcatttattacagtaagttttgttggcttactttaaaattatttctctccttataattttttctttttaaattatatttaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggtaataaaaatttcatcatctactattttttattagagaacatagtagtacttttcaaaaatctgtaatgctctagcagtaaaaaatggaatcttttctttaattgtgattaaaaatatatacgtaggccaggcacattggctcatgcctataatctcagcactttgggaggctgaggcaggaggattgcctgagcccaggagttcaagaccagcctgggcaacatggcgaaaccccgtctctacaaaaaattagtcgggcatggtgatatgtgcttgtagaatcagctactcaggtagctgagatggaaggatcacctgagccctggaggtcaaggctgcaataagccaagattgctccactgcattccagcctggatgacagagtgagaccctgtctcaaaaaaaaaaaaaaaaaatatatatatatatatatatatatatgtgtgtgtatataaacacatacttgtgtgtgtgtaacgtgagatctacctacttaagaaataaaaaaatgaatcttaatgtatctctttgcattgaagccaaagtataaataacaaaacttcctggtaaagatccaaattgtaagttttcaaggaatgtgatgtaaaatagttttgattttaacacataagatcctaaggtccactgatagctcaaaactaccaatggatcttttcaatgtcaatttaatgtttgtgttagagataacgtttaacttttgaaagcatattttaagttttaatctttataaacctcgaaattatgtttaggtatattcttccatacatatcttaattataatttttaaatgatagtctgtatttgactctatgtaaatataaaaacatatttaagtatgttaagatgtaaagttatactactaaagagaaatttaagcatttccttccagttgagtatgctataacaatcttgaagtctgtgttaccatgagagagtctattagaatttaaaggattaggctgggtgcagtggctcacgcctgtaatcccagtgctttggaaggctaaggcgggcagatcatctgaggtcaggagttcgagaccagcctggccaacatggcaaaaccccatctctactaaaaatacaaaattagctgggcgtggtggcacattcctgtaaatgccaccttttcaggaggctgagacattagaatcacttgaaccggggaggcggaggtagcagtgagccttgatagcgccactgcactctagccttggtgacagagcgagactctgtctaaaaaagagtattaaaacattgtagggtttgcagtggaagaaatcatttatttcttccttgattagtagtaatagagacatgagtcagtgtctataaatggcacttaactaatttttttcttttattaagttttatttcacaggcttaaccaatacgtgttaaaagcaagttacattttctcttttaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgagccacggcatctagccatgcttaaacatttttcatttctttttctttttttttaagacggagtttcgctcttgttgcccaggctggaatgcagtggcactatcttagctcactgcaacctccacctcctgagctcagattctcgtgcctcagccttcctagtagctaggattacaggcacctgccaccatgcctggctaattttttgtattttttttagtagagacggggtttcaccatgttggccagggtggtctcaaactcctgagctcaggcaatccgcccacctcagcctcccaaagtgctgggattacaggcatgagccaccgcggctggcccatgcttaaacatttttaacaccttccaaccatgtaaaagaaaattttaattccttagagccagacatacaagttagtcttgtcttctagtccagtttacctgaatgaaagaaatatgtctcattttaatactttagtcatatgtgttatgtgtgtctatatatatgtaagtatgtatttgtaagtttttctagcttgcttgttaatttgatttgaaatgtacattattacagtatttgggaaactttctactttgtgttttgattttcatcttcctataccaattaatttcatatttcttttttttttttgaaacgaagtctcactctgtcgcccaggttggagtgcagtggcacagtctcagctcactgcaacctccacctcctgggttcaagtgattctcctgccccagcctcccaaggagcagggattacaggtgtgtgccaccatgcccagctaattttttgtatctttagtagagacggggtttcaccatgttgtccaggctggtcttgaactcctgacctcaagtgatccatctgcctcggcctcccaaagtgctgggattacaggcgtgagccaccacgcctggcctaatttcatatttctcttgtgttgtttttactctcagtactttttaaaatgaattttagttttgactatctgagcatagagtttctaatacatttgagatatataaaatgtatgtaaatagaaacaccattatttcttgtacttgtgttcttgagtattttatgggctagagatctgccttgtgcattacagccactagccatttggctatttaaatgaagtaaaattaaatgaaatttgaagttcagttttttcattggtactgaacacatatcaagttctcagtagtacatttggtcagtagtgatcattggacagtgtagattatagacatttccatcattgcagaaagttctgtgggacagtgctggtctaaactctaaatgttagatgttaaaaagccaagcaggctcccaaagtcccttctagctttagtgttgaatgattcttgtgcttctgtttgtgattttgctaaggtgttgacttatctgcacaatttgtttaagacattttattttctctgttgtcacatattgctaatcactttcaaaagaatctgttgtattaaggaagttcagattcattccctacatattttttgagctactcatgacttaaaaccttttttaaactttatagaagttttctagtcagataatttaatatatatgcaattataaacaaaagtgttgtcttcatgctagtttaaactaatttttaaaaaattatttctagataatccgcaagatgggattatggtgaaactagttgtcaatttgttgcagttatccaagatggcaataaaccacactggtgaaaaagaagttctaggtaaactacagtcatgcgctgcgtgacatttcagtcaactgcggatcacatataggacagattataatactgtatttttactgtatgttttctgttgcctgtagtattcagtatagtaacatgctatacaggtttgtagcctaggtgtgtagtaggctataccatctaggtttgtgtaagtatattctgtgatgttcacgcaatgacagaattgcccaatgacacatttctcagaacatatctgtgtcattaagcaaagcatgattgtattggcggaatgaatgtgagttatgcggtggtcatctttattatatgagtggttatctttattatatcttcaaaataagtgagggtttgtcatttgggatattggggaaatatgagatgctagctaagttacatgcctatttaattaaaatgtccctaaaaaggccccttttgtacttttcttccttaaatattcatataaaatgaaaagttagagatttacatatgtgtataacttaatttgaaaatgccttgtaaatatttaggaaagtcagaaatacttgtttttagagttaagttgcaaataaattgactgccgatatattttataaatacattataactgacaggtactcagtgtcttttgttatgtagcagacataagaatgaagacttggagggctagattaaacttaaataattaaaaaccattcaagtcctttcctacagccatttgaggggaaacctaatgtaaaataagaagccaacatcatctctagtttaggtgtttagatttagtgaccacgggatggagaaatcacctggttaaagtcagcttgaagctctcgtgatggtttttgtttctaattagaaaaataggaataagtagtgtttcacagattctactatctttcttcaacagccttaacttctcattaggagcctaatatctacagtacttccttttttgtagattttaaaaaattgagatatatcctaatatagaaaagtatacagatcaaaaatatctagcttgaagaatgtttgcagagtacgcttgtacatgtagcacccagactaaaaaacagaatcttaccagaactgtagaagttttctttaaccaacatacttacctccttgtccatagtggcactgcttttatggacagacctgatttacaacagaagccctaagtggctttcctgtgtagcataaaattaatgtggtttgttctcacagctttccccctaagatcaggaatgagacaaggctgtccactttcactactgctgttcaacagtgtactggaagttctagccagagcaattaaacaagaaaaagaaattaaaagcatgccaattagaaaggaagtaaaactatctgtatttacagacgacatgatcttatgtatggaaaatcccagagaatccacaagaaagctactgtagtgctaataaatgaatttagcaaagttgcagggtacaagatcaacacataattagtggtgtttgtatatactagcagtgcacaatccagaaagaattagaaaagcaattccatttacgatagcatctaaaagaaataaatagccaggaataaatttaatcaaagaggtgaaaaacttatatacattctgtttgttagacgtgagtcactaagtacagaccacactcaacgggagggaagttaggctctaccctttgaaagaagggctctcaaaaaatttgtgaacatattttagtaaataccatcatgatggaaagagcacgaagagccctctgggttgctgaaaatgtcctgtcttcatctggttagggagaacacaggcagaaaaaaatgtgtatttgtatgtataaattttcattgaactgtgtgtttaagattatggaatttgtgtgatacctcaacaaaaattttaacagttttaaggttgattctctctctctttttttttttttcttttgtcacccaggctagagtgcagtggtgccatcttggctcactgcagcctccgcctcctgggttcaagtgattctcctgcctcagcctcctgagtagctgggattacgggcctgcgccaccacgcctggctaattttgtatttttagtaaagatggggctttaccatgttggccaggctggtctcgaactcctgacctcaggtgatccgcccgcctctgtctcccaaagtgctgggattacagtcgtgagccaccgcactcggccttaaggttaattcttgaagtacagaaaaacagcattatagttttgaaattagaaaatttcagttttatgtatgatctcttacctatgactctactgaaatagaatttctatatgtagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattggtgagtatttattgataccttatatgtaatctcaatatgacattcatggagaatgatacttcacacaaatagatattctcagtaactaaagctttgtccttttttaaatctcagtgtctttatgaaaattcttatatttttattaattcacataattatttaccctactatgtgccagacacttgatataatggtgaacattccagacaaggtccctgttaaaattttagtgggactagacaaataaacgataaataagaaaaatgccagatggttctacacagaaaattaagataggggaatataaagggagatgttttaggctcttgtcagtatcagaggtgccactctcctctaagcgaggccttattttgatccttttaaaataagtcgtaaagcagagaggttgttttataatcctagaagtcttaagctaatcagacagggtcttctattacttattctctgtgcaaagcagaattgcaccacatatcaaaatttcaactggttggttgagattacttttgcgtgcatgctctttctctctcttatttatttgttgattgattgattggtatctttgagtactccatcaccaccatatttgatggtagcctcaaagggttttcctcacaaccaggcacctttctaagataaatacgtgttttgatttttttctgtacttcccttcctccttctcttgaggaataaatgattggcaataatgtctaactgccatgtttccgttattgatttaatgtacctgtatatttctttcttttgttgttgtttttgtttcattaaacaaatttgtatggtttctttccaaacattttattataaaaagtttcaaacatacagcacaatggaaataattttatagtaaacacccatatgcttatcatatagtatctatattttatgctgtccttgcttaatcacttctagccatccgtctatccttgtgttaacatgtattaattcatctctctcttttttttttttttttttttttgagacagggtctcgctctatcacccaggctggagcgcagtggcatgataatacatcatagatcatagctgactgtaaccccaaattcttgggctcaagcagtcctcctgcctcagcctcctaatgtgcaaagtttatgtgcttgagccacaccacactcagccagttcatctcattttttaaatgtatatcaaggtatatcaagcacagtttttgaagagagtgccacagaaaatttgcgagcattaaatgtttcattcatttcatagtaattcgaaattggtttttctgaaacagatgcacagaaatattagtgtgacttcaacttaagaatactaggaagcaggtacaagttttttgtatttttctttaacagggaaaaactttagatcttcaagggactttagcatatgaagatgtggacaaaaggattcccagaatttttattacttatatgtattagaacatattattttcaagtatttcttgagtctttttaatttatagtagtcacaattaaactgtattgaatgaagggaattgcagttgcagtgattagtaattcaagtttactgaatgactagtgaaagtcctttgatacttttatttgatattggagaattttgtaaatgtaaagtttcctaatacaaattttaaattttagttttgaaattttttcagtggaggttaacattcatcaagattaataactggtgtacttgataggcatttgaattgtttttttcagtgtcaaagttcgatcagcagctgttacctgtttgaaaaacattttagccacaaagactggacatagtttctgggagatttataagatgacaacagatccaatgctggcctatctacagccttttagaacatcaagaaaaaaggtctcttaagtaataaatgtttattgaatacccagcatatctaaaacagttctgtttgctgtgggtcatgactgttaaattgcttgaaatagtattgtactaactattaacctttcctataagtaatttaagccatatttcataaatccagggaatgtgttatttttaatttattatggcagtgtggaaaagctcagataggtaacctgaggaaatagtagttgatttttgggggaggggaaattcttaaagacagaccttgtttttttagaaatagaaagcgctactttgctcccatgaaagctgttagctctgggtatggtttatagttattgtgatccacaagtgtttatttccatgtcaagttaacatatcacaatcccctggtgaaatataggaagacccatagatttctccctttttccatgttgatatcgtaataaggttccactgtaagtattctgtgaagcatgtttaagaacacttgttccttccttagtctaagcattcctctttactatcttcttttcataaagtgactgagaaatacacagtttagttttcaccaatttaatttcagggcagaaacccaacattgaagcagtactttcagtgcatcataaatataattttagtgttagtaaaattactggtaatataaactgttaatgaaactaataatataacctggaaggcattataattctaacattttaaaatctcatttcattttgaaatcaagtctctgtggtagatgtggtctagttttgttcaagagacagatgagtcagagtttgtgatttgtgtaatatgctactaatgagtgacagagctgagagtagaacctaatttttctgctgcctaaagcagcagtttttgccataccactctgcctcttgtataaacataaatgttttcatcttaaaaggtaaacattgcctccagatttagttttaactgtatttagctttattcagaaagatttgttatactcattttgtgtaggaaaggtacaatgatttccacttctcttatttacattttctaatccctttctttctagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtaagaagattaattagtctgatataattccttgtttatgacctgtttatctaaagagtgctgtgatactgcacatcatcttcacataatatcacccccactcaaactgttgtaaatttattaaagtgagcatccgtatttagtcataactttatgcattaggtttcagcttcgggatagcaacatactagaggagttctaaggggtgccttgaataatttgttactaatgatagttaaaatactgctgattataaattatttgcattaaccaagagcctgttctaactttgtttacgtcttctgataagagcacctttattttccctgatatgctttcttgaataagaaaaaggagtggggcagcaatcagcatagcttttttatttttgaggatatagtacaatttatctcaacgaagagtaaaggtacataccaaatgaaacaaagtttgtactcttccatcaaatgtgtaatctaaaacagcatactatgatgctctaagatttacagagttaatttatagcactgtcaaatgtgattcaacagaaatgtgaaaatacaacatctgatgaggtcaaacatctgctgattacagataactgatagagaagtattttcgtaatgtactcacattgaaagcaatgtaagaagcagttcttattttctacagaaaaagtagtgacagtgaataaaacatcaccttctctgcaatactacaccgcactcataccaattcagcagagtggtaccctgaacacacatacagcttatttctcattagtgaacaaagctaagatttttataaagttttacctttgagccagaaaataaaatgttccaaatatacatatgtacacaccccatttgtggtactttaaattctctagctctaaaactggtgttttgccttgtctttggtttgaaaaagaaaaagggtgcaattagtaatctataacctgtcttatgtgtgtgaagtatgatgaatatgatggatatggagtgtaatgattcattcatatgttaaatatggagtgcggtgaatagcaaaagtaaagctgaatactgttttaatgtgccagatgtattggagcacttttctgctctttggaatataccacaaataattacccaaattttatgcccagaagttgggcttattaaaaaataaacatttttaacatgactgttgtagttcttcactgaggttagaaaatgcataaaaatcagatttccaacttttgtcttaaacttttgatacctttttccctcttctatcatatcagaaaactccttctgttactaacgcttttcaactctgaaattgtatttaaagtggtgatataatttcatttgtaagcaatattctgtttcattatggtaatggcctagactggaaataaacagttacagtgtcactaacatatatatttgatattgatatactagcctagtgtggttttttaaacaccacctaatacatgttttttgtttgtttttttagcagtatgttgagtttatggcagattaatctatcatcttttagaaatttaatatgtcaacggggcatgaaaattttaagtaaaatgtattaattttactcatttttactcaaactattgggtggatttgtttgtatattctaggtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcaggtattctattaaatttttaacattaatactgtaaactcagttctagagaaagatggatttaagatggaatcccactaaaagcactttacaggattaaatctataacctctaaatttgtttcttcatctatggaatggagataaaagttgccaacagttgcaacaagttttcaatgaaataatgtgtgtaaagtgcctaggatagtacttgatgtatagtattccctcagtacattttggctattgataatgggtcaactaattgagctttcaatatgtgtcaggcactgtgcttgcactggcaatattaatgtgaaaaagaaacacccacattctagcaatggaaaaaacaaacacaatcagatattttaggtactgtggtgcagatacgatagaattttcatattttcagagctctggccaactcaatttaaaaagcagcctttggccgggcacagtggctcacgcctgtaatgccagcactttgggatgccaaggttggtggatcacttcaggtcaggagttcaagaccagcctggccaacgtggtgaaaccccgtccctactaaaaatacaaaaattagccgggcatggtggcaggcgcctataattgcagctacttgggaggctgaggcaggagaatcacttgaactcaggaggtagaggctcctgaggctcactagccaagattacaccactgcattccagactgaacgacacagcgagactgtctaaaaaaagaaaaaaaaccctttgtataactataattaacatttagtgtatatccttctaattgtttaaaacaaaaattgaactgtactttatttactcttataacctactttccttctatgacatataatgggtatttctcatgccaagagcataatagcaaaagaaattccaccaagggttgggtatgtataatacatatatgcatgcttgaaggctcattatgggtcagttttttaaacctaaattttataaaaggatacaaaattcacagatctttattgttaactgtctttattatatattattaatgtgttttatatgcaaacataaagctaggtgcaaattcacttgttgtacttaaagaccaatcaattctaatacaaatgttgatttaatgtgatattttgccacaactaatctgctcctcccaatccttccagtcacttcagcaaaggttgtgattactcagttcttccaattgtttcttttagttttactgctacaaccttcatttgacatgactctaatgtcatttagacttcagtttgctatgctttatattttatgtattttattttctgttggctaacagcaattacaaatctactatttggaaaaatataaattataaacatagacatagatgcccatcctgtgatcctactagattataggctgttctctaaatgatctagaatgtgcttatatgaattttccttaggccactgaaatgaaaatcctaaaataaaaattctcatagaggctttgtaaactatctaaaatgtatctcttatctttaattgggaaaatacaggtataagtgatttaagcatttaaaactttaatatgtaatttacagtactattaaaaacaatttttattacatagtttaaggtaatcattgtttatgataatctggtaatttgttatcatgaacatggccaagacttttttcatgtttatcacttatgtatttatgtcacaaccattggaaggtaaagtaactgttttattttatctgtatacagtgccaatatttttattaccttaagtgaaaatttaaacttcacatataaaattctgttattgaaaaggaaatacatatttttgtaaaatttaaatggtgtatcttttctgatggctataagcctcattgccttcactaaacgtcccatgtgcatctcaaactcagctgtccaaaagcaaacgtgtcatcttcttcatcccttcccccagcctacttttttaaatgtgtacctttttgacaaatggcactcagttgcttactctagaaacctctctcacgtatttcatctgattaccaaatcttgccaattccatattatgaataacttagtccatttgtttctctctgcccttagcatccttactgctttctagctccatgatttagcacagttgaaattctttcattaaattttccaagttatttcttgcttccagccatctcagatattattattattgcctgtagcactatcctttcctgctctgatgactattactcttctttcagatatcactttttcttttttcttttttttttttctttttttctcttgagacagagtctcgctgtgtcacccaggctggagtgcagtggtgcaatctcggctcactgcaacctctgcccctcaggatcaagcaattcccgtgcctcagcctcctgaatagctgggattacagatgtgtgccagcatgccctgctaatttttgtgtttttaatagagatagggtttcaccatgttggccaggctggtctcaaacttggcctcaagtgatccgtccgcatcagcctcccaaagtgctgggattacaggcatgagccattgcacttggccagtatcactttttctatgaaacttttcttgtctaggtgaggttccctctgctaagcttctgtagcattttaaactttcctattataacacttatcatattgtgttgtaatgtcccaggctagtcagtgagttctgtgtggtctgacatgatctgtcttgttcatgcttatatactgaggacctagcacataaaagatcttattgaatcaattaattagtcctcctttgaaataaaatataaattacaatgtaagttctcactttttttaagataacagtttcttttaaaagcaaaagaaatcctattaaattccttcagaaccaattttgtgttaggtactgcccaccagaaccttatagcatagtgggagacagacacataaacaagaaggaagaaggtgtgtaagcaagaatgcctgggactgaggggagatatttttgtttgtcagagtcagagcactttttccgatgctgtttggataaaaaatcacaaagaacaatgcttgctgttgtggactacatgagaagacaaaagaggtaatgtaatgagtgttgcttcttacgtttaggatctagagtgtaacttgttaactatcggctgaattttaacatgattattttaggtgaaggtgttgcaaagtgttatatttaatttgtgtgatatttatatctccttgcagtaatccatattcaggatagcagtttggttaaatcagtgtcaagaactctcaattctagtaccagctgtaccagtaaccatgttacctttgttaaattatgcagccttcttggctccaatttatttcatctatgttagggataggagcaagtgtttttccaagttacatttagctgtattacccctctttttacttttctctttgctttagttctaagaagtaaatagagttgtgtaaatgtcttctttatgtatctttattttaagatgtaagtttctttactgtgtgcagtggtctcaaaatctgtggcaatactgtgctgtgacaatgtttattttcttgtttctggtaaattgttttatagtatagtatctttgttcctgttatttctcatgagatttttaacagtgcatacagaaattgctagaatggatggtctgactgatgagtactgcttgagagttgaccagaactctgaagaaatagtgtagtaggcctataatttgaataggtaggaatcgatgtctcataagtgtgtatggtggtggtaggggtggttggtaaagaatgagagggagaggtgagtgaaaaatgaaatgtttttaagcctaaatgcattaatatcttaaaaaattaattcctatgtagtcttaaaccattcttcttctctagtagaaaaagaagttttatgcttttcagtgtctttgcttctggttattttaccttagagttttataccagattatcttctgaggaggcctatcagaagctttaatgtagtggagagcatttgttttcttggtgttgggaggcagttttacctttgagtcattcatttcagacttaccattggggtagaatggtgttgacattagcaggagttggagaagataaaaattcttcatattccattttaatgctgaataagatcctgaagaatattcctggagaaagtatgaatgggatatagaaaaacgggtaaagacatgcattcaagtccaagcttgtgctgtgtaaaaattacttgttatcctgtacagtatgttgggcaaaaacaaagaacaacaataaaacaacaacaacaaaaaaattgcttgctgtctttgaacctcagtcttatcatctttcaaaatcagaataatgtctgtagtgtcttcctttccatggggaaattatttcacttctctgaacttaacattcatcggaaaattaactttagttgagtgcttgctgtgtagtagggtgtgccttattcatcagctttgcaggcattatttaattgttgcacccattctccaaggtccatgttgttccagcatttgcaagtaaggaaactaggaaactgaggtttaagaagttaagttgctgaagatcacacagctggtagtaggcaatatagctagatttgaacctacctgtattgtacttcaacactagtgctcttaagcactaccatgtcccatctctacaatgctagttttgaaaaagatactatctatggtccctttcaatcttgacctacctattaacacagtggaagatttttattaagtaactcaacctaggcaatacattaaggagaaaataagtcacaataggaaagacatgtatttgtgtcttagatgaaacaatattttttattaaattgactgttttaaagtgtgtgttggggggtgcttgtgtgcatttgtattagctattctgtgtatcctattcttagtctgtggtacatggatttcttggtagagagcagatatgaaccccaattttgtatcaggtgatagtctacaggttttatcagattctctgataggtttgagggaaaaaagaaaaaccaaaaagattaattaaataggactcttcagccatgttatcttataatgtttataggtatatattggggaaatgtggtttttgggaatttgtaattttctgttaagcagtcactaccattgtattctatatcaacatgcttttattttgatattgaagtttaaaaaagtgaatgacattatatctcatttttctttagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaaggtaatggaatttagaatttttggtttttaaaattaatgttggcattgtctcaataagggtatatagtaaagatttattttgcctcctgttccccatttaaaagatattttagatagaaattttgttttaaagtgaaattataataaatttttaaaaaggaatatgtaattcctgttctgaaataataggaatgcttattacttaggtattataaaaatttaacagatagcaaattcctataggacagagtccatacttaattttctgtatattccccataatagccctagcattgagaacttaatttaagggtgataaatatttttcaaatgattaaattatttcctaacttcagtcagattagatttaccactaatttctaaactattcaagattcattttggatataaaatatccaaaattataatccaaaatggctataatgtgactgatttatttctgtgactaattaagtttcatttctttatctacctatatttctagtgaatttaattcgctttcctctgactgagttagaactgtcataagaatctaataaatatactcctagatcatggggaagaacaaaaaataagaaagtaagagtaaaaaataaagtaaaacactttattatcccaactgctcttttcaaatgtttgttcgtttgaaatggcctgggtctcattatttcgcccaggctgtggtgcagtggtgcgatcatagctcactgtagccttgatcttccgggctcaagtgatcctcctgcctcagcctccaagtagctgggactataggcacacaccactgcatccaactcattttttttaatttttatttttaatagagacaagatcttgctatgttgctcaggctggtcccaagctcctacgttcaagcagtcctcccacctcagcctttcaaagtgctgggattacaagcatgagccgctgcacctggtcccaaattgttttttaaagcggttatacccatttgtgtacagaaatgtagttgataaggaagtggatcggtaggaagccttatatttgaagaagggtgccaaagtataactgttcctagtttagttaaaaaagtaaagaaggttgggcacagtggctcacgcatgtaatcccagcactttgggaggccaaagtgagaggattacttgtgaccaggagactgagaccagcttgggcaacatagtgagacctcagctctactaaaaataaaaataaatcagctgggcatagtggcctgcacatgtagtcccagcaactcaggaggctgagggaggaggatcgcttgagcccaggagggagaggctgcagtgagccatgattgtgccactgcactccagcctaggcgacagagcgagaccctatctcataaacaaaaaaaaaaaaattaagaaactggaatatgtatataggtaaatattagaggcagtatcacttatgatagtatttattttatgtactagattattactgttatagacaccacagctgtcatggttttagaattgaagttacttacagaactgaatgttatatgtataaaatgcataaagttaaggccttgaagtaggcaaatctgagttctaatcctgactgtcaaactttctagttttatagtcttggtttaagtggatcctactgatctacttccttttcaatagttaatatcagatgtcttaaatttatatctgttaagtattaaattctgtcttattgtggtctttatttgtgtgtctgtaattattgattgggttgaatttcaggtgaaaccactgacagagtatatagtacctgaattggatggcatctgctctatttttaaacaatccaatctctttataaataatcatatttttgcatataggcttcccatatgtagattattcttaaaatataattttcattcacaaattccttttccatcctaggtataaatggtattatgttttaaagtataagtgatttattctgttttgtttgccaccttcattagtttttttctgtcaaagtctatagtatatgtattcaggagcttccaaatagtatgttctcattaaaagaggtgttcttgtgacaaacagaagtcttgcatttgaagaaggaagccagaatacaactatttctagcttgagtgaaaaaagtaaagaagaaactggaataagtttacaggtaaatattagaggctctattatttatgacagtatttatctcatactttgggttattttgttatagacactgtacagatgccatgtgatttttaaactgaatttacttactggactaagcatcatatatataaaattatggtctgaagcttaagccttagagtagacagacttgagttctaatactgactctgccacttcttgagttccttatctgaaagacgaaggtaaaaccacctgtctcagagtttatgccatgcattttctgccatagcaccctgttcatttcctttatagcacttagggtttataattatatatttatttgtttgcttgtttattgtatgttacagaagaagcagattgcctcttctataaatttcttgatatccattcttaaattggctcatgttactgtctgggatgcttgccgaatttctttggtcaactcattcctccacaatgacaatttcagcttctccattctgcttaaacctctcatcttctcttctatgccgctgctttcagcctgcctcctacttggagaaaatagaaggcatagagaggaaatctcgccacatcccactctcaaacattgaaatctcctggcatctcctcctttaataatcttccgtcatgttacagaaacagtttatccttctatttgagactaattcttcctgtgctttgtttttttatctgctctttctcaggtgctttattttttaatatgctgttctccctctgaactatgttctgaacattttaaaacctctcctgtttaaaaattccctttctcacaaagacaaaataatttccctcttccctatgttctcttttaggtatcaccctctctcttccttcctctcacagacaaactttgtgaaagagttgtccatatttgctgtctgcatttcccccccttccatttattccagtaaaatagcacttgctaatgtctctcataaacttcatgttgctaagtctggtggtcacctttcattcttccttttccttaatgttttattaatacttcacatcatcaaccatgccttgcttgaactgtgttctgtttacctttttgatccactctcctgatttttctcctttcacttttgccttcttcataggctcctcctctctactgagtttttggaatatcgtgtgtgtactaagcactgtgctaagcatgggtactgaacttttctactctgaggacttgatttcacgttatgaatagaaacatttgagttggaactatagaattatgccaatataaatgaatttgtgtgtagaaaatatttcacagagcaagcaccatataggcagttcaattgcttgatcaattttctatgcagtatagttcctagttttttctattttattttttttatgttttcatttttatttaactgagattgttttaaacagaatatatcttttctgtgtaaattttacaacaaagatttcagtaaccaaactactttatccatatcaaattttaccaattccaatacagttttgtgctatttttcaaagaaaaatccacgacctttattcttaccaaattgagttttcaagagtcagactttgtaggactgtattttctaatgtacagtttttttgtttttttttccagacaggatctggctctgttgcccaggctggagtgcagtggtgcagtcataacacactgcaagctctgcctcccaggctcaagccatcctccaacctcagcctcacaagtagctgggactacaggcatgccccaccatctccagctaatttttgtagagatgggtttagccatgttgcccaggccgatcttgaattcctgagctcaagcagtctgcctgccttggctacccaaagtactgggattaaagatgtgagccactgcacccagcccatgtacagttttaggtgttgacaagattgtttggttttgtttgtgtgatttttttttttttatgtgatataagcctggtaggtcggtacttatttcttatctaattcatgaaattgtaggcaattcttctcgggtagactacagtcctcctgttgtctaggaccagtctactgtgttgctgatccaaatcattagtatatacagttgacccttgaacagtgtaagggttagaggtgctaaccccctgtgctattaaaaatcagggtaaaactaaattagtagtcaaaagttaactactaatagtctactgttgaccagaagccctaccgatgatataaacaacacaattttgtatatgtattatatactgtattcttaaataaagtagcttgagaaaagaaaatgttattgagaaaatgataaggaagagaaaatgcatttacagaactgtactgtgtttatcaataccgtaagtttatatcatctgtttacaaagaatcatctgtctgaaattgtaggcaaccactgctggttgatatgtactttaggcctcaatctacagaatgtatcaaacaattcacctttttcttgtaatggcatgacttttctctgcatcttggaagcacctccagccactgtggtgttaatcaaggcttatagtattgcagtaaacacagtgaaaaaatacatgagaacctggagagattacttttcatttctggatacaatttactagagaaatgaactgctcatgtggaaattattagtgtcacatggcattttaagcagatactcacaacacaataatgcttaccacagtagcaactgaggtagctgcaaaattattacaatagtacaatatgtacgatagttaatcttatgcaattatgatttaatactgcatctttacatttgtttatatttgtcttaaccacaaataatgctgtgtacagtgtgtgtgtgtaagttttgataaattttaactctttgtaatagatttgtgtatattttatggtagtaaatgatgaaatgtatcatatcaaatgtatacaaatgatggaatgtgtagactagttgtacatttattttatgcattcatgacataacttttaaaaaatttttcagtagttctaaactgtgtggtttgtgaattttttcaaattgtggcaaacctccaaaaagttttcaatatatttattgaaaaaaaaatccacatataagttgtcctgcacagttcaaactcgtgttgtttgaactgtatttcagaactgtatttcagaatcattacattttatttctataacataacatttagagttgggagttacatattggtaatgatacaatttaaaatttgctaaatttatagaccgattttttttccttcttcaatttttgttgtttccatgttttcaggatcttctcttagaaatctacagaagtataggggagccagatagtttgtatggctgtggtggagggaagatgttacaacccattactaggtaaattgcatttttctaaacaacggtatagtaattctgtttatgaaggagttatgtgtgtgtaaaacccaaagctattttcacaatcttttcttatagactacgaacatatgaacacgaagcaatgtggggcaaagccctagtaacatatgacctcgaaacagcaatcccctcatcaacacgccaggcaggaatcattcaggtacattttttcccagatttggtaaagccatcactagtgtagtgctgaggttatttcagtatgttggtggatatttacacagccagataaactctagagataagactagaacttatctgtttttcagaggattaggctaaacattcagggatactcctgaagcagagggatgcaaaaaaaagagaaaaaattcagggagacacaggaaagtcagacaggtcattgacctaaaagatagtgtagatttcttgatcatagtgttgttggataacaacagaagacattgctcgagcatatacaatgtgccaggtagtgtacttactgcttcacatggaaaatcttatgtaaactatttctcatagtttgcaacagagttggtcccagaacctgttgtttctattactggctaatactccttagccattcttccatgaaatattagagccctttgagctctatttttgtgttttttgggaaacattaaacgatattttgggattaaaaaaatgtttttggccaggcgtggtggcttgcgcctgtaatcccagcactttgggaggccgaggcgagcagatcacgaggtcaggaggtccagaccatcctggctaacacggtgaaaccccgtctctactaaaaatacaaaaaaaaaaaaaaaaaaaaaaattagccgggtgtggtggcgggtgcctgtaggcccagctacttgggaggctgaggcaggagaatggcgtgaacctgggaggcagaggttgcagtgagccgagatcgcgccactgcactccagcctgggcaatagagcgagactccatctcaaaaataaataaataaataaattttagagataaggtgtcaccctgttactgatgctggagtgcattagcgtgatcatagttcactgcagccttgacctccctggctcaagggcacctctcgcttcagccacccaagtagctggggctacaggtacacactaccatacccagctattttaaaaaaaaaaaaaaattgtagagacaggtcttggtttgttgtccaggctggtctcaaactcctgggctcaagtgatcctcctgcctcagcctcccaaagtgctgagattacaggcatgagccaccacacccagctgatattttgggattttaaatgatattgtgaactaaaatttgtctaagttaatttgtatctttgctgtttttttctctggttttctgttgatatctttgattacttaacttaaaaacaaaataactcctgtttaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcaggtaagaaatttgacttgatttttttttttttgcctctctcctcattctaaacaacaactgtttttctcttctatgaatataacaggagttgttttatatatatatatatatatatatatatatatatatatacacacacacacacacacacactatatatatatacataccatatatatagtgtgtatgtgtgtatatatatataaaaaaatatatagtagatgttgcaagctatagatagccctaaatccttcagtaagatagcaataagcagttaatgcacctaggcttgaattttactctcttattccattaggacaacttcaccccacccctaaatatttctaaaaacagaaatatgaaaagggttttcgaaatgagtatcatctcgcatagtttgttggactgaggcatgccaagaaaagtataggcattcctctttctacttcctgctacaaacattttagtcagtaagatagcacttatattggctggaggatccacaaaggactgcttatctttatttatgaaatattttcttttattaaaaaataatacggccaggcacggtggctcatgcctataatcctagcactttgggaggccaaggcgggtggatcgcctgagctcaggagtttgagaccagcctgggaaacacggtgaaaccctttctctactaaaatacaaaaaattagccaggcgtggcagcatgcgcctgtagtcccagctacttgggagcctgaggcaggagaattgctagaacacgggagacggaggttgcagtgagctgagatagcaccactgcactccagcctggacaacagagcgagactctgtctctaaaaaaataaataaaataaaaaaaataatatgcctactcagggctgggcacagtgtggtggctcacacctgtaatcccagcacttggagagctgaggcagatggatcacttgagatcaggagtttgagaccagccgggccaacatggtgaaactccatctctactaaaaatgcaaaaattagctgggtgtgctggagcatgcctgtaatccaagctactcgggaggctgaggcaggagaatgcttgaacttgggaagcagaggttgcagtgagccaagattgcaccactgcaccccagcctgggcgacagagtgagactctgtctcaaaaaaacaaaaaaaacactcagttacccaggaagataacatttataatctgtatataaggtcaccatgttttctgaatgaaaagccaagcacctaatctaataaaggatttcatatttatgtaaagttttttgataatgtaaaccctaaaaaattaattatgtttaagtatgttttgttgcctttgtagaaaaaaaaaattattggccgagcgcggtggctcatgcctataatcccagcactttggaaggctgaggagggtggatcacatgaggttaggaattcaagacaagcttgggcaacatggtgaaaccccatctctacaaaaaaatacaaaagttagctgggcaaggtagcatgcatctgtagtcccagctgcttgggaggctgaggtgaggggatcccttgagcccaggaggtggaggttgcagtgagccgagatcatgccactgcactccatcctaggcaacagagtgagactctgtctcaaaaaataataattattggaatgcctttcaaatatttcagactgtaagactgctataaaattagagatatatcctcatattttaaaaaccttttcctgtgcgagttgattcttgcttgcctctgtaaatcaatatatactattcttctccttcctcttgtatttcagctacacagacctctctgtgttttcttgtcaggccaagctgtttctatccaagggccttagatgtatcttctccttttcccccagttaccatgcgggtggcttcttttcattcggaccctagttaaataataatgtatcttcagagaggcctttcttgattacccattctataatagccatctagccattttgttttgttaccctgttttaattctctgcatgtcccttgttactttccaatacttatttattgtctgttcctccaaaccagcacataaattccatgagagtaaagacctgatctgacttgtccacttgtgaattccccttgtgcctagtgcctggcacataataggtatttattgaataaataaatgaaagtagagcatatttagaaccaggcagagtatctgagtaatttcctttttttctgcttaaagaatttaaatgactcataaaatttgtatttcttaccaaaaattctagaaatgcattttttagaatggagaaatgttaatttaaaaattttgtcctttggtgaagctatttatacatgtatatcttagggttctgtttttaagtatatttttttctttgacttatctcacagcaaagaagtagaaggaaccagttaccatgaatcattgtacaatgctctacaatctctaagagacagagaattctctacattttatgaaagtctcaaatatgccaggtattatgaaaagacaaagttactgtattttaacatttaatgtcatggcttcttttctgaaaacttgagaaacaattttaatgtaaggatttgcattgatgaagagataaagacttggtggctgtgatcagatgtttccttgtaattctctgccctccttcaaaacaaattgtttctgggattccaggttcattctttaccctgacccttcaagaaagttttggtgattccctctttgttctcttcctatacaagtatcctgagaattatatcttgtctcttttggtaattgtatggcatttagtgttctaatttataaaattgtaactcacggttaatacttacaaacttgttttgaggcacaaatgtgatgaggcatgaggaaataattataatggggtaaacaaatgcagcatttttaaagccgtagtgacttaataaatcctatgtttatcacagaaataaaatttactatcatttaagtgcctatgatatgctagccactgttagactcttttcatatgtattctctaatcatgacaataactatggatgtgaaaaaaggcttagagaagtccagtaacatgcccaaagttacacagctataagtgacagaactgcaatttagatctaggtctgtgtgattccaaggtttacagttgatccttgaaccacttggaggttaggagtgctgagcccctcctcctcacacatttgaaaatgtgagtattactttgactcctcaaaagcttaactactaatagcttactgttaaccagaagccttaccaataacataagcagtagattaacacatattttgtataagtattataataccatattcttacaataaagtaagctagagaaaagaaaatgttattgaaaattataaggaagagaacatatatttactagtaagtggaagtgggtcatcataaaggtcttcatccttgccaccttcatgttgagtaggataaggaggaagggttggtcttgctatctcaggggtggcaaggtgggagaaactctgagtgtaagtggaccatgcatttaaatttgtgttgttcaagggtcagttgtattttgtttccactgctattttgtattcactgttgcttgttagtattattagatcagtagcaaagcctatgatgagaactctttaacaacaaatttaaacatttatttccctgaaaacctcttctttattttcagagtgtcttttcttttttgctactagagtaaaagaagtggaagagatgtgtaagcgcagccttgagtctgtgtattcgctctatcccacacttagcaggttgcaggccattggagagctggaaagcattggggagcttttctcaaggtatgtaattcgtatgactttgttatcctaaagtgcagcttttctgttaccaatagtgactttaaaaaataaaaactataggccgggcacggtggctcatgcctgtaatcctagcactttagaaggctgaagtgggtggatcacttgaggtcaggagttcaagaccagcctggccaacatggtgaaaccctatctctactaaaaatacaaaaattagccaggtatggtggtgggcgcctgtaatctcagctattcaggaggctgaggcaggaaaattgcttgaacccagcacaacaggcagaggttgtggtgagccgagattgcgccatggattccagcctgggcaacagagcgagactctgtctcaaaaaaaaaaaaaactatgtagagaccaaatgtgtgtgtttctttccttttatcaagatataagttgattagccctagtgaattgtgcttttattaaacattttccaaaatagtcattgtaaaaatttaagttttaaaaattcagcttaagtgtgcttttctctttataactttttccctggcctaccaagataaaattgtttcctcatgtttttgcatagcatgataacactccattcagttttagcactacattgtattactgtcattttatctctgccttgctaaactagaagctcccttaaaagtgggaaccattctattgtttattgttgtatacctagtgtttttgttttgttttcttttttttctttttatgtttttttgagaccaagtctcgctctgttgcccaggctggagtgtcatggtataatctcagctcactgcagtctccacctcccaggttcaagcgattctcctgcctcagcctcccgagtagctgggattataggtgccccgacaatgcctggctaatttttctacttttaatagagacggggtttcgccttgttggtcagcctggcctcgaactcctgacctcaggtgatccacccgcttcagcctcccaaagtgctgggattgcaggcgttagccaccatgcccggcccccaatgttttctcttctggtgactgataattatgtttagtaaacattcagtggatagtggatgtcagttaatttgtaaaaggtgttcagaaggaattgcttcttataatggtgagagggaaatgatccagggattttggaagatgaaatagtatagttactcaggatgctgtagatctaaattctttccttttatcaagatataagttgattagccctagagaattgtgcttttattaaacattttccaaaatagtcactgtaaaaattcaagtttaaaaaattcagcttaaaagtgcttttctctttataactttttccctggcccacccagataaaattgtttcctcatgtttttgcacagcatgttacactccattcggttttagcactgcattgcattactgtcattttatctctgccttgctactagataaaagaagtggaagagttgtgtaagggcagccttgagtctggcaggatgacaaagtaaagtgttttgggtcctcagtttcctcatttctaaagtcagggatttgtattcgatggtctctaaagccccttttagccctgctattttgaattactattattattatacgagggaagaaagaggatataaatgactaaggtcactctacctttatgcaaaaataaaatttggaatatgttttggaagtagaaaagagaaggaaattttagagtcagaagaaaataataatagttttttcaaaatgacatagcagaagacatacatattaatgtggcttaggaggaaaataaaggaacaaaagtcttttctgctttcattcataagtacattggcagtacttactgccagaaatcaagaaatttttcctctgaatgaaagattatcctgctgaaaagagtacagaattctttaagaaacagtgaatagaatggtagtaaccagaggcagggaagggtgttgtggagggagaggatgaagaggggctggttaatgagtgaaaaaacacaggtaaatagaagaaataagatctagtgtttgatagcacaatagggcaactgtagttaacagtaatttactgtatatttttaaatagctacaaaagaagatttggaatgtttccaacacaaatgataaatgtttgagatcatggatatctcaattacccaaatttgatcattacacattgtatgcttgtatcaaaatatcacacgtacctcataaatatgtacaactattatgtatccataaaaattaaaaataaattttaaaaagaaacacctaaagaataatctggctgtttctttggtagagaaataggaagaagagaagcagagggaaggttggatgaactggtgcacaaatgcttatgctctcagattacattccattcatatacatcaaccaaaacattaaataataacaaactaaatgcagaagcagagataagaattcatctcgttctgttaatccagacattaaagagatttgcaaaaatgcaaaacagtgccatgctcactaagttttgttttgttttgggaagtatacagttgaaattctttatctacaggtttccatctatggattcaaccaaccgcagatcaaaaatatttgaaaaaaaaattttaaagaatagggtataacacttatttacatagcatttacattatagtaggtataatatgtaattagagatttatgtataacctgtgcacattctcctattacacgtaatctagaggttatgtgtaatactttttggaaatgtttaataaaagcacaatctagaggttacgtgtaataggaaaatgccctgccattttaaataagggactttgaacatcagcattatcaaggtgtcttggaaccaattttctgcagatacagagaaactactgtagttatttttcctaaaaattgttatttatgatatatagtagatttattatttttgaataaattaatacattttagatttttctcagtctttctaatatgatatcatatctaatatcagtagatatggtccaacgatcgaaagttctttggggtcttcaataatttgtttgattgtaaaggagttccgcaaaaagtttgagacctgctgtggtagggtcatttagagaggaattgaagttttggttcctagcatttttgttactgttccttccctatcaagcaactaaaagagctttcatttcttagtcatcactttgtcatcttactctccctgcttcctctttcttatttctttcaataaatgtccctgaaggattgggtagtatttcatagttcagttatttgggaaggatactattcatataaactaattgtgcaatatgccttttctgttcctttaataatgttggtaaatgaaacctttgccagatgccagcttttccttcactggattgtgatttttttgacagctataattatgcatcaagtcatccccagtagggggtccctcatttccttgctgacatgtcctcattactacaggcagtattgaagcaggactaaagatggaggcattctttatgataggtctgatgaatatgttcttgtttcagaagagtatttagaagggctgctttttgtaatgtcagagtattaaaaattttttttgatgtttgtcatctgtgacctctctgctaataactcttaagagctctgaccgcatagcattttgtagttttctaaattttgatccatatgtaggattatttacaagttctagtcttgtcactacaaaagttcctttgtattattataatattatatcgtaagttccagaacttacatagtttttttttttttttttttcatttctcttgcttacatgaactctatgtcgtggcattcagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcaggtaaatacaatttaaaactatgtcatcttacctcttgactttccttttattatttaaaaaacagaaagcctgagggaaaaagaaatgtcattaagagatagagatctctattaatatatagtaaaaataattgtttaagagttcccattttggaattagatctgacttttaagccttgggcaagggtacttaatcttttctcaacctcaatttcctggttataaaatgagaagatacgtaacttactatattgataacaattcagtgattttatatactgtgtgtatgtacacacagatacacatacatacatatagagagagacagacagacagacagataggcagacgtggggtggggagatgtcatgcagacagagaggtccttaagatagtccctgacaagtagttaagtcctcaatgaatggtagttgctgctttcattattattattattcatggtagtagtatcagtagtaaaagtatttattcccatatgtcattttcatttcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcggtttgttttttttattggctggattagtgttttactgttatttaaaaaaacacaaatgtactttaaaatatttttaataacaattttattagagccttgaaattagtaatttattaacaagatattgtaaaactagtcttgaaaattaatttgtaaatgaagtttagaaactttttcctatatatcacaattctatcagtccatcatgtggtcgattcatttaatatatcccagtattaagcctttaacttcctatagaattcaagaaaggtatgtgggaaatgaatgaaatagctactctaaatttgaaatgacaagtgaaaaaagggaagaggaaatgaatgagagaactaaattagaaaataaaagcaagttgggacaattaggttgtcaatccaaatgctttgaaaatatcacatctaatattttatctaacattacctgttggtttttgcaaacttatgttgctacttcagctgtaaacccagcatacacactggataaagtagaggcattggtgtccccaaggtttgtctacagtggtgtcccacagacatgtacctgcttagtgaatatcagctcactgtgctttattatttatttatttatttattttttgagacggagtcttgctctgtcacccaggctggagtgcagtggtacgacatcggctcaccgcaacctccacctccctggttcaagcaattcccctgcctcagcctcccttgtagctgggattacaggcacatgccaccatgcccagctaatttttttgtatttttagtagagatggggtttcaccatgttggcaagactggtctcgaactcctgagctcaggcaatctacccgccttgtcctctgaaagtgctgggattacaggcgtgagccaccacgcccggcctttactgtactttttgatgttgggcactcattgtatagcatcttctgttattagagaaatcattataccaaagcactgagtgccaatatgatatgtgtaaatattgcttaatagtattggccctgaagtatgtgctgtctggagttacccaacttccttgtacctcagttttctaatctgcaaattggggtaataatagtacttatttaataggattcttgtgagaattaaatgagttaatatatataaagcctttacaaagtgtctgacatatataagtactcaataaatgtgacttgctccaataatggcaataataataataaacagaggatgatcatttcctacatgggattattaaaatagttgtatggcaaaagcagatgaggaaaaactttttttttcccacccaccaaggaaaaacatttttaacctgcttttttccccgtacatgaagggcagttgggtacagtcatggtaatgcattatattttaagattttgcctttcttatacagaacaatcccagcctaaaacttacatacacagaatgtctgagggtttgtggcaactggttagcagaaacgtgcttagaaaatcctgcggtcatcatgcagacctatctagaaaaggtaagatttttggagcaacccttaagatagttacttagcatgaatatgcttcatcttttcatcaagatcaatatatttccaaagcaaataaaagtatggttttatttttctatatattattactgttgtagctctgtatagtctctagggtggagtgaaacattgttacaaaacaaagcagccaattttgaaagtaagcccaagtatagtatctcttcttcctccttcctacctccactaccagctaccctttcagcaggttgcttctgatcatttcttcatttatgcatctacaaaaataactgattaagaataggcaagtcagcccttgctcttcattagcccagccacccacaagtaaaggcttcaatatactagcccctttgactttcctgtttctccctcttattcctttagattcactaattttggaaatagttacctcactaaataagtgtaacatgaaacacatgatgcgattgtctttcttttcttttcttttctttgagatgaagtctctctctgtcgcccaagctggagtgcagtggcgcaatctcggctcactgcaacctctgcctcctgggttcaagcgattctcctgcctcagcttcccaagtagctgggactacaggagtgtgccaccacacccggctaatattttttatttttagtagagacggtttcgccacattggccagtctggtctcgaactcctgacctcaagtgatccacctgcctcggcctcccaaagtgctggcattacaggcttgagccaccacacccagcctgattgtctttaaattttataaagttctctgtttttgcagagttctttacaagtattagctgtctgggttatttctacactgtcaaagttgttttgaaaagtcaagaaaataccatagttcagggctgtccaatcttttggcttccctgggccacattgcaagaagaattgccttgggccacacataaaatatactaacattaatgatagctaatgagcttaaaaaaaatcacaaaagaaatctcataatgttttaagaaaatgtacgaatttgtgttgggccacattcaaagccgtcctgggccacatgcggcccatgggccgtgggttggacaagtttgcaatagttcatataatttagctagcttttatatgtatataagttaaattttagtgtattaccttaatttgagtgattctttagatgtatttagtatttgtaaatataatttaaattggttgtgttttcttgaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacaggtaactaggtttctacaagtgacaattttatgttcaccagttaactgagtgagtgtttttgcatagaaagagtgacttggtctttttatctgatatagttttgagctctaaaggtcggcttaactatatatagattatcttggtcttttgggttcttttcggtttttgttttttgtttttttttttgagacaaggtctcactctgtcacccaggctggagtacagtggcgtgatcactgtactccagctcactgcaacctcgacctcctggactcaattgattctccccctgagcccccgaaatagctggggctacaggtgcacgccatacctggctaatttttgtattttttgtagagatggggttttgccatgttgcccaggttggtctcaaactcatgggctcaaacgatctgcccaccttggccgcccaaagtgctgggattacaggtgtgaggcactgtgccctgtctgtcttggtcctactgtagttaatcacaaattagtatgtaagatattgacgtgttcttttgtgaataattcatgctctgcttctaagttcattgtggagaatatagatattagctttctgttttgcttttttggtttgtttgttggtatcatagtggaaaaggagatagatattgaaattaattacaaaagttacctattttgatgtaattaaatccctttatttaagcctgtcttgaatctgtatattttagtgtaagcagaggtgtaagttagctaaatagcttggggagagtcccctttgtcctttgatgcttaggaaggtgtgtgaattgcacagttaagacaaaagtaagtttattccctttataatccttagaagtttgcttttttccctgggataaaaacccaacttttttcattaaatgttgtatatcatgtgtgattttgtagttctgttaaagttcatggcttttgtgttttaccttaattattctatgcaagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaaggcaagtgttactcagcccaatattctaccctgtgcttgaaaaacttagacataagccccttgatgtcaggaatcgtgtatacctctttgtattcctagcacttggtccagtgctctacacataagtagcattttgtagttttctaaactttgatccatatttaggattatttacaagttctagtcttgtttctacaaaagttcctttgtattatataagctgacaagctgtaaatgatgcaagtttgtgtggaggtgatagaatttagcttggtcctatgtctttgcagttaccataggagagggtctagaatggggcattagattggaggatttagaaagcagttaaagatgatgtgatcacaggtgggttttccccctgctgcagaaatatgggatttttacaataaattacttttgtaagtagagaaaatatatttttcagaaaatgtcaagacagcagtattgtataagtttttctttgaaaaccttagattatagtgatgacacctaatattaaatttaagttgacaagctatatattgttagtcaatttgaaggttagagataaaatgtttctcctgcaggaaaataataagactcataatagatacagtcaatctctgctgtagtatacactaaatattacttttggcctatggggaaaagcaattacttcattttattgtacactgacttctcaggaatcaagatcacagtcacactcagatcacatttgtcttccttagattttttggaatataaacagtaccaagtattctagttctgaatccagtttaatttaggaccaaatattttgatttaccaatgcattaatctagagtacccattagaaagaccttcagataagaaaagaaatgaaggaaaacaatatagttagtgaagttttgttaaccacttgtgctaatagaggagcactgtcttaaaataacttacttgcttagatgtgagaatatttgaaataccttgtttcttaattttgtgtcttttttttaatggtagagagacggaatgaagattccaacatataaatttttgcctcttatgtaccaattggctgctagaatggggaccaagatgatgggaggcctaggatttcatgaagtcctcaataatgtaagtaaacctgaaaatcaaaccacaataattatttttattctattattactatatattatataaagtatatataccattccctctaagaaatggaaatacaaaattttgtattttttgtcttctcacatcacataagttactcattttctctctctaattcctcataggcctctgcctttttctcacacatgcaggcatacacgctctacccactgcagtatctagacagtaatacacattttaatgttaagcaaaatgaaaaatatggattatatttttttgtttatttgcataaatctaatagttcttttcttacagctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggtatttggattaaacatacgtaccttttagaagtgtgatattcagtctttcctagaatatttctttttaaaatcttgtgttattaagatgccatctaaaatcggttcaaggctggcacggtggctcacgcctgtaatcccagcactttgggaggctgaggcgggtggattacttgaggtcagaagttcgagaccatcctggctgaccgacacagcaaaaccctgtctctactaaaaatgcaaaaaacagctgggcatggtggtgggcacctgtagtcccagctactcgggaggctgaggcaggagaatcacttgaactcgggaggcggaggttgcagtgagccaaggttgcgccattgcactccagcctgggcaacaagagcgaaactctgtctcaaattaattaattaattaattaattaaaattggttcaaaattccttaatatttgtcaaagcataggagataccagtagtagtttacttttttcctcaaagcagttggcaaagtgaaacaatagattttgaaaggcacctaagtcattgacgagagtatgtatctttgatgtatttcatttatgactgttttgtttgtatctgaggaattataatcattccattgtctagatttgtgcataaattctgtttttctctttgtttttctaactctgagaagtttaaatgttgggtagttccttatgtaatgttttttgttttttattaataggatcgaacagaggctgcaaatagaataatatgtactatcagaagtaggagacctcagatggtcagaagtgttgaggcactttgtgatgcttatattatattagcaaacttagatgccactcagtggaagactcagagaagtatgttttttttaaagaagaaacgttactttcttgctgtgttactctctgtagagatatattagttatagagcctaataagtaaatctgcttaaaatcacaaacgtaatccaaaagcttaatttatatctgatggcttcagcattccctggttactttttcacttaatatctcttaatagaactggtaataggtgactacactaaattaattatttgatttcttctgataatcttctggcatacatacttattacagagaattgcataatagaggcaagtctattaaaataattgaataactgaacatttctagcctcaaaagtttttttaaacgatgtggttactaaaactgccctgggacttaaaaacaaaaaaaggctttaccatttcttccataggtgctaaaatgccattatttaattattattcttgctgtgtcagttcaaataattacaagctgctatataatctttggttttgtgactagtctctaagtatgcttctaagtatctccccatactttaataattgtatttttttctattcagaatcatatcttcaagtttaaattcttattacttgaaaacgaatgggacttcacatattgtttctctaagcaaacaaaaagtattgacatgtcttttagttgcatttaatggtaatgtgacaggagtatgttatctatgtactatgcaaactattacgtaattattttaagatgtttagtctggttcctcaggtggaatctggtctagttacccttgtcaggtaacctgcaaatttacttgaagctacattaaccactgttgagctttgactctgagctgcatagtggccaaagcccagagtcttcatttctcaatcagagcctgaaccacagattagcaacaagttggggccagtggtatctgctgactattcctgcttgaccttcaatgctgttcctcagtttgtcactaaaatctcttcatttttaaatacagaaggcataaatattccagcagaccagccaattactaaacttaagaatttagaagatgttgttgtccctactatggaaattaaggtaatttgcaattaactcttgattttttttaaactaaattttttttattagattgaaccatttgaaatagtatttttatgtaggtcaaaattggttaaatattggcaaatttcatatgtttcaacctataatttctcagtattatatttcctttgcccaagccctaaaatactcaaaagcttctcctgctttcttttccattgccttctgttctacacctcccatctttcttatgaaggtctatagactgttactttcattggccagaaggagagtttccgtgtgcttatgccaagattaatttttgacttggcaaggaaggttccaattgtcatatattgtttttaaaaattctatgtgcagtaaaatgtattggctgtgatatatcacagtattaagtaatatagtatgtattattataatattaagctgacttcatatgcatgatacacttagctctgttctaatattcttttattgcaagaaataatggaagtaatttcatgtgggcagggatatatgtaataagggttataagtttagaaaatgatcatcttaaatacattgtctttcttttcattttgcagtttagtgcttagtatctagttacttgatttgaaatgtagctgtatcatgtggattaactgctgtttttctagctatatcagctaggtgatttcgctgaatgtttccttaaaatgccagatttagcagttataacccagaaaactccttctactgttttccaaaatttactttatgttttcgtgaggagttatttctcagatgactttacatatattagtgaatctttgatgaaacagtagttaaagttacgagcgtgagccaccacacccggcctaaagttgtagttcttaaccactatcacatcgtcatttgtttctctgtttaatattaaaattgccatttataatgtatttttctttaagtgcaaatagtgtatctgacctattatcaatcatgtttatacttttattaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaaggtgagccttcccttctctggcttagcccttagagttttagtgatgaaaatttttagttcatattttctttctgctttatttgggattttgtctttattttgaatacttacaaatgaggaagatttgtagagtagaaatgcattattttctagaaccaggcttttctccattttttttgtgtctctgaaagacaatcattattatatggttgattcaagtaaaagaataccattaacatgtacagacatgtacagtgaggttgcttcttatgaaaaaaaatactttggtgtctgtctcttatttccttgaatagtgcaagttgacgtcctttgcatcagtataccgggtctcgtactgtgccaagtgctatttaatgtaccaaaaagggagagcattcttcccttaccatttgctgacgagctctttgggtcctactggggagtggtggaaagacacagtgctgttttactcaggtgtttgcagtatgccttcctaggggggacttccagttaatctaattacagaagtagcgaggggaaactttctaaatcagtgtaaatgttgtagcttattctaaatgaaagaatggcagtaggtatttaattatttgggagactgtcaagaggtgcacagatgctcagattggtttgagtgccctttgctattctcagatgactctgtgtttttataataaaataaactgtacttgtttattcatgcttaattattctgaagggccgtgatgacctgagacaagatgctgtcatgcaacaggtcttccagatgtgtaatacattactgcagagaaacacggaaactaggaagaggaaattaactatctgtacttataaggtaactatttgtacttctgttagttcaccaaaaacatataaaagatgccatttggttgggtgaagtggctcatgcccatattcataatgctttgggaggccaaggtgggaggattgcttgaggccaggagttcgagaccagcctcagcaacatagtgagaccccatcttgacaaaaagttaaaaaaaaaaaaaaagccagagatgatggcatgtgcttgtagtcccttagctacatgggaggctgaggtgggaggatcacttgagtccaggagtttgaggctgcagtgagctcaaactctgcagtgagccccagtccagcctgagcaacacagcaagatcccgtttaaaaaagaagaagaagaagaagatgccattatttggaccaggagtctacaaatgttttctgtgaaggaccaaataataaagatttattttctttgtaaaaagtatttattaatgttaattatagttaggtgtttcttatagtcaactgaagtattttttccttttttttctactcaacaatatgtcacagaaatctttctcattttttaacagctgcattgtgtgtatgtatgtagttttttatacaagtccttatcgatgggcatttgtgttgttttcagtcttttgctgctacaaacaacgctgtattgtagtgaataaccttgaacatacaaatttcatacatgcgcaggcaaatttgtagcatggatttccaaaagttggattgctgggttagaggatacatgcatctgtaatctggtacatattgccaaattactctcaatgggagtgtacccacttacatttcctctagctatttgcctgagaagacaatcctcagtcacattctatgagctgatcatctttgactcttatattaattattcatttaaccagtttagaaataacaataaatccttattttgaagggcctattttccataggtttgtcttttgtgatttcattcctgtacctcatttttaaactttctccttctataaatgttgtaacagggactatgggtgacatgtgcttttttatatatttctagttttccactatgaacgtgttttatttttaaaataatggctaaattaaaagccctaaataggggagtgaagaagaataaattagatctaccctccaaaatgctgcttgagttaggctattgtaataaaaagcagaacttggttttgagcttcttaactgctttcagagactaaatataaaacttattggttgggagaggggcatactgttcattaaggaaagcacaattttttccgtagccttcaagtttgtgagaaatttgtgacatggaaccttctgcaataataactaacataatagatgttttccattagcagtttaaaaagctaattaatcctcgatgaatgcaaaaagcaaaagttgctctataaaggctactctgtagagggatttctttgatgtggttaagatcattggtactcaagctttagcagacatcatagtcacttagagagtttgttaaaaacacagatttctgatccccattcttagaatttctaattcagcaagattagggtagaacctgtgaatgtgcgtttctagcaagataccagttatgttgatgctgcactggtccagggacaacactttgagacccaccagtctacttgttctaccatctattgacctgacttcattttagaacaaagttgatgatctattagctatctcctatctgacagataatgtagagattgctaagaagtttttagagactagatattctgtaatgtgaatgaaaggaaattgtttatgctctaaataccaaacttttagatgacaaagataataggtgaagaattgggttacaaaagtatgggctataggagcacctcctgaactctcagaaagtagctaagatttccaagcagatacacaattgaacctccaaagttcattgctgtaaagcacaaaaaagcaaatgcctgacctagaatatcttgaaagcagaaattactgaactttcatctctaccttatgactttttcaacagctagttttcacacaaaactattttaccatataagttattccattaagatttctagccgggcatggtggcccacgcctgtaatcccagtacttcaggaggccgaggtgggcggatcacttgaggccaggagtttgagaccagcctggccaacatggccaaaccccatctctactaaaaatacaaaaaaattagccaggcgtggtggcacatgcctctagtctcagctacttgggaggctgaggtgagagaatcacttaaacccggatggcagaggttgcagttgagccgagatcacaccactgcactccagcctgggtgacagaccgagacttcttctcaaaaaaggaaaaatgtctagaggccagatgcagtggctcatgcctgtaatctcagcactttgagaggccaaggcaggaggatcacttgaggccaggagtttgaaaccaacctgggcaacacagcaagacctcatctctacaaaaaattaaaaatttagccaggcatgatggcatgcacctatagtcccagctactcaagaagctaaagcgtgaggattgcttgaaatcaggagtttggggctgtgcatgagctgtgatcatgccactgcagtccagtctggacaacagagcaagaacttgtcttaaaaaaaaaaaagtggggttggggggtaacccagataattaattatttaatgttatacatctcaatattaaagtaaaacctgtaaacacaacagtttaggtttgactatttcttagaattacgacaataagccagtaatgttattttgagattactccaagaatgtgaaagttgtgtcatcattatgttaaactaagtgttcttgcctttagttaaggttccctagactacagcgaagtagtctacccagtccagtcatctgtagagtcattcccaatcctgagattcaggtcttctgtggtcattgtgtcaacaagagcatacattgactacctggaactagatcttggtatacaaaccttgtgtcattgtgcaacctcaaaaggagagacttgtatattgaggcatgccagatatctcttgtcagagagaatcagatggaaatgaagacagttcttattgtgtatgttgatagctcagacatagcccttaacattaaccagaattagggtggctggccccatttttctccaccaaaactatgcattgttacaaagtatactgaacaagtctaaaatcttaggtgtcagaggatttgttttctaaaaggcaagtctctaataaacaatatttaagtgctgaaaggagctttgcacttaacctgatcatcctgccttgtgccaataaataatttttattccttgtcatgcatatttcagagcatctatctcagtcatggttctggggagagaagccataatatcttaagacattcactgaatataatgaattaacttcatttctgtgtatctaggatgatatcagctgtgtactttcagagaactgagaaaatagtcatcagtccttttttgtggtattcacacaaaatacccagatacccagttgaaatcttccagagagtctttagtaccagagaaaacactgtcatttgctttttgaaattcaaattcagctctttctccaacaaccaacatcacagttgagactctaagctgaggtagaaaaaagccaacccattcctttctgtatcaatctctcaacaaaaaataagggtttgattccccctccccgccccagagctagatattgatagagagtaatcaatgtaaaagagactttagacagagtacactacactgcaagaatgttaatgtgatcaagcatcaggggtcacagctaactcaaagacagcaggggagagggcatgtagaatacttattaggcaggaagggaaatcagaaaggccatgagatcattcatttgtttattcaataaatgtgaatttatatacctacgttgggttagatactctactgagtgctaggtctatagaagtagtaaaacattgccctagtccttaaggtgttcacattctaatagggaaaataaacataataaacataattataatgcaaagtgtattgttagagatggtaccaccttcacttggttgctcagactgaaacctagaggctttattttctttttacttttattattatggaaaatttcaaacatacaaaaggagacaataacatcatgaacccccttgtacttgtcactcagtttcagcagttaccaactcatggacaattttgttccatttctctttccaccaacttccttccaatattattttaaagcaagatgtcatatcatttcatctgtaaacatttcagtgtgtagatctgtaagataatgtctgttttaaaaaaccattctcacaatactgtcatcactcctaaaacaattcacaaaaattcctaaatgtcaccaagtaatgggagtcattttaaactcttgtttctctcttctcaagtcttgtctattccatcagcaagtcctattggtcaacttccaggcaggtcactttaccacccctgctattaccaccctacttctgcagtcacatctctgtagatactagagtttaaaccaacagtttacttctgctcttggttttccaaagctagttttattaataactgttagagtgatccttttaaaattgtctaagacagagtactcttattcggtatctgtgggggattgtttccagagccccctgtggatactaaaatcaagtcccttatatacagtggtgtatgaagcatttgcctataacctatgaacctcctcccatgtactgtaaatcatctctgggttacttaaaataccttatatagtgtaaatgctgtgtaaatagttgtactgtattggtttttaaaatttttattttttattgtattgtttttattgaggtttttttggtgaatatttttgatccacagttggttgaatctgcagctgcagagggccagctgtattccattttcctgttcagaaccccacatgagttcacattatccctgaatgacaattctctaagttaagtgatctgcctctgctgttctccctccagccttatctaccactctcctcacactcctctcactttctgcttgtatagatgagtcatctccacctgacttacctggtcttttgcaattgcttagacacaccaatttgtttctgcctcagggcttttctgcttctgcctgcaatgcttttccctcagatcttcacaccagtcactcccttacttcattcaggcttctgctgcagtgttaccctcagaaaggcctccgaccatgttgccattacccactttctctcttttttaaacttaagttttgttctcttatacttattatctaatattatgaaatgtttattaggatatatgttcctcaccagaatgaaactttatgagggcatagtcttcatctgcctttttcccactctgttctcagtgccctagccctgtgtgtaacatgtaatacgcccccaacaaataaatgttaataaattaatcaaatgcttccttaagacacaaaacagttcaacatatgtgagaaacttaaaatttaaaaatgtatagaactaaagacaccataaggacgagtgaccagctgagaaaacgaatataataatgttaattagaacaaaaaggatcattttaatataaagaacaagggatttatatgaagaatacaatgatattcaacttttctagtaatctggaaaatacaaattaaaaccacagtgaaatactattaccctcagattagcaaaatataaaaagcctgacaatattaagtattgcgaaagttatggaataactctactggtgggtatataaatcggtacagtcactttgaatagttatttggcaatatctggttaaccgaggtgaagatgtatctctggctcagctgttaaattcctgggtatataccctagagcagacttgtccaacccacagcctgcaggccacatgcagcctacaggatggctttgagtgcagcccaacacaaatttgtaaactttcttaacattatgagattttttttgcagtttttttttcttttttagctcatcagcaatcattagtgttagtgtattttatgtgtggcccaaggcaattcttccagtgtggcccagggaatccaaaagattggacacccctgcctagagaaactgaaatatgttcacgagtagtttatttcattgcagcagtatttcatggaaatgtggaaacaatgtaaatgttaatatgcagattggataactgttgtatttatgtagtatatagctgttaaaatgaatgatgtagagttaaatatgctcacatagttaggataaaatagtattgaataaaaaaccaaattacagaaatatacatatagtatcctaatttttttacttaatacttacaactatttgtgtacatatagctttgaaataaaaatataccaaaaaatacaagaacatgataaaccagctaacagtcatcttgatggtgggagggacttagggtcagtgaagcacacaagggggagcttcatctcttccccagcaaatgtgagaaaatcctagatttgataaagctgtttaatggataaaagggtatctgttaatatcattttctatactttatgtatgtttataatataattttaaaaaactttcctagtaaagttgcttattttatatttaggagtacattttctctctgtgaagataataagactaaagcaagagtacatgtaatttcaataatgaagttacactaaaattgagaccacattcatgggtaataatttccaagtgaaactccccaaatttaattgatactaaaattttaaggaaagcagttaattcctctcctaactggacaaactaagtatggattaatgacagatgacggtgagtatagttaacaggagtgacctctcagagaatcgtggggattgagtgatgggcaggctctcaaacatctaggcagcaggctggaaaattatattctttgagcttaagtttatttccgattggtttcctccaaggagctttgtcttctatggacagagaaatattaatacaacttgaaaaaaaatgctttgcactgactctgatagctgaatgatcatcaaatgctctttaatggccttttaaaattaaaaggtatttaatctgtaactccaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggtgagtgacacccaaaattaaaggttattgtaagattatttaatggcttattaaagctgacagctgtcagatattatagaatacaaaaaaactttaatttcatcaggtaattgtcaaagatactaagtaaaagaaaaactcatcagaatgaaagtgtgtgagtgaaaaaggaaggattttaaactacataatatgtcaacccttgtcagataagaaatgtaaaggttattcaatgtgtgctgatttgttttcaatttgggataaactaattcttagcaaacaaaacactaaaatgccaggcacgatggcatgcacctgtaatcccagctacttgagaggctgagtctgggggatcccttgaacccaggattttgaggccagcctgggcaacagagcaagaccccatctctaaaaaacaaacacagtaaacaacaacaacaacaagattatgaagtaattttttatgaaactgatatagaaaaccttctgagacatttacaatgtcacattggccatctagtctgatattcattcgctgaatcagcaacatttattgtatgttttctgtctaccaggtactgtgctgacttaagacttcacaaatatcaaatattacgactaatcatcataatccttatcctcattttaaaatgagaagttcagagaacttgcccaaggccagtgagctaataaacagagcaaggatttgagccttgtctaaatccaaaatccatttattgttcattttattgtgctttctgtgacatgttttttaaaatgtgtgataagtgctataggtgttgtgatggaagtctgtacagggcacacagggtacagtgtaggtatggaggaggaagtgcttagttctgcctggggtggggagaatagacagaagtagatccaagaaatgcttcacagaggaaaaggtgtgtgagccgagttttgtaaatgagttgtttttccaggcagaaggagcatataagcaaaggagaggagacatgagcaggaaaagacaacataagcataggcttagtgtttgaggaagaaaagatgagattggagcagtaattgttggtcaaaagatggagtgttgctttatgaaatgcaaaggagtttgcaccttatgctataggcctcataagaccctaaaggatagtaatatcagacttgcattttagaaagaaattccgacggcactgtgggttctatttttgagaatgcaaactggaggcatgagatggtctgaactgagatgaacagcagtaggaagggagaatcgtgggtagagatgagaaatatgaaggaggcagaattcataggatttgattgctgattaaaaataaggttggggggcgggtgtggtagcgcatgcctgtaatcccagcacttaaggataccaaggcaggaggattgcttgagcccaggagtttaagaccagcctgggaaacatagtgagaccacatctctacaaaaaataaaaagtcagccaggtaatggtggcacatgcctgtaatcccagctactcaagaggctgaggtgagaggattgcttgagcccaggggccaaaattgcagtgagctgtgatcacacccctgcactccagtccaggtgacagagaccctgtcaccctgtctccaaaaaaaaaaaatgttggagaaaaggagtagccagtgcctcccagttttctgtttggggcagctgggtagatggtgaagctctttactgcattgaagaatagaagaggtgactaaagtttgccagagatgaagtatttgaatttggaagtgatccaagtgaagatgctgaatgggcagcttgagaagcacattaagctaaagcttaataaagatatctgggccaaacagatttagaaatcatcagcacatagatggaagggagttgaagtcggtaagctttgcttcaggtagtattttatggcaagaagatgttggaggatagagatctgagtcatatcagctgccatctatgagggattcttctgttctttctcttttcctgttttctattgcaacccaatgctgtgatgccacctgaggttatctggaactacttaggcatttctgtgtttatttctgcttaagagtacaggattattcaaattagaatttaatcaaaacaagtaacagtcactgtaggtgtgcttcctcccccaacaattaatatggaaatcctaaagggattatcacttgtaattaattgcttccctgtccagactgttagcttcttgtaggtaatgtatcctgttcatctttattgcccctatatctgtcatatttttatataaaaatgtgtatattagtttaattgaacacaatattgaaaaataattatatatattctctatttaaaggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattggtaatcttcttgtacatatagtagattgagcactttgttgtttggcaggttttatttttgtttgattcagcactttttctacattctgagttgcagggggatgatagtgatgatgtggttagtaaccaacccatcttcattattaaatcatatgtttcttgttcatcctgattcttagtgtctacctttttataacttatgcagaagagaattctcctacttcaataaataataaaaagacagggttttcttctttgttttatagtgaatatggcatattttctctcctctcaatatattattttctgagactttctttggaaaataatgaaacctgtgataacttatttcctttaattatttttgttcttttgcatataacctctaaatatcatcacctagtgattaatactttttaatagaattttgttttcagaatagaaaccatgagatatatttaaatattttgtgtacaatatatattttgactttttttccctaagaaattagaataggtagatagtatggttaacaaaatcctagagtatgagaactaatgtaaacattagagatcatctaatctatttgttgttttttttttttttaactaaagacaactccctccatcacttacatactataccccaggaaggcagggcatgtatgttttgaaagagttcccaggtaattgtgaaactctcttctacatagagaatcactaatctgatacaactagtttataaacaagaaagtaggcctagttaatgacagagcaagccagacacccagtcattctgattccctacccagtgtgtttttttgtaatgccatgtgatttctcccattagtgcatgtcatcatctgtcttaaatacagaaatgcagttttttggggggatacacacctggtgaaatgaattaatgattaatttgtgttaaatataattcatcaaggagaagaaagtttcactgaagagtgaagagtttatccatagacttctcattttataagtatgttcaataaaaatttgagtacatataatgcacagctttgacccaggtaaataatgggtctcaactttagccacaataattttttaagtactaatattttaaaatgtgtgcctattagtaaagagaaaatttttttagcaaatcatctaggatttgtaaaatgcaatatgcattaaaatagctggcaagatttgagttaaactcaacatggccggttatgcacatcatttaagtaggctaaaaatcctaaactacttaaagattataccaagtcagtggtcttaattgaaattatggctatatattagaaagagatggaatcagtgatttcagattgtttgtttcttttttctccagttggttacatacttggacttggtgatagacatgtacagaatatcttgataaatgagcagtcagcagaacttgtacatatagatctaggtaagtaataaaatctatgtatctattctttttagtaaatatttggtcatcatggaatgttgtttgcctaccaagatattacaaatataagagacagataaattgaagcagtaaatattgggtttttttgttttcagcataaacagttgtcctagaagaaacagttaactctgcctggggtactgagtgaaacttaatagatgaggtgtcttttgagcctggtcttcaagaaagaaagaaagcataattcagacagaagatagagcagattcaaaagaaggaatcagggctattccaccaaaacaaggagtaattttaagatgtagcatgttgtgggagtggtgagacattaaatgtgtctggagtgaagtaagcctgtagttgagtcgcttgagagagagattggtactagactgtaaaaagccaggctaaggagtttcaacttcattgcattaaactataggaaataaatgaaggacatgataatattttattttcagaaatataatttcaggagcactttggggagtggtattggcagcaggaagaaaaattaagggatattgtaatagtttagatgagaaatgatgaagatttatactaaagttgtagaaaccagaatattggatttgagggacatttttgtagtaaactgtaccagtgatattagatgaggaaatagtgggggagtggggcccccagataactgaagcttctaactaaggaatatatcaagttttgtaaatagtaagaaagtgatgaatttagttttgctcattattttgaagtattaatggaatttctaggtggaatagacagtttaatatataagaaagaaagaatatatagcttctatgtatatatatagacagtttaatataaaagaaagagaatatatatagctaaggaatatatcaagttttgtaaataataagaaagtgatgaatttagttttgctcattattttgaagtattaatgggatttctaggtggaatagacagtttaatatataagaaagaaagaatatgtagcttctatgtatatatatagacagtttaatatataagaaagaaagaatatatatagctaagaaatatatcaagttttgtaaataataagaaagtgatgaatttagttttgctcattattttgaagtattaatgggatttctaggtggaatagacagtttaatatataagaaagaagtgtgaatgtaatgtaaagaagtgtgaatgtaatgacaaacttctattaaacagtattaatcactaggtgataatttttagaggttatatgcaaaagaacaaaaataattaaaggaaataagttatcacaggtttcattattttccaaagaaattctcagaaaataatatattgagaggagagaaaatatgccatattcactataaaacaaagaagaaaaccctgtctttttattatttattgaagtaggagaattctcttctgcataagttataaaaaggtagatgctaagaatcaggatgaatatgaaacatatgatttaataatgaagctggtttggttactaaccacatcatcactattatccccctgcaactcagaatgtagaaaaagaagtgtgaatgtaatgacggagatccagaatcttcagcaaatagatttcagttgaagtcactgggctggaggaggttctgatctcacacatcatccgtgataaagagacctaaagatgaaatcataagggaagtgagccttggaaaggctgagccagaaaaaaactgagaagtactcaaaggaagtcaggatcttggaaggcaagaggggaaaatcttttatgaaagaagtagtgctcaatagtatctgatacagaaaggtcagagaggatgaatgctgaaaatagacctttgaatttaacaagtaatcaatcctagaggccttggaagtcccctttggatagaatggaggaaaccatactgtaaaaaggcaaggactgaatggaagttaaggatgtgtagattaagaatgtggaatctgccaggcgcggtggatcacacctgtaatcccaacactttgggaggccaaggcaggtggatcacgaggtcaggagattgagaccatcctggccaacatggtgaaaccccatctctactaaaatacaaaaaattagccgggcgaggtggtgggcacctgtagtcccagctacttgggaggctgaggcaggagaatcacttgaacccaggaagcagaggttgcagtgagctaagatcatgccactgcacttcagcctgggcggcagagcaagactgtctcaaaaaaaaagaatgtggaatcttcctacaagaagtttagaagggaagggaaggatggcagagaaatttgctgcaggaatgagagacacatttggtccttgcttttttaagataggagaggtttaaacctgttagatattgaagatacaggagaaaaacaaaagataattgaaatagcaagggaaatcataaagtacgtgagtctgatagcattggctttagattggaggcatgttagcttttctgctgagagagaaggaaaagtgatgccaataggaaagtcttaagctggagaggaaggagtatgagggaattatatttgctattgtgtttttgctgagaaatagaaagcatgctcatttgctaagaattggagggatggtaactggccttaaaagaacaaataaaattctaaaatttaccatggaaatgagaccaagacctgactagaaagggataaataaataagacatgccaagcagtttaaggggcactttcaatcctaaatttgtagtggagccaatagggttgttgtatgattttccagcagtcctcaacatccttggagcttaagttgtagtttaaaatgggagatgtggtggagggacaaggggacaaggagatttgaagcactgatgagagtaatcaaacttattgtctctacccctgggctgagttagggaaagaagagggctaataaactagaaatctcagtcaaatttgaagactgtttagtaagaataaggggtagaaggagaagaggttttgattagaatgtacaatttacaatgtctaagaagcagttttagcagactcatttctggagtacaacccatatgagtggttcattaagatagaatgaaattgaattccattagaacagagacagtcacggatattatatggttttccccagaatgaattctagagttgggacagaggggaagattgtgagctaggtccatgccaacattcagcgaatgtgagagaaaaccttacaggtttacagagtaaacgtgaagatggaagggatttgttagagctagaaggtggggatctcaacagaggagccagactttatctgagaatgaaaggagagtggtctggaagatgcaaattagaggtaggagtatgccaacctgagtccattcaggtcgtgctaaaagcatctataaatgagaagggtaaattggtacaacccctttggaatattgtttggcattatccactaaagctgactttatgtatatcctgtgacccatcaattccactccaacacaaatgcatacatatgtataaaaatgtttatagtagcattattcataatagcccctaactggaaacaatccagatatccatcataggtagaatggatgaacaaattgtcgtatatttatattctctttgtatataatgagattgaatgaataataacacacaatatagaagactctcacaaatataatgctaagtgaaagattccaacataaaagagtacacatgtataattccatttacataaaattcaaaagctgataaaattaatgtatagtgttagaaatcaggatagtggtgaccctttgaaagaggtgattagtgactggtaggagggactgaaagggggcctctggaatgctggtagagttctgttaacgtggatttgttcactttgcagaaatcccagtgagtcacacttgggtgatttgtatactattctgtgtatgtctgtttggttacctgttgctgcataacaaaccaccccaaaatttagtagcttaaaatcacaatttatttattattatctctcatagtctgttgactgggctcagctggacagttttcacttaggatctctcatgcagctgcagttagcatctggggctggagttatcttaagactcagctgggccagagttcatgattgcttcttcacttacatgtctgatgcttcagcactcccatgtggcctctctgtccacaatagtgtcctggacctactcagcatcttggggctccaaggggaaggaagtggaagttaagggctaggcctgcaacttgcacagtatcacttccatcacattatgtcatcacatagtcatgtcatagggtccatcctggttcttccctgtttctgggactccagtaaccctatgttaggcctttgcaatgtatcatttatactgttacctgctagtctatattttctaacctttttttccttttttctgactcactccttggtgtcagtggacatatccggggaacctggactttcagccctactcagctatagcaagccctttccctattgagtgtcagtggaggccaattggggaatctagtcttctgcccttacctagcagtaacaaggtggtgactcccaaaggcattaaaggcagaagtttaaggaagatcctgagtctcgtaataactaaaaggtgtaggtgtcaattgaaaatcattaggcatacctggaaccaggaaaatctcaactttaatgaaaaatggccacctgtaggtgccaacactgagatgacaatgatgttggaattatctaagattttaaagcagccatcataaaaacactgaaggaacaattacaaacatgcttgaaacaaattaaaatatagtaagtctcagcacagaaataagtagtctcagtatagaagtagatataaaggagaaccagatggaaattttagaacagaaaaatatagtaaataaaataaaaaatttcaactgcagaatgaggagacagaagaaattatcagtgaatagaagacagagccgtagaaattacccaagctgagcaacagaggaagaaaattaagaggaaaccttcagcatctagggctaaacagagttcctagacttgataccaaaagaacaatctttaagaactctcaaaacttaacaacaaaatctacttataaaatggccatgtactacaaatgtgtatagcagctttattcataatagccaagaaccggaaaaatccagatgttctacagtgggcaaatgcttaaacaaactgtgttacatccatgccctgaaatactactcagcaatgaaaagaaacagaactattgatatacataacaatttggatgaatctccagagaattaggctgagtgtaaaaagctattcccaaaaggttacatactgtatgattattccacttccatttatataacatacttgaaatgacaaaattataaaaatggagaacagattagtggctgctagaaaaatagggggtcagagggctgggtgataggctatgggagggaaataggtgcagccgtaaagggcagtatgaaggatccttatgataggaatattatatatcttgactgcatcgatgtcagtagtagtatagttttgcaggacattacagttggggtgaaatggggaaaaggcataagggatgatcttttctgtatgatttcttacaactcgaagtgaacatataattatctcataaaatgtcattaattttttttttttgatggagtttcactcttgtcgcccaggctggagtgcaatggcacgatctcagctccatgtatccttcacctcccaggttcaagtgattctcctgtctcagcctcccgagtaactgggattataggcacctgctaccacacccagctaatttttgtatttttagtggagacaaggtttcaccatgttggccaggctggtctcttaactcctgacctcaggtgtcaggcctcctcagcctcaaggtgctgggattacaggcgggagccaccacacccagcctaaaaattttttaaatataaatatatcatctccattttaaattataccagtagttacttcatttttaaaaatcaccctttaacctagatttctctagttgggttaagaagtagttaggttatttggatttgaggtggatctcacagacagtgacaaagatgaggaaggcagccagagcagaagtaaactactgtacatactagtgttcatagaacgtaggtaacatgtggtttcttgcctttgtaaagttcacattctaactggaaagaaagtaaattagctgtcaaacctcctaacttcactgtattctttactttaggtgttgcttttgaacagggcaaaatccttcctactcctgagacagttccttttagactcaccagagatattgtggatggcatgggcattacgggtgttgaaggtgtcttcagaaggtaagtgatatgaagtaaaggagggaaataatttttgatgtcaaaattacatgggctgggcatggttctttgcacctgtaatcccagctgctcaagaggctgaagtgggaggattgtttgagcccaggagtttgagtccagcctaggcaatacagcaagaccctgtatctaaaaaaatacacacacacaaacacacacacacacacacacacacacacacacacacgggttagagatttgtatagattatagaatttagtgctagaatcgtattccagtgccttatcaatactaaggaaaagaccctgggtaaaagcaataatagttcctcttccttccacccacctgggacctaagcccatgtaacatacatactgttattccaaacctcctctggaagcatcccacctttacttttaacacctctatcctggctgactccttcttaatgatccaaactactattgggtgctcatcactgtgcatatagaagagactacatttttatttataggagcttgtgttctagtataacattgtgctactaaaaaagctttgcagttccttgtagttttcccagcataggtctgtgtactcaacttggattggggcagattgcagtcagtgtaaactaataattgccacaataatcaaagactgagagctgagcccagtggtgcatgcctgtaatcaatagtgttgtgttattcttgtaaatgccaagcttgtgaaatagtcaaatacatatttgtattcatttcaaacgtctaatgaaagcccactctgccaagtattatgctattttgagatacagatatgtagattattaagcataggctcagcatactacacatgagagtatacagataaagatacgttgacaacattggtgtgtaacaaaatccgtatttataatgtgtttgactctagatgctgtgagaaaaccatggaagtgatgagaaactctcaggaaactctgttaaccattgtagaggtaaagtattttataaggaagactttattttttttcttaccaggtagactgtgtatctcatcaggaagtcactgatgtgaagagcactgcttcattttaacatagggggatgtggctgggcagcagaaaggaggagattgtgcacttagccttttcacacatccaaaaatactggtttagaaatgccttcagcccccttgagtttcttggaatgttagagcattgtaagtagtctctagttttcaattcataaatcaattctttgacatttagatattccatatggtattattattttcagaatggtttccattagggtttaagaaaaatcagaaatttatatctcctttttccctgctcaggttcagaactaattagtcagacaaatggagatcaaattgtcagcatcattactagaggaacatggcttaggaatgagggccagactagtttactgctggtgctacctcagtacctctctgctgtcttaactttgggacagctcacctgaatagggtttgggcctgcagagcaaacacatgtaatcaggatcactgccttgtcttgatccagggcagaaaaaaggaagtcaaacaaatttcagtgtctgtgctgttagtacctatgccagtcattcaccaatctggtaagggtatgtgagacaagaaatcaggagtgtggcctccccagggaagcatggcaggtagagtgcagtatgggcttgccacttttccactactcagcttttcttcctttaacctgatttatgttggactggctgcatgttagtattacttttactgcatttaaaaaacattgatgctgatcaaattcaaaccaggtttctagagatggggcaggaatatgtgcatttttaaaaatctctcctactgttcaactaggatatgagaactgtcttaattcattggcattaaccattaagcctgtggtcaataagggtggggctttatcccttggaagatgagtaacagtccatcagggtggtcctgtgtgcacctttatgaaccgaggcatctttatagatctcctttggactgcagatggtaatacagattttgctacaaggagtttgctgaaataggtcccaataatacgttggtaaaattaaatccaaggctgtgctattcccaaggttaaaaatacattcttttttcttttaccgatttcaaattctgttcatacatgttgtcatttgttacagtttgccattggttctgcagtaagaataaatgataagaaaataagcatgatgtgtaacattttaaaaaaataatacatggtaacatggatgcctcaataatgtcgaaattaaactctaaagttatattatcttgcactttttcatgtaagaaaaagagggctgggcgcggtggctcatgcctgtaatcccagcactttgagaggccgagacaggtggatcacctgaggtcaggagttcaagaccagtttggccaacatggtgaaaccccgtctctaataaaaatgcaaaaattagctgggcgtgatggcgggcacctgtaatcccagctactcaggaggctgaggcaggagaatcgcttgaacccaggaggtggaggttgtagtgagctgaaattgcaccattgccctccagcctgggcgacaagagcaagactctgtctgtcttaaaaaaaaaaaaaaaaaaaagcccaaacttttcaaattaaagagtcaaagcagcttaacatattctttagtattttactctacctagtttcagtcagaagggatttttatgctaaggtggatttgggagtttcttccagtacttgtatcctacctaacactcaccagaagaaggtagttcttttagggcctcagaaatcttactagtttaatgccaaactgcttatggacttcactttttagagtagtaggagatcaaatgagagaagtgacagtggccagatcctttgccattgtaaggactttggatttcctttgagtgagggttttgagtctgaaaagtgatttgcatctccacctacaataactgtcacctttaaacacaccctccgggaggaggagccaagatggccgaataggaacagctccggtatacagctcccagcgtgagcgatgcagaagacaggtgatttctgcatttccatctgaggtaccaggttcatctcactagggagcgccagacagtgggcgcaggtcagtgggtgcacgcactgtgcgcgaactgaagcagggcaaggcattgcctcacttgggaagcgcaagggtcagggagttccctttcctagtcaaagaaaggggtgacagacggcacctggaaaatcgggtcactcccacccgaatattgcgctttttggaccggcttaaaaaacggcgcaccacgagattatatcccgcagctggcttggagggtcctacgcccacggagtctcgctgattgctagcacagcagtctgagatcaaactgcaaggtggcagcgaggctgggggaggggcgcccgccattgcccaggcttgattaggtaaacaaagcagccgggaagctcgaactgggtggaacccaccacagctcaaggagacctgcctgcctctgtaggctccacctctgggggcagggcacagacaaacaaaaagacagcagtaacctctgcagacttaaatgtccctgtctgacagctttgaagagagtagtggttctcccagcacgcagctggagatcggacaacaggcagactgcctcctcaagtgggttcctgacccctgacccccgagcagcctaactgggaggcaccccccagcaggggcacactgacacctcacacggcagggtactccaacagacctgcagctgagggtcttgtctgttagaaggaaaactaacaaacagaaaggatatccacaccaaaaacccatctgtacatcaccatcatcaaagaccaaaagtagataaaaccacaaagatggggaaaaaacagaacagaaaaactggaaactctaaaacgcagagcacctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaataagttgacaactttgaaaaaaatttagaagaatgtataactagaataaccaatacagagaagtgcttaaaggagctgatggagctgaaaatcaaggctcgagaactatgtgaagaatgcagaagcctcaggagccgatgcgatcaactggaagaaagggtatcagcgatggaagatgaaatgaatgaaatgaagcgagaagggaagttcagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactctttgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcatcagtgaagtagaaataaaatactttacagacaagcaaatgctgagagattttgtcaccaccaggcctaccctaaaagagctcctgaaggaagcactaaacatggaaaggaacaaccggtaccagccactgcaaaatcatgccaaaatgtaaagaccatcgagactaggaagaaactgcatcaactaacgaacaaaatcaccagctaacatcataatgacaggatcaaactcccacataacaaaattaactttaaatgtatatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagaaacaaagaaggccattacataatggtaaagggatcaattcaacaagaagagctaactatcctaaatatatatgcacccaatacaggagcacccagattcataaagcaagtcctgagtgacctacaaagagacttagaatcccacacattaataatgggagactttaacaccccactgtcaacattagacagatcaacgagataaaaagtcaacaaggatacccaggaattgaactcagctctgcaccaagcggacctaatagacatctacagaactctccaccccaaatcaacagaatatacatttttttcagcaccacaccacacctattccaaaattgaccccatagttggaagtaaagctctcctcagcaaatgtaaaagaacagagattataacaaactatctctcagaccacagtgacatcaaactagaactcaggattaagaatctcactcaaaaccgctcaactacatggaaaccaaacaacctgctcctgaatgactactggatacataatgaaatgaaggcagaaataaagatgttctttgaaaccaacgagaacaaagacacaacgtaccagaatctctgggacacattcaaagcagtgtgtagagggaaatttatagcactaaatgcccacaagagaaagcaggaaagatccaaaactgacaccctaacatcacaattaaaagagctagaaaaggaagagcaaacacattcaaaagttagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccagtaacaggagctgaaattgtggcaataatcaatagtttaccaaacaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatccaaaagcttatccaccatgatccagtgggcttcatccctgggattcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccagagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccactgtctcagcccaaaatctccttaagctgataagcaacttcagcaaagtctcaggatacaaaatcaatgtacaaaaatcacaagcattcttttacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcatccccatcaagctaccaatgactttctttacagaattggaaaaaactactttaaagttcatatggaaccaaaaaagagcccgcatcggcaagtcaatcctaagccaaaagaacaaagctggaggcatcacactacctgacttcaaactatactacaaggctacagtaaccaaaacaacatggtactggtaccaaaacagagatatagatcaatggaacagaacagagcccttagaaataacgccgcatgtctacaactatctgatctttgacaaacctgagaaaaacaagcaatggggaaaggattccctatttaataaatggtgctgggaaaactggctagccatatggagaaagctgaaactggatcccttccttacacctgatacaaaaattaactcaagatggattaaagacttaaacgttagacctaataccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacccttttacactgttggtgggactgtaaactagttcaaccattgtggaagtcagtgtggcgattcctcagggatctagaattagaaataccatttgacccagccatcccattactgggtatataaccaaaggactataaatcatgctgctataaagacacatgcacacgtatgtttattgcggcattattcacaatagcaaagacttggaaccaacccaaatgtccaacaatgatagactggattaagaaaatgtagcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaatatcacactctggggactgtggtggggtggggggcggggggagggatagcattgggagatatacctaatgctagatgacgagttagtgggtgcagcgcaccagcatggcatatgtatacatatgtaactaacctgcacaatgtgcacatgtaccctaaaacataaaagtataatttaaaaaaaactaaaaaaacaaacaacaaaacaaacaaacaaaaaaaacacaccctccaatgctttgtgtattttacactcatctacctaatcttccctccgtaaatctgtccgaatttccccaaatcatttggtgtgattgttccaatcttcaagaataattttcccagtgatcttaccacagtaagaccctttctgccttcagctttaggagggtgcttctcaattagcatcctggttcccagtcctctgggacatcatttctttcctctcttggattcatttcttttcttctcttagatttcattgaggcacagtcactatttctgaactgatctccccgcttcctaagcccctccttcagagcactttaacctgggtgtatttcccttttcttttcagtgtatttgtctctcctggccttcaagattttattttcttcctaatggaccattctctcctctaagattttatgtgttatgctaaggaaatatatctctccctctaactcagtgatgcttagccaagagcagttttgtcccctagaggacagttggcaatgtctggaggcatttttattgtcacaattggggatgggagatgaggatagtattggcatctactgggtagaggccagggatgctgctgaacacctcagaatgtacaagttagcccccacagcaaagaaataccccatccaaaatgacaatagtgctgagactgagaaaccctgctctagcttaatcagtctgtattcctttactgtttccaaccacttctgtcttgtcagactgaaacataattttttacttattccagttcctccttaattctaatatttgcaagtatgattcctgacacaagcccttggttttgaagtaatttagatttttcttctacttcaacccaagaaaaccatctagtctgtattagaggccttcattccttttcattagttcattaataaaatatattaatatttcccttttgtgggtgaaactggtttggatctctgaaatctaaagccatgtcagtgcccaacttgaagtcacataggaaaccttgaacttaacggacaagctacatgtaatcaagctcagtttctccacagtatttaatggtcctggaggacactcaaaacagcattaaaaaatagagagattttggttctgctaatctagtacgtgtcctgaaactaaatctgctaaaggcattttatagtcccaacctgcagatttactgagaaactgtatacagatagcagcaaaaaagtgttccaaccttgtaatactggaatgccctgtagaatcattctttatattgtctccacttattactaagatttgtaagcatttgctaaagcctattttttttaaagttctgtgtttataaataccagagcagttagctgttctgaactgccaatatcagaaattcctcatgaactcactttctaaaatttacgacctaaagctacttgctctagccatgtcagttgttttggtatcctaattctacacctaatatatatctcaagattccaaacgcagcaccaaaccttgggttttgaggaggtttcaacaaattatacctttctggatccacccagatttagaactgagagaaaaagagccataggaatagggtggagatcagaatttcagatttgttactgataaaactattggagaagacggcttaggagtgaggtccaaataggcttgctggtgctctccagttcccacatcccaatctataccttgagacagcctgggctgaggaagaattgggccctacaaagcaaatacactaacccagggttaagagtagagagagaaggaaagaaagtgactaaccttttaatagattagtttcatccagtcaggaaacatgggtcaagggatgtcacccctaaccatggaggaagaatgaattcagaatgaaatgagaagcttggagcattatgctaggatagtttcctcaaggaaacatgaagtgtgcatgatgtttgttcccctcccccatcaactaccatgtgactggcttatttgtatgatactggttctactgtttctaagtatgtgattaaaatgtacattgttcttttaatacatatgttctctctgtttaggtccttctatatgatccactctttgactggaccatgaatcctttgaaagctttgtatttacagcagaggccggaagatgaaactgagcttcaccctactctgaatgcagatgaccaagaatgcaaacgaaatctcaggtgagcagtattttaagaaggtcctgttgtcagtttttcagattttcttattcccaaggcctttaaactgttcacctcactgaaacctttgtgtttttgtccttagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 1539 - DNA, 129592 bp, Homo sapiens
  source 1..129592: mol_type = genomic DNA
tgtattaagaaagcagtttatttcttaataactgaatgtatattattttacatataattaatgatcagagagaaataacagttgctgagaacgtaaatttatgttgtactttagaattgaacagatacaaccacagattcataccaaatgcattacttttagattattaacatattcttttacataatttcatttcacatatatggagtccaaccaagatacatctggcatagtaagttttcatcagtagcttcctgtataaggtaatgcacatgtccttcaatagataacggcagtcctgtcactctatttcgagtcttgattacaccttgtagtcgctgctcaatgtcaagaacatgggtcttggcctaaaaagaagaaacataaaaccaaaaacagatgttaataatttggaattactacctttctttatattttgacatttaataaatgttaataccattttactgaccaataccccttttgtaagagcaaatacaggaaaagaagaaattaaacaaatacagttagcttgtgatactgatttggaggctcgcaagattgattcaacatcaactgcttggacatgtttctggactacgtgaaataccagggaattatttacacattacaattctagaaaaataattttttaaatctgctttggaagtgtttaggacttaaacatttcaatgaatattcaaataacaatgctgtactgcctaatatttacattatgttagtacatgcaaatgggtgttctaagtgagctacttggaactgtacaatttcttaagcatatctgaatgcaaaaggaagaataacgttattagaagaataattctcagaggtggtgctgggtgggctggtgggctgcgctgcagcccacgagcacaaagaggagggccacggggtggagactgttgctgtgccatctgccatcgacttttccgccaagagcctggactccaaatatgacttatgttccagcagaactccaggtattaaaataacccctacaacagccaactttcccttttgcagttgcaaaccagctgccgcttatttctttggtgaagcacttgagccatgtgcgtgaaccaaacccagttcattcaagacagtgtttaagttactttgccagacctttatcaaaatggggctgctgtcttctttcacttgtgacaagtttagctcattgagactacatcaccacagagctattactcacttaatgaggtccactaaagagagagttcatcaggatccttgtgaggctatttctcatatccagaaaatcagatcaagggaagtaccctttgaagcacaaacttcacgttacttaaatgaatttgaagaacttgccatcttaggaaaaggtggatatggaagagtatacaaggtcaggaataaattagatggtcagtattatgcaatttaaaaaatcctgattaagggtgcaacaaaaacacattacatgaaagaactacggggaatgaaggtgctggcaggtcttcagcaccctaatatcattcgttatcacactgcgtggacagaacatgttcaagtggtccaaccacaagcagacagagcttccgttcagttgccatttctggaagtgttctccgaccaagcagacagataccaatacggtgttaaaaatggtgaaaatagcagctcacccattatcttcgcggagctcacctcagaaaagaaaaaccctttgcagaatctgacactcaaaatcagaacaacaagctgtgaactacaccatcaattccgtcttaagagacaccagtgaatatgaatcatccctggagctccaggaaaatggcctggctggtttgtctacctggtcaattgtgaaacagcccctgctgctcaggtgtaattccctcctagaggagaatttcacatccactgaggaatcttccaaagaaaacttcaacttgttggggatcgaggtgcagtaccacctgatgctgcacatccagatgcaggtgtgcaagctccagctgtgggactggctagctgagagaaacaaacagggccaagagtgtgtgggcaagtttgcctgtccttatggccagtgttgcaacaaaaaattttcaagatttagtggaaggtgtgttttacatacataacatgggtattgtaaacagagatctgaagcctagaaatatttttcttcatggccctgatcagcaagtaaaaataggagactttggtctggcttgcccagacatcttacaaaagaacacagactggacccatagaaacagaaagagaacaccaacacctatatccagagtgggcacttgtctgtatgcttcatcccagcagttggaaggatctgagtatgatgccaagggtctcactctgttgcccaggctggagtgcagtggtgtcatcatagctcacagcagcctccaactcctggggtcaagtgatcctcccacctcagcctcccaagtagctgggactacaggagtgtgccactgagcccagctaattaaaaaaaaacaaaaactatttgtagagaccagggctggctttgtccagttagatatgtatatagcttgagtgtgatcctgctagagctctttcagctgtttagaacagaaatggagcgagcagaagttttaacaggttcaagaactggtcagatattggaatccctcagtaaaaggtatccagtacaagccaagtatatctatcacttaacgaaaaggaacatgtcccagagaccatctgctcttcaactgctacagagtgaatttttccacaattctggaaatattaatctcaccctacagatgaagataatagagcaagaaaaagaaatttttcttttagttcttttagaagaactaaagaagcagctaaaccttctttctcaagacaaagggttaaggatgacatgaaggatgggggcgtacaggtctagccttcctcgagctatatcagtaggatgaaagtggacttaaactctttaggtagttaactggaatgtaaatttttaatctttattagcatatagttggtataattcattgtatttagtaagcctgtacaagacttattaaagatgtaagagtgccccccaccaaaaaaaacgaatcctcaatctattctaacttattaaaaacaactatctgagctaggcacagtggcttatgcctataatccctgcattttgggatgctgaggtgggtggatcacttgaagccaggggttcaagaccagcctggccaacatggtgaaacccatctctactaaaaatataataattagccagctgtggtggtgcacgcttataatcccagctacttgggaggctaaggcaggagaactgcttgaacccaggaggcagaggttgccgtgagccaagatcgtgccactgtactccagcctggatgacagagcgagactctgtctcaaaaacaacaaccaccaccaccaccacaacaacaacaacaaaactatctgcaaactttgcagcttcaactaagtaagaagtgaattgctgcatttgttaacatagcttgtgacatactggtatcatgatattaaagctcagacctgttgttctgtaagttcaggcaatttgtactatagtttttcctactgtatctcataactgtgaattgtctatggttaaacaagtgtgccatgaacttttattatacaaatgcgaatactgttaacattactgacaataaagaaaacttatggcattgtgatactagagaactagatttcagagtaatcaatagtcactaacagtatttccaagcagttctcatgcatagagatgagaactatagctgcatatcaagttcatttgtagagatgaggactacagcccatatcaagctataccttctactaaccttttcattgacaacttctccagtttcattcagtggcgctttggaatgccctttcactggtttactccattccacaagaggatcatgtagaaaagtctttaagacactaaaattgaaacaaatattatggtatgatgttatctttgcaagaagaaatcttgctgacatcaatatttaagtgaaggatgagaagctaatggtaatactcttataatacacattactacgtcttcattaagttatgtgaaatttctgttttggtgtgaggggagggtaagagaagggaaggcaggaaaaaaggcaagatagaggggagtcagaggtgttttggagaatagagtaagatgggttctatgtgccatctctaagtgtatactgtgaactggtaaatgactatattttgaatgaaggaattttatcccttaccatgtcttcaataacgatataacatctatagctaccatatagacctagcccagaccttttttctgcaccctaaacatcaaatccaattacctatgggaaatacccagttggatatgttccaaacacctcaaactcagtatctccaaaataaaattaattaccttttcccaactatttctcctgtattccccaaatcatcatccacccatttgccctagacaaaaatctaggaatcatcctcaccccgtcttcctctaacatgcaattacaactcctaaatctctttggaatctcttcagttatctccgtctctacggccgtgacactatccagtacaccatcatcctttcctgggttactgcaataaacctctaactagttttctggctgttggcccaaactaggaccctattttttctacagtacaaatcagattatctctttccaccccttgccccctttttattccttcttaaaatcctcaatgacttctggttgctctgcaggcaaagttataatgtagtaacaggccccatgtgagaccttcataatctagcccctgcttacctgtcctgcgtcatctcttagcaccacctcctggaagtataccctctggaatacatactgtatttctcaggcaggccatgacttcacttgccttgatatttttatcactcagaacactctcttctcccttgcatggtcaactttattaacttttaaggtctcaactacttcctccagaaattatttcttgactgacccagactaacacaggggctcttggtaactgttccacatgatgatatacttcctatttcagagaatttgcttttgcatatgtccaactaaccagtattctaccataatgtctgatagacagctttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtcttgatctcctgacctcgtgatccgcccgcctcggcctcccaaagtgctgggattacaggcgtgagccaccgcgcccggcccgatagacagcttttaaataatgaaggtgaataaataagctttaaaagtcctttcaaacaatctgtttcccacagctaacatcatacttaaaagtcaaagactgactgctctacccctaagatcaggaacaagacaaggatgtccacttttagcatgtctattcgacactgatttagttagggcaagtaggcaagaaaaagaaataaaaggcattgatattaaaaaggaagaagaaaaactgtatctgcaggtgacatgttattgtggagagaaaatcttaaggaaggcacaaaaataattattagaactaatacatgaattcagcagattgtaagatacaatatcaatatataaatatcaattatatatctatgcactagcaatgaacaatccaaaaatgaaattaagaaaaattccatttagaataaaatcaaaaggaataaaatacttaggaatacaatttttaaaagttaaatataaaacttgaccctaaaaaccacaaaacattgatgaaaaaaataaaattcaaataaatggaaaaacattctatgttcatcgatcagaagacttaacatggttaagacagcaatactcccaaattgttaagacagcaatactccctaattgatttacaaattcaatgtccttcctatcaaaatccaagctgattttaaaattaatatggaaatacaagggacccataatagctaaatgatcttgggggaaaaaaagcaaagttggaacactcacactttatgatttcaaaatttactacaaaggtacaacaatcaaaacactgtgttgttagcataaggttaggcatatagatcaacagaatattgctgaaaatcaattgaccatttcaacaaaaaagccaagataattaaacgaggggcaaaatattcttttcaaaaaatggtgctgtgactaatggatatgcacatgcaaaaaaatgaatatggacccctaccttacaccatatctacaaaataactgaagacagataaaagatttaaatagcagagctaaaagtcaaaaatgcttagaagaacacataggtgtaaatcttcatgactttggattagggaatagtttcttagatatgacaacagaaacaccaaaaataaccagaagaaaaaaacaaattagactgcatcaaaatttaaaacttttatgtttcaaaggccatcatcaaagaaagtgaagagacaacccacagatggaagaaaatatttgaaaatcatatcttaaaaggtcttgtatccaaaatgtgtaaagaactcttgcaacttggctgggcggggtggctcatgcctgtaatcccagcactttgggaggctgaggaaggtggatggcttgagcttacgagttcaagaccagtctgggcaacatggcaaaaccccttctctgctggggaggctgaggcagggaaatcacttgaacccacgaagcggaggttgcagtgagtggagatcacgttactgcactccagcctgggcgactctgtctcaaacaaagaaacaaactcttgcaactcaagaataggccaggcatggtggctcatgcctataatcccagcactttgggaggccaaggtgggaggatcacttgaggtcaggagttcaagaccagcctggccaacgtggtaaaacccaatctctactaaaaatgcaagaatcagccagacatagtggctcatgcacacatgctgtcccagctacttaggaagctgaggcacgagaatcgtttgaacccaggaggcagatgttgcagtgagccaagatcacgccactgcactccagactgggtgacagagcgaaaccctgtctcaaaggaaaaaaaaaaagaataaaaaaacccaatttaaaagtgggcaaaggatttcaatagacatttgtccaaagatgatctacaaatggccaacaaagacatgaaaagatgctcaccatcactggtcattagggaagtgcaaattaaaaccacaatgagatacaacttcacatccctagaatggctaaaataaaaaaggcagacaataaccaggatagataaagatgttatctaaagatagaaaagatgcagagaagttgaaacccacatacattactagtgggattataaagtgttacaactgctttggaaaatgatttgagagttcttcaaaatgttaagtacagcatttaacatatgacccagcaattccactcccaggtatacacaagagaactgaaaacatatgtccacataaaacttgtgcacaatgttcacagccacactatttataatacacaaaaggtggaaacaatccaaatgtctcttaactgatgaacagaaaaagaaaatgtagtatatccatataacaggataccatttggcaataaaaaacaatgaagtactgatacatgatgaacactgaaaatattacattaagtgaaagaagacaaacacaaaaggccacatattagatgattccatttatatgaaatgtcctgaataggtaaatccatagagacagaaaatattataaatgagtggttacaagtagatagcaggggtgggagggggaagggatcaggagtgactgctaatgcctacggaatttctttttgggctgatgaaaatgttttaaaattagatagtggtaatggatgcacaatcttgtgaatatactaaaaaccactgaattatgtacttttaaaggggtgaatttatggtatataaattatatctgcataaagctattatttaaaaaaactatttcagtcagtacaaagtggtttctacataaaaacaaacatatgtaggggccaataattatattcgaggttactgttaaattatttacaaagtataggtgattacctcattaaaggctctcgctgatcacgcatcagcctcattgtaacttcacatgctcttcgaaaaagaccctctgttcccataggacccattccattaaccatattatgagtcaggcgaaatggcacaatttctggaacttcaaaggtttctcccttagaaacaatacattttattacaaactaacaatgttagaatttaaaaatctttactcaaagaacttcatgtccagattcttttagcaaaaagcaaaaataccctcaaaatatttatgttgtaattactttagaagtttgtaacatgaaggagccatgtagctctgcctttgcttttacagaactgaaaccatacttgatcttggataagatctaggagataagtggacttacctttcactgagtttagtacagtgaataagcagtattacagagaaattttatgcattcaatatttagtctcatattaacttctttaatgtctttcttgaataatatgaaatacaaatattctcatatatttctacttttctttaacactttcatcttaaaacaacagaagcagccaagggtcagatgctcacatcccctcataaaggaaataaaacatgtcatataatgaagtccagttgttcattttctgctgtcctctaatctgccttttctagggacctttcatcccttgtccaatcagttaccctaaattcctctcttgtatggtttaacccatgccagtattttatctctgatttgttctcagttggatctatgatctttcttggtttcttgtgacagcacaaggcaacctgtagatgatggaggtgaagaaaatagtgcgctaacctaccagtctgccctgcaggattataatattggaaaattgtagggggccttaaagatgggtccaattgcctcaatttattcccaggtcccactctggacctacagaatctgaatctcctgggtatctataaatttttttttaattcttggataattctgatatgttgctagaattggaaactatcgtattaaactactctgtctctctaaaactgagtctcagtaaaatgaactgatctgcccttattcacataactaataactaattgagtcagaacctaaacctatgctcttggacttcaaattcagtactagctttacagtatcactcttctaagttctctccatcctaatacgcattactacatgatccactgatgaaaactagtcaacaaattctcagtataactcaactgtgagtataactgctactaacaggtatgtcaaggaagatacagttgttgagaaaaggaaattgagagaaaacacaattagtaagagtaactcatatcacataccttattgaaaagacaattgaaatctacatgtacgcattcaccagtcaaagaatcaaagagaatattttcaccatgacggtctccaagccccagaatataaccaaccattgacattactgcagtggaacggcagtaagctgatctactactgtacctaaaagaaacacaatgcctatgaaatatccatatacatatgaggccaatataaatctaaaatattaaaaataaacattcaaccataacaacgtattatattcttggtaacttaccatgatgtaggatcagggaatgttctcagaaaccactcatgaaaaataggaggatgcctgggcaggagaaattctcggaatactttgagtttttcagataaagctgctgactttggtagcatacactggcgaagttcttttcctgtcatatacactcctgcaaggaagagtgatatccattaatcacatcagccaaatgaaaaaaggggcaaagttttttttgttaaaattggacaagaaacatctacttttattcaaattgttattgaaaaacaagaataaaggaacatttttcaattaagcatacataaagttactgattgtataataaaataataaaccacattatcttcccttaatacagatgacccttgaacaacatgagtttgaactgtgtgggtccacttacatgtgatttttttcaaccaaacatggatcaaaaacatgggatgtaaaatcagtatatactgaaggctgacttttcatacatgcaggttctgcagggctgactgagacttgagtatgtgtggattttggtatgtgagggtattctggaagcaatcctccagataaggagggaccaccgtacttacccaagtgaagcctcttattgatgaaaattaatgtcagttaaaaccagtgttgtgaaatcaaatagttccagaatacaagactcaaaattaagtcccatatgaatgaacttattttgcatatatgtgtacatatcaatatatatgtatatatacatatattttttacactgacacaaattatcaagaaaaaatatattttcaaatccaaactcagacatatacaatatgtcatgctcataaataaaatagtcaacagcaagttctttgaactctgactcaagtgtctctgagtttcagttttgcaactgtgaacttagacaagttacgtaagttctctggcactgtccataaaatagggatggataatcaggcgtgttaacaataataaataaaataatgtacataacatacttggcacaatacccattatatagtgatttatcagtattacttaatgttataaattgaactttatctctcaaaaaaatatgctgaaatcctaattcttggtacctgggaatgtgagcttattcagtaacaggatctttgcagatgtaatgttgttaagataaagtcattaaggtgggcccttaattcaataatccagtgactggtgttcttatgagaaaatagagacacagagacatagagagaatgctatgtaacaataaaggcaatgtggtacaatacatccagaagccacagaacaccagaaggttaagagaaaggcaaggaacattagccttcagagagatcatggtcctaatgacaacttgatattgtatctttagcctccagaaccgtgagatgataaatttctattgtttaaactcgcttagtttgcagtaatttgttatggcaaataccatacaaattatgtatgaaaacatatacttattttctacttcactttgacaacttgatctattcatttttaatgtattacaccatatgaactttaaaaacgtcttattttaaaacaagtttagatgttacaaaaagttgcatcaatgatacggagttcccacatattcttcacccagctttccttaatgttcatatcttgcgtaacaatagtacaattattcaaatcaggaaattcttattattacagtattattaaccaaacctctgaccttattcaaatttcaccagctgtcccactagcacactttgtttaggggtcaggatccaatccaggattacacattacatttagttgtcatcaaatgtcaactccttaatgtcatcaaatctgggaattcattactttgacatttgtaaggagttcggaccagttatatttatatttctctactgtaaagttactatacttttccctttataattgttaagtatctgatagggagatacttcaagattcttcaaataacctgtttctcatcttttgcctattaattttagcatccattaataatcactgcctgcaataataattactatagtgtttgctaattgctgatttcccatttccatcatcctttctacatttattcattgaaattctattagtacataaggaagaactattcccacttccctatttatttatttactcaaatatctgtttatatcagtatggactcatgtttatttgtttattccatgggttataatagtttacaatcattatttattttgctactcaaattatcccaggtttggacagttggagcctcttattccaatctaaaacgtcagacttcattctagccttctctccttcctttctccaatagtgagaaaactggctctcattatacaacatatttacttacttgctgaagactagtactgtatatacatagtttcagaattgttaaccaatatctgtgaaaaacaaatattcatatatagttttgtaagctacctcaaatcctgttgggatgaagacagggaaggaatcaaaatggaaggaaggaaggaaggaagaaaggaaggaagggatggaaacacttaagtgtttctgtatataaaatctagaaatttcactatagcttatatcaaaaaacatatgctagcatatattaataccaattatacccatattatataacttagtacccacactgtatatgtataagaattaattttagtacccttttctttatatagtttggtcagaataggtctcaaaccagcagtgttgttcacccattcaataatcccacattcatcatttagtggaataactgcatatgttcgaatatgaagttctcttctacgagactctgcatcttttcttaagcactgttaaaaaatacacataaatttaaaaacaagatagaactcaaaatttctaaatgttatatcaaatatatttaaagattgttcatttcataaccaaagaatgtcattgaaggcttactatgtggtatacatgaataattcttctgaatggtaggaaggaagctactgggacagtatctctaatctatttacagattattaaaaatgtcctgggtaggtccttctttttaattattcactattaatgtgacaagaatattgtatttaaaatatttaagttgtatatttaacaatgacaaaatgctgctgttttattttctattgctttataggtattactgaaacattaagtctttaggcacagagactgctatttaatttttcttttttttttttgagatggagtcttgctctgtcgcccaagctggagtgcagtggctcaatctcggctcactgcaaactctgcctctcgggttcttgccattctcctgcctcagcctcccgagtaggtgggactataggtgcctgccaccacgcccagctaattttttgtatttttagtagagacagggtttcaccgtgttagccaggatggtctcgatctcctgacctagtgatccgcctgcctcggcctcccaaagtgctgggattacaggcatgagccactgtgcccggccaattttaattatttctaaaatacataaacaaaagagcatgagttctatgacatcctcaaaatgtattgctcctcttgcggtttatcacaaccttatttctaaagctatcccttagcagaagaaagccttacatatttcatctgattgatcctgatatatcaggtggaaataaacagtattatgtttaattctagacctgtatgaagtaagcacacatctgtaattgtaacctgctcaattcaaaagcacaatcactgatcaaaaatacattttactttaggaaataggttccataactaccaggaaaacaatatggccatagaatctcatataaagatcagtgtgtggcctccaaaactaacatagttttttacaaaactatgttagtaaatatgttactaactaagttagtatgtcaggctattttattttaccatgtttatgagggaaaatgtaacaaaatactttaattaaagtaacaaagctgattaatgtaaatttataaactaaagccaggccacttgatactcaagtaaatctgatactcagaaaaactcagggagctttggagagaacatactaatggttcagtagttagtgaattaaggtaccattttaacaaacaatacttttttgttgttgttgttgagacagaatctcactctgtcacccaggctggagtgcagtggcacgatctgggctcactgcaacctccgcctcccaggctcaaccaattctcatgcctcagcctcccaagtagctgggaatactggcgtacaccaccatgcctggctaatttttgtatttttagtagagaaaggtttttgccatgttggccaggctggtctcgaactactggcctcaagtgatctgcccgcctcagctgggattacaggcatgagccaccacacccagcccaaataatatgttaaaataaaaaataatcctccttttcatattgcttttgaaatagctttttaatgtggtattaatttttaaattacttttggttaaaccaagcagactataactttttttaaaaaacaaactcatctactgctatatcttttctatgctaaagatctatgactttaaaatgtgggaaggcaatgagaagaagggaaaaaaagcttgtagaaaaataataaagtttcatctttccacagtatagatcaatttttaccaatggaaaaagacatacactatgcatctacaaatacctggttacagaataattcaaaatacataaaaccatacatttataataaccctttaataagattcctcatatcatctttgagatagaaatcaaataccaacagaactgaaaaaatgctaatgattaccttttatttatctatttatttatttataagagtcagggtcttggctctgtcatctgggctagagtgcagtggcatgatcatagctcactgtagcctcaaactcctgggctcaaacaatcctcctgcctcagcctccttagtagctgggactacaggcatgtgccaccatgcctggctaattttttttattttttgtagagacagggtttcactatataggccaggctggtctcaaactcttggcctcaagtggtcctctttcctgggcctcccaaagtgttaggcttacaggtatgagccactgcacccagcctatttatcttttgataaatatattaacacaatagccaaaaggtagaagcatccaaatgtccatcactggataaatagataaataaaatgtggatggaaaacaatagactattattcagcttaaagagggagaaaattctaacacatgctgtaaaatgaatgaactttgaataatgccaagtgatttaagccagtcataaaaggagaaatactgcacttatatgaggtacctcaaatggttaaattaatggagacaaagtaaatggtggctgctggaggctgaggagaagggaaataggaagttaattgtttcatagacacagagttccaatttgggaagatgaaaaaagttttggagagggatggtggtgatggttgtacaacaatgtgaatgtacttaatgccactgaacaatatacttcaaaaactgtcaaatgttaagttttatgtatgtacattttatctcaataaaaaaattaagtgaaaatgaaaaagactttatatttcattcctgctttttaagagtgatctgtttgtatactaaaatgcctatatcagattgatagtaattatagcaactctgaaataaaagcaatctggttttataatagtcaaaaatttttttaaaataaaaaataaataaataaaataaaagcaaactatctcccaaccttattaatcaaggaattgaattccattagtctacaatcctttctcaggtcatcttttggcttacacatcatgatgtagaactttccatctgagccttttaaagaaatcttctttggtttctgaagagaagcaagaatttccacctaaaagatgatgagttatatatgaattagggccaaaaatttctgtgtaaatgtctatatattataaaccttgagttatgtaaaaaaaaaaaaagaatattaccagctatattatgtagtgaatttgtattttaaaaatcttttattttaattatctatgacctatgaaaagaatgactgtctatgaacagaaacattttcacccattaaaaatagctatgacataaaaagattacttcatcgccaatacaagtacttacatattcaaatttagacaccccccttcaaagcagtcaaaatgtttaaaagatttttgaaacatcttttcaggatctttctgcggagcctgagactctgtttttcaagctttatcaattaaaagtagtttgatttttgaaaaaacaaactccttcaaaattaagtgtacctaatgaagtgagtaaataagatgaataatactgcttaaattaaaaacaaagcatagactgggtacagtggctcatgtttgttacactaacacttgggaaggctgagcaggagaatggcttgagcctaggagttcaagactagcctgggcaacatgacgaaaccccgtatctacaaaaaatttaaaaaattagctgggcatggtgacatgcacctgtagtcccagctactcaggaggctgaggtgagcaaattgcttgagcctaagaggcagaggttgcagtgagctgagatcgcaccactgtattccacccaacccgggcaacagaatgagaccctgtttccaaaaaaaaaaaaaaagaaaagaaaagaaaaatcaaattgtgaaaaaataaagattatagtcatactaaaacaacaggagcatttgaaaaatcaaaacgttacggtgaatgtgaatcatgaatcagaactttttttaatcactgaatttttttgccatcagtacaaatgagtttagttttactcttctgtatttccaattatttttcttcacaaataagattcacgtagattttgtgaaatacactttttatcttaatttgaagtttttaacaactaaattttaaaatcatagtcatataaaactgaagtttaccatatcatcaaaccctgcaatataggcccaatgtccaggaaatggttcatggctagcatggttagcatgggtacccagaattgatggaagtgtaggtatcatgactgattgtagaggaatgaggatttcactaaatgttgcttcttctaccagctttttaagcattttaaaatgagtgctcatgcttaatgtggaactacttccatcaacctgaaaaaataaatagtgcattttaatttgtttttaccttaaattccactataacaaaaatttcacttttacaatattttgattacaaaggttcagcagtctgtggttttctaagtatttcctaatcatcccattttaacctctgtcatttacctcattaataatagtacctacatcataggattgtttaatgattaaaggagagagtagaggcctataatctattatcaaatattagaaaatccaaagagctctgtaaattaaactctcactgaagaaacagttatgtgtttgattatgggatactccaacaggttaccctcagtggaaatatcaaatattaaatatgcactaaaatcttaaaaatcctaaatttctaagtgtagcttgccacaaaggtttcagataaagaactggaaacctgtacatgtaaagcacttacaacagtgttagtgttttaataaatgttggccaccataacactgtttttgataatgtcaagtgcatcagaggtcaaatgggattaatggagataataaatgcagattacccttttgagatgtttattgataaaggaaaggtgagaaatagtctgtatcttttcatctataaacactgatgcactctgaatatttgtcaagtgaagtctagctatgtaccttattaaagaacttctctctccctccttataaccacccccacctcccacttttatctttcctatacatccttgggggtttttctctaatacttaggtagaattatggggttactcctgtaaccatgttcctactttagtcacaaatctaccgaaaaaagtacttattactctagataaccatctgcttagttccctaaaagactgtaagcacctcaggcatgagaatagattttattcatcttgtttcccttagcatagtgcttgtcccctcataggcactgaaatgtgtactaaaagaatgaaaagcaaaaccccaaccctcttccctatcgtaagtgtagtttaataatgtatatgaattttgaaagtttaaagatatgatataatcatagactaccataagtaacttagaatattttacatacttatatttttatggcttatttcatattctctactaaaaattgctgagaaacatggatatctactctcggaaaattcttaattcacactaagaagaacttttagaaatattagagggtatttggaagtaagatgtattagaaatattaaaaactgctttattaagacaaatcatacataattaaaatatacattttgatatatgtgtacacctatagttagaattttaatttaattaatcaaatgaaaaaatctgctcaaattatatacataattacccaacatcagtttataagcactaagattatgatagtaccggtttattgcacaattctagaagcttatctgttaggcgagttgcatctccaacaaacttctctaaggattttttcatatgaatagctttattgaggatttccttgcatctgttcacacgcatgggataagatgactgtcataaaaaagagttaaatgtcataaaaaagagtttatacaggatttttaaaagataaattttttgcttgacaaaaaacttaaaaagtattcatgatgagagtttatatgatacaaattttctgaaaatttatttggcaatgctatcaagagccatacaaatattgccaccctataactttgtgaattataaagttatagggatctgccctggagaaataattacaagtgagaataaacatagacatatctagatgtgttacaattgcaagaaaaatagaaataaccttaatgattaactaaacagttaaataagttattgaaggctattttttagaattttatatattaaaattatatcttcaaattatatttaataacatggaaacaataaagtgaaaaatatgaaattgtacggcaacataattaaatttagtgttaaaatatgctagaaaatatacaaataaaattacatcaaaacattaatgaatggcccaaggtgtgaattttaatttttgttttatgtctctgtattgtctaaattctctaaacatttacttattacatatattgaccaacatatgaattcccattaatgatgcaataacggttttttagtattaataattcaggtactggcggggcacgatagctcatgcctgtaattccagcactttgggaggccaaagcagaaagatcacttgagcccaagagtttgagcccagcctgagcaacacagcaagatcccatctctacaaaaagaatttaaaaattaactgtacatggtgacacaccgctatcatcctagctactgggaagctgaggcaagaggatcacttgaacccaggactttgaggctgcactgagctatgatcccaccactgcattccagcctgggcaacagagaaagatcctgtttcttaagggaaaaaaaataaaaattcaggtagtttggattaaaatatttgtgaaaacataggtaaccattttgcatcaagcattaactgtttactagacttcataaagaaaacacatgctgaattatttgatcttaaacatactagttacttcatttcatatggtaaatatatccaaatattaagatataatgctataaatttctctctttaaaaaaatatttaaaattactaatctaatacaggagagacgccctggaacttgtatctacatattagtattacataatcaagttcatataaaatggtaaaagatcttttcatataaaaaggtaaaagacccttttacctttgacacagctgtcatcatccacattgcttgttgaggataggctagaaatactttggctattatttccatcaagacaacaaaaacttcatcgtgagaatgacaaattcgagagatcaattgtgaaaaagcagtcaaaaattgatatggagctaaatagtttgtatgctctgtgataaccttgtttattttacccaaatcattcctcatttgtacacgatcggagcggccagctgggggaagaaataagtttaaaaaacaataaaggaaagagaaaaatcagtatatcagttcatttcacagaagaaaaattttgctttaaaaatagctttaaagtatgttattcccatgcccaaggttaggtcacttgccaatttgtgaaaagatagttgtctctgtccaaccagaaaaaatatttagagccattcaaaaacccaagggacattaattttcactatccattttaatttttagggtaaattatttggctaaaactaacacattttaatatgtgttagattcattaagaaataatcagatttgtatttgtggccctgaattaaaactactttaaaagtctatgatttgtctttcctttttaacatttagtatcttactcacacttacataatatcttaattatcaaattcattccaagcttctaggaaattagactgtccagccaaatctgactttataccaaagttataattcctagtcctttaaaacttttacgtgaagagttatacctttttcccattcatatgcctttgtaccataatcaagccatagagttaacattcgtggcattgactgatatatgaactgatttccatattgtagagatctgcaattatatagacaagaaacactattagcatagctgtcatttttatattatacgaattaaaatttaaagattcaaactaccacataccgttttcacaaaaattatggtatcaatatttcttcctagaagttatttttgactcctctgtctcctttttagctcacttagttctacattccctgtaccaaaaacatgtacatactgtatgtttccacttacagtatacagaatttgtacattatacaaattctgctctaatcaaagtctatcaatacttctttcaatttttccttaggatctctgtgccttcatttgcattctttggccataagcctaggttaggtccaatcattctatttctgggaaattataataacttggtcaccctaaatccatatttctacccttcagtaaattccagactaacattcctgaaattctggctttatcatgctctccccttattaaaaaacaggaatcaatacctacatattaaaactatataaatgattctgcctgggattcaaacattcagaatcttttatctccataattttccaatcttagcatcttgccactcaccagtatacatcttccatcaggtctagtttctgcaccatcctacaaaccaaccactcaacgctgtttctggtaaaatttgtgaaaagttaaagttctctccttcttgaattttttaggggcctggacatcagtttattttcaaaagaaattttattgtggtaaaacatacataacataaaatttgccatcacaaccatttttaagtgtacagttcagtgttatattaatatggttgtacattcacattgttgcgtaatcatcaccaccattccccctccagaacttttttcatcttcccaaattggaacctcgtacctattaaacagtaacttcccgtctccttccccacccagtctctggcaaccaccattgtactttctgtcttcatgaatttgaccattgaaggtacctcatataagtggaaacatacagtatttgtcctttttgtgactggcttatttcacttagcataatgtcctcgaggttcatctatgttgtaccatatgtcagaatttccttcctttttaaagcagaataatattccattgtgtctacatcacattttgctgatcaattaatctcccaatgaactcttgcactgctttcatgttttagctattatgaataatgttgctatgaacacgaatgtacagatatctttttgagacccatagagacagtttaatgacatagaattgcatttaccattctacaactatagaagaagtggggactttcttttccccttcttattttgtcaagattaatttaaccagaaattaggagagctagcaggtttttttaaaggtgcacaacataatgtttttgtttttaaacatttcatttatttatttaaatcaacaaataaaaattgtgtatatttattgtgcacatgttttgaaacatgtatacattgtggaagagctaaaccaagctaactcacgcatgctaattatttcacatatttattttgttgtggaataaaatctattctcagcaattttcaatacaaaacatttgttaactatagtgaccatgttgtagagtagatctctttaacttattccttctatttaactgaagttttatgtcctttgaccaacatctccccaactcctcactactccaacccctggtaatcaccattctactctctagttctatgagttcaacatttttagattctacatataagtaagataattcagtattaatctttctgtgccaggcttacttcacttagaataatctccaggttcatccatcttcgcacaaataacaggattccttcttttttaagcctgaatagtattccattgtgtgtgtgtgtgtgtgtgtgtgtgtgtgtgtgtgtgtataagtatacatacatatgccacattttctttattcattcccatgttgatggacacttagtttgattccatagcttggctgttgtgaagatgctgcaatgaacatgggagtgcagatatctcttcaacatattgatttaatttcctttagatatataccccataatgggattgctagatcatatgatatttctatttttaatttttaaggaatctccatactgttttccataatggctctactaatttaccttcccaccaacagtgtataagggttcccttttccccatatcctctccaatgcttgttatcttttgtcttttatatgatagccattcaaacaagtgtgaggtgacatctcattgtggttttaatttgcatttatctgatgattaacgatgccgaactttttttatatacctctgttggtcatttttatgtcttcttttgaaatatgtctgctcagacccttttcccattttttttaattgggtaatttgtttccttttttctatttttatttttattttttcagacaggatctggctctgttgcctgggctggagtgcagtgatatgatcctggctcactgcaacctccacctcctaggctaaagtgatgcccctgcctcagcctcctgagcagctgggactgcaggtgcataccaccacgcccgaataatttttgtatttttttgtagagatgggggtttcaccatgttgcccaggctggtcttgaactcctgggctcaaacgatccatctgcctgagcctctcaaagtgctgggattacatgcatgagccaccatgcctggccaggtgatttgctttcttactattaagttgtttgagttccttacctattttggctattaaccccctatcagatgtgtggtttgcaaatacattctcccattctataggttgtcttttcactctgttgattgtttccttggctatgcagaagtcttttggtttgtataatatcatttgtctatatttgcttttgttggctgtgctttttggttcatatccaaaaaaattattgcccaaaccaatgccatgaaccttttcctctatgttttcttctagtagttttacagcttcaggtcttacatttaagtttttaagccattttgagttgatttttgtatatggtgtaaggtaagagtgtaattccattctattgcatgtggacatccagttgtcccaacaccatttattgaagagactgtcctttctgcattgtgggttcttggcacctttgtcaaagatcaattgactgtaaatgcgtggattcatttctagggtctctgttccactggtctatgtagccattttaatactaatgtcatactgttttgattattatagctttgtggtataattttgaagtcaggtagtgtgatgccttcagctttattctttttttttttttttagagacatagtctcagtctgtcacccaggctggagtgcaatggcacaatctcggctcactgtaacctccacctcccgggttccagcaactctcctgcctcaacctcctgagtagctaggattacaggtgcatgccaccatgcccagctaattttctgtattttagtagagatggggtttcaccgtgttgccctggctgatcttgaactcctgagctcaggcaatccacccacctcagcctcgctatgattacaggtgtgagccaccacgcccggccagctttgttcttgctcaagatttctttggttatctgaggtcttttctaggtccatacaaattttaggatttttttttctacttctgtgaaaaaagttattggatttttttttttttttttttgagactcccagtctggagtgcagaggcacgatcttggttcactgtaacctccgcctcctgggttcaagcaattttcctgcctcagcctccctagtagctgggattacagatgtgtgccaccatgcctggctaatttttgtattttcagtagagactaggtttcactatgttggccaggctggtctcaaactcctgacctcaagtgatccacctgcctcagtttcccaaagtgctgggattatgggtgtgagccactgtgcccagccagaatttttaaacaaaacaaaacaaaaaaaaaaggaaagaaagaataagctattggaattctgatagaaactacattgaatctgtagatcactttgggcactatgaacattttaataatattaattcttccaatacataaacaggatatctttccatttgttcatgtcttcttcaatttcttttcatcaatgttttatagttttcattgtataggtcttttgccttgtatttattcccaagtattatattttatttttgtagctactgtaaatgagattgtcttcttaatttatctgcaagtactctgttattagtgtatagaaatgctacttacttttgtatgttgcctttatatcctgcaactttattgaattcatttatttgttctaatagtcttttattggagtcttagggtttcagtatataaaatcatgtcgtctgcaaatagaaaaaaattgatgacttcttttccaatttggatgccttttatttatctctcttctcgaattgctatggctaggattcctggtactatattgaatataagtggcaagagtgggcatctttgtcttaatcttagaggaaaagctttgaacttttcaccactgagtatgatgttatctttggggttatcatacatggtctttactgtgttgaggtacattccttctatacatattttttttttaaaaaaagtttgtttttttttaaaaagcctcttttattttaaaaaacaaaggaatgaaaaacacaaaattgggaatagtggttgcctccagggatagaggggtgacataaaggttagactagattaatggatgttcattctattattatgctttacaacttatatacatgttatgttttatatatatatgtttttaattatactttaagttatagagtacatgtgcacaacgtgcaggtttttagatatgtatacatgtgccatgttggtgtgctgcacccattaactcgtcatttaacattaggtatatctcctaatgctatccctcccccagcccctcaccccacaacaggccccagtgtgtgatgttccccttcctgtgtccaagtgttctcattgttcaattcccagctatgaatgagaacatgcggtgtttggttttttgtccttcgatagtttgctgagaatgatggtttccagcttcatccatgtccctacaaaggacatgaactcatccttttttatggctgcatagtattccatggggtatatgtgccacattttcttaatccagtctatcattgttggacatttgggttggttccaagtctttgctattgtgaatagtgccgcaataaacatacatgtgcatgtgtctttatagcagcatgatttatattcctttgggtatatacccagtaatgggatggctaggtcaaatggtatttctagttctagatccccgaggaaccgccacaatgacttccacaatggttgaactagtttacagtcccaacaacagtgtaaacgtgttcctatttctccacatcctctccagcacctgttgtttcctgactttttaatgatcgccattctaactggtgtgagatggtatctcattgtggttttgatttgcatttctctgatggccagtgatgatgagcatttttttcatgtgtctgttggctgcataaatgtcttcttttgagaagtgtctgttatatccttcgcccactttttgatggggttgtttttttcttgtaaatttgtttgagttctttgtagattctggatattagcccttcgtcagatgagtagattgcaaaaattttctcccattctgtaagttgcctgttcactctgatggtagtttcttttgctgtgcagaagctctttagtttaattagaccccatttgtcaattttggcttttgttgccattgcttttggtgttttagacatgaagtccttgcccatgcctatgtcccaaatggtattgcctaggttttcttctagggtttttacggttttaggtctgacatttaagtctttaatccatcttgaattaattttcgtataaggtgtaaggaaggatccagtttcagctttctacatacagctagccagttttcccagcatcatttgttaaatagggaatcctttccccatttcttgtttttgtcagggtggtcgaagatcagatagttgtagatgtgtggcattatttctgagggctctgttctgttccattggtctatatctctgttttggtaccagtaccatgctgttttggttactgtagccttgtagtatagcttgaagtcaggtagcgtgatgcctccagctttgttcttttggcttaggattgacttggcaatgcaggctcttttttggtttcatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttccttgagcaatggtttgtagttctccttgaagaggtccttcacatcccttgtaagttggattcctgggtattttattctctttgaagcaattgtgaataggagttcactcatgatttgggtctctgtttgtctgttattggtgtataagtatgcttgtgatttttgcacattgattttgtatcctgagactttggtgaagttgcttatcagcttaaagaaatttggggctgagatgatggggttttctagatatacaatcatgtcgtctgcaaacagggacaatttgacttcctcttttcctagttgaatgccctttatttctttctcctgcctgattgccctggccagaacttccaacactatgttgaataggagtggtgagagagggcatccctgtcttatgccagttttcaaaaggaatgcttccagtttttgcccattcagtatattggctgtgagtctgtcataaatagctcttattatttttagatatgtcccatcaatacctaatttattgagagtttttagcatgaagggctgttgaattttgtcaaaggccttttctgcatctattgacataatcatgtggtttttgtctttgcttctgtttataggatggattacatttgttgatttgtgtatgttgaaccagccttacatcccagggatgaagcccacttcatcatggtggataagctttttgatgtgctgctggattcggtttgccagtattttattgaggatttttgcatcaatgttcatcagggatattggtttaaaattctctttttttgttgtgtctctgccaggctttggtatcaggatgatgctggcctcataaaatgagttagggaggactccctctttctctattgattgaaatagtttcagaatgaatggtaccagttcctccttgtacctctggtagaattcggctgtgaatccatctggtcctggactttttttggttggtaagctattaattattgcctcaatttcagagcctgttattggtccattaagagattcaacttcttcctggtttagtcttgggagggtgtatgtgtccaggaatttatccatttcttctagattttctagcttatttgcatagaggtgtttatagtattctctgatggtagtttgtatttctgtgggatcggtgatatcccctttaacattttttattgcatctatttgattcttctctcttttcttctttattagtctagctagcagtctatcaattttgttgatcttttccaaaaaccagctcctggattcattgattttgtgaagggttttttgtgtctccatctccttcagctctgctctgacctaagttatttcttgccttctgccagcttttgaatgtgtttgctcttgcttttctagttcttttaattgtgatgttagggtgtcaattttaaatctttcctgctttctcttgtgggcatttagtgctataaatttccctctacacactgctttaaatgtgtcccagagattctggtatgttgcgtctttgttctcgttggtttcaaagaatatctttatttctgccttcatttcgttatgtacccagtagtcattcaggagcaggttgttcagttcccatgcagttgagcagttttgattgagtttcttaatcctgggttctagtttgattgcactgtggtctgagagacagtttgttataatttctgttcttttacatttgctgaggagtgctttacttccaactatgtggtcagttttggaataggtgtggtgtggtgctgagaagaatgtatattctgttgatttggggtggagagttctgtagatgtctattaggtctgcttggggcagagctgaattcaattcctggatattcttgttaaccttctgtctcgttgatctgtctaatgttgacagtggggtgttaaagtctcccattattattgtgtgcgagtctaagtctctttgtgggtctcttggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggatttcaacccctgcctttttttgttttccatttgcttggtagatcttcctccatccttttattttgagcctatgtgtgtctctgcacgtgagatgggtctcctgaatacagcacactgatgggtcttgactctatccaatttgccagtctgtgtcttttaactggagcatttagcccatttacatttaaggttaatattgttatgtgtgaatttgatcctctcagtatgatgttagctggttattttgctcgttagttgatgcagtttcttcctagcatcgatggtctttacaatttggcatgtttctgcagtggctggtaccgattgttcctttccatgtttagtgcttccttcaggagctcttttaggacaggcctggtggtgacaaaatctctcagcatttgcttgtctgtaaaggattttatttctccttcacttttgaagcttagtttggctggatatgaaattctgggttgaaaattcttttccttaagaattttgaatattggcccccactctcttctggcttgtagaatttctgccgagagatcagctgttagtctgatggggttccctttgtgggtaacccgacctttctctctggctgcccttaacgttcgttccttcatttcaactttggtgaatctgacaattatgtgtcttggagttgctcttctcgaggagtatctttgtggcgttctctgtatttcctgaatttgaatgttggcctgccttgctaggttggggaagttctcctggattatatcctgcagagtgttttccaacttgtttccatttccccatcactttcaggtacaccaatcagacatagatttggtcttttcacatagtcccatatttcttggaggctttgttcgtttctttttattcttttttctctaaacttctcttctcgcttcatttcattcatttgatcttcaatcactgataccctttcttccagttgatcgaatcggctactgaagcttgtgcattcgtcacgtagttcctgtgccgtggatttcagctccatcaggtcctttaaggatttctctgcattggttattctagtcagccattcgtctaatcttttttcaaggtttttaacttctttgccatgggttccaacttcctcctttagctcggagaagtttgatcatctgaagccttcttctctcaactcgtcaaagtcattctctgtccagctttgttccgttgctggtgaggagctgcgttcctttggaggaggagaggccctctgatttttagaattttcagtttttctgttctgttttttccccatctttgtggttttatctacctttggtctttgatgatagtgacgtacagatgcggttttggtgtggatgccctttctgtttgttagttttccttttaacagtcaggaccctcagctacaggtctgttggagtttgctggagatccactccagactctgtttgcctgggtatcagcagcggaggctgcagaacagcaaatattgctgaacagcaaatgttgctgtctgattgttcctctggaggtttcgtctcaaaggggtacccggccgtgtgaggtgtcagtctgcccctactgggggatgcctcccagttaggctactcaggtgtcagggtcccacttgaggaggcagtctgtcagtgctcagatctcaaactccgtgctgggagaagcactactctcttcaaagctgtcagacagggacatttaagtctgcagaggtttctgctgccttttgttcagctatgccctgcccccagaggtggagtctacagaggcaggcaggcctccttgagctgcagtgggctccacccagttccagctttccagccactttgtttacctactcaagcctcagcaatggcgggcactcctcccccagccttgctgccgccttgcagttcgatctcagactgctatgctagcaatgagagaggctccgtgggcatgggaccttcagagccatgcacgggatataatctcctggtgtgctgtttgctaagaccattggaaaagcgcagtattagggtgggagtgacctgattttccaggtgccatctgtcacagctttgcttggctatgaaaaggaattccctgaccccttgcacttcccaggtgaggcaatgccttgccctgcttcggctcatgctcggtgcgctgcacccactgtcctgcacccactgtctgacaagccccagtgagatgaacccggtacctcagttggaaatgcagaaatcacccatcttctgcgctgctcatgctgggagctgtagactggagctgttcctattcggccatcttggaaccgcccctctgaaactttttagtcataaaaggatgttgaattttgtcaagtgctttctctgcatctattgagatgagatgatcatatggtttttgtccttcattctattaatgtggtatatcaaatatatgtatttggatatgttgaaccatccttgcattctggagtaaattccacttggtcatggtgaatgatccttttaatgtgctgttgaatttggattactagtataccttcttcatgaggtttaccagacttttgtagcaattcaatgcaaagaagtacacttttgaaatcataaagccagtggcttgtggcttgacttttgacctccatgacttctggacttgtttggttcacttttggtatctggctaatatagcctcccacatagctgggaccatggttgtacaccctatgcctggctgatttatttattttttgtagagatgaggtcttgccatgttccctaggcttttcttgaactcctgggctcaagcaatccttccatttcagcatcccaaaattctgggattacaggcattaatcaccgtgcccagccatatctgatatttactacatttattttgatttatttatttattttttttttgagatagagtctttctctgtcacccaggcaggagtgcagtggcatgatcatagctctccgcaatctccacctcctgggctcaagcaatcctcttggcttagcttcccttgtagctgggaccacaggtgtgcaccaccatgcctggataatttttgtattttttttggtagagatgggttcttaccatgttgctctggctggttttgaactcatgggctcaagcaatctgcctgcctcagcctcccaaaattctgaggttacagacatgagccactgagcccagcctattttgatatctaatcacacattctattatgtaccattatttaaatgttttatgtacttaaggtttctaaccctaattggatcctagattcttaagggcaaacattgatatttaatcagtaataacacaattattcagtcaggggataaatatgtctcaatagctaagtttactcccttaagcatacaaatattttattttaactactatggatagaaacaggttttaaaatgtacttacattcctgaagggtactttaaaaatactcactatacataacagttttatgcatatagaggactttatatagccacttgttttaaaagaaatgtgttaagtaaattctatatcccaaggcacatgatatatactaagactaaagagcaaacaaaagaagctattactcatttttcaaaagaactgggccaagagtgatggctcacacctgtaatctcagagcgttgggaggctgaggtgggaagattgcttgaggccaggagctcaagatcagcctgagcaacatagtgagaccctgtctctacaaaaaattatttaaaaacatagttgggcatggtggcatgtgcctatagtcctaactactaaggaggctgaggcaggaggatcacttgagcccagagttcaaggtcatagttagctatgattgtactgcactcctgcctcagtgacagagtgatactttgtcaattaaaaaaaaaaaaaaagaagaactgcctttagtacctttactcattttgctaccctaataccattgatgatgaacaaatattgctttttttttccattttttttctcgtgtgacacagccctcaggagatcctgagaacatatgccccctttctttcttttttttttttctttctttctttttttttttttgagacagggtcttgctctgttatccaggctgctgtgcagtggtgcaatcacagctcaccactgccttgacgtcccaggttcaggtaatcctcccacctcaacctccaaagtagctaggactacaggcacacaccaccacccgtggcttacagatattgctttaatttctgaaaatatttaactgagaagtcatagtacctcataataggcaattttaacagatatattgatctgaagatatccttccatgtaaagcaatggtacatgagtatgataaggagaatgtatggaatgatattgtttcttagcaattaataatttataaaaacataaacagtaggcctgagattatacttgactataatacaccgatatatgaaattaaaagttatatttcacctattaactagtttaagaataagtactttctacaagtctaatgtcaaaatcattttcatgtatatatattataccacttcttattggaatgggctagaaggaagtactccattgcaataaaatataaccacaaaggctgagtggagtggctcacatctataatcccagcactttgggaggccgtggtgggtggatcacgaggtcaggagttcgagaccagcctgaccaacatggtgaaaccccgtctatactaaaaatacaaaaattaactgggtgtggtggcacacgcctgtaataccagctactcagaagggtgagccagagtcgcttgaacctggaagcagaggttgcagtgagctgagatcgtgccattgcactccagcctgggcgacagagcaagactctgtcttaaaataaataaaataaaataaaatgaaataaaataaaataaaatatatatatatataaccacgaaatatgacattaagggtcttctggaattctatggttggggactcaggggatgagggtctggaatgagaaggatacttaatttggtgctgttgaatttttttaaaaatccaggctgtggaattataatacatatattggttttagttcacagttactggctcctaactcctcgttttaatgtcagggcactttaggcctcaggaaacagaatctctctctatgagcttctcctgtccttcactcatctgcctaagggaggattctaatctgactgtgagtcaaaagatcctcatcccagagaggatcctgccccatatcctagaggaaggaatgctacatagaaaaggccaagaaaagtctgaacagacagaccttgctgggtttacattatgagctatttgtccactcacatttctacatggttgtcaatcatgcccatgtaataaagactccattaaaaaccccacaggacagagtttggagagcttccagagaggtgaacacgtggaggctgacaggagggtgaagaagacctcatccacgtgccaggaggatggcacagcccatctccatggagacagaagctcctgtgccggacccctccagacctcaccctacctatctcttcatcagactgtttatttgcatcctttaaaatatctttcttaataaactagtaaaaatgtttccctgagttctgtgagccactctagcaaatttattgaacccaagaggaggttgtgagaaccccaacttgaagccagttggtcagaagttccagaggcccagacttgcaactaagggaaggaggagatggtcttgtgtcaccaagccctcaacctctgaggtatgacaccgtctccaggtagagagtgtcagaacagaattggaggacaccaagctggtgtccactgcttggtgtatggggaaaaaaacccacatctttggtcatgtaagtcttctactgtgttgatgattgctgtgttggtgtgagagcagaggaataacatagttagagagagtttccaaaacacatgtctatatcacttttttcatttaaaaagtttttaaagtgaagaaaaaagttgcataaaggaaaaatttacatcttatctaaggtgatacactgaatcagtcataagccagaaaatacctagaatatgctaagacatgtgataacagtttcaatattaatagtcatccttacatatttaatctgcaaacatgcagttctcatactcacctgccaaaatgaagaactatataccggatgagatcaccttgcttttccattttgttgtctgtgaccatgggcatcaatttgtcatagtacttggcaaggtaaaaatgcccatcctcccattctggcaggcacgcggtcacatcctataaaaaagaacataggatacctacctaaggaaatcccacgctatgctgggaagtaaaatatgaatagatgattagggatcaaaagtatgtgacctttatctaggcagagcaaagtcaaaagcagactcaatctttgatgtggaaaaggaatagctaacttcttgtaaaggttttctcaggagggctgatttgttctggtgggttgcccactgcccaacatgaaatagtgctggaagaattcgcaacttaggagaaaactccatttatgtcaccactttaaaagatacatcaaagtagtgtctggatgggttaaatttttttatacatatatatgatatgtgtgtgtgtgtatatacacatatatcatgaaaggcatttttaaaaatcttcaaagcagaagtaatatcaagtctctaaagagtgtaggactttaaaaagcataaaaattttggtaaaataaaaatcacatattttgtttttctccaagatctctcacaagttattgccctttctctcaattccttcagaagcaggcttctaaaaaggattctctacctcacattgattcctaaaactatgtcttttcagcttcagtcttcaccactccactaaggagctccttaaatccaagagatattttacaactctgatctcatttgaactctcttcaatatgtttctgttgtccaagtcacttatttcaaatgctttcatcccttgacttctgtgaggccaccatcttccaagttttctcctctctttctggccactctcacttagtctcctttgtcatttctttttgctgttcctgccttaaatatttgtgtggtttattaatttttaatattacatgaaatgtgatgggaaatacacaggatcactgacaattttttttttaattgaagttccacttttcatctaaagaagtttgagaacagtttagaccagaaaccttaagtgagatcttgagtttctactgactctaatcttgagactctacagacacaaacctgcctgggaatagaggacagaatgatatgattagacgtgtggcacatgctaggttcatgtacctaatcagccacacagggtaagggctgccagaaaaacatattagtcaatctagtctttccttcctttcttctttcctgcctgtcttcctgccttcctttcttcctccttccctaacttccttcctcctccctctctcatttcagcttagattttaaatatttattttgaaaagtaaaattcacatactgaaaaatacactaatattacatttacagcttgatcaattatcacaaagtaattacctttatataaaatctccttcctccctctcttctctctcgctccctttttagttaagatttttaagttttattttgaaaaataaagtttatatacagaaacatatatgaatcttatgtatacaacttgatcaattattacaaatttatcatcctcatacaagaactccaggagttttttgtctgtttttgaacttttatataaatagaatcatactataataattattattattggctgggcaagatggcttatgcttgtaatcccagcactttgggaggcccaggtgggcggatcacgaggtcaggagattgagaccatcctggctaacacggtgaaacctggtctctactaaaaatacaaaaaaaaaaaaaaaaaaaaaacaattagccgggcggtggcaggcgcctgtagtcccagctactcgggaggcggaggcaggagactggcctgaacctgggaggcggagcttgcaatgagccaagatcgcgcaactgcactccagcctgagcgacagagcgagacaccatctccaaaaaaatacatattattattagagacaaggttttgccctgttgtcctggctggtgtgcagtggcatgctcatgactccctgcagccacaactcctaggctcaaggcaatcctccctcctcagcctacggagcagctgggactagaggcatgtaccaccacacccagctaatttttgtattttttgtagagacggagatttgctatgtttcctaggctggccttgaactcctcagctcaagcaatccgcctgcctcagcctcccaaagtgctgggattataggcatgagccaccatgcccagccctacgtgtattatattttttatctggcttatttcattcaacattacatttgtgatatcaatccaagttattgcatataaatttggtttactatatagtattccattataagaatatgctacaacatatttatccattctataactgattgccatttggattacttccaatataaaatctacaaataataatgttataaacattcttgtgtttatcctctggggacatgctgggtcatattccagatatgagcctctaatgtattgcaaatatcttctaatctgtaggttgcctctaactcacaatggtatcttctgataaacagaagttattgtttattttagggttagtgtttttgttatgtttaagaagtcctgacctagattaacaatctacctcaagtttacttttgtttatggtgggaagaagggatcaagtttgattttttgttttcctataagatacccaagtgatacaacaacatttattgaaaagactattttggttattcacagtttgcccctccagatagatacacttgccaactttagccttttccactctgctcagtgccccagcaaactgaaattgatgatttatatcaatgggcctgtttgccctctggcttcctgtgaagttcaatcaatggaaggtagcaatagattagagggtgagggggagagtgaggttaaggtctttatacctgctcgtttccttcctgctgggctgcagttgacagtggtggtgtttctttccctaaggttaagttctggtccaatggtcctttcctacaaatttagctccctgtacaggttccagtaaatgccctatccttttgctccttcaggtctagagttagcaacgactctctgttgttgctagccatggggtactttcaccatcctttgttaatttcccttaatctagtttttcattaaactctccccaattacctcttttgattgggccaactattttctccctgcacctgacctcacacgatacagtaaagagcatctcagatagattggaggtcactaaggagatatgacaactaatgctatatggaatccttaattctagacagaagaagaacactattgggaaaactggtgaaatgtggtctacagatagttaacagtattgtttatcaatattaatttcccacttctgatactctggtagtgtaagatattaaaattagtggaaacacggtaaagggtagatatggaaattccctatactactactaactttttagaagtcaaagattatttcaaattaaaactgaaaaaatgaaaggtgacagagaagcttcttggttattcttggcctttatgtttccacataagttttaaattctaattgtcaattacctgttagcatttgatgagtaatgcattaaacctctaggtcagtttgtagagaaataattatattattgagtcttcccattcatacatgtattctagctaccaatttatttagttcttttttacttcactcaattttaatgttttaatttttattttgtggagaggtcttgtgtgcaatttaatcctaggcatttcatcatttttattgctatcctaaatgatatctttaaaaattttaggctgggcatacatggtggctcacaactataatcccagcactttgggaggcagaggtgggaggatcagtagaggccagggagtttgagaccagccttggcagaacagcaagaccctatctccacaaaataaaaaattagctgggtgtggtggcatgtgcctgtagtcccagctacttgagaggctgaggtgggaggatcacttgagcccaggaggttgaggctgcagtgagctgtaatcatgccactatactccagcctgggttgacagaccaagaccctgtctcaaaaataaaataaagtaaaattttaaatcaactttcttaagacatatacacccatggaaccatcattccagtcaagaagatgaacattcctaactctcgaaagttcttatgggcgcccacccttgccgtcactctcctgccaactacccaggcaaatactgatataatttctatgcatatacattaattatacctgttctaaaatgtcacataaatgaaatcatataagcatatagtcttttatgtccctcttctttcattcagcatatctatgacattaatctaccttgttgcgtgtatcagtagttcatttcttcttactgtagggtagtattccattatacaactgtaccagtttgtttacccattcttctctggatggccagctggcctatttccagtttttgtgactaaacctactataaacatttgtgtacaagtctttttattgacatatgtaattgtttctgttggataaacacctaagaatggaatggaatatggtagatttaactttttatagtccccaccaggtgcatttattgcattaataggtattgctagtctttcagactttagccattttagtgtgtaatgtgttatttcattgtggttttaatttgcatcttcctaatgactaatgatgttaagcatcttttcatttgctttttggccatttgcgtgtattctttatgaagtgtctatccaagacttttgcagatctgtattttttttcttttaatagacaaagtttcactctgtaactcaggctggaatgcagtggtgcaatcatagctaactgtaaccttgaactcctaggctcaagtgatcctcctgctttagcctcccgaatagctaaaactataggcattcgtcaccatacctggctaatttttatttttgcagagacaggttctcactatattgcccaggctggttttgaactcctagcttcaagtgatcctcaggcctcggcctcccaaagcaccgggattacaggcctgagccactgtgcctagcctcacagatctttaaattgtcttactaagttgtagggttctctataatttagctacaaatcctctgtcatatatgtattacaagtattttctccaagtctatggcttaccttttcattttcttaactgtctttcttagaaaaggttttaactttgatgaacatctaatttatcaggattttttaaatgcttaatgctttgtgtgacctaagaaaacctttgcctaccctaaggttgtaaagattttcttctattttttcatctaaaaattcataattttagcttttcagtttagatctataatctacttttttgaagcaattttgtctatcatatgaggcagaggttgaagatcatttttttcctcatacagatatccaactgttcaagtactttctgcttgtaaatggtatgttttaaattcctttcttgttgtcatatagaaataaaatcatcaggcaatcttgtttaattcactcaatattttgaatagtttataatcttttgaattttctacatatgtattcatatcatctgcaattaataactttcctatatttttttcctagtccttgtatcttttacttctttttttatttaaagattgccatttgggtaatattttaaaatgacagctctattgggatataattaatatattataaagttcacacttttaaagttgttgttagtatatttacagagttgtgtaaccatcaccactatttaattccagaacattttcatcactccaaaaaaaaaattgtaccaattagcagtcacttcccagccccaacctcagtctctagtacccattaatctaccttctgtctctatggatttgcttattctggccatttcatgtaagtggaatcatgcaatatgtggccccttggatctgcatgtcattctacagtagtcagcctctattcttttctctactcatttctgtctacatcatgtataggcaaccagaacaagagaagcagctactgaggcctttatgacaggaaattaggggtgtatgcagaagaaacagaacctgaaaagttggtagtctgacaacatctctcttccctaaccctggctttagtacccaggcagagatgggagaactggaatatttgctatcaaattctgctgttaagtactggtgagtttttgtgtgcctcataagttgttgtgtcttacatactagaataaattcagaagatctctctaactgggaaggtgaaacttacaagtatggtttcagaacttgcctcattatcactgccctttaggataatatagtttttaatgcaaatcaaggttagtttcttaggtggcatgacatcttcttgtaaccaaggaacaggagctggactcctatttatcttcatcagaatgcaacacttcctggatctaaagattagcactgtctgtgccatttgctttggctgttggtcccatttaggtctttcttgtatctttgatttctctctcttctcatcatgctcttatttttgtttatgttcttaaacttatggagcctatatacaatagctgtttttaaatcctgtcatttctagaactatttctactgatttattttttttcctatctgtggctcaaatattcctgcttcttcattcacagagtaattttttaatggatgctggatatatttttacattgtcaagttttagattttgttgtcttgctttaaagagtgttaggctttgatctggcaggcagtaaggttacttgaagatcagtgtaatcatcttaaagcttgttttactgcccttctagtatggatatagagtagtttttagcctaggactaatttagtcctacttctaaggtgtggcccttttaaggtctttactgaatgctccatattatgcaatgaggcctcttaatctggctggtggactgaataactctcaatcctgtaatctgaatgaatctcaatcccgtgtgagctctggaaattgttcttatagcctctgcatgtttattctttccccagcagttattcctagcttggcctcatagaattctgaattattcatgtgcaggctggtattcagcgaacacaattcctatgcagataggaactactctgtttaacttttttctctcagttaatctgtcccacaaattctagccacctgctctttgctttattatttcctttcttctacttttttatttctctccctacttttttagttccttttctaactctttgggatagatacttaactcgttaattttgaacctttattttcttcgaatatatgcaaataaaaatttaaatcccttttaagaatggctttagctgcacaggatatgatatgccatttttattatcattcagttcaaagtacttttcaatttccattgaaagttttcattgacccatggattattgagaggtatatctcttacaacaccatctatataaagtttaatacctagtaaagaagttataaattggttttgctgaaaaattttcaggctaggatgtagttaactttgagacagagggtgagaatagtgattactgggatgaagggtagtggggttatagagctcaaataatattctatttcttgatgtggtggcagtttcatgagtatatttattttgtgataatccatatacttatatactcactgaaaagtcaaaaaaatttcctggttatttttatacatgtgctttgccatatagacttaagtcattttacgtagtcaacagagttaactgaaactgcattatacatatacttgccttatattttttcataattgcattgctttcaaagttagctgtttcttccataaatcggcccactagtagcatagctcgaccatggattaacatgttcttaccctcaggtggggtttcattttcaggaaaacataattcaacacctttttgaagaacaattagtgcctggtgaacatcaccctaaaagaaaaaaggcaacaataagccttttaatttaaaaacatacttctattttctgcaaaagtattagttcattatgtttttgtacaaatccatttgtaatttcatgtttatcttttacttgcctcttattaaagtaaaattctaaaactgaaacattgcttcatctcattcattcatttactaattaattttataactgcagttggctctctgtagccacaggttccacatcaatggattcaaccaacagtggatagaaaatattaggaatggctgggcacagtggctcatctctgcaattccagtgcttttggatgccaaggcagggggactgcttggggccaggagtttgatactagcctgggcaacatagcaagatcctgtctctacaaaaaatttaaaaattacccaggtgtagtggctcatgcctataattccagctactcgggaggctgagggggaaggatcgcttgagcccaggaattcgcagttacagtgagctatgacacaccactgctctccagcctgggtgacagagcaagatcctctctcttaaaaaaaaaaaaagaaagctaggcatgatggcttatgcttatagcctttgatacaaagttcagggtgaggtgggaggattgcttgagagcaggagtccaaggcatcagtgagctatgatcatgccactgcactccagcctgggcaacagagcaagactctgtctctctcaaaacataaaaatttaaattaaaaaaaaaaagaaatattacaaagaaaaaattaaaaataatatgaataagcaatacaagtataacaactgtttacaaagcatttgcactgtattaggtattataagtagcctagagaagtatacaagaggatgtccgcaggttatatgcaaatactgtgtatgccactttatataaaggacttgagtatccacagattttgttatccatagagaatcctgggaccaatccctccatggatatcaagaaaggactataatcaaagttcagggaattgaagacaatcacaaacaaattaaaatccctgacataaaaaaagttcatagtcacatgagaaaagaaactatgtgaaataaaagcatatttgctaagtgttacaacagaggaatatacatcagcattatacaggatagagaagagagtcccttaaacctacctgaagaatataggaaaatggaggagaactacagtcaggaaaagttatcaacgaagaaaatttgaattaggttttcaagaatgagtagaaatcttcttggcagagaatttagtgaaaggcattctaggtagatggaataataattttaattggaagaaaagcacatagtctgattttagctgaagtttaaagggtttttgagatggtgatgaatgacactgaggaagtaggccaggacttgatcagaaagggatttgtgtagttcctagagttaggcttaatcctaaaggtatgaagaatactttgtaagatttaatctttttgaaggagcaacatgattcgatgtggattttagaaagatcacaaactgcaataacgtatacagggaaatggtgagatcctaaaatggttgttaatattgttagaggaagtaaataataaagtcataagttaaagcagtggaaataaataagagggagaggattcaagagatatttctaaggttgaagaacaaagatttagtctccagctggatgtgaaaagtgaggttgcagaaggaatttaagatgatgtccagatttctgtttttgatggaaggatggaataaagtcttgttcagagaagtaggaaacatgagaggagaaacagatattgagtattaggtaataaattgcattttgaacattttgagtttaaggtattataatacatagactaccactagctcaataaaatgaccaggtactgactaatgcacactgaataaattgctttcccctctcatccaggaaacctctcctgtcctttctcagccaccacaagttggtgtaaccacaaatggcaccaacaatagttgctaagtatcaattccagaacatgctattattattagtaatgcctattactaattctaaactggtgactagcctgaggagaaatttaagtaatagccattaaatctgggttattggccaggcgcggtggctcacgcctgtaatcccagcactttgggtggctgaggcaggtggatcatgaggtcaggagatcgagaccaccctggctaacacggtgaaaccccatctctactaaaaatacaaaaaattagccaggtgtggtggcacacacccgtagtcccagctactcaggaggctgaggcaggagaatcacttgaactcgggaggcagaggttgtagtgagcggagatcgtgccactgcactccagcctgggcaacagagtgagactccggttcaaaataaataaataaataaataaataaaaataaaaaataaatctgggtcataaaccttgcaagtagttccaatgtttaaaaaacccccttcttattactttggctttaatctgaggtctgccgtgaacttctgttcagatgctaggccctttctggctagatcagagctgaatatttacagtaacactggcaagtctacagagagctaattatctgccagcaactaagtgacagagttacattcatttaaccaacatttactgggtcactactatatacaccctgtatacatacataaggtgaaaaattaagaggtcgttttcctcaaggaaaatgtaagatagatgaaaactgaaaaaactccacattcagccttgaaatgggaaggtatctggggactgtagagtaaaaagaacaattacttccaggctatggtagataactaatgaagaaaagtgatagaaaaggaaggttcttaatttggattagttatgttctctcagttggccttttaaggaagtacataattcccgactatatatatatatatatatatatatatatatatatatatatatatatatatatatatatgatgacatttccctggccattaccttggaccagagccactttgccctttccacgtacagttcagcgagtcgtgattcccctgcattaaggagagcattgtaggctgtctggtggtgaccagcctttctagctaccctggcactctgcagccagcattctccaaccatttcattgtaatctggtctaaaggaagtaacaacacattggtgagagagaccattggtaagtgtacacaacaacttaacttaaaacaatttaaatctaggtcataaactttgcaagtagttccaatgttttgaaagcctctgttcccaatacagaaccttcttcatatactatttcaaaggaattaattattaatttgtttaaaaagccttgacttaacttttcttacagtgttctgttttacctattatgaaccttattcttgatttttatcagtaaaaaacatatcccccagatatgtttttaacatcttaaaaaagagaaagaaatggtgtctaaaagtgattcttaagttctaggttcctttcaaccagatagtgtagccctgatcattaaaaatagaaaaatgtagattcagacagaaaattaagaaatacaaacacccccaaataatatccaaataccaaattcaagataagtgacatttttaaaaaaagtagtgtgagaaaccttttgttgaggcttagtaaagccctccggagagccaggataggctccttggctctgtaggaattctgggtcatttctagtcgagctacccagtttagagaatcttcttgagaactgtcacctggagaatgctggaaaagtggtttgatgctatgctccaactcacataacatgtgcaatctgaagatagatagagcctatgttaaaatgttatcatattcagccttattaatctcatatataaagcaagtactttaaatcagaaataaagaatttaaaatacacagttgtctttggtagaactttaatatatccttgctaagtaaataattacatttatatcttttcaaactgaatgtaaacaccaatttatgctggtttatacatttggtgctttagccaggcatggtagcgtgcacctgtactccagctactcaggagactgaggcaggtggatcacttgaactcaggagttcaaggttgcagtgagctatgattatgcctgtgaatagccactgcactccagctcaggtgacatagcaagaccccgtcccttaaaataataaataaataaataaataaataaataaaattaattacattaaacttttaaaataaatatttagggatttgcagtgaatcccaaattcctaattaaactggagaatgatggataaaactaaattcaaatgtatgaaaccaaaatttaccacctaaatgaagataaaagaaaatatggatccattataaaccaacatgaggtatttgcatatattgctggtgctactataagagggcctggcatagcagatgatagtaaaaaattatgaaattaatgtagtttttttctaagagtgatggaaactttgatacattcacactagctttttcccccttgtatgatagtcagtgtctatgattcagtgttcaaggtacaaggatatagctgagtagctacagaacagaattaaactcagtggtccaatctctagtttcattaagatatcaccaaacgggttgatactaaatataatgaattcttctaacttaaaaaaacagtgctatgtagtaaatttcttataccttaattacaatatttagtttatcatttttcctcaggtagaattcatagacctaaaatgttttccaacattttcttcttcacctataaaagttaatattctttctagtaatgtgatgcctatatttttggggggaaatatcaaacacatttctaaatgaaaaggaaagggaaacaacaaataccaagcaccaatgtgccaggtgctatagatgtctatattatatttggttatatagaaagcaaactatgacattacaagaggacaaacataagatatttttattatgtttttcattagtctcatagttgcctttccttaaaaggatgtatgttagaattttaactgtagggtgattgtgaggtaaaaagaatgaaagagctgtctagtgtagctatgcatgaaaccaaactcactatcaattatttactcaaaaaaattttccaatcctgtcaggtgacatttataggccagaaatataaaaatggaaattccaaaatacctcacaatatattcatatcctcgttggtaggagcctctttcaaagcttgcagctgaaagaggtacaatttgttctgctctcactagtttcagtgagtcataaaaagctgtgatatctctttttttggctgataataatagctgtcccagtctgacactccatgttgtagattttccatctgaaaaacaaatgaagagtcaagaaatgtcacggtagctgggtccaagagtcagctttatttcattagataaaatggtcagctgaaatatcaaacaggtggcttcattcctttttttttttttgagacagagtctcactctgtggtccaggatagagggctatggcatgattatagctcactgcagccttgaacttctgggctccagtgatcctcccacctcagtctcctgagtaggtgaacaggcatgagccaccatgcccagctaagttttttaaaaaacatttttgcagagacagtctcagtattttgcccagactggtctagagctcttggcttcaagcaatcctcccaccttggcctcccaaaacactgagattacaggtgtgagccaccatgcccagcctggtttcattctactttgaacaactaaacaaggcaatcataaaacaggctaagatattaagtatgaatgttgctaagttacttaagtctgaatatttatgtcatattaaaaccgctttttttttttttctttgagatggagtctcactctgtcacccaggctggagtgcagtggcgcgatctcagctcactgcaacctccaactcccaggttcaagcaattctcctgcctcagcctcccgagtagttgggactacaggcgcgtgccaccacgcccagctaattttttgtatttttagtagagacggggtttcactgtgttagccaggatggtctcgatctcctgacctcatgatccgcccgcctcagccgcccaaagtgctgggattacaggcgtgagccaccgcacccatcctaaaactgcttatattttaagaagtaattttacctgctgccaaatagttttccaccaaatcccactgtgacaatttccaagctgcttccactctgtacgtgtttaattcatctgtccactcggacctattaaaagaaacccatatcaactaaactttaatttatttaaggtgacattcagagatttttcattggtttacatactctatttattatatttattgaatttgcattatattgtattttgttcttagatataaaataattatctctatccagaaactatccagaaaattttaatctttccatccttcaaaaatattttttcactaattacttctgatacaccatttaaaatgacattcttcaacaaattaaagtgtgccatatattagagcagagttaattcctgaataataactaagcccattgtaaaaatagctgcatgcttaatttgaacaaagagcaaggaagaaaaagagccaactgaacacacataaattcagaggtaagcaattccaataactcagaattctgaattaaatttaagacaaaaatacaggggggccagtggtataacttacggacagttgggaggtatctagaacaataccaagagcaaaagaaagttacaatgatttgtcaatggcataacaaagtatataaaactagctacgtaaaatatatacctatttttaaactactttcagttagtttaaaatttgagtttgcaaaaccagtatgatataggctaattattttgttctaagcattctacttaggtgacattaggatgaccagtgatatttgagatcatgactacacagaaaccgctaggctttcctcatgtttcttttttattaatcatactttctgaatttctgccatatgtttagatcctaggctaggtacaattttccatttaataatctaataacactgcatacagcacatatatatccatattataaataaagtaacagagaggctggaatcaatatcctcaaaagttttccttgctctttttattgtagtaaaaacacataaagaaaagacaacaagtgatctaacaagtttcatttttaaaaattctaaaaatagaagctagaggattccaatttctaaatttatgaccaccaccaaaaacagtttagaataaggctaaagaaatacaactgaaatgtaattttcaaaagtccaattttgaaggactttacaagcttaccatcagacaccaaaatataaaaatttcaggataaaaatctcagtagaattaggcagtatttgttatccaactgtgggataacagattatctatgggatatcagataacaaaggggatgtgtcacacgaagacttatagcaaaaagtacaaatggcaatcaggatcaggctgtgagaatgtatccacataaatgggtacattaaaaagaatgataaatagggcaggcacagtcaatattttaggaaaaatatttgtttaatgcaaacagaaattaccccaagaaaaacatgccccatccataatcatttgcttcaccatgacacagcaccccttcattgaatattgacgcatgcctttttcacaacccaaatcaggaggctctatgtatcccagacccaaagagaagaaaagaggagtctgaatgtgtagtctatgtcaaaaagaaatttgacaccccaatttgagccatgactctcccaaatccctgtaatctatttattcataaagtctctcaactaatctggagaaacatatccacaacatataagcattccttctttacttctgtaaaacttcccttgtgatttcataaattccactactgtgataccatctgaccaacagtgaacttctctgcccttagacattgtaaaatgatagtctttatgaatcacagttttggaacctatacaaacagtacttagaaaaggctggcttcagaatctataaaaagctcaaataaatcaacaagcaaaaaaacaaacaaccccattaaaaagtaggcaaaggacatgagcagacacttctcaaaagaagacatacaagcagccaacaagcatatgaaaacatgctcgtcgtcacaattatttgagaaatgaaaatcaaagccacaatgagataccacctcacactaatcagaatggctactattattattattattttgagacaaagtctccctctgctgcccaggctggagtgcagtggtgcaatctcagctcactgcaacctccatctcccaggttcaagcaattctcctgcctcagtctcccgagtagctgggattacagatgtgcaccatcacgcccagctaatttttgtattattttagtagagatggggttttaccatgttggccaggctggtcttgaactactggcctcaaatgatacacccgccttggcctcccagagtgctgcaattacaggcatgagccaccacacccagcccagaatggctattattaaaaagtcaaaaaagatgtagaaggggctgcagagaaaagagaatacttatacactgttggtgggaatataaattagttcagccactgtggaaggcggtttagagatttcccaaagaactgaaaatagaacacacagcaatcccattactgggtatattcccaaaggaaaataatccattctaccaaaaagatacatacactcgtatgttcattgcagcactattcataatagcaaagacatgaaatcaacctaagtgcccatcaatggtagatgggataaagaaaatgtggcacatatacacaatggaatactatgcagctataaaaaagaataaaatgggagctaaacattgggtacacatggacacaaaaatgggaacaatagacactgcagactacaaggggtgggggagggagggaggcaagagttgaaaaactatcttttgggtactatgctcactacctgggtgatgggttcaattgtatcctaaacctcagtatcacgtaatatgcccttgtcactaacttgcacatgtaccctcagaatctaaaataaaagttgaaaaaaaagagaaagaaaaacttggcttcagagtagtccaaaaacagtggcctgtataatctttgtttaactgagatcccattcccttttgaccagattttactgcccagaatagccatttagagtctggtgaataaatcaaggaatacagctgtcagctctcacagcaaagcagcttcaagagcagtgctaatctccacatttaatctccaaactggaagaactactcagccttaatgttttgccacatacatgtattattttttgtttaatttgattttctacaataaacccaccttctttaggaaaggaaggctgctttcacattcatcaatcatttagggtaaaatcaatgcacacagtctacagtggtattccgtaaatcagtcacaacctctagcacggaaaataagtggtactgatactgtaagcagagcatagatgccctttgaggcccaggaagtcccatctgagcctcaccaatagccagtgggttctagaagttccttgtgttaaagcaaatctaattcaaggatggctctttagacagaagctgttaagtggtagactgactatgaaaaacttgaggaaaaaaaaatgttggtgcttatctccaataccatgaaaacacataaaacatttattactctactaaacattaaattacccaattcactaactaaaaattctccattcagatgcaataacaaaagaaaatcattttataaaatattacctgttagcatgcactccattcacctgagtgataacagtagacagctgaccaagacctaacatggactttactacaccatgataatgaatgatctagaaatttaaaaatatttaaaatagcaattatcacttcaataatagcttggggaccaaaaacagtttaactgatattctttaaaaattactatttaccttattgcccttatttttttattattattattattttaattttttgtagagacagggtcttgccatgttgcccaggctggtctcaaactcctgggctcaagtgatcctcctgcctcagcctcccaaagtgctgggattacaggcatgagccaccatgcccagtcacacctttcttaatttaacaattgatttgcttacttacatggcaggacccccatcaatgtcctaacacatttaaagtaacataaataaatgtagacaacatagaaaatctcagattgaagttattatatttttcaatttggactactttttggttcacatccaatataaaaagtatctaatatctttgatattctgtttaaagattgtcatatttctcacataaacattcaagctcaaaggtcctgatgttttaaatatggatttcgggctttagcactaaaaagttaaagaggattatgtactatcctttaaaatgaaaagaagattgtgaaaaataaagaatttatatattgtgcttctgagaaacatgtcaaatatgacaaaaagcaatatcccaaaattagaaagaatctaaaggcaagattgtaaattaatgattctaaacccctttcccattccaatagacacacagcttattcccattactaactgtaactctgtgattctacaggaccattttagagacgtgcaggtgggtgagtaggtgtataaaatatgaaaatgtttctcaggctatggagaatccctagttctacaaactgatccatggcttacacttttaatagcaaactaaaattatatacattttagagttattaaatgaacattttaatacagatatactccataataaatcttattcatttaggggatttctaaagtcatataaatatagtattggaagggaccttttttttttttgagatagagtttcactcatgttgcccaggctggagtgcaatggtatgatcttggctcactgcaacctccacctcccgggttcaagcaattctcttgcctcagcctcccaagtagctgggattacaggcgctcgccaccacacccagctaattttttgtatttttggtagagacagggtttcactatgttggccaggctagtctcgaactcctgacctcggggaatccacccgtcttggtctcccaaagtgctgggattacaggcatgagccgccgcatccggcctggaaggaatttttaaaatcatctagtaaagtctctaattttatctgttaggaaactcaagcttagagagggttaaatattttccagacactcagtgacactgacagaaacagtattaaaactaaggtttcggctggatgtggtgtggtggcacacgcctgtaatcccagctactcgggaggctgaggcagaattgcttgagcccgggagacagaggttgcagtgagccaagatcatgccactgcactccagcctggccaacagagcgagactctgtctcaaaaacaaaacaaaacaaaacaaaaaaaactaaggtttccagagttcctattcagggctattttcattacagttgcctttcaattattatcttacctggtctggttctagctgaatagccctgtcataacaagcagtggcatccctcagcaagccaaggctttcatgttcaaggatctgttcttttagagatggttctgcctttctaattgcactgactccggccactccatcaggttcatgcatagcagcatacaatttctttgttcaatgattaaaaaacaatcaaaaacaagaaaaaaacacaactggaaataaaactataaaaccacctgtttatattgaaacagcaattttttgagaaatttttcctcaaagtaatagtaagcatttgtttcatggcaaagtcacagtaaaattataaacttatttccaggcattctattccctcaacattcttactccttttaaatacaaatctatatcaatagctgttattgatcataaggtttataaagaacctcaggatcctaaaactgtctagatccaaatgataacatattctgttgagtatagcttataagagttttattgaatttttaaatttttaaaaatgtaaataaccattttaatatattgttattgagatgacttcaagaaaaccaagacagcaatctgggctcaaaggagatattcaagctaaagataaaaatttaggaatcagttagcacaaagacagtctctcacaacatgagaaagaatgggatgatctaggaaatggataaagaagaaaagcagactgacgatagagattagagtttctacatttatcaagaaggaagagctggcaaatgaaacaggagaagtgagataacttggaagaaaactggagaataaaatatcccagaagccatgggagaaaagcaaatgatgtcttaatgagaaaggcatggtcaatgatactgaggttaagaaaatgagggctgggaaaaatttactggatttggtaacatgtggccaccaattttcttagcaagaatagtgtcaacagaaaagaaaaagagaagtcttgttgaaatgggcagagtgaatgagaaacaaagaagtgactgcagtataaagaaactagacaattccttcaaaaactggttgtgaagttccggaaacagagagatgggatgtatctaaaggagaaggtaggatttaccagagcatgtctatatgctccatatactctggttcccaaagagaaattaattacactagagaaagaaggaatatatgaagaagttacatcttgaaattgagaacacaagtagaaagattgaattttgacaggaagaaatccttccttaaaaataacagaagaagccaggcacagtggctcatgcctgtaatcccagcactttgagaggccaaggcaggcagatcacttgaggtcaggaggccagcccaggcaacatggaaaaccccgtctctacaaaaaatacaaaaaattagccaggtgtggtagcagcgcctgtggtcccagctgctcgggaggctgaggtgtgaggatcccttgagcctgggaggtggaggttgcagtgagccgagctcgtgccactgtactccagcctaggtgatagagcaagaccctatctcaaaataaataaataaataaaataacagaagggaagaaaaagaatatggtgcagatgctgtttcatttgcagatttttcctaatgaatcatgaagcaagattgtcagctggaagcagggaaacaaagtgaaggtaagagacagtcatcttgacaaaggggaaagtagccttactagagaaacacagccagcctgaaggtaatgttagagtcctgcagttttaaagatgtttgagatcatgaacttaaactgaaaccagttataacacccactgtgtaatttttctccagctgcttacatggttggagtttgacaaacggagtacaacacagtgggaaaaagacaagaagttgagcatcactctaagggaacgattttaaccatgaaccatagacttaaagctggacaaggaggaacacaaagataggaaggggctaatattcatcttaagactgcaagttactaattttctagttattttatcacactttgctttttgatttgaaaagcccaccaatcttgagctcttatttaattccactgtattcgcctcacctgctcttactttcttttcttccctacacaatcataacatcgcctaaatcattatttcaccagcattttcatgcttgatacctgacataaccggcacttgcccccactaactcactcccaaattcaggaccacaactctcacaaggagaagagtaattccttgaatcatagcccttccaaactcctcctccacaactgccacaggcatttagctaaaattccattgtgaccataacacttccctagttcgcaccctccaagaagtttgggcaacttaaaaagtcttctattatttgtgatctttcctctaccattccaaaaccgacactttactctttggcatataccatgctcttttcaaacactccacagagatgcctctgattataatgtcttgcctccctatactgctcattttttaagacaccatctccaagaagccattcctgacctctggctcatccgcttccatctcccaccctattccacatggatgagttaagtgtccttcctcagggtacatgtgtgttactgtacttaaaatattataccaaattgatgtttatctctccccactaatctataagcttctaagcatagcatataaaacattcaataaaatgaacaacataaacataaaagactggccacattaattttcattattaaattcactatattaacttcagacctgtaaaaatccaagatgttcctgaatattttgcttcttttctgtaataaatgattcaaagtgcattacagctcgtgtgtatgctttggagcgaaaggaagctactgccagagtatcctggggtatgaggtctagaaaacgggttacactctgatagtcttcataatccacagtagatactagatcataaaaaaagttgagtaattaaagacttataagataaaatttaaaagtgtcaatttaagtatttaagttcaatttatttcactaaacaaattaatctgaatatattaggatatcatatttagaatgtaactaacaacagaacaattgttcagagagtcttgctccaactctgccattataacttacctttctttggacagtcatttaatttactgagcctctatttctttacctataaaaggaaaatgttagtacctgtcttgccttccttacaacgttgttggtgaggattaaatatcaatctattattaaattttgaaaagatataatgatgatacaaaagatacaagattagtcattatttttgatgactataaaaaatgattaaatgtagctattttgtagggaaacttcaaaactatggaaataatcttttttaaagtttagaattcattgttatccacctattttttcttggttgccaaaaatacagtatcacctattacaatagaaattgaaagtaatggctgggcatgatggttcacgcctgtaatcccagcactttgggaggccgaggcaggcggatcacaaggttaggagatcgagaccatcccggctaacacggtgaaaccccgtctctactaaaaatacaaaaaaattagccgggcgtggtgacgggtgcctttagtcccagctactcggggggctgaggcaggagaatggcgtgaacctgggaggcggagcttgcagtgagctgagatcacgccactgcactccagcctgggtgacagagcgagactccgtatcaaaaaaaaaaaaaaaaagaaagaaattgaaagtaaaagtgccttcaaagtaaaaccacaagtactttaggataatttttcaagagtgtacaaaaagacaaaaattaaaaacttctaaatgaggacagtctagtttatgaattatttaaaacttctaaattttaatgattcataagtgtgtagaaaacaggcaacaaatttcttcaaaatttaaataaggcagtatattttatttttatttatttacttactttttaaaaaaaattattttgatctcattctcactgaggctgcagtgcagtggcaagatcatagctcactgcagccttcacctcctggacttaagtgatcctgcctcagcctcccgagtagctgggaccataggcatgtgccaccacgcctggccaagttttgtattttttgtaaagatgaagtctcattatgttgcacaggttgatcttgaactcctgagctcaagtgatcctcctgcctcggcctcccaaagtgctaggattacaggtgtgagctaccacacctagcctaaggtagtatattctaaacagattatatttaaaataaggtccttatttccatcaaaatttgtagatgatttcaaattctgattttttttttttttttttttttttttttggagacagggtctcactctgctgcccaggctggagtgcaggggtgtgatcttgtctcaccgtagcctcaatctcacaggctcaagcaatccccacacttcagccttgtgagtaacctaggactacaggtgcacaccaccacacccagctaatttttgtattttttgtagagatgggggtctctacaaaaatgttaaagaaatgttaaaggtattgtacttttgaatcattacaaatgttattcttaaaagctagaattttggccaggcacagtggctcacgtctgtaatcccagcactctgggaggccaaggcaggtggatcgcctgagcgcaggagtttgggaccaccctgggcagtgtggtgaaaccctgtctccattaaaatacaaaaaattagtcgggtatggtggcatgtgcctgtagccccagctactcaggaggctgaggcacaagaatcgcttaagcctgggaggtggaggttgcagtgagccaagatcatgccactgcactccagcttgggctatagagtgagactgtctcagaaaaaaaaaaaaaaaaaaagctactgtcactgaaaatggtgataatagagtgtttggttttacagtaccattttgacatgcagaaataaaaactaacaggctggttgtgctggctcacacctataattccaacactttgggagatcgaggcagatggactgcttgagcccaggagttagagaccagcctggccaacatggtgaagccccgtctctactaaaagtacaaaatattagctgggcatgaggcatgagaatcacttgaacccaggaggtggaagctgcagtgagccaagatcacaccactgcaactccagcctgggcaacagagagagacttagtctcaaaaaaagaaaaaaaaattaaaaaacaaacattcaatagttaaatataaaaatatattaatagccacattccagacaaaaacattctccaagcaggtaattattggcaagtccaggaaatttcagaaaaataataaactattttgcttaacaacaggaaagtatctgcttcaacagaacaagagggagatgctcacaaactgagaattatggaagtgaaggcctctttaaggactgttagatagtttttcaattagcctgaaagcctgaaggaaaaatacttgatgtctgtgagaacagctaaggtataaggccagattataaccatccacttattgccaagaatggaaaaaaaaaaaaggttcaaagaaagtaagaatatccattagtgtgtgatgaatataattcttctcatcaatgcttatatcatagggacaaattagcagttgtcatttttaaatcaagattcttcttagtgaaagttgtaatatcacaggaaaaaaacagtgcaaggtaagatagagcagggtgtagtgtagtaatgcatactaagcatatctggacagctggctagatatcaaacactactagagacaagaaaaataaataaataaaaatagcttctctttaggccatgaaataaataaaattaaaatctcccttgaaatttaaaacttaaatgtgaaaaagattacaaagaatattttccaagtgaagaatgacaaagaacagagtacacacatacacacacacacacacacaaaaactgaggaaacatataatatgttaacagggaggattaggttaataacaatattagcatctcatttatttcacattttataatttatctgttcatcatctcatttattcctcacaataatctcctaagggagataatattaaccccattttggccaggtgtggtggctcacacctgtaatcccagcactttgggaggctgaggtgggtggatctcttgaggccaggagttggagaccagcctggccaacatggtgaaaccccgtctctactaaaaatacaaaaattagctggccatggtggcacacacctgtaatcccagctactcgcaaagctgaggcaggagaactgcttgaacccaggaggtagaggttgcagtgagccaagatcctgtcactgcactccagcctgggcaacagagcaagactccatctcaaaaaaaaattaataaataaaaataaaaatattaaccccattttatacaaagaaaaaataaatatgtgccttgtcgaagtgagagtaagaagagagaaaggtcttattactataaattcactgttttttctcagtgaaaaggccacactattacccattttaaaaatacacaaaacagctgggtgcggtggctcatgcctgtaatcccagcactttgggaggccaaggcagatagatcacctgaggtcaggagttcgagaccagtctggccaatatggcaaaaccctgtctctactaaaaatacacgaaaaaattagctgggtgtggtggtgggcacctgtaatcccaactacttgggaggctgaggcaggagaattgcttgaacccgggaggcagagattgcagtgagccgaggtcacgccactgcactccagcctgggcaacaagagggaaactccatctccaaacaacaacaacaacaataaaaaacatgaagcaaggtattttttaagctagtgcttaaattatagaactgataaagggaagagctaattggtgaatagctaaaaaaaaaaaaaaaaaagaaacagaagtgataactcacccattgagtctaccttatttctgtttgatttgctgtgtggacatttctcagctttcagtgcctgaaatttgtgccttgcccactgtgtgagatggtcaagcatggagaacacagtctgtgtactgagttgacacagatcagatgcaatgtcttgggtatttatggtatgctgatcgtcatgctttagaactgccataatttctgcataaacctatgagaatcatttataattaataataatatctatataataccatttaactattatatgacatctaaagctaaccattctaaggcaaaaattttcaaaagaaaaaacacaattggccaggcatgttggcctgtaatcccagcactttgggaggctgaggcagcccaattgcctgaggtcaagaccagcctggtcaacatggtgaaaccctgtctatactaaaaatacaaaaaaattagccaggcatggtggcacatgtgtgtaatcccagctactcagaaggctgaggcaggagaatcacttgaacctgggaggtggaggttgcagtgagccaagagcatcactgcaccccaacctgggcaacaaagggaggctctgtctcaaaaaaagaaaaggaaaacacaattgatcaataatacattcctctattgttcttatctataattaaatcaatccaaatattagtctaaaaagaaaatatgttaacgactaaagaaaattttaaaaattttaaaatattctagattattcaataaatgataatgaaactttgttaacagtgaaaaaaacttacagtaatatttcacactatatgcaaaattaagttcagagtaattgaagactaaatataaaaacagaaggattaaaagaaaatatagcaaataagttcatgacattagatgaggcatcacataaaaggtttaaaattaataatctataaaagatgtataaattttgcatttacatttaaaatttctgcgtggcaaaatgtgaaaaggttaaaaagaaaatgactaagttggaataatttttgaaaatatgactggcaacaaattggtagctagaatatacatagaacgtctatcaattaaagggatacacacaccaaacaggcaaagatatgtaaatgaacatacatagccatacataggtctacatttcctactaataggtagcctttctaatactaattacattggagaaagtaagtttcacatgttcaaaaaccaagtaagatgatttatctcacctcctgctgatcttcttgattacaacccagtaagacatacaccagaatatgtggaagaagatagatggtcactttgaaatcatgcttcatcataatgctacagcaggtgaaaattttactggcaagatcatgtcgaacctgtaaatgcaaaatgtgtagacagtaacacactttcacatattgattaaatgtcaaagagtagcatgtgagataatttatcacaaacgagtattcatttttaaatttaaaaagttttttaattaattttttaattaaattatttggggttaaagtcaaattttgttatgacttaacttttgatttgctaacactgttgaactcataaaattttaaagagattttttcttcaaatacaaagccaaaaaacaaaaaaaaacccataatattccagagctgaaaatagttaacagtattccacatttcacacattatattttcagtatattcattaaaaaaagaaaatgtcagccgggcatggtggctcacgcctgtaatcccagcactttgggaggccaaggtgggaggatcacgaggtcaagagatcgagaccatcctggccaacatggtgaaacccagtctctacaaaaaaaacacacacaaaaattagctggtatggtggcgggtgcctgtagttccagatactcgggaggctgaggcaggagaaccacttaaacccgggaggcggaggttgcagtgagccgagactgcactccagcctgagtgacagagcgagattccgtctcaaaaaaaaagaaaatgtcttgaagttactaactacgaattagtataatgatattttaaaacactaacagaaatgttaattaaaggtggggcacggtggctcacgcctgtaataccagtactttgaggggcagaggcgggcagatcacctgaggtcaggagatcgagaccatcctggctaacacggtgaaaccccgtctctactaaaaaaatacaaaaaaattagccgggcgtggtggtgggcacctgtaatcccagccacttgggaggctgaggcaggagaatggcatgaacccgggaggcggagcttgcagtgagctgagatcgcgccactgcactccagcctgggcgacagagtgagactctgtctcgaaaaaaaaaaaaaaatacaaagattagccgggtgtgatgactcatgcctgtaatcccagctactcaggaggctgaggcgggagaatcacttgaacccggtaggcggagacttacagtgagccgagatcgcaccactgcactccggctgggtggcaagagcaagactccgtcacaaaaaaaaaaaaaaaaaaaaagaaaggtaaattaaaaacaaaaattgtaaattttaaatatactgtaaacattttcttggaacacagagtaccttttgtctatccagcatgtaaaaatttctcattaaggaaatagaaatatacctgtttttctatgaaaattcattgtaaaaatctttatttttattttagagaaagttcagataatataacttcttttagaaatgctattagagtataatatatctctttattgaatgtctttttattatgtaaaaaactctgacatagcatttacatccttttacatagtattattttacaatataaaaggaataaatgtaattttacacacacattaagaccatagtaattttcttggtaaaacaattacttttcactcagaagctattattagtaactacagagaaattattattctctattagttaacattttcttcaaaaatttctatgattatcagcacaaatacttcaatgattattgtgtgtgctaggcattcagatagatgttctggtttcctttagaatttccattcagttaacaaactgaacagggtttcttacctttgtaataagataacctgcccaagatgctgaccattctgcaaagttactacccaatttacttaagtaaattggcttctttactccagaccaatcggttgacttctgagaactcttgtatctgtaattttgaaaatttgtttattaaaaagataaatccacctgtttagaattttagtaaattacagcaactccttcagttgactacctcagtactgccttgcctttactgcaatctgcttacctttttccagtatccttcttaggggtgaagtaggtcattcttggacacctaaagtacttctaaggatttgagtctgccccctcctcttcctcagatccttccaactctcttcttatataagaaaaacctgttcctttgaagttcaagccacccaggtatactaccattttctactcctcattatgggtaactatgcaacacactgattaccaaactcattgataactttagaacactgctcagggttttctttcttcccagtgttattatcatcctgggtgacttcagtgtctagctggagcacttaatcaagctcagaagtttccaatgactttcttctctacttatcagggctcaggaattatcagggctcccatgctaattcaaagaatttcttcactttgaaatcaattatttagacatctcattgtatggtcatagtttcctaaatttccagttttttcacccagttattccagcacacccattctctcttgttgagatcttctgttccgtgaccctgctaagctctcctgatctatgacacccctgtctctttgcctctttccacaaccatcttagtctgtatggtccttcacttctagcattctcttggtaatatcctctacccactccattgccacactgtcttttccagcggtattcatctgctaacctcccaaccttgaatcagtctaaatatttgtctttactgaaatgatactcaggctactgcactgatacaggaaaatcactaacccacttataagattagtactactatgtattcttagtcttcaaagtcagtgggccgctaaagttacagaattccttctacgttttcattattggctctcttctgttttccagtgattatttcaaaccatcaccaccctcctaaagtcacctacaccaactccattgccactttcagccaatgaggtcatctcctatacctcctacttcacagagtaaaaacaaaatcattgcttcccgcaatgaaatctgtaaacttagctgtgttccatccattattttatctttccctattgcaaaaaaagagatctattccttctaagtataattccctataagggccacggctctcccattccggatgctccttggggtccttactacaccaactatcacttctctctcacattacttcaacatgaccctttctatttgttcctcagcattaacatttaaacatgttcacacagctctcatcttacggctacctgtgtgtaggatttttttgaatggcatgggtttctttcaaatcaccaataaaagcttaggaaataacaaatgccctatacccaaagtcttatacccaaataatatatatatatatatatatatacatatttcactgtattccaagtttctaacagttgaaaaatccaataatctctcagttaaccatcacactaaaccaggagaaaaaattcaaatccctattttgaatcatcacgcgtatagttctctggatgatttttatcaaatttatagtaaacttagctagaaaactactgatactgggatacaagccaggctctgcctagtcataacctgatgttttctcctaaagttatttctatggtgattttgaactgcagttgttctatctggttctaaatttcagtctcccaaatacagccatcctttaatccagatttagtgattatatataaagagcccaaattaaaaaaaaaaaaaacataaagtagggagtataacttaaaggcagcaaaaatatgaatatgcttttaagaaattccatatttccctaggtcctctggagtaaatatcaagcagtccaagctataaaattgagctacaggctaacctggtattttagtttttcatacaaaagggaatcaacgctattgaaaacgcactctatcaacctcttaattttatgtggctccaatttcaataagcagatcccaactaggtaaatctcctaacttccatcattgaggaaccattcgagaggttattctaactgctcaggtataaaagctaaagaccaaaagaatttccattgctttgttaagatctacttttaaaagaccacttaaaagttgcttcctatgaaaaacatgacaagtaggcagaaatgttggcttctacttcttatgaagtatatgatagccaacctcacaaattctccccccaaaaacaaagaacttattaagcaagctaggattgaataagcatttattattgagtgtcaactaaatatcaggcactttgctaagtacttttaatattatctcctttattcctaacaataatcatacaaagtgggtaaaattatccatgttttcaaaattaaaaaattaaaacctggaaatgttaaataacttgcccaagacttcagagctagcaaatgcaaagccaacaatcaaacctaagcctgtgtgactacaaaggtcataaactttccagtagattacagaaattctttgacatctacaggtgctatacaaaatacagactaagaaaatgggggaagtatggagtcctcaaaaatgaaaatccaaattttaactttagtctttaactttactttttaaataatgctaatagtggccaggtgtgatggctcatgcctgcaatcccagcactttgggaagcccagacaggcagatcacttaaggccaggagaccagcctggccaatatgatgaaacttcatctctactaaaaatacaaaaagtagccaggcatggcggtgcacgcctgtaatcccagctacttgggagactgaggcaggagaatcacttgaacccaggaggtagaggctgcagtgagctgataccgcatcactgcactccagcctgggcaacagagtgagactctgtctcaaaaataataataataacagtaataattcttctttaataaggctaataataataatgctaaataatcacttctttaataatgctagtcataagacataaaatgatgtttaaaagatttctaagtataaaaaattatctaggaaataaatatgcatacctctgggcttttataaagactgttagtataagtctaggcactttctaaggttcaaagaagttatttgtccaaagtcaagtatctaatatgcatgtgtacctagggtaccaaaaagtagtttctaaatagaaataatttatagttgtatggatttttttcatataaaatgcttcatgtatttgcatgtcatcttgcatatttcgtcagtcctaacaaagtcatttaaattttttaagagattaaatacatttttttaaaagcagagggtgaaaatatattcatgaggagaaattgggagtaatgaaaatctttaattgggcctactaaaggctttctgactagctttaaactttaaatttctgtattacttatacctatcaaagaattcaactcacattcagcttaaagtatattctttcaatttactaccgaccattgaacttttaaaaaaatcaatccttttaacttcaataaatttatctgaatatttaaagttgtagaatttaacccaatgagcagactgcacttctcatctagacaaattataagcataaatcatagtgaaaaatatacatgaggagatactaaaacacttttaatgttaaaaaactatatcaaaaatcacattaatttttttttttttttccaaacaaagtctcgctctgtcacccaggctgtagtgcaatggcacaatctcggctcactgcaacctctgcctcctgggttcaagtgattctcctgccccagcctcccaagtagctgggattacagatgtgcaccaccacgcccggctaatttttgtatttttagtagagatggcgtttcaccatgttggtcaggctgatctcgaactcctgacctcgtgatccgcccgcctcagcctcccaaagtgctgggattacaggcgtgagccactgcacccggccaaaaaaatcgcattatttttatataattaaaaacaattttatgaaaatacattaaataagcctacatacctggtatttagatgaggttctagtatttcccgaacatgctcaggaaatctcctccacaattggtgacctgggccgttggtctccatctctctacagtcataaatagaaagcaactcctacaaatacatattttacatttgtaagtccacagtgaagcagataacgctttatattcgtcaatgttctacatatcttagttataaaaatacagccataactcattttattgcacttcgctttatttatgcttcatggatgctgttttttttgtctgtttgtttttttagaaatagaaggtttgtggccactatgcatgcagtaaatctatcagtgccattttcccaacaacatatgctcacttcatgtctctatgtcgcatttcggtaattctcaaaatatttcaaactttttcattattactatatctgttatagtgatatatgatcagtgatctttgatgttactgttgtaattgctttggggctccacaaactgtgcccatataagacagtgaacctaatcgataaatgtggtgtgtgttctgaccagccgttccatccccctcactctctttgggacttcatatttccaaagacataagaatattgaaattaggccaattaatgaccctacagtggcctctaagtatacatatgaaaggaggaatcgcacatctctcactttaaatcaaaagctagaaatgactaagcctagtgaagaaggcatgtcaaaaacctagacaagccaaaagctaggtgtcttgcacctaacagccaagtataaatgcaaagaaaaagttcttgaaggaaattaaaagtgttactccaatgaatacatcaaatataagaaagagaaacagtcttatttctgatatagagaaagttttagtggtctggataaaagatcaaactagccacaacattcccttaagccaaagcctaatccaaagaaaagccctagttctctccaattctatgaaatctgagagaggagaataagttgcagaaaaaaagtttgaagtgatacaactcaaggggcgcttcttaaaaaacaaaaaaaaacccaaaaagtttgaagcaaacagaggttgcttcatgaggtttaaggaaaagaagctgtctctataacataaaagtgtaaggtgaagaagcaactattgatagagaagctgcagcaagttatccagaagatctagctaaaatcattctattctgttggaagaagatgctatccaggactttcacagctagagaggagaagtcaatgcctggcttcaaagcttcaaaggacaggttaataactctcttgttaagggctaatgcaattggtgactttaaattgaagccaatgctcattgacgattccatacatcctagggctgttaggaattaggctaaatctaaatatatgcgtctactatatacccataaaaattgaaaattagaacaataaaagtaaaaaaaatttaaaaataaaaaattatgtgaaatctactctgcctgtgctctataaatgcagcaacaaagcctgaatgacaacacatctgtttacagcatggtttactgaatattttaagctcactgttgagacctactggtcacaataaaagattcctttccaaatattactgctcattgacaatgtacctgtcacctgggagctctgatggagctatacaaggatattaatgttgttttcgtgcctgctaacacaacatccattttgcagcccgtgtatcaaggggtaattttgactttcaagttttattacttaagaaatacattttataaggttatagcggccacagatagtaattcctctgatggatctgggcagagtaaactgaaaaccttctggaaagaattcactattctagatatcattaagaacgttcatgattcatgagaagtcaaaatatctatcaacattaacaggagtttgaaagaagttgattccaacccctcctggataactctgagaggctcaaaatttcagtggaggaagtaactagagatgtgataaaaacagcaagaaaactagagttagaagtggagcctgaagataggactgaattactgccttctcatgataaaacctgaatggacgaggagttgctttttataagcaaagaaagtggtttctggagatggaatctactgtggttccactcaaaatgctgtgaacactgttcaggtgacaacgaaggatttagaacattacataaacttagttgattaagcagtggcaaggtttgagaggactcattcaaattttgaaagaagttctactgtggggaaaatggtatcaaacagcatcacaggctacagagaaacctttcatgaaaggcaactgatgtggcaaacttcgttgtctgatttttttaagaaattgccacagccattccaaccttcagcaaccaccacggtaattaatcagcatcatcaacattgaggcaaaatcttccaccagcaaaaccattatgacttgcgaaggctcagaagatggttagcattttttagtaacaaagtattttttaaataaaggcatttacattggtttttagacataatgctattgcacacctgacagactatagtatagtgtaaacataatgttaatatgcactgggaaactgaagaattcatgtaacttgctttatagagatacttgctttattgtggtggtctggaactgaacccctactatctctgagttatgcttgtacatagaaaaataaacagaattttatagttttagagctgtgaacatccttaggacatttatttcaatgcctagaatgatttaagtaactcatttaagtcacaaagctgaggcagtagtatatatttgtatatacatacaaaaattttgaaagtaactatacctataataattggttaagaggtatgcttctgtactctaaaatgtttatcatgaacttgtataactttgataaaagtgagaattaaaacaaaaaggagtttcacaagtatagaatttacaacgttcttatttgaattaaacaatttaaagccagtaatgactatatccactcttacctgaatggcataggcagctgaatcttgagctcggctattatcagcatacgcaaggtaagctcttgttagctccatcaataatccataggcaaagcttgaatcttctactccagtctcaatcagaaaaaaaaaaaagaaaattccaggataactgctataaattttcttaggtgtactgctttttccatggtgaatttaacttaactgcgtaagtgaatttaacttagacaaaggaaaagacagtgaggttcaaactaagtttggtatcaagactacaatataatctgtagctaaaaagccaaaatgtaaagctttttaggctatttctaaggtgtacaaaaaattattcaacttttgcatatctctgacaatttgcattgtttgttttttaacccttaaaaagcaaaatgtaggccaggcatggtggctaatggctctaattccagcattctgggaggccaaggagagcggatcatgaggtcaggagttcaagaccagactggccaatatggtgaaagcccatctctactaaaaatacaaaaattagccaggcgtggtggtgcacgcctgtaatcccagctactcgggaggctgaggcaggacaatcgcttgaatccaggaggcagaggttgcagtaagccaagatcgcaccactgcactccagcctgggtgacagagcgagactccgtccaaaaaaaaacacaaaatgtatacatagcatctcctacgttgcattctgtagagcccaagagtcatctgagaacctctaaggaataattttaatatacgcatatagtataactcttggagatatagtcttagagattcacaatgcacacagatacattaaaagtcacattttttttaaaaggtcacatttaattttgttctatatggagttcccaaactcatttgactacaaaacattactactgtaatatcctggaaactagttatccatggaaacactagcaataatgtttaaaaagtaatatttaaataattgattaggctttaagtattgtcattattatattaggaagctttatttacaagaatataacaccctagatggggttcaaactttattgcttttggctaaaggtttctgcaatagtaaaagaaataaactcagaagttaactgattgtctggttctaggtgaagcttttattaaggataagctgaatagttctttgtaaatgaaatatataaacctcaataggacagagaactcttttgtcattccaaatttccactacttaccacaaatgtaaaatcttttccttgagtttcagttgttgagaaatctaatcgacctggatctatcgcccccaattcccctaaacattccccacagagcaaccgagcttgagagtttgcatcttggcaacctttcaaaagcactgtcaccaactgtgagataataggttctactgtttcactgtctgttgcatactttatcagtttttcctaaaataaaagtagaaagaaaatttatacgtaatttctacaaactagtatgttttcctgagctaggaagcttaaaaatattaaggaatatctaacataaatattgacaaaattaaatttctgtatctgcaattttttcagctagtttttgatgagttcacataatatagttcaacaatatgtcctgtacaattagaatcattaaatgtctgaaagtctttgatcattaatccattaaacaagcagttactgtgcattttatcaatatacaaaaaatcagtaaaacaagtcttaacaagttcacagtctaagaggaaaacagacaaataactaaaatatcatatgatatgtacaataacaaatatacttgtacggcaaagaagcaatgaataagaaaaaacacagagtaacttttaaaggacagtggacagatatttcagtagataagtggaggagcaactattaggttaaaacaagaagtttgaaaagtgtataacaactagtaaagaaggaaaaaagatataaaaaagggttctgtgaggatggaaaagagggaggaagaaagaggtagcctaatgataaatatgtcaattcaaatagtcttttttcagctatctcttcaggatgctgtaatgaataaaatgttaagtaagaagaaacaattctcaagccagtgaagatttagaccttgcacttgtgtgatcactttaaagctacttcatttatattattttctttctagcacaagtcaagtgtataggagcatctcaaactccatgttagaactgtaatgagtaatacaaattactgtaatacatttcaaaagaaaaacgaaaagacatttaatcttatccagaatcttcaatagctgatttcttaaataacattacaggttaattcagctgtaaagaccgcctccccacccccacacatacacaccctggtaatcagttaaaagtaaaactcagataagaagtgtcactttttatcatatactaaatgtccatatgtacttgggtctatttctagacctcctattgtttcccactggtctggttattcatatactagttacctctttgttataactgtagtggctacaaagtatattaatgtttggttgggctactatattctcataacctttttttttacagggggagtttactagctattttttacatgttttatttttccatatgagcattattataaacctcctacagttaaaaaaaaaacaactttggtgacattttcattgggattgcattccattaattaacctaaggagaactgaaatcgttataacatcaacctacccaataataagggattgatatagcttaggtatctgtccattccaaatctcatattgaaatgtgacccccagtgttggaggtgagatctggtggcaggtgtttgggtcacatgggtggatccctcatgaatggcttggtgccatccctgtgataataagtgagttctttctctattagttcaggtgtgagctggactccattagttcaagtgataactggttatttgagagtatggcactcctcccattgctttcttgctccctctctcaccatgtgatatgccaactccccttcccctttggctatgagtaaaggctcaggcttgctgaaaccctcaccagaagcagatgctggcaccatgcttcttgtataggttgcagaaccataagccaaataaacctcttctttttaataaattacccagcctcagggtaatttactataattcctttacagcaaagcaaacagactaaaacagtgatggtttccatttagttaaatctattacccttttgtgtctttcagaagcattttaaaatttttcttttgttggtgtatgcatttcttgttaagtttatactcaactatattgttttcctgttgctattgtaaatggggtattccaaaaaaatttctacctagttaccacttgtcatatgaaaattattaatttttatgttaattttatatcccctattttactgaattcatctgtggtcaagttagttttatcagtaattctctataatttccgaagtatattagcataagaaatggagataattttacatcttttccaattcttatgtctctgattatcatatcatctgtaaatatagttttacatcttttccaacttttatgtctgattgcttttttccctaaattccttagccaatacctccaagtgaacgctaaatagtgcagataataggaaaccttgctttcagtgggaatgtttcttgtttcccattaagtatgtgtatatatgtactatgtatatatatacatagtacatatataaacatgcatacatatatgtacacatatacattaagataatattcatcaatttctgttttcttgagtgttttcatttgaagtaggtgatgaaatgtgtcaaagtctattcggcatctatggaaataatagcatgattttctctttagatctattaatatagtgaattacattcgtggattgctaagtattaaccatctttgcaatactggaataaaatgcaactggtcatggggtattgtgggtttgtttttgtttttttttttttgagacagggtcccgctctgttgccctggctggaatgcagtggcatgatcttggctcactgcagcctcaaactccccaggccaaggtgatcctcccacctcaacctccaagtagcttggactttaggcatgtgccaccatgcctggctaatttttgtattttttgtagagatggggtcttgctatattgctcaggctggtctcgaacccttgggctcaagcaatccatctgccttggcctcccaaagtgttgggattacaggcatgagccactacacccagcatggggtgttttcttaatgtgaaattgatttgtttgataatatttcatttataaatttttacactgatattaatatgataatctttaattttttgtttcatgctatcttttttcggtctactgaacactgttatatattgccgcttttttaaaaatggaagttttctttcatttcctatactccaggacaatttaaacaccactgagactatttagtttgtgaaaatttgatttaaaaatccccttatctgggcctggtgctttcctatggatgaagttcttttataatattctctatttctcctacagaaactaatcttttaagctttctatttcagctagagttcattttgatacactatatattccaggaaaagtatacatgtttacaaatttatttgtgtaaaagggtacaaagtagtctcttgtgatttttaaataccttctatgtttcaacagtttattatttacatatttgacatttaccaatttcgctagttttttgctagcatttttactcattaattaattttactgctttctgttctctatatttctgcttttatttttattattttcttcctgtactatcttttcttaaatagttttaataaaatatttgtttcacatactataaaattaactcttctaaggtgtacaaatgaatggtctttagtatattcacaagttttagtataatgaagtatatcacaagtgcaaccatcacttctatttaatttcagaacatttttaccatctcaaaaggaatctgtacccatcagcaatcactccccatttcccccaaacctcctaaccctaggcaaccattaatctactttctatctctatggatctgtttattcaagaataccaaaggttgccagcaaaccaccagaagctctcaaaaggaaccaaccctgccaccaccttgatctcaaacttctagcccatgggagctgtgagacaataaatttctgtttctgttgtttaaagtcattcagtttgtagtactttgttatagcagccctagcaaactaacacaaagatccaactaatacaataatcaatttttatgaatgttctatctgctctttaaagtatgcttctattatcaaggtgtaacgtctgacatatattcacaatagctactttattatgttatttagatcttctacgtatttatctactaacttattttatactgagaataacatggtagtctcctctgattgagtttctatatatatcttcttaagcttcttattttggctttatcaaggtggctggtgtgttatttggagcatattcataactattaaatcttccttatgaattatggcattaagcattaaaaagtatccattttggtcatatttaatgcttttcagcttcagttctattttgtttggtggcagaatgagaattcctgctttcttatactttccacttatctggataatttttgcttatccctttatttttggcctttctgaatcactttaggtacgtatcttgcatgtggtagagagttgtttcttactttgtaagccaatttgtaaattttttaattttaaggttgttcacacttattaatgtgactcagatgcttggctacaattctgtcagattttttattataatacaatggattataattataatacagtatactataattagtgctttcttccctctatcctgtttcgtgtttaaaaaatcatttatttgggtaaggatgacagtttatacttttgttctggaattatcatatatatatatatatatatatatattttttttttttttttttttttgaggcagagtctcactgtgtcacccaggctggagtgcagtggcgcaatctcggctcactgcaacctctgcctcccgggttcaagcgattctcctgcttcagcctcctgagcagctgggattacaggtgcgccatcatgcctggttaatttttgtatttttagtagagacagcgtttcaccatgttggtcaggctggtcttgaactcctgacctcgtgatctgcctgccttggcctcccaaagtgctgggattacaggcgtgagctaccgtgcccagcctatccaatatattaatacctttaatattaattaaaggtgaaatattatttaccttaaaggtaaaataaaaattaaggtaattttttgaaatacctacactccctcttttccttatttgactttctataactagtttgccggtgtaaaatggtatattttgacttccagttattgcctatgcaacaattactgagcttatcttacttactccttactctcccccttctctcatttaaaaaaattgcattatttctagtttattagaatataacatttacatataattatcccacacttgccctattgttgttttagtcttatatatttcgttaaatacataaacagtaaccatcagaccttttgccaaagtctgcccagtcatctcttgacttaatgaagctcatcctctaatacatctcttaggaagggatcacttgtgaaaaccatattacttcaattcttgtaggtttaaaaccgtgttctcatacatgatactctaaggacagcttgactctttcttgactcatactttatgacattttttgacattttaaaaaaatgctgctattttctaggcccactctgtacattcctactgagaattctgataccaatctacttttttttctccttgcaagtaattttttgaaaaaaaattttttggccaggaagctttgaagactttttattattaaagtctaggatatgtctcagagttaattatcctgggtcaattttctccaggatacaagtcttttcaatatgtagattaggtcttttatttccagaaagctttcttggattataattttaaatattaattctgttctcttgttttggttttattcttcagagacatcaattatttgcaggtgaaatctttgccaatcttccatttcaactactttttctttttactcctttttactcctttatctattttactcctttatctcatttttcttctgttttttatacctttattcaatgccccttgctaaatgtttagtcaaatatattctcccctgtagttcttgtaatttaatcttcatttcaatttctttcctaagttcaatcaccctcgtttcatcttggtttttatttctcttgttttttaaatttttcatgcaactttttttatatctgaaaatgattgtttaaaatattcaattaaagttatactgctaagttcaatcttcttccatgttatggttggttttgaggaggaactgtcatcaattcacagactttattttcattttctatttttgtcttacaggaaccttgcatacatatattttttctacacatattgtgaaatttctaaactagaaaaccctccataacagctatctgcagtaagcattctgtagtggcttcaggatttctctttcatgagtatccacgtcagcatagtgaagtgcagttttcttcatgaatagcttttttttctttttctggtagcagggggaggatttggttcatctctgattttgtacatttcttttacttctgcaggacccttaaaattctccctcttactttcttctttctgtttatgccatagtctctgaagagtgcctctcctctcctcttcttttactactcccaagaaactgattttcagagactacaaacgttgggcatactttcaagtaccttccctgtagccagtagtctgacataccacatcctggacttattttcagtaatgttgcacttaagagtatgactctctttctgttggtgattttctctttgctccatcaattcttagttcctattcttcattttcttctttttttatacagtctcatcagaacgtacccgctctcaacaccatacaaggttaagatatgagctccacagatatctctgttagttacaagtaatttgaagttcataatattctgtctcaaagttctgttgaaggtgtaaattatgtgtggtttcaattgctctgcttgacactctttatgatatttcaggggctacacagaaattcagatgtaggcatccaccattatcctaagacaacctgaaagtctctagcagttttattttattttattttattttatttttattattatactttaagttttagggtacttgtacacaacgtgcaggtttgttacatatgtatacatgtgccatgttggtgtgctgcacccattaactcgtcatttaacattaggtatatctcctaatgctatccctcccccagcccctcaccccacaacaggccccagtgtgtgatgttccccttcctgtgtccatgtgttctcattgttcaattcccaccaatgagtgagaacatgcggtgtttcgttttttgtccttgaaatagtttgctgagaatgatggtttccagcttcatccatgtccctacaaaggacatgaactcatccttttttatggctgcatagtattccatggggtatatgtgccacattttcttaattcagtctatcattcttggacatttgggttggttccaagtctttgctattgtgaatagtgctgcaataaacatatgtgtgcatgtgtctttatagcagcatgttttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttccccacatcctctccagcacctgttgtttcctgactttttaatgatcaccattctaactggtgtgagatggtatctcattgtggttttgatttgcatttctctgatggccagtgaggatgagcattttttcatgtgttttttggctgcataaatgtcttcttttgagaagtgccctgcttcggctcatgctcggtgggctgcacccactgtcctgcacccactgtctgacactccccagtgagatgaacccggtacctcagttggaaatgcagaaatcacccatcttctgcgtcactcacgctgggagctgtagactggagctgttcctatttggccatcttggctccacctcccagttttattttcaatagcctcttctcttatgtgtaaacgttagtaaatgtcattttattagaattctgcattgccataaaagtttattttggcttcttacaaagttatctttttgggattttatcaaatggattcctgactagtatcaatcttcagaaaccaattatatggtttcttaatttgatctctagtctgacttttctacatagaaatcattttctgccatccactgagcttagaagtcttctattccttcaaaaatatatattcctccttaaaaataagtagaaggtgtcatctcttcaatgtcaatgactgtctgggactacccatcagtacagggcttttgcagggtcattccataaaaaatagttaagtatctaatgctataccagcgatcatcttattaactttcctatcaccacctcttggaatttgctttgttgctacattacacccaatcatttgtttagccactcctaccacaacttcaggtgtatttttaaataaaaacctcctttcaatccactcttaaagtatcttttcctctccctgtggctaaattttaaattctaaaacagaatcttttgcatctgttgtctcatggactcttaagagtactgactacaaagactctggcctctcatcctcttatcttatgccagtttcatgctctggtggtattcctgtaggttcaaccaacttgtagagctgcactgtccaatacaatagctactatccacatgtggctatttaaatttaaattaggccaggtagagtggctcacacctgtaataccagtactcccagaggcccaggcaaggggactgcatgaggccaggagttcaagaccagcctgggcaacatagcaagaccccatctcttaaaaaaaaaaattaggtgagcatggtggcacacacctgtaatcttagctactcaggaggctgaagtgggagaattgcttgagcccaggagtttcaggctgcagggagctatcatcacacccctgtactggagagaccctgcctctaaaagtaaataagtaaataaatttaaattagcaaaattaaatagaattaaaaattctgttactcagaacataatgtttgagcatatatttcaagtgctcaagagagccacatgtggctagtggctactgctgaagagtatagatatagaatattttcatcctcacagaaaggtcctttggacagtactattggaagtcttaattcaattgtattcaactttaatgctatcttcttgccacagttgggaaaaaacccatttccttctctctttattcctaggtgttttgggccagtgcctgctggagtatggttaggaagacgtgtttctggatctttattcttttcttacctcctcatggatcttccaatcttccttgcctttagtttttcttaccagcctgccataaatttatccagttatagatgctaaactacattaaatacttactttaaaaaaatcccataataatatacggctattatatcttaatcagagtactcaagactcctacaagtacacttcccttcttattctgtctaggtaatctattagcattggggctttacattgaaggaatcctgtaaggaagttgccacatatgatttatcttctgtgatccaggaggcaaagtgaggcagctgcagctttccttaagactgtaagaaatcttcttgaattctcagatttagttatttatatctaggaagtgatgattgaggtgaagtttccttatgttagacaatgactgtgccatctgcttggaaataacctaaactagaaaacctctatgcaaagaggagaaaacctttgtgattcataaatctctgtattaaattaaaaggctaaaagtcctttgagttacctgaaaaccaggtaaaggtatggggctaggggcaagcacagggtagtttcattgtagtttagagcaggaatagaggctgtaacgttgataatgcacatctatagtcaggaaggcacaacacttaacctagaggagattcaaggctcctcccctctgttgggatcatctccacactggctgctacccacattggttatacaaactcactgccccagaaaaatgtgctcattaccatcacgtatatcttttgtcctaagtaagtgcttgcttctattaatggaaggaaatataacccttccattatagaatggtaatcccaaaattcatgagggtcttaggctctcatatcttaccatatgggttctagatatgcaaaaatgagtaattccgttaaattttttccaatttattcatatacagtgatctggtattttaaataccagttctcactatcatcaagtttagggataatctacattatgttgccaaagaaaagaataaagttcactcaccccttgaaaaagtaaacttaaagatttagcttcattaaaactaacgttaattcagtcaaaatgtacaatagtaaaattgctgacatttcatatgacatatatccataggaaatatgtgagaagacttacataaactgctgctgtattatacaattatatacatgtttacttacgaagatgcagtaacctaaaatataaccatcaaatcatgatccttcaaaaacaacaaaaactgcaaatccctaagattcaagctcaaagggcatctcatggattcctaattctcagtcagatctgataattcaggtaaaataaaaatttcttctttcactaaatctcaaacaaaaatgtcattttgtcatcttttctttaagcctccaatctttctttgttatacatttttaattatatcatattagcatacctgatttttatacaaggtttccttcaagcttgtaagagcatgaatacgaacatcgacattttcatgttgaatggccttcatagagagctgaagagttgtctgaagatcagtgctctcagaggtctcctatatacaaagcacagagagacagaacttattaatcaactattttaacaaccatttccaaaggcctgaattctctatatagttaccattaaactataccaaaccaattttttaaagtaatgaaatttccattccttcctttgtacagcacaaatcatttttagtaattctgagggaaagggatttcattgtaaaactgttagacctggagaaaaattttatcccaactaagtaagaatttacttctctaaaataagtacttcttgacaggaagtacaagtttcccttaatttacaaagggctacataatagctttgaaccaggtctatggattatataggtaattcaattcctttcactacccaaggtgacacctaaggtcaggtgtcccactttctacccagaagttctatgaaatcaccactaacatcttcataattttagagagctcactaagatttaagatgctggaattataaattattccccttctaaatctcaggaatcattcacatctgacatttctatatcatggtttgtagcacaacaaaactagaatcatcccacagctttcctttcttctcttagggtgtgccgctgtggtagcgcttctttttgggacaataagtaaggacactttggtctgggtagtaaaggcataagaattgtattttttgctctctgttctatctaatggtgttacatatttaatctaaatgctaaaacttccctccaaaagtcatggattcatggtagcattatctactcaccaggaattagctatcagaataggactatattatccctagatatgatcctaaaggatctttatttcatgtattggaacttgggaacaattctgtattaatgatctcctaaaccacaaattaaaaattaaatacctttctgtattcctggagaacggcttttatcttttttaattctggatgatcaggtaaaaaatatatttcatgaagaaaatcttgcacagcatccctaatagttagttggaataaaaagaattatttgccaagaatatgaatactaaaaaaatgtaaagtaaaagttgaaactaaggccaatttaattcataattaaaagtgctagttgattactgagctgcaaagtattttctaactatgtctaagatgctcagctaaattattagtggaaaatgaccaaagctatgaaaatcactctataatagtgctacaataaaccatgcttctcagcatacaaacccatatatacagtcccttcctcttcaagctgggctgagtgtgtgacttgctttagcaaatagactgtggcagaagatatactgtgccaatttggggcctgttaaaaatgcctgcaagtttccatttgtgtgttctggagagccctgagtcactacgtaagaagtgttgccaccaacatggacagaccgtggtacagagagacagactgtgagactacacggaatgagagagggcccagcccagtctacctgccccctgaatgtggccacatcagtgaccacttgtaagaccagtagaactgaccagctgagcacagtccagattgcaaaattatgagcaaataaaaatgctcattgttttaagatactaggttttggagtgatttggaatgtagcaatagacagacaaagactacctcaatatacaaattatcatgaagaattatagaaaaaaatacataaataatccttgtcagggctataatttttaatttccttctaatataataaatgctctaatctttctgggtccaaatataagcatttctaaatcctagtcttcattaactcatgcaataaatatatattaaataactactatgtgctactacatgctaagcactctgctagtcactggggatggaacaataaacaaagccaaagtagtgccttcattcagcaagcttaaggtcttctatcttgcagcatgatcataactcactgcagcctcaaactcctgggttcaaacaatcttcctgcctcagcctgcagtagctaggattacaggctctttttgcttttttttttttaaatgtttctgtattttttgtagagatgaggttctcactatgttgcccaggctcctggcctcaagcaatcctccagccttgtcctcccaaagtattggtattgttggcatgagccaccatgcctggtcaggatttttcttatgattatgagaaaggtagagaaatgacacttctgcaataaacagcaaagacatgactatgtacaaaaaaatttaaaaggtacttgaaaagtagtcccaaaatctaaattagtgattttgttgttttatcatgcacaaaatataaaaatatcaaaaataaaagtattttaactaaataaaaacacattaacttttccttcttctatgatttctccctcattagacagttactgcaactgactaaagggaccagcaatagcatatgggtgagtaggtaaataagtagtacttcaatcccaacttttcacaagcaaaggaatgattatatacaacattaagtaaaatcacagaaaaaaaattaaatatataaaaagacatcccagtctaaaaagcagcctgaatcaaaaatacaaatgggaaagaataatgcatgttctgtcaatagtaatccacactggctatagcctaatgcctgttttgaaaaattatgggggaagatagtaagaaatagtctgtggccacatttttagaaagccttcaatatcaagctaagcaatttggaatttatcaattaggaaatggagaatctcagaatgcctttgtatgctggaatgacaccaataaagagatatttttaaaacacagttctagtaacaatatcaagaaaagtgatgaaagcttaaaggaagagaggctggttcaaagcttaacgcaatgaggtaataagggtttcaactaaggtaagctgcagaaagtaggtatctctcctaacctttctcatgctattcaactatctgccttttgactgtgaaaagaaaggtaaattaggttacacatttacagaattaatgaaaagtaatttttaactggtgacctattagtgagctttggaaataattataatagaagcaatgccacaactgaaatagcatcatttcaatatgtaattacatgccaattacttttgtttattgataaaccctgaaattcaaaaaagtgacagtttccacattaccatcagtaattttgagacataaaaatacagtttaaaaagttattattttactattaatttcagttacaatacctgttttcaattatgaggtagtggaagatagctgcagtttctttaggctggatgtgtataagaggtaacaaagctactattacatgactgagaagggagcccagacaagcatgatccaggcagcgaacaaagcagtcccaagctctatgtgaaaaaacaaatagaaatgaagtccaattacttttattatttgtaaagctctatcaatcagtaattagttgaagacacatgatatatacaaacaatagattaaaaggcagctttaaacatggaataaagatcagtgctatatattcaaataaagtgatgtccaaattatgtgaagtcaaaaaagcaaggtgaaaaacagtgtttggggcagaattaataataaaaaaaaagtatgtgtgtgtgcatttacttattcttttacagagggtggatatacaaaaattaataaaaatagatatctgtagaggtcgaaattggaatctagatttctgactataatttgttacacagatttgaatttgggactatgcaaatgttttatataacttttaaattaaataaaatagagggaaaaagcaacccttaaaagttttaaagaaactgaaacaagtgaacctaactaaatgttaaattggtagcacatgcacacagaaaataagtacttcacgtgattctaaaacctattctttataaaaattttctagtagctacattcacttaagacttagaagcaatgacagtaggcccaaagagtgcctatgcttggaattaatctgggctcaaaggaaccagagccaggtttccttgaagaaatcactaattttgagtcagaggcaggaaatgttcaagataagcccaggtcatcttgtcatgccagaaagcagagaatctataagagattaatagaggtcatatcaaaactcatagatgccaacttgaagggatttctacttgcttaagatgggacaatttcagcaataaaaaaggatagtgactttaatggataaaaaataatcaaacttataaaaatctacgttatcaaaatgatattaaaaaaacttcactggaggttgctacagcacaaacctatattcctaaattgattaactaaagggaaatattcaagtatttatgaactgctttatatgaactatggttgttttgcttttaaagacaaggtcctgctatgttgcccaggctagactcaaactcctggcctcaaatgatccttccacctcagcttcctaagcagctgggactacagatacgcacaatcatgcccggctagccaaattttatgaggaattttgttttaagaagaatcccacctagtaaatacagaaggaataataaaattagaaaatcattatttcatcaactgcaatgaaataatggacttaggcaatgatcattaattaatgctaaaatcatcagatgaaagattagtggggaattttataataaagggattcaggttgataaaacctactgtctaatcttaccattactaaaagtggacaaccagatattattatgtggctcatactgtgccacaagagaagcacaaagcctcacctatgaggtatgttatcataataaattgaacctaaatctaatcaagcatctatatctaagtacccatttatagaaaagacagggaggaaagaaaaaatagagggaaaagttaaattagctattcgccaaatccaacatcctaaaatcttaacagcctaaaataagtaaaatgtgtgagtagagaatttaagggatgaggctgtttacaagagacacttaaggagccaggcaaccaaatacacatatgtaaacttcatttatagtctaattcaagaaactatgatacatacaaacatctctggaaaaacatctctgatacatacaaacatctctggtcatatacaacataatatatacaatgtctttgggaaaaatacctttgagacaactggaggaaatgtgactaaggactgagttttagattagatatttctattaatcctgctaagtataataattcatgaaggttattttttaaatgtcctcatccgttagatacatctaaagtatttacaagcacaatgataagattctgggatcttctctaaaataccccaaccaacaatcaaaaaggtagaagtggattaaaaaaaactagcaatgttgataactgctaaagttgggaaataggtatgtaggttcattgataactcttctatttcccagtatgttaaaagacttccatagtaaaatgttttaaaagaagtaaatatgttctattttaaatacaaataaatagtctttctaccttatttattatttgaacccaatttccctcaaagagataagaattcaagttagtgctactggaaaatgcaaaaaaaaaaaaaattaataaactcaggcagtcatttacctgcaacacaattcaggaaaatcatccttgaatcgaaggccagttctcagtgtggtcatcatcttcaccctcacagaactgacatgtttgggtcccattaacttcatcaaagacatcaaactgttcaaggcctatagagttaagtagtgcttcagagtaaagcttataaacatgctgccagaagcagatgagccctaaggacaagtgcttcccacccagtatcagggtgtcatctattctcagataatacaaaagattgaataaatgttggccagtttgttttgtccaattgcttatgtcttatgtggtaattataaatttgaaaaatacaagttgagttcttttttgttttttcccttgaaggtgatttgttattttagcccagtattcatctagaacagtacaatttctaatttattaaaggtataatgcatattgtttaatttctttcatatctatcccaaactgccatacacatatataaaacaaactgaattaaaatcatttaaatttgagaccatataacaatttttgtagtaaatggaatacttcctagtaatcagtagttaaggaaatttttgtcctaatgatattaaattcaagatgtcctgaatttagtaaaacaaataattaatgatacactcagaaaatgaaacacatgaaaaacacagaaccagacctgttatcagcagctccagtttataatgaaggggtaaagaaactctggtcgactttatatgccaaaacattttagttatttatggtttacaagacaaactgtagttttcttagattcaaggtgattctctcccttagaatagcaattggggaaacaataggaaagaagccatgtagatggaatagtagttggttgggggattgaatttactagttgacaccaaaagaacaggcattggttgctgaaatttgcaaaatttaatatggtaacatatgtctttcttggctccttaataaaaaaaaaaggaggggagagtatacactgaaataaaagcttccattcgtaggtgttttttgtttgtttttattgtaatcttactgactgcagaggtggaaagcaacagaaagagaaattttatcaatatctaaaattttactccaatttataggacgaaaatttccaacggtggccaactgttgcagcagtcataatgaaacttcactgtggcacaagcatttaaacataaagttgctttacattataataacctaagatttctggtgttcaaaaacaccatgagccatgacccacaccagaccaatctaaaccaaggagactcaatgatgcaacttttgtttgagctttcagtgattgctagtctctctcttcaaatgctggactagatgttgtgatgacgtgagcttgaagccattgaggtcattaactggctcttaagtacagagccaacccagatgaatctgagccaaaagactgactctgagaacttttttgagtccaaaatcaagttatgcctaaagctacatcatccttacgcttttagtaacacagccacaagttccttttagtcactttgggttgggtgttctatccctcctaaactaaagaaatgaaacgaatacaattccaatttttagactcccaaaaaacgtatatgagttcttcagcaatagagaatgtcatatttggttatttctcatctttgaatgtttgtagctagatgcagaatttatctatattctgtatgaattctatcttagcactctggaactatcaccacttaccattttcttatcttcaatgccaacactagagctcagtaactgcatgttaaaaaaagccaaaatgcccaacaatttgggttgtaaataatcagcctaagaaataaaaacagataatatgtaagctttatacagattgaatttcttaagttgacattttaattatttaattaatgtcatttatattttacctaactagattagcatattagaaataaacacttggttaattaagtttctccaaaagcatatatcttcacatgtagtatttaaagaaacatgtagtatttaaaggaatgatttatagtcaccacgaaaaaatatgattaaacagtacagtacaatgagaaaatgatgagttttttaatcatggagtgaactggggtgggatcctcaggatctaattcatgtcgggatgtggggtggagaggaaaagaagaaagaaaagaatagagaaagacaagggactgcccttattctatgacatttagagctatggtagaaaagtacgattaaggaaaaggtattctaccagaataatgatctgacataggggataatatccctggaagtaacaggggaaaagaggcacaagaccatgggcatcaaaagttgcagactagatatcatcatccatgacgctttaggtttcctgaagtaaacagagttccttccttagttccttccttccttccttcctccctccgtccctcttttcctccctccctccgtccatcccttcttcctccctcctttcctccctccctccgtccgtcctttcttcctccctcctttcctccctccctccttcccttccattcctccctcctttgcttccttcctccctctttctctttctttcttcctcttttacttaaacagggttccttccttccttcctccctccctccctctttctttttctttctttcctcctcttttttcttagagttccttccttcctttctatttctttctttcctcctttctctctcttttttcttttctctcctcttcttttcttcctctctcgacagggtctctgtcacctaggctgaagtgtagtggcacaatcacgactcactgcagcctcaacctcctagactcaagcaatcctcccagctcagcctcctgagtacctgtgactacaggcacgcaccacctcgcccagctaattttttgtattttttgtagagatggagtttcgccatgttgcccaggctggtctcaaactcctgggctcaagcaatcctcctgctttggcctctcagagtgctgggatttcaggtgtaagccactgtgctcggccaagttaatactttcttaagagaaggtcctggaggagagggcatgggctttaagtcagccaaatctaggtttgaatcttaattttgacacttcctaatgtgtgatcttctataagttacttaattcttccaagtttgtaaaatgtgaataataaaaccacctactgcatagagttgttgtaaaggctaaataagataccatttattggctaggtgtggtggctcacgcctataatcccagcaatttgggaggctgaggcaggtggattacatgagctcagaagtttgagaccagcctgggtaacatggcaaaaccccatctctacaaaaaaaattagccaagcatggtggcatgcacctgtggtcccagctactcaggaggctgaggtgggaagattgcttaagcgctggaggcagaggttgcagtgggctgagattgcaccactgcagtccagcctgggtgacagagcaaaatcctgcctccaaaaaaaaaaaaaaaaaaaaaaaaaaaagataccattcactaagaacttagtatatagctaagtattaaatcaatttgttcatattactacaaactgagaatgtgaccagtctgtaaagaagaatattcttttgtttcatgtctttatgtacaggcagaagaaaggagcaaaaaaaaaaaaaaaaaaaaatgagctgggaatgagtagcaactaaagcattttgaactccataagaaagttgcactgcttgatgttgaggcatctgatttaggtatcttcaggttccatgcattaccaagaaaagggtaggagggtgtgtgctaccatataatagagaggagtgaggtatcctacaagtctctccagattagatgtcaggataaatctttatcttgcctagcacaggaaatcatctggtttttaaaatctaaaattgcattttgttctgcaaacttctgatttaggttgagactcaactttggcatggtaagccacaattcactaattgtatggttctagcctatgttgcttaaataaaaagcagataaggatcacacaatctctgtcaacattccaatattaaagttcttgcactcagacaaacaattatttgactttatctacctaccaatatattatctatcaccaaatacttattatgtatgcctagaatcctatactgggtacaggtgtacaagataagcagagtcattctctctcattagcttacaaggtagactagcatgaatggaagacactaaataagtagtaagtatgtaaacaaagttgtgataatgctataagaaaataaacacaatcctgtgatagacaagaaatgtggtaagggagtcgagacagggtactcaggaaactcttgaaatctaaagaatgagaaagatccaggagattattccaagcagagagaccatccagggcctaggtctcgaagcaggaaaaagtttggcatgtttaagaaacacaaaggaaaccatgttgaaatatagggagaaaggaagaaaagagttgtaccatgtgagagtagaaaggtaggcagatcatgtatgccttacagattttattttatgttaagggcaatgaaaaccattgaaggaatttaatcaggggaacgatatgagtttgtaaaaagagcactccaaaggctgtgtaaataattaattgtagagagggaagaatgaaaggacagaaccattaggagatgttcacagctgtcccaagaaagatgatcattatttgtgtaagggtggtggtggcagaaatgaaaagatatattttggagagacttgataggatttgctcattaattataaaaggataaaggaaatggagggctcacgaatgcttctcaggttttgtctcatgcaactggtagatagcggtaccattactgagatgggaaagactgggagaaaaacagattagaaagggaaaataaagatttctaatgaacatattatatttggaattgtttgagatgcttataagacatgagagtagagatgatgaaaaggtgaatatctgtttgccatcttctgtcatcctcaggtccattctctgccgccttctgccctgctccgtacctgggacactgaccggactgcattacttaggatcccttaccctctggctttccactgaattcagtcagcaggaaataccactagaacagagggtaggaggagagagtatggtattcatatttcctgctctgtctgtgttttgaggtagttctggcagtggctatgttcctctacaatgagaggacccccctcatggttctggctctcaatcaggttctagtaacactatttcttcccctttcccagaactaaggggggcattaagttttctgtggtttgtagtacctgggttccttaacattccttgctggttcccttaaccttgccatgtcactaaaagtagcccctttgttaaactatttctgtgtaaatgtttgtgtgtatgccatctgtttcctcccaggacctaacctataaaaccaagctcagaggcagtctggactgaaatttcaactaaaaattatcaaaatgtaactcatattaaagaaaaagatcaaagaagatcattaaaggagagaatgatgactgagaaaaaagagccagttacatagtcctgagttattctaacatttagaggataaagtagataatttacagggaaaaagccagtaaagaagcctaaatatgagtgaacagtgaagcaaaaaagaaaatcaagacaatgtggtatcacagatgccacgcaggaaagaatggccaattgtattgaatgatactgaaaggttgaataagataggacagagaagtgactatgagatttaatagcccagaagactgttggtgatcctgacaaaaggaatttcatggaatagtgagaaaagagccagactagaatgggaaatgagaaaccagagataaaaatctctcttaatgaacttatgtctagtattccattattggaatggtaagcttgtagaagttatttatatcctactgctcaaggtcatcaccaaagtctgatttttcacaaaaaaaatttgcaacctctggcataaatgggttaaaatattttgccaacagtcctttaagtctgttacaagaataagggcagttgaaagaaaaaataataatttaattctgtggatttacatatttttttaagatagataaacagtaaagtgatttcaaatacaaatttatggtagggaaagatttaaaatagagaacatatttccaaacttcccttctatccaataatggattaaactacagttagaattgaaaagtttcatttgttgacctaaggaaagagtagtcggaggggcagggtgagaggagagctacaaacatattctaatatacatgtaatttaaaagtagtagagaaaaataaacttcaacatttttattcagtgaaaaaataaaatctactaaaaacacttaaaagtccacatttttcaatgctaatatatgttgttaatgccctaaatatgtaaatatgtaaacaaagttgtgataatgctataagaaaataaacgtgatctcgtgttcatgatcttgtgcatgtgaccacgtgatttaaatcagccttttcaaaataaaaataccaacttaaaatttaaacaaatggctagcagccagaaaatgaccaaaaatatgatttcttcaattttataattaagctgcaaaaggaagaaaaacaaacaaaaaaacctcatagaacatattccttaccatcagttcaggtgatatgatatctctcgggccctgatatggatcatcactggatgcaaatgaggcaagtattgacaaaccattaaaaacctgttgatagtgttctccaatacgcagcaataattcattatgcaatccttggaaatcttgtctcaacaggctccccagttcaatttctgtttcattctaacccaaagacatgttaaaaaaaatttttttcttcatactaatatcctggaaataagtatactgattttaacatgctattagtacatcaggagctctagcccagatgacaggatttattaaaggtattaagaaaaggcattggaaaagattctaatcttattctatcctggtaggtctcccatggattatatgtaatgaagagaagtgatccaactttatttagaaataaaatattaaaaagcaagtcctagttttctctaaggtcttataatatcatcaactcattattggggacacacaaccctgggaggaaatgtagtatagtggcttatagcagtctttctgttcagattgctttagtttaaattctagctgtcatttatcagatatgctgacttggacaagttacctaatctaacctcactctgccttagttccttatctatgaaacaaaacaaaaaaatagtacctttggctgggcgtgttggttcacacctgtaattccagcactttgggaggccaaggcaggtggatcacttgcagccaggagttggacaccagcctggccaacatggtgaaaccccacctctactaaaaatacaaaaattagccaggcctggtggcagacacctgtaatcccagctactcaggaggctaaggcaggagaatcgcttgaacccaggaggtggaggttgcagtgagccgagatcgtgccactgcactccagcctgggctacagagcaaaactcccatcacaaaaaaaaaaaaaaaaaattaagagtacctttatctcattgggtaactgtgaggattgcatgaaatgatccatatcaattgtttagctcaatttctgacatgtattaaatactccataaatacttattactatcattctatctccacaatatacagtcgaataatactttctcaagatgaataaatacatttgatattcactaactctcgtggaaagagatgtgctgctggcatatattatgaaacaaattaagtaaattaacatcagagaaaacagtaaagttatatgcatatttctcatagttttcctgttcccatgtagtttcatattcctcagagatattttgttaatatgacaccaaaaaaaagaagcacaggttataattttaaatgtaaaaactaccaaaaacctggaccaaattgtaatcagaacaccaagtaactaaaatatagacattatactacatttgaaggtgattgcctcttcctatggatataattaagtgtgtatcatcagtcaacttataactccaatcaactgaaaagtactataatgaaataggctgagaacctctcccatgaaaggatgcctatcatatcccattatggtgaaatgatcaaagaaaacaaaaggagaattctatttaatatgctctcaggacaaagattatttaacataacaacatttaaacttacattcttctaggataggctataatttactcaccctctttcctagaagaatgttacatctttcctataatgctaatttatataaaaaagtaaaatatatagaaatattcaattaccttcagataatgaagggcacgttctaattcatctttggaacaagaacagaccaaatgagaaaaaatatatttgaagttgtttattaaaatctctctacgattgacatttaattgttttcctaaagttcgaatgagagcagaagctgcagggcttgctttggcagcaagatcaggtagtagaacttgtaatgtcctctgaaaaagaatgcaacaattaccaaaaagtacatttgtctgggtgaaaaaaatattcacataagctatgtgcaaaaatatttttaaatgccacacatatttggagtccactccatactataaaatatgtaatagtagatcatttataccactataattttatactttattattccaacaccttagaagcagaaatgatcatattagactttgaattgccaacggaacaaatcatagcaccaaagacataagggctcaaatagctaactgaattgattagcattattcaattagtattaacttttcaggacagctaaccataaagaacaatgactcaaatccacttaaacttaagttttacagcataagcaataatctcatatcaaagtcaaaatctagaatggaatgaacaaaatactgaattgcaaacctcaagtgaactatatgttgcaacttacagtaagaaaacgattaagatcaggaaagtcgaaaacgttggcaatttcagacaacgtatttaaagccatttctctctggtgagccacatcttgttttcgcacgtcagcattctggcatggagtattcggaagtgctgtcatctgactagagtgaagggattctaccaaaaactagagcaaaaaccattttattgtgagttttcacacaaagaagaaattttaactaatactttttaagccaccatagagggcagtatcaaatagtattctacattatctgaattggtccattcaatttttataacaaccttaatgaggtagactatgtcataatctgcctttcacagatgacataatcagacttagttaaaaaacttgaatatcatgctaaggattataccacaaataaattcagtattttagcataacctaacttttcagccattaattgaatatatttaaaacaaagtgtcatataacataatatcaaggtgtaaaacagtttactatcactaaaaagtctatacaccattataagatgatttccttcctccctcatttataacctgtatcttcagaccaatatcctaaaatataaaaatggcaagatttcagttatagtaaataaactataaacaaaatacatcgtttttgacaataattttttttttttaaagacagagtcttgctctgtcactcaggctggaatgcagaggtgcgatcttggctcactgcaaccgccacctcctgggttcaggcgattcttctgcctcagcctcctgagtagctgggattacagatgcccgccccatgcccggttaatttttgtatttttagtagacatggggtttcaccatgctagcaaggctggtctcaaactcctgacctcaggtgatgcgcccaccttggcctcccaaagtgctgagattacaggtgtgagtcaccacgcccagccttaacaataattttttaaagcaagcacaatgctttctttttaaaaccaggcacagtggctcatgacagtaatcccagcactttcagaggcagaagtgggaggatcatttggggccaggagttagagagcagcctgggcaaaatagggctgctctctctaaaaccccatctctacagataaataaataaaaattagctaggtgtggtggtgcacacctgtagtcccagctactcaagaggctaaagtgggaggatctctaagcccaggagttagaggtttcagtgagttatgatcacaccattccatgtcactgtatgctgcctggacaacagagtgaaatttggtctctaagaaatgtttaaaataaaaaagaaaataaaacttttaaaaagcaagcaaatggaacagattagagaactcagaaataagatgacacacctacaaccatccgatctttaacaaacctgacaaaaacaagcaacagggaaaggactctctatttaataaatggtgctgggagaactgactagccatatgcagaaaattaaaactggaccccttcctcacaccatatacaaaaattaactcaagatggattaaagacttaaatgtaaaactcaaaactataaaaactctagaagaaaatctaggcaatacctcaggctataggcacaggcaaagatttcatcacaaaaacaccaaaagcaatttcaacaaagcaaaaattgacaaataggatctatttaaactcaagagcttctgcacagcaaaataaactatcatcacagtggacagacaacctacagaataggagaaaatgtttgcaatctattcatctgacagaggtctaatatccagagtctacaaagaacttaaacaaatttacaagaaaaaaacaaaagtgggcaaaggacataaacagactcttctccaaagaagacatacatgcagccagccaacgaacatgaaaaaaagctcaacatcactgatcaaaactacaatgagataccatctcacgccagcagaatggctattattaaaaagtcaaaaaacagatactggcaaggtttccgagaaaagggaatgcttttataccgttggtgggagtctaaattagttaaaccattgtggaagacagtgtggcaactcctcaaagacctagaggcagaaataccatttgacccagcaatcccactactgggtatatacccaaaggaatataaaaaggaatataaatcattctatagtaaagatacatgcacatgtaggttcactgcagcaccatttacaatagcaaagttggccaggtgcagtggctcatgcctgtaatcctagcactttgggaggctgagacgggtggattgcttgagatcaggagttcaagaccaacttggccaacatggtgaaacctcatctctactaaaaatacaaaaattagccaggcatggtggcaggcacctataataccagttacttgggaggctgaggcaggagaatcacgtgaacctgggaggtgaaggttgcagtgaactgagattgcaccattgcactccagcctggacaacagagcaatactccatctcaaaaaaaaaaaaaaaaaagcaaagtcatggagttaacctaaatgcccatcaatgacagactggatgaagaaaatatggtacatatacaccatggaatactatacagccataaaaaggaacaagatcatgtcctttgcagggacatgaatggaattggaagccattatcctcagcaaactaacacaggaacagaaaaccaaacaccacaagttctcacttataagtaggagctgaatgatgagaacacatggacacatggggggaacaacacacactggggcctgtaaggggggtgggggaagggagagtatcagaaataatagttaatgcatgctgggcttatacctaggtgatgagatgacctgtgcagcaaaccaccacgacacgtttacctatgtagcaaacctctacatgctgcaatatacccctgaacttaaaatataaattgaagaaaaaagaaaagcaagcaaaataaaacatgtataaatattcttcttttttgtaactcttaaaaagtactgctgttgcctatagtccagacaaacgctgactcttacctgacagatgggtttcttatactggctgaaaaaactttgcagtttaacacttttagctgcaaccagagctctaatttctgtgtatgctgctccagagacagatgctgacttggataacaaacaatgcaataagtgtaagagtgcaaatggtaccaaatctccttttgcggccctaaaattaaaaacaacatacatatgaatacacaaacacacacacacacacacacacacatacacacacatatgtatctccaatatcccagaaacaaacggaaatctacaaataaattcatgttgactcacattttgtctataatatcacaaatatcatatcaccatttttaacagcaagcaaataaaaatggagaatggccaaaataaataaggaagaacacaaatgctgccaagtataccttccaatatcccctgttgtaagaatcaaggtatccttcagctcattatttcttgatatttgggcatgtgtatatgcttccttcattcttaagacaaaaagctagaacaataaaattaactggttaaagaaatttttagagctaggttgacgtaaactcaaatgttaaaaacaaaaattatcaacctcctttataaatccatcttcagagtccaaggattccaatatgtgcttgatatttccactaaaagccactctaacatctttgtctggatcttccattaaatttaataaagttccaagaactgcttttacatctgtttcatcttctctaaaatcaagatgcttacaaagatgatgtagattatctatgaaagctgaaggacaagagtatacaatacctaatttaacatattaaatgtcaaggttgtactgtaaaaatattgtcaacaaataatatgccatgaagaatcctaagttctcttataatgtcaatgtttcatatttaagtatgtatagcacacagaattttaggaaattaaaatggatacttataaattaaaattactttatatttaataaatgtcactttttttttttgatatagggtcttgctctgtcacccaggctggagtgcagtggcatgatcacggctcactgcagcatgcagccctgacctcccaggttcaagtgatcctcccacctcagcctcccaagtagctgggaccacaggcatgcaccaccatgcctggctaatttttgtattttttgtagagatggggcttcaccatgttgcccagactggtctcgaacacctgagctcaggcaatccgcctgtctcggcctcccgaagtgctggtgttaaaggagcgaaccactgcactcagcctataaataatttaaatctaaaataatttccagaattgttataaaataacaagtctctttcagattttgtagaccattatatgttaccaagataaacttaaaaacacattgcaggccaggagtggtgactcatacctgtaatcccaacactctgggaggccaaggtgggaggatcacttgaagctaggagttcaaagaccagcctgggcaacaaagtgagatccctctctacaaaaaatttaaaaattagctgggtgtagtggcacatactatggttccagctactcaagaggctgaggtgggaggatcacttgagcctgggagatcaaggatgcagactgcagtgagccatgattgcgccactgcactctagcctgggtgacagagcaagaccctgtctcttaaaaaaaaaaaaagaaagaagaaaggccgggcatggtggctcatgcctgtaaccccagcactttggggggacagagtgggtagattacctgaggtcaggagttggagactagcctgaccaacatggtgaaaccctgtctctactaaaaatgcaaaaatttgccaggcctggtggcacacgcctgtaatcccagctactccggaggctggggcaggagaatcgtctgaacccaggaggcagaggttgcagtgagccaagatggcgccattgtacttcagcctgggcaacaagagcaaaactccgtctcggggaaaaaaaaaaaaagaaaaaaagaaaagcacatttctcaaggggatcttagctttattgttaaccttacattacaagatttagggagtactttctattgctttcaatagaaagtttctattgaaacttcagaacaagtttcaacttactacctaaacaaatggatcttctaagtatttgtataaatctcatacttcataaaaatttatactccattaccactggaaagtggccaagaagatacactctatagtcctcagttgggcaaagtaatttaactatttgaagttctcaaggtccaaggttgtaacagggggcacattaagacgatctctggtatcactaaagaagataatctaatattgaatcttacaatattgaaacaaccatcaggtatgccccatttaggctgtcaaatcacaagagtattcgaaaaatcccaaaatcacctctcctaccagttttgtgatgcgatctaataccagttatcccatttataactaatcaatactgagcactgaatctataaagcatgtaacttcctgtaatttttcaaggcttcagtctaattcttttactgatttgaaaagcagagcttaaataggttttaaagtattaaataagtcataatcactcaccaagttttactggactaggtattttttttttcagtaggaaaaggaatggcttgcagacagaagcttttagttgagaagatgaacattcatgttgagaagtggctttcaagttcctacagaagaggtccacatgtccgtgttcagagaaaggttctgttaaagaacttgtcagataaaacatgccgtgaagagtacagacaagttgaccaagtatagaagcaaattctttcttgacaatgtcagaatcatctttgactttatctctggggaaaaaaaagaaaaagtactaaactttcttgcctaattttgtggtctaaatagtcttgcttaatttgggacaaaagtactggtaaaacaaagcctagaaggaaaaaatgttaaattctaaaactaaaagcaacatttgctttacatattcaacaataaacacaaccctgcatacatagccagacaattatgatctttccaatagagtgatatattcaaattaaaatcttagtacatacataagaatcttgggaactctgttacaagaattctgctgctgcaataagataaaaaatccactaacacaactagcccggattacttcatgggagctctgcagggcccagttgtaaactgctgttctccactcaaggaatattcttcttggaaacagagtcagaagaaacacacatcgtgattgtgcctgtggtgctgaaaaaattaagtctattaaacaagatttctactaatgttaattttatgtatacacatatacatatatataagtaaagtaacatttgtgtatacatatatataaataaaagtcaagtaacacttaaaatacatttaatacctaatttaattaaaagctccttttcagaaaataaagcaagtgcactgaaaaaggtctatacacaaccttactaaataatcaaggaaatgcaaattgaaaatcatacctaccagataggaaaaagaaaaaatttaagatacttaactccatgacattttttattttctagatagcaaaaattttaaagtcagctaagtgtcagtgaggatgtggaactcatactctgctaacaggagtgtaaactggtgtatctttggagaacaatacagcagaatagaggtgaagatgtgcaaactctataacccaacaatactactcctaggtaggtaaaaacgttaaaataatgcttctcaaactttaatatggatatgaatcacctatcttgttaaaatgcagattctgatcagtaggtctgggtggagcataagattccccatttctttctttctctctctttttttttaatgtgctctttcagcagaatcaaagacgctccatttctaacaagtccctaaatggtggcgatgctactggtctgtggagcatacttttcaaacagcaaggacttagaatgactaaagaatcatttataaaaatattcatttaaatgttgcttgtaattgtgaaaagttggaaacaacttgattgtccaccaataggaggtctgatagtgtccatccaaatttggctactatttggaagtttaaataaaaactagagttacccatatcaccatggataagtctcataaagatagtgttgatcaacaaaatgtaagctgtaagaagcaaaacaatttcttatattatttataaataaatacatatatagtaaaagtaatagaacattcaacagaacaatcaacaccaaattcagaacagtagtaatctctggggaaaaaaatgaggggaatgaaatcatagagggacaaaggcttccatcatatctctaatagcccaggctggagtgcaggggtgcaatcttggctcactgaaacctctgcctcctgggttcaagagattcttgtatctcagcctccctagtagctgggactacaggcgtgagccaccatgcctggctaatttttgtatttttagaagagatgaggttttgccatgttggccaggctggtctcaagctcctgacctcaagagatccgcatgccttggcctcccaaagtgctgggattacaggcgtgagccaccgtgcctggcctaatgtttctatttcttaaactgagaagttggtataagaatttttggtatattgttcttctttttaaaatatttctcaaatacttcctaattttattaaatgaagataatgatatgtaaggacacattgcaaatgttttacaaaaagaaaggaaatgggatatgtggggcaggcttttatgtgttactttttatgtatctaacccccttctgaactattaaaaatgtacctgctcttttaattattgaaaaaaatataaataagtcttagaagtcctatatagagatgagttaaaacaaaccacacaaggccaggcatggtggctcacgcctgtaatcctagcactttagaaggctggggcaggtggatcacttgaggtcaggagttcgagaccagcctggctaacatggtgaaaccccgcctctactaaaaatataagaattagctgggtatggtggtgcgcacctgtaatcctagctactcaggaggctgaggcaggaaaattgcttgaacctgaagacggaggttgcagcaagccgagattgcgccactgcactccagcatgggcgacagagtaagactccgtctcaaaaataaataaataaataaataaataaataaataaatagatagatagatagatagatagataaataaaacaaaccacacacacattcttgtgagcacttacaatagctatctgaaatcctacagcttaatgttagaagattagcggcaaatgtggtcaactttaaacagccatcatcagaatgggaataaatccatggaagtgagagcataccacataaatcttccaggatatgatcttcaaatgaactgtttactacagaagcacaaaataagtcattaattataacttttccttaatcatatctcttttaaataaaaataaagacatttgaaatactatcataatgatcattggataagcagaaattcttaacacagagatctataaacgatggtctgaggtctgtgaacccaaagaaattaaatgtgactttataaaaacatgttatctatgcctgttttaaagaagaatcacggcattcctcaaactcccaaattaaaaaactttgaagttataaataatttctattgactaaagaatcaaaatattatgcacataaattggcaactcagaacttctattattgacaaatttaatagaactgaaatcaggaaaaaacttctgagtattccaaacacgcacttaggcttcaggcaaaaaagaaagcatatttctatactgattatctttaaaggttattctgatctgttgctaatttgtactcaccttgcatataaatcaaagcatcataaattttcaccaccttatcaatggttgcctccaggtccagtttctgaacagattctaacaaacttctacagctcttaagcacttttgtgtaaaaatccaatgacatccaagttatcactacagaaggtttcttcttggatttatgttgacagtccttgaaagtacggctgcagtaagtacattttgttaaaaacattggaattaagatgaattttgttatagtcaaacataaaattgtagtaaagccaaaagaaattgtgagtacgaaatttatctataacaatttaaagtaaacatgcaaatcaagtaatatgttattactattttaagttgaatctatttatgtcagcttaaatcacccttaggatttgggaaccaaatgactttgggagcctgaggtgggaggatcacttgagcccaggagtttgagaccagccgggccaatatagggaaacccatctctacaaaaaaaattttttctaaattagggtgtggcggcacatgcctatagttccagctacatgggaggctcacttgagccccggatagagatcaaggctgtagtgagccatgatcatgccactgtgcaccagcctgggagacaaagcgagaccctgtcttcaacagccaaacactgggttttgagttgtacacaaatgtgttctggtactttctaatcatgtgtccccaggaaagtcagttttggcttcagacaaaaaagagcctcagtttctctgagtgtcagtttctaatttttaaaataggcataatagcctttaccttacaggactattgtaaatattaactaagatatatacagtgcttagcaccgtacctagcatttgactcaatagaaaataaatttattaactacttcagtgaaaagtttgtgttctaaggttacatgagtcaagtgaataatgagtaaacagtaaatccaagttcattacaggaaacccaaccccaagaaacaagaagtttgttttaccagttcatgttttgatgagaacaatgaacagtacacagagcagtcagttgtaagacaacagcaattccttctaacatctcaataacaggattctttaggccactgtattcaagggaaatctgaagggattcagctttctgtttcagtgcactccataatatgctcttttggttcatgtccacatgtttaattctataattatgaatatagtagagagatattcatatgcaatataaatttggttaaaacatgaaacatatttagaataaaacatactatgtaatatcaactattcaaaaaaattttttttttttgtgagacagagtctcactctgtctcccaggctggagtgcagtggcgccatctcggctcactgcaagctccgcctcccgggttcacgccattctcctgcctcagcctcccgagtagctgggactacaggcgccaaccaccacgcttggctaattttttgtatttttagtagagacagggtttcaccgtgttagccaggatgatctcgatcttctgacctcgtgatctgcccgcctcggcctcccaaagtgctgggattacaggcgtgagccaccgcgcccagcctgaaatttatactaagatttaaaacaattaaaacaatgttcagaagtaactgaaatatggcaacttagccactttataaaaaatagttggttaatgttttaaaaattgctaatagatgcacagtctcaaagatttttcacatattaaaaagttaaattagataagcatataaaaacatgcaaagtaactatatttaaccatgaaatgttttatactactaaccgtctacaataattataaaaatattttaagcactcccttggctacatttagaaagatgttctttgtgtatttaaatcaaagcacttaactaaagctgatttttaaaagtgaacaaagttttatttaatggctaaatacaaactgaatgaaggtcatcatactcctcagtctgttttggtgctcttttagaagggtttagagacgagctgagacgacgccttttgggtgatattccatcactattactgctgaggttttcctgttgagtttggcattgaatctcctcaatgatttccatactttccattttcaaagctgcataaagtgggcccaacaagtactgagaaaataaaaaataatttccagaaatattccttagaaaatatatttatattattcataggcagcaagaatgtattagatgttaggtgttttctagtgaaactacttttagagtctcataaagcaaaataaacatctaaattgatctatattatttaagtctatatatagactatggttctatagtcttagaaggtttaaacaaatccttctctctacatcctgtttttcctcttaccaaaatgctataaattttaattcccttataaaaaattctgtaagggaattaccaactttcttcatgtaactttaatccagcaagattaataaactaaaatatttaatcaagttactgcatctctgatgattttattgtattacctgactcccacagtccaaatagaaaaaagcgcataatttggcatgattaatcattcataggttttctaaaagtgattgattataacttgtcagacacataatctgattgaccaaagcttctgcaattaagttggtaactgcccccttttaattaataatgcaacaaatacatttacacttcacagattctacttagaaacattctactccattggcagttcattaccaacttaatgaacaaatccttctgaaatcaaagtaaaagtccataatagtgagccagactacactatgaaaatcattatgttccaaatataaattactattaaagatattctattttcttattattacattttgcacatatgtatacaattaaatgatgaacaaaatacatacttaactagtaacctgaaaaattacttacctctgcatctacctcaattccaagcacatccaaaagagctttacaaatatttctcacatagaccttcctgacttgtaaagcagattcatacccagctggcacaaatttaaggaaatactgcagtaaatggcacaaagctgcttttagcaaatcagacttaagccgcatgagcacaccgtcttcaaacatgacacagagtttttccagcagcatatttaaatagacaggttcaatatttctataagcttctgcttcaaagggaaatagtgtctttatcagctttgataatggctcttcatagagtttcaattggtcagtatccatttctacaaggtgttttaataattccaaaaatgagctgaaaaaagtgctagctggttgtgctggtagtcctccaagctgaaaaagttctgttaaaaagctaattgctagggatttaatttttggactaccatactctagcagaacacaacctatctgccaaagtaagagttcttgccttctaaaaaacacaattgcaataatacgagtaagaaccattaataaagtgacttcaataaattctaaattttgcatactcatcaactgcaaaggagctgattgtaaatatcccatgtgttcatctaattgacttaaaaatcggctcatgaccactggccattccacagcatgacccatcacatttcttctatggaggtaaaccaagtcttcaaaaagttgtaataattcttttgtgagtaccccaaaaatagcaggactcttgcttttaaaaagaaataataatgaacagatgacttcacagattttcttgtgtaacaaatgacaggagggagttgctgcaatccgcagaagtctcgttatgatccaattactgaattctttgaaataaacaaaaaagatattaaataaacaagtatatccgaagtgctaattcatttgctaaatccttgacgattgacttttaaagaataaacttcactaacaagagtgtaaaacattctcttcacaatggaaacataatagtttagaacacaggcatacccagttttattgcacgttgcagatactgcatttgtcacaaattgaaggttgtggtaactctgcatcaagcaagtgtatcagtgccatttttccaatagcatgtggtcacttcatgtctctgtatcacattttggtaattctcaaaatatttcaaacattttcattattatcgtatctgttatggtgatctgtgatcagtgacgtttgatgttactattgtaattgtttggagctgtcatgaaccacaccgatataaggtggcaaacttaatggataaatgtatgtgttctgacccaccgaccagcagttccccatctctctccctctccttgtgtctccctattccctgagacacagtattgaaattaggttaattaataacccttacaatggcctctatgtgttcaaatgaaaggaagagtcacacatctctcacttcaaatcaaaagctagaaatgattaagcctactgaggaaggcatgttgaaagccaagacaagttgaaagctaggcctctttcaccaaacaaccaacttgttaaaacaaagaaaaagtttttggaggaaattaaaagtactactccactgaacgcaccattgatgagaaagtgaaacagccttattgctggtatggagaaagtttttgtactctgaatagaagatcaaatcgttaaaagatgaggaaatttccagtaggaaaaaaagaagatcaaaccagccacaacattcccttaagccaaagcctaatccagagaaaggccctcaacatcaaggcaagacactccaccagcacaaatattacaacttgttgaaggatgatataatcgttagcattttttagtaataaagtatttttaattagggtacatacattgttttttagacataatgctattccacacttaaggtacaacgtaaacataacttttatatgcactgggaaaccaaaaaattcatgtgacttactttattgcaatattcactttattgtagtggtctggaactgaacccacaatatttctgaggtatgcctgtaacaactttggagtcagacaggcaaggtcctagctttccacttactagttgtataaacttttcatttctctgaacctctgtaatttcatgtataaggagaataatgctatctatgttatgggttactgtgaggaccaaataagaaaatgcacatgaaatactcagcacagttccaaagtaaaataaatgttcaataaagggtagctattgtcattctttcaactaaaatttgagtggtgactctgtctcaggtacacaagaataaatcagtcatagtcctgtcctcatgaatctcacagtacagtttcttgagctttttgactgcaacaaagaaataacattttatatcatgacccagtacatatacatgcattttatttaaatatttaaaacaaaaggttcattaaatagtacttactcttattacatacaatgtactataatattttctttttttttttcttgagacaggttctcactctgttacccaggctggagtgcaacggcatggtcttagctcactgcaatctctgcctcccaggctaaagcaattagtgtgcctcagccttccaagtagcttgtaccacaggcatgtgccaccatgttcagctaatgtttttctgttttgttttggtttggtttggtttggttttggtagagacaggattttgccatgttgcctaggctggtctcgaactcccaaagtgctgggattacaggcgtgagacatcgtgcccagcctatgatattttctagtttatttcatcttgttttaaatgctgataattgcctaatttcataacccactagtgggttatgacctgtagtttaaaaactactgtaggaaagaatatagacaaaccaatgattagagcacagtttaatagcctctatgatagatgaaatgcagaacacttagtactaagagagaataaaggaataaccaagccagttctaagcagttagaagtagtgctcagaaaaaaacttcttggaggacatgctatcaaagttgagttaaagtttgaacaaaaaattttaaaatactttatccattatacaaaaaaaatgtttattttgcatctctttatgaagacaccaatgaagggacaaaagtagtaggtgcaataaagaataagcctagagaaaagcttcaatatatagaatagcggtcagcaaactttttttaaaggaccagatagtaatatttttggcttgagtgcccaagttgcctttgtagtagtcacagacaataagtaaaagaatgagcatggctgtgttctaataaaactttgtttacaaaaactgaagccaggcacagtagcatgtgcctatggtcccaggtatgcaggaggctgaggcaggaggatcccttgagtctaccagttcaagaccagcctgggcaacatagcgagaccctgtcttatttaaaaaaaaaaaaaaaaaaaaaaaaaggaaacaaaacaaaacaccaaaactttgttcacaaaaacaggcagccaccctgtggactacagcttgccaagctctgatctagaagaaagagattaccaaaaacagaaaaaagaaaaccatgccaaagtgttcaatggcaaataaacaaatttgattatttctaagtacctagtatacaatactaaaaagaaaacaataaggatatgtgaaggaaaaataaccattaccattttgctccttcaatttatagcaaagctgacccaaaaaagtataatcctgtacatgtaatatttcagaagagcagtaaaaggaggattttatagaacagatggcaagtgaatgcatgaataacagcacttaccaatacaactgcctttggcctcatggcttccactcacatttacaaacataagtggggaggatttcatgatatgctggatgaaatcaagcaacatcacggaggttggctgagagtcagttttctttacaagttctacagcaactaaaacaataagattcattttaaagagtcatgacaaattaaacaatggtccttttgttaagaaaccagactgtgggccaggcaaggtgcctcactcctgtaacccctgtactttgggaggctgaagtgggcggatcacctgagcccaggaactcaagaccagcctggataagatgtcaagatcccgtctctacaaaaaaaatttttcttaaaattagctgggagtggtagtgtgcctatagtcccagctactcagggggctgaggctggaggattcccttgagcccagaagttcaaggcagtagtgagctacgatcacactattgcactccagcctggaacaaagcaagactctgtctcttaaaattaaaaaaaaaaaaacaaaaagtggggtgggggtggggaaccagactttggtgaccagaattatatccagcacagcactcaacaacattcaagctaaattgatggggctaaacactacagtcttttttttttttgagacacagtctcactctgttgcccaggctggagtgtagtggtgtgatcttggctcactgcaacctgtgcctccggggtacaagtgattcttctgcctcagcctcctgagtagctaggactacaggtgtgtgccaccacacccagctaattttggtatttttagtagagacagggtttcgtcatgttggccaggctggtctcaaactcctgacctcaggtgatccacccacctcggcctcccaaagtgttgggattacaggcgtgagccaccgtgcccagccaacactacagtcttatctaattttaaatgtttaaaaatcacatgcattcctctaccatacatctatttatcaaacatgtacttcaggaataatatgccaggcaatgctaaaatctaaggattaaaaaaaagttctcacaatccagtggggcgccaaacaaaccaactaataattataatacaatatggtaacagcactaatccagaataaggagaaacaggtatctgggaggacactgtgaaggaaatgattcctagatgaggagttggtcagagaggggaagggcaagtagtctaaacggagggaatatgaatacgatacaaaaacacatcttgtaagtattcagtagtcctttgttatttttcagcaacccatcattttactgattgaaaaagaaaggattaatggctagtctaagtcataaaatctgcgccaaatttggaatccaaattataaaccctgagcctaatgccattttatattatccctcccatgtaatttcaacagatatgacaaatgtgacaccatcttgccaggttggtaatattctgtctagcagattggcacaaacaggcaataattgattcagtaactcacataatcctataatctcctataggcacaggcatgaacctacttaaagagtaacttacttaaagaggtttttttgggtggcatttgctattagtctaccactggcataacagctaaccaaaatagggtccacatgattggtactggacaaatatttttacatataatatccaatattaaagaactcatagcaagcagtagaaaatctagataacaaacaggaaaagagaattattttaaaagcctaattcaaattttgtaacaagcaataagcaatactgattaacaaataacttgcttgaaaatagtaactatcataaatactccatatctaaaactacatggagaaaatgctactataatttatacatggaaaagaaaagtctaatttataaagtttatataagaaataattggtttcttaccaacatttacatctgtaagtatccggtcaatgaattgacacagaatttgtcttggcttctgtacaactgtattatattcctctggtgtggcactaaaatacaaattaaaagcttttaatccttaaagtgactcagtttcatttgcaaaaaaaatttctctaaagtagaactcatcaaatgtgttcagtgtcaatgttgatattcacagtattcttctgtttaaaaattgaaaagaaaatctgaatatgttaccaacttacaagaaaaaaaagaatatgctaagtaatactaaagagatccaatcagcaaagcctagacctgaacttctcaatatggtggccactagctacaagtaactagggagaacttgaaatgtgattagtacaaattgaaatgtgctattgatggcagtggcagcccagttggagcggtgaggaaggtggtgctagggctgctctctccagggcgctagtgggcagaagccccgcccccttctgaggtgcaagacaggtggaagccccgcccccttccgagttgcagggtcgggagcccagccatcctgggtgcagctgcagccgcccaaccacggctgcaaacccaggcatccctgctctttccagggccgggaaggccccctgccctcacagacttggaaatgcctgctcccgctgcctggcctctccccgctcccggcacccacaccaatttcggagcaaagttgtgggggagcccaggtgttgtcaggaccaggccgcgtgtgcatgtgctcaggacggcactgacacaccagccccctgctgcctcatctccctctggactttgggcaggccaagcggtaggctgagggcagctcaatatgggcctgcaggcgcccctcggcacgaacagcctcggtgtagtgggtggcaggttgatggcagcaggaagtaggctcctgggaggaaaggggtgggtccccagtgaagacccaccttcaagccaggaacagcttgaagcctggaagcctggctgccagttacacggaccacagcgagaacttagggtgctttttccaggcccacccatgactgcctatggaccaattagcattcacttcctcccttctgaagcacataaaaactaaatttttggtggaacgctaatacccttttccacagtggctgtaccattgtacactcccacctgcagtggacaagggttccaatttctccacatcttcaccaacacacgttattttctgggtgtttttttattattattttattttccccttttggcgacagggtctaaccctgttgcccaggttactgtgcagtggtgcacccataactcactgcagcctcaacctcccagcctcaggagatcctcccacctcagcctcctgagtagctggcaccacaggtgcatgtcaccacacccagctaattttttgtattttttgtagagacagggtttcaccacgttgcccaggctggtctcaatctcctgggctcaagcgatctgcctgctttgacctcccaaagtgctgggattgtaggcatgagtcaccatgcccaactgtgttttttttttgtgggattttttttgttttttggttttttttgagacagagtcttgctctgtcaccaggctggagtgcagtggcatgatctcaactcactgcaacctctgtctcccgggttcaagcaattctcctgcctcagcctctcaagtagctggtactacaggcatgcaccaccatgcctggctaattttttgtattttagtagagatggggttttaccatgttggccaggatggtctcaatctcctgacctcgtgatccgcctgcctcagcctcccaaagtgctgggattacaggcatcagccaacatgcccagccccaactgtttttttattaatagctatcataatgggtgtgaaacagtatcctgtggttttgatttgcatctccctaatgattagtaattgtgagcatcttctcatgtgcttatttgtccatttgtatatcttctttggagaaatgtctattcaagttctttttctgtttttcatcaggttatatttgttgttaagctgtaggagttcttaatatattctagatattaaactccttatcagacatatgatttgcaaatattttctccagttccatgggttgccttttcactctattgatactgccctttgatgcacaaagtttttaattttgatgaattccaatttatctgtttattttgctgcctgtgctttgtgtcatatcaaagaaatcattgccaaatccagtgtcataatgttttccctctatgttcccttatttttatttatttatttactttttgagacagagtttcactcttgttgcccaggctggagtgcaatggcgcgatctcagctcaccgcaacctccgcctcctgggttcaagcgattctcctgcctcagcctcctgagtagctgcgattacaagcatgtaccaccacgcctggctaattttgtatatttttagtagagacagggtttctccatgttggtcaggctagtctggaactcctgacctcaggtgatccacccatcttggcctcccaaagtgctgggattataggtgtgagccaccatgcccggccccctctatgttcacttctaagagtttcatagttttagttcttatgtttaggtatttgtatgccttttggacttttaaaattttcctgtagcagtaaagagagaagccagattgcaaggggctgaaaatctaatgaaatgtgaatactgagaatagcgggttctttccaaagcttgatcatgaaatgaagagaagtagagttggtgataactaaagaactgtatgagatcaagagggctttgttttgtttctcccttataatggaaagacctaagcaaccaattcttgagatgtgactcctcttcttggaaccagatataagtaaaaagacaatccttggacaggagggtaactctttcataaacatagaaagaatggatgggtacagacgcaaataatttaataaattcaaaaggcaagtaaaacaagatcctctgcttcaaagaactcagaatagttgctggggagaggagaggaatgcacttaaataatcaaaagcggccgggcatggtggctcacgcctgtaatacgagcattttgggaggctaaggcaggcggatcatgaggtcagtagatctaaaccatcccggctaacatggtgaaaccccatctctgctgaaaacacaaaaatcagctgggtgtggtggcgggcgcctgtagtcccagctgctcaggaggctgaggcaggagaatcgcttgaatctgggaggcggagattgcagtgagtcgagatcgcgccactgtactccagcctgggcgacagagcgagactcagtctcaataaataaataaataaataaataaataaataaataaataaataatcaaaagcaagtatcatgtacacccaaagcagggaatgattaactctacctagaggattcacagtgggttatgtgtgagtgattagcaaagtccatcacttctgacaaaacaacttagggtgtagtaagacagttacttataaataatagcatatatttcatatatgtcacaatttatttctatatagcactgtaaaatgttcatacattttccccacttattatctcaaatagtggtaaaagaaaaagagtgaatttttttctttttctgatacagagtctcgctctgtcggccagggtgaagtgcagttagtggcacgatcttggctcactgcaacctccgccacccgggctcaagcaattctcctgcctcagcctcccaagtagctaggattacaggcgtgtgccaccacacccagctaatttttgtatttttagtagagacggggtttcaccatgttggccaggctggctcgaactcctgacctcaggtaatccgcccgcctcagcctcccaaagtgctgagattacaggcgtgagccaccgcacccggccctttttcttttttttttcttttgagacggagtctcgctctgtcgcccaggctggagcgcagtggtgtgatctcggctcactgcaacctccgcctcgcagcttcaagtgattctcctgcctcagcctcccgagtagctgggactacaggcacgtgccaccacgcccggctaattttttgtatttttagtagagacggggttgcaccatgttagccaggatggtttcgatttactgacctcatgatccatccgcctcggtctcccaaagtgctgggattatcggcgtgagccaccacgcccggcctgactttttttttttttttttttttttttttgattattcaaaccacaaagtccaatcctaattgattacatataggatcaatagcatttacagctaataaatgccataaaagaactgatactggtcgggcatggtagctcatgcctgtaatcccagtgctttgggagtccaaggtgggcagactgcttgagctcaggagtttgagaccagcctgagcaacatgatgaaaccctgtctctacaaaagaaatagaaaaatgagcaggtatagagacacacacctgtagtccccagctactcaggaggctgaggtgggaggatcgcttgagcctgggaggctacagtgagccaagattgtgtcactgcactccagcctcggtgacaaaaccagacccctgtctccaaaaaatagaaaagaaaaaaaagaactgttctctggtcctggtacatagtagacatttaaagaaaaaaaaacaactcttcaatgaatgaatggttcataagaaccttcctgaattttgtggtttcttcattcctaatgtacagccttctggacctatggaatatttacctattccctgccactagactataagctcctacaggtggcagactgtgctttatttctctctgcatgtcctaaagtgccattagaccgtaagctcttataggagagaaaatgcattttatttctttttgcctctgctacatcacctagaacttgcttaatagaaaaacttactgaaattaacaaatgtttttaagtaacataaactctagacacaaagaatcaaagggccaggcgtggtggctcatgcctgtaatcacagcactttgggaggctgagacggactgatcacttcaggtcaggagttccagatcaggctgcccaacatggtgaaaccctttctctactaaaagatagaaaaattagccaggcgtggtggtgggcgcctataatcctagttacttgggaagctgtggcactgaggcaggagaatcgctgggacatggaggtggaggttgcagtgagccaagatcgcaccactgcactccagcctggatgacagagtgagacttcatctcaaaaaaaaaaaaaaaaaaaagcaagtttgtatatgctactaaataaagtccttaaaaaaaaaaaagaatcaaagaacaagtagttacatttgcatatgaaagcaaaacaacttagtgctatgtatcttatttaaatcagcgctggccaatagaaatataacgtaagccataattttgttattttctggtagccacattaagaaaagaaacaggaaaaaaacaattgatcctaacaatatatctgaaatattaggtgaatgtgtaatcgatataaaaattattcatgagatcttttacattcttttttctggtactaagtctttgaaacccactgtgtatcttatatttacagcacatctcaatttagactagccgcatgtgaggtggtcaatggtcacatttggctagtggctaccatagtatagggcatcacaaatttaacaaaaaattcaaaatctgtaattacaaggtaacatgaattgttttagacaaagtcaggagacattatgataaaccacagtaatttcacaagtatcatttaaaaatgtgaacaaagaggaacatgggaagaggagccaggattgtgggtagtggtcagagtttcttacaaagtttcattttgtaaagattatgtactcatgtattatttgtgtaatttttaaaaatcagttttagaaaaatgtaaattgattaccattcattagatctactatcagaagaaagaaacttggccgggcgtggtggctcatgtctgtaatcccagcactttgggaggctgaggtgggcggatcacttgagcccaggagtttgagaccagcctgggcaacatggtgaaaccccgtctacaaaaatacaaaaattagccaggcatggtggcacacacctgtagtcccagctacttgggaggctgaggtgggaggatcgcttgaccccaggaggcagaggttgcagtgagacatgttcatgctattgaactccagcctgagcaacaggtgagccagtctcaaaaaaaaaaaaaaaaaaagaaaaaagaaagaaaactcacaggagtgagcacttcttattttgtgacttctaccctggaactgagctaagagggtataacttttcaaaagcatactataaaatttgagtattaatgtaagtattatataaagcttaggcacctcctctgaggtaagcatcaaataccaggataaccaagacagaatgcacctgccctaaaataatttgcagattaaaggacaaacaagaggtaattatggttaagaactgacaggcccaagaaagaacacaaagggacactcagccctgagcagggccctgtcagtcatggcttccttaacgaggtgatacaaaactgactccctaagggacaaggcagtgaaataagggtaagagggagggtagtccaagcactggaaactgtaagaggctctatgtggctaaagcctttagagatgcagctgaagagggaagataaggttaaatttcaaaggactggctaagtagtttggattttacactgaaggcaatgtgtaagcactgaaggattttaaggaagtaaaaattaagcaagttttaaaaaacttgcttatttccctgtttaaaagattccaatggtttcccatcacacaataaaatctcactcctttttctagcctccaaggtgctgaaggatgtggcccttgcctacccctccctgtttaactcataccactcccctctttactccctgtgctccagccttcttactatccttttaaaagtaggctcattcagccttggcatggtggctgaggtgggtgcatcacttgaggtcaggagttggagacaacctgtgcaacatggtaaaaccccatcttcactaacaatataaaaattagctcggtggtgcaagcctgtagtcccagctacaggaaagggaggctgagacaggaaaatcgcttgaacccgggaggcagaggttgcagtgagcagagatcacgccactggagagggcgagactccgtctcaaaaaaaaaaaaaaaaaagcaggctcattcccacttatgggcctttgtacttcctattccatcccagattcacgtgactagcttctttacaccatcaaatctcctctagtggctaatgctgctgctcctcagaacctcctccacatcccactgttccatttaacattttaatagcaactatcacatttgaaaatgtcttacaactacaaagcaatctcaagtaggaaaatcagagaaggtgattctgaaatgacatctaaatgaaaccatccagtgttcagatagaaggaacagcaaacgattaaaggcaggaacagccttggtatcctggagaaacaaggtcagtatcactagagtaaagtaagcaaaagagggataaaaggtgatgaagtcagaggcaggctgagccagattatgtagaaccttagaggccttggtaaggagtttggattttatactgattttaagtgtgctggaatgtcaaaggacggttttgtgcaggggaacttacaatatgactaatagatgaaaaatcactttactgagtggaaaatctattataagtaggtaaaagtagaaatggaaagatcaactaaggttactgtaatagttcaggtaagaaattctggtggtagcagtggagacagtgagaagtgttagattctagatgtatcttaaacatatggttgtcagaactaacttatggattattaagcgacaagggaaaaaaaccaaggatgactcctaggcttttggttggcatatttacgataacacaggagaaggaacaaattcaagggcgcagtaaatcaggcgttctgctttggatatgttaattttcacttcccagtgtggatgttgagtaagcaacctaatatatatctccgatctagaaatataaatttgggagttatcagcatatggatgacatttaaagccatgagattaggtaagattacttgggaagacagcacagattaaaagagggccaaggacatagactgaaagcacatgtgaaaatagttaagaatgacttctagatttccagtttggagaactaagtgaatatggtgccatgtactgagatatctctacttcaatgaataagagaaaaataatttttttaatttaaaaaaagaaagcttgtgaaagctaggacatgtggggaatttgtattggatattctgaaccttaactacacataggacactcagtgaaactaccagtatacagtaaatatacaattctatagaagacatgatttggagaaacatattagtagtcatcaaatagcagattatagttgaaggcaggagagtggaaaggtcatttagcaagattatgcagagcagactgctaatagcaaaaaaacaataggacaaaatttatctgagggactgaggaagagcagcccataaattagaacactaatatctttttttttcagtagtctaattgccatagtcaattaagaggaaacattttggaagaaaaggccttgaaagcttgaatctgaaacctagctctgttatctgctagctgtgcctttggttcttcaacttctctgtccctttttcttaaacagtggtaacacttgtttcattctatgtcatggatatactatgaaaattgattagcttttttgattcaagtagttgtaatgaaaaagccatgacaattaaaaactattagacaactctctgtgggtcagtttttctattctttctcttggaatagctacaaataaatgaaaggtaacataaactctactgatgaaaccgactatatataatccaagaaccaattatttttattaacaggactcacggaggaagacagaagagggaagagaagtattaaccagttaattctactttaaagcaaagtggcaaaaatatactcagcttcacaatgagcctgaaagatgaaatttgtaaaccaacttcctacaatgatcacttttcttcctcttcttttagagaggtagaggttattttataaactaaacacaaagtatacttgccacagataagtggaaaaaattcacacactcaaaaatagtgatgcagttacgacaagaatggtcccttcatttatccttttattcatatattgagactagattatttggatggccaaccagtggaaatgaacacaactgcgctgcaaaaagaaagagaagtagctatcccattggcttaatgtcagctttgactttgtgtggaaagttttcaaacagtttaagaaattgggaagcagttattccaaatgataatttaactgcggtagcagcacaagcttatttatttcttgttcgcagtagtgtagaattaaaacaaacaaagcaaaacaagctctaccgagtctttaggcctggttcagggaagcctgcctgtgtattgaagaggtgtgagagccatcaacacctctccctccttgtggtaagatactggttttcatgaggtttacagacaacatgcatttgcaaatgaaatattaaattgtctccaaattttggcaacactctgtgcacgctgagattttgtggacccaggggtctatctctccaatttctgactaaaataacggatcgggaactggacgatcaatacgagggaggtcacatcttcagtatgtactatgacttcacttcaaagaaaaaaactgccttttccagcaagtgatgtcacttgcagaaaatgagaagcggtgattttctttcaagggcagtttggggacaaaatgtaaggctaaaaaccaattcctccacgagtgatcacaaagaacagaaactgatgggtcaagtccctcgtctaaggaaaaagattttcgagaagaaaatgagtgtagaaaagtgaccagaaagcgatcagcagggactcttcctccagctgcaggaagcaaactctcgatcggggtgagtggtaaaccagggccggcagacgcctctctcccccacggaccggcttcccgcaggtttgtggcgactgccccatgtgctatcaacgggcactctgagggagaagcgcccaaatcagccacggagcatctccacaagggccgcagcgggggcttaggggatcccagccatagcgcagcaggggaggggagagcacgtgaaacccaagccggaatcagcggaggaggatgcaggacccaggctgggcctagccctacctgcccagctcccgcagggcggggatcatggaagccagctccaggccatgttcccccatgctgaggctgcgaggcactagtcaaccacgccaacgcgggttcccggcgtctccaaagctaccgctgccggaagagcgcggcgcccgacggagccgtgtggaggccaaaactcctcccggaa

SEQ ID NO: 1540 - DNA, 370381 bp, Homo sapiens
  source 1..370381: mol_type = genomic DNA
tcagtttacaatgcataatgatatgtctttatttcatcaacagaaatggtgtctagacaaaattcagttaacactagcaattcaattgagtgaaaactttttttgcacaatagtgtatttacaatgagtaaatgaagtttcaattcattagttcatagcaatgcttttttcccccaaaaggtaaaaattcttagttacagagaataagcatcaacagcctttcattttttacaataaaaaccacgagaaaaaccacaatcacttagaaaaaaataaggacaagcctaagaactagtacaataaaatgatgcattgaattaaattacattaatcgcatagaatctgtgtaaaaagtatgtagaaaaacacctgatgtaacctgttacagtcgttgaccagttatgagaggtacagagggttatacaggtagatatgtgtgaaaactgtccgtattgttcaacctggggaggaagagaagaggggctgcagccccttgcatacactgagaagaccctgttttgaatatggcctctggagtttgtaaggcatatattagaggtgcacttgcatcagactggttctggaacaaattgtcaaattgtcacaggctctcttggcctcactagcaaaggtggtgcttgccttgaatggctcactgtgtctaacaagcacctgaagctcccaaatgcatatggaatcttcctgatcactcactagaggtgccatgtctttatgtcagagcgtgaaacgggcatcccaggatttgcacacacaaaatacattgttaggacttaaggggaggtcatagttctgcctccaaacatgttttggtagaagactgagcatccatctgtaggaaaacccctctttgtccaagtcccttcactctttcgcaacatatgcgtctgattattcccatgggagcacttggcactgaatgtgagtctacctgaaatgaatggtcttggtgcacacttctgcttctaagaagggccagtgttttatctgaggtcaataaactggaatgagaatgaaagtcagagctgtttatccattgcttgacagcaaaatgcatacaccgtgtcacaacattaaatcaaagctatgaaagttggcctctgcaaccaagtgggtattcttcacaaaatggcagcatcgttttcatattacatttaaaatgcactgatattcatttgatagaaatatcatctcccagggtggagtgtaggaaaatactataaacttttctttgcaagtaatgtttttgcaccgtcagttgaataatttatgctcaatctgccacaatgagacttttctatgtacaaatgctatttgcacacactatttgtgtacagatatgttctgttctacagcatcggttttggacgctggggtcatgagatggctcaggcagtactataaacatacactttcaacacacaatgcctcgtgcacacagatttcctgtatgaataccaactccacacagggcattgtattgtggactgactcaccagaaattgcacttccaacacagtcttcagtttggggaagaaacactaactcatgatacaacgaacagctttattcttagaaaacaaaaacaaaaacaaaaaacaccttgttctttagtctatttacagtcatttgaggaccaaacttgattcttgctccttctggatctgagactcctcctaaactgtaagcaatagtgaagcagtttgaagtcatttctaagacagctcctagtttaaatggggcataatgtagagaagtaggtagccaaatagggacttgagaaagctttgcaggcagctcttcctcattttgagaggattatgctactccacaggatgtcaagcagcttcacgggacaggagtttttggtgtcttaacaggcttatcattttcaaacctttgtctgttccttctttttcttcttctttgatggcaatcataaaatattaaaagagaaaatgtgggtttaggcctcttgacaacagcattaaacttcacactgtgcacacttcactttagccagtcctctcatgagtcttgtcgctggtcctggctccttttgaaggagtagtggcagttggcatactaatcactagacttttgttcccttccttggaaaagcaatgtaaggattacatcccgaattatagtgcatcttaaaagcagcaaacctttagaaagacagttaataaattactcgcacaacattcagttgcagacacacagagtcaggttttccactgcagcatcatctctgatgcctgagtcattgctgggaactcagaagataaatagcaggatggcctcgtaactttgtcggtttttttttttttaaagtttttctaactgttttgttccagaatcagtatgtaataaagttcgattttaatcaaggcacccccaggtaacgcagagaaacaaacacatacagcaaatcactcacctgtccaaagcctgaccaacttgaaaagaggttgcctggatacacaagcaggacaaaggcagatccaaggggaggactggatttaggtgggatgttcattagtctcagggtcactcacctccactggctctgccccaacaaccattcctaccccagccatttggagacccaagcaggcatcctcctaaacagcccgtggttggagggtctcttatttttgtaagaaaagagccttaagaacaaccaaatgttactgtactgtgcaaacactcttccttgctgttcactcacttttctttttcctaaaaggcgtggggttgacagagggatcccagggaaaagagacaggctaggttttaaaattccacttgaggccgtttggattctggtccccagcaagtcctccctttgaatcaacccagaaataattttgacaagcacatagttctgaataggaaaagacacacacacatcacatgaacaactgcacgaagctagtcactgttcatggtggattatgaatgaaataacttgtgagaaatctctatgaaattggaagatggtttttagagcagtgtttttaaccagttcccatggcagaagttaggttgggggaagaggaagaaaagcaaggcaggggtgggtgggaggaaggtgaggtctgagttagggtggagagaaataaagaggccccgcccctgctagaaatggctgccaaacaggtctgggctactgaaccacagaaacctgaggaaatggatggaatgtggtcaagactaccagttgcacatgagttgttaccagggtaaacctcatgccaagaagctgggttggacctggttatgatatgagcagaaagtgttctttttttaaaagaagaggagaggtcacttggaaaggcaacaatagagttaaaaagcaaaatactgtcagctgactccactgtaacacacgcctgcgaagtatcacgtgattcacattgagtttatattctcactgtcaccagttttccacaaaggcaaacctcatggtgaagcacagaactgtcctagtaggccaagaaattccaacaaccataacaaaaaccagcagctccaacacagagctttatcaagatctgtttcagacacacacacacacacacacacacacacacacacacacacacacacacacaaacaagaaaaaacaaaaacccagaggcaggttttaaaagtggaactgtttaaaaagaaaagccttttttttttttttttttttttttttatcctactgcatgaactgacaaatttctggcattcatacatatttaaacatttagtgctaatatttgtacagaaaaaagttaataatactaaaacatatgttactatgatttcacttttagcctacatcatatactaatttccccttttacatgcagctttaatattgtccaaacaatggcacaaataaagaaacaaagtcaaccatctattccccactgcccaccaccccatccccacatcaaaccgttcaggactctcttccccagccgggctggagtggccctcgggctgctcagtgagacccggacccaaggccactggagcgagggagctgattcctcctcctctggggcacaccttcctgtaaacgtggctggggccaacacggccccagagccaagggaagctgctctctctgggttgcaagccaaccagttttgcagcaagaagagaaaattatcatcaggtgagggtagggtatgtgtgtgattcgggaaggggacagggagggttcccggtgatagcttgtccaaagcctcagaatgaagtctgccttcagacaagacactggcagaaaaacctcagaagaaaactccaagcctttggagaaggaaaggagaaagaatgtgtcagcctgtgtcagggatggatcgcagatgccaggatgccctgctctctcccaatggggtgaaggcaggaccttcggggctgtgattcaaatcccctcaggccagatgtcctgggaggccaagcctgggcaggaaagccagtggctggttggccccgtccttcaggggagcaggtcctactgcacaacacttccaagagcaagccgaggcctcaggacgtgttgaaatgaatgggacttactccctgggtgaaaactttctaacttgatttctaggagccaatgcctgctgagttctggtataaaatcacggattcctgtttttctgatgtacttttgagtgagatgtccaaactctctccccacttaggaatctgaacatccagcatcaactctgaactctctatctgcgtttaaactttgcttagggaaaggtggggaggaggtgaaatataaaaatattcaagcagattattgtctacacatcctaggatgaattcattatttggcaagattgtttttcctacataattatcacctgagtgctttttaattagctaaaatgttttacttttttaactaaaagcaaagaatatacagtatacttgagttataccgaagttacaacttcatttaagaaaataggtttgacccaaaactcagtgcaagtggcaaagttgaccattactgtacagtatctgcaaggaaaacaaaaacaaaaacaaaaacaaacaaaaccccccaaacaaacaaaaaacaaacctacaatgctcaaatgacaccacttggaggtgccaaaaccaaaccaaacgaaaaagaaatctgaaataaaaccttgggaaaaagcttccaacactgaattttgtccataaataagtacgaattgaaaattgaactgtgaagcaagaaaaatgaccatgttaacagttaccaaactagttctagcatcagagacaaaagaagaggaatgttggaacctgtttctaaatgagaaataagtttccagttttaggatgagaaagttgaggcatgcaggacttttgcatatggatatatatatatatatatatatattttatatatatattatatataatatgtacagtctagctataaaactttgatgtgtatagaagctgtcttcaatgaaaaaaattgaacattcagaagaaattcctgagatagggtttgtgacatgggccactgagaaaaaaaatccgtggttggggcctagaggtgttgtagtctatccctgtgaagactgaaattgagccacagacagacagtgtcatcactgctgtctttccttgcctgggcaaggggtagcaccattgtgaaggtaactatcactcctgctcgagaagaggagaggatacttcggaacagtattgctgctaagaccgctgtagtgtgcaccaaatgtgttctcggtttcttcgggacagcagatgaacagtgccacaggctgactgaagaacgcctggatgggagaggtgtgcggactgggaggcagagccgagtcactaggtataatctttcctgggctgttcgtcagttgtacacttatcagtcatttcctggcagaagtccacggtcactgtttggctcctgggttcaagaggaggtcctctctctgagaaggttcccgggtcagtgccttctagtctcctcccagaggtacaattctcggaggtgttgctgggtgcccaggggggtccggggggagccgcgcctggctccaagcagcagggcacgttttcccccactgcgcattgggaggccgcaatgttctgctcagcacccaagggcgcagggttaatactggaggccgtgggcaagtccatgggtctgaggacagggcaataccgatgcagggcctggatctgctcggggctctggatgtctcggcaaacttcctgggaaaggcaggagaagttgtccaacagttcccccatgcatgctttcagttgattcctctctgacaacagtttctctttctcacacacctggacagtagagaaaaaaagagaagggttgatcaagcctgaactggaggacagaaggcctcgtttcaggttttccagcctttgttttgcatcctccattataatgtaactcaagaatgactaggtcaggctctagaaacttaaagatacatattcagggggcccagacacaggcttctgccacaccttccatctgatgccaacaccttccccaggacatctcttcatccctctccaaggcccgggcaaacaaccggcaaaatcgtcacgaatcagaaaacttcagagtccatgttttggtttcctggaatttggggtttgtagagagttaaatgaaaaactctcagtcccaatcttgtgactgaaaatctcccccaaatgtatcaggttgccatttttgaaaggcaaaaatctaccattccaaccgtatgacatttcgaaaaaagcaaaactatggaagcagtaaaaagatctgtggttgttaggggtaaaaggggttgaacaggtggagcacagaggatttgggggcagtgaagccactctgtatgacactatactggtggatccatgtcattatacatttgtccaaaaccatagaacgtgcaacaccgagagtgaactctaatgcaaactatggacttgggtgataatgatgtgtcagtgtaggttcattgactaacacatgtaccactttgtgggggatgctgacagtgggggaggctgtgtgtgtgggaacaggaccatatggaaactctctgtatagtgtgttcagttttgctgtgaacctaaaactgctcctaaaaaagtaagtcaggctgggtgcagtggctcccacctataatcccaacactatggaaggccaagttgtgcggatcgcttgagctcaggagtttgagaccagcttggggaacatggcaaaaccccttctctacaaaaaatacaaaaattagccaggtgtggtggcacacgcctgtagtttcagcttcttgggaggctgaggtgggaggatcacttgtgcccgggtggtggaagctgcagtgagcgagatggtgccacagcactcaccctgggtgatacagtgagaccctgtctccccgcaccaaaaaaaagtttattaaaaaaaaagacaaaaaaaaagtcatcaacaatttcctgtcgttgcctaacatacggagtttcatatagaacccagtatcagcaggctctctggccttggtagcagagcagactgaacaggagggaccctccctaggacagctgggaaaagtgcagtctggagcagcgattctccccgacttgggaagggagaagtaaggatggagcctgaacccttgagtactagcccaaggttctgagatgttcttctccttaaacaaaatcctacacatgctcctgtgttactgaaattcaccatcccaatagagaggtgacttcagcagcagactggagactaattaaggttttaccatcaacatttgtgagaagggggctgggcatggtgggtcatgcctgtaatcccagcactttgcggctgagatgggcagatcacttgaggtcaggagttcgagaccagcctggccaacatggtgaaaccctgtctttactaaaaatacaaaaaattagctgggtgtgttggtgcgtgcttataatcccagctacttaggcggctgggacatgagaattgcttgaatccgggaggtggaggttgcagtgagccgagattgcaccactgcactccagtctgggcgacagagcgagactttgtctcaaaaaaaagaaaaaaaaattgcgtgagggtgaggggaggagatggggttccatgaggcacacacaatgaagtggatgaagaaaaggggcatctgaagcagcatgaagtcagttctcaccaaccctttgcaagcgcaggcaggagaagaggacgggagagaaaatgaagaggagaaagggaggagcaggcatgcgacacgcacaaggaacaggtctccgacacgggagctgcatgtgccgtaacatgaatgcaatctggcaggcggcgtgggcatgtgtgtcggaaagagagatttacaccgggaaagggcacctcctaaaatatttataaatttatcaagaaaatatgttttaaaaatgaaaaataaacagatgtacaagtgcaacttgagagaaatacattatgcgagtttgcaacagctgagtggcgggtgtgtgggagacggcgtgggagtggggagtgagtgcagggcctgctggggaccgggcagggcagggagggacttggggagaggtggaagctgctccgcccaccagcgccatccctgtcaggacatagcatcctcaccacagggtggcagataagaaacaaaacacatctgggatgtctccttagggaaaaaacttatatgggtggctgtgcaacctggagctctccccttttagtacagaaatctgcaatgtgaggggcaatactgcttgggcgctgggagaggaaccccaggatcattctgccacattaccccggccaaagcacggacccctccaggcctactcatctgttaaatgttccaggccactttctagggggaagaaaatgaggtgccgcgtgtgacagcagcaggggaaggcattgcaaatcatgccttggttaaaaccatgaagctctcagtcacagacgtacactgatgaatgtgttcttattcggcactgaaacacaacgtgttatttaaggggatgccaaaaagtggttggagaactagatgatgctctaatttggttttttggttgaaaaatgctagcaaagcgctttagatatctgcctggtctgtggcttggaatttatttgttcagtatcacaaaattacactaagcagaatgcaaattaccaaaaccaggcatttctcaaatgtgggtgactgaagttattttactaccttaagaggagtgcagggcactatagacatgtgcctaggcccctgtagactcacacccagtggacttaactacctaagcccagcaggctttcagaagacccacactcaccagcaggaatgtcgtctccttatgtgatttaaattaaattttgttgtttaacgacattaaacatgttaaagcaatatttgaaagaaagaagaaactcataatcccctgaactgaatagtcacaatgtccagcgaattttagggcaatagacattttctgggcgccagcaatgggtccaacactggatattcagagatgatcaagtcactgtccttgtccttgaggaactgacagttgagggctggggagacagacaaatgtatagataactcaagagtaagtgataagcactaagccagaggtcagatcaggcttccacaggcaggtgcccagcctaactggggactcaggaaaggggcttcctagagaggtgatgcataacctgactcattcattcatttagagatggggtcttgctatattgcccaggctagtctcaaacttgtggcctcaagtgatcctcctgcctcagcctcccaaagtactgcgattacaggtgtgagccatggtgcccagccatgacctgactcttaaagaacaaaggagatagaaaaagtggaggaatgtccaaggcagagaggaagtggcataggcacaagtgcagagtttgattttatcagggatcaagtcctaggaagggagtggatggtgacactggagaggtagctacagactggaacacaaatggcaggagatatcctactaagaagcttggactttctttgttggtgatgggagctgctaaacacagacattttccctggtggtgagtgtcaaagaaacccacaaaacaacaacaacaacaataacaaaaaaccctgacgtccagggctatcttgataacatataacatcctgtgcttttctaacatttcatccttgtgctttcgttctcattagctggtggctcaccatgaggccaggaggtgctgcaaacagtctgaggagccacacttagatcatgaccataccatgtggcctccctcttcttcagcctgacacagacatggcacctgagatgagtttctgttatttggtggcagaaaggtggagctgaaggaggttgagttggttgtcttcaaagctacagtcaggagccagaggtcacctggatttactttctgtagtttatggttgcttatcaaggagaaggggcgggggcacatagctctgagtatgggggagcctgggagacgggagtttgttttctgtgacaaaacactctcaggcacagggatggcgatgacagccaccttgaggcagaactgcaaaagaaaggaccctgggcctgcaaagaatgtcaggagatcatctcctgagcaatggcccctctgcaggtaggcgtcctatctctattccattctcttctgccaggaggcaggagaaagcagtggtacaagacacgatttggaatcagacacctgggtttgcattcaagttctaccaagtactgggaagttttccagcccttctgcagttccctcctctgtaaatggggataaaggagtgcctgagtcatagcgttcatgtgaggattaaatgggatcatccataaaaacagtttagaagaatacctggaccatagatgctcataatcaacatcagttatttattcatttttttttgagacagggtttcactctatcacccaggctggaatgcagtggcgtgatctccactcactgcaaccttcacttcccctgctcaagtgattatcctgcctcagcctcccgaatagctgggactacaggcacgtgctgccatgcccggctaattttttgtatctttagtagagacagggtttctccatgttggtcaggctggtttcaaactcctgacctcaagtgatccacccgccttggcctttcaaagtgctaggattacaggcgtgagccaccacatctggccaacatcagttattttcacatgttggatggaaaataaaaaataactacctctatatgaataatgactgaaggatataaaatattgacacactattacacacctgcgcgcatgcatgcgcgtgcagacacacaaacacacacacacacacgcacagatgtaaagctattatttctgttgagaaacttcttaaaaaataaacccaaacttccgcaaagggtgacccttctgtctacttttccaactttcattgctgttactttacattagtcctggtcacttcaggttgctgatcacaatggatgggtcaactcaccaatttgcggatttcacattctaaattctgaatacagtccagtttccttttgcggcagcgctgggccgcgatgcggttcttgctgcgccgtcggacatcatgaataaactctaactgttctgaggttagcttgtgcattttaatcatcatctggaaatcgttccttggaagatctgtgatttgatctacaggaaaaggaagttttacctgaaaccaagaataacagaaaatgattatggcagctggattttaattctggcaggcggaacatcaaaaatgataaaacctcctttttatgatgaccaagtaatatggaaactactgaaagcaagcagtgattacttatttcctgtttaaagacagataagatgtaataatacctggataatcaaacagaataagaacacatatattgcaatgttattgtctctgagatttttgaagcaaatgacatgaacaatattggaaaatgtgtcatttttcattgatgtagcacttttgtaagaaagattctagttagttgaaatgtacttccataagacctacagcctaactcaataaaatgacaagttatagggagataccacataaggacatatctaaagcccctgaatgaagagagccccatgtatcctgaaaatgctggagacacaaaaaacccagtgtgattcttagttacaatagcatatgggagataggaggagataacttggataggcttcactagcatatagtaggagtcaaaagaaccgggctttcatccttctcaccagacatgagacctcaggctagctactccacctctctgagattcaatttcctcatctgaaaaatagggcattttaaaaaagccgtacagtgctatacaagtgttgggcactttgggaatttattttccaattttacaatgaaatgttgacattcctttatcaaaaggtgagatgcatttttcctgccttttgaccaacagaatgcagcagtagtaatggtgtatagtttctgaggctaggtcgaaaattagctgccatgcctcgaggacattcaagcagctctgtggagaggcccatgtggagaggggctgatgcctctagtcaacaaccagcatcaccttgccagtcatgtgaacaagccaccctggaaagattctctagccccagtcaaaccttcagttgagtgtagccccagccaacatctgacttcaccttatgagagatcttcagcccaaactgctcagatgggcaactcctgaattcctgactcacattcacatttctcatagaaactgtaagaggtgttaagtgattactattgttttaggtcattaagttttggggtgatttattatgcaacaatagacattggatgcaggtacttgccagcaaaattccaaatcttgacaaattccaattcttgacaaatcaaggcaaataagcattatctaaagcgaggacagcagtctcctgaaggatgggtttgtatccttactatgttgttaaatgattgcttatatttcttttttttttttttttttttttttttgagacagggtcttgctctgttactcaggctggagtggagtgttatgatcacagctcactgtagccttaacctcctgggctcaagcaatcctcttgccttggcctcccaagtagctgggacaaccctgcccagttaattaaattttttttttttttttttttttgtagagatgaggtcttgcgccacagagaaggggaaaaaaagagatgaagtctcacaatgttgcccaggctggtttcaaactcctgggctcaagtgattctccctactcagcctcccaaagtgttggtattacaggtgggagccactattcctggcctgaaatatttcttttcttttttcttttgagatggagtctcggtctgtcacccaggctggagtagagtggcacgattttgactcacggcaaactccacctccctggttcaagcgattctcctgcctcacctcctgagtagctgggattgcaggtgtgcaccaccatgcccagctaatttttgtattttcagtagagatgcggttttgccatgttggccaggctggtcttgaactcctggtctcaagtgatccgcccgccttggcctcccaaaatgctgggcttacaggggtgaaccatggtgcctggcctgaaatatttcttaagaatagcaaccagtgaaaaagactgcatgaaagagccccaagtgcggaaggtgagcagcaaaccactactctatctcaagagcctccttggcacccatgaggtgacacaggcttgcacctttgagcagtttgtcactccccttcccgaggctcttggggattcagcagcttctgggttcagtctggtcctgcttcagaagctcctggaataaaaaggttgtgtgctgccaggctaagagacaacgtgtgggttagctcagattgcttcattcttgtttacattcacgtctgctccggatgagccagcagatggcactacaaacctaaacttccttcaagcactagcccagccctgtctaatacaaacaatacgagctacatttgtgattttaaattttccagcagctacattaaaagaagtaaaaagaaacaggtgaaatgagtttgaatactgtatgttatttaacccaatagataaaaatacttccaacatatagctaatataattattaatgagatagtttacagttttttttttttttgtgctaaactttccaaatccaaagcacattttatccttacagcacatcataattcagactagccactttcaggggctcaacagccacgtgcagcatgaggcaaatggactggacagtgccactctaggagacagaataaatggactcaatgaatcccagcagccagaaaaacatatgggtctgggctgaactgatcaaaatgctcttgggtgaagaaaccaacccctcgatagtgttcagatgctgcagggttaagtctgtgttcttcaagggagtgaggatgaagacatttgatcctgagcccaggtttctctttggttacatcatttgcaggcagacacgagtcccggctgccggcatgtgtggctagtcaattcccgtgcacaaaggcaaatgtacaaaatgatcatttgacttttctgtggttgggtgcaagctctttgtcaggttccatcacagctccgagcttgtgcagtgtggcatttactgaaggttcccagcaggtgatctgattcaacttctacctggtgagctctgtcccatgacacctgtaaaattttggtccaagaaagcaaaatcgcagtagggcccatgacaccactgtcggcttggccctgctccgactgctaaagacaggcagccaggacaaacagttccttgttatgggctcgggaaaggcctttgtgcacggggctgtgtttgcacagggcttctaatgatatgaaagaatgtttgatttccctcttatacccgttggataacaaacacactcagatcctgcacggtgtctccggaacacagaggtctgtctgttggagatgtggatgttccaacacagcagaggtggtggcgctttgggggcttgtggagttttccctctgatgacaacaaagccattctgcttctgctctaaatgtgtttacttactctcagaaagaagatatccctatagttcaggccacagggaaagtcaaaaggatgtctataccaagagctactgtatttaaatcatccagacagtgaatataaaacactaggggaataggagggagagttgccaagaaaaagaaaaaaatcaccaatgctagtttcaaagtccttgagacaaaaagccatacaacacttcagcagagctgctgcaacacaatctgctttttaaagagggtcagaggaaaaggtaatgggtcaactatagactttctcccaggtgaaaaaaaccccaactcactcttgtttctctttacaagtcttggttccccctctagcaagggaggacttatgttcactgacatgcgggggtctctgaggtgttctcagacaggcaccgggtcggggtgggtgggaacttgaccacatccaagttgtttcttgagtaataagttccaagccaagaacatcttgtctggaaataaggagtagccactgactgtttggtcccgtggaggacatgcctctcccaggctctcggcactcaaaacattcctcaaatggggctgaggagtcagagaaggccaacagaccttggaaagcggaaacacatcaagaaggttgaggcccacctcttttccttctagataattattctgagccaaacaggcccagttgggcttaacatcttattaactgtccctccacacacttgctcctccaggatctcacttcccagcagtggcttggtttcctaaagagtcccaacagccaatgtgatgaggtgaagagtcctgtggactgtcgccatccccactagttatactcagccacccacacacagctccggacacacaggctgcatataaggggaagggcacgagggattcatgggcgccactctttagccaggggtctaccactttggttctcagtggagaatcggagaatcagggcagccactgagtcagcaggccaagggccaaacagggcaccagaggcctgtgccacagttggcacaataagctgctgttgattttattcagcccagcaaagtgttgactcttccccctctggaacacgacaggagcagcaggaccgaggtgggtttttagcacggtacctgccctgtcctgctaagcacggctataggagggttagttcttctggagattccagctttacacattttttttcttttaaagacagggtctcgctctgttgcctaggctggtctcaaactcctggcctcaagctatcttccttccttggcctcccaaactgttgggattataggagtgagccaccacgcctggctaggctccagctcctgagcagtcagtaaaatggatagtccctgcagtgtgtccagggattcttaggtccaggtgtgacatctggacagtgcatggaacctacatatgtctccttgcatgctgtctgcaccaacgaggcagaggggaggctgtaggctgggccctggaatgccggtgcttccttctcaccaaacagaaatcggctgctttatttctcttccctgccaacagccacgaccattcttcagcctaaaccatcatccccttcctcccagttaaaaggaaacattgaaaaattatataagtattatataattatagattattctgtaagtattatataaaaattacatattatataaatatagctttcataaaatataagacaaaagaagggaaaaaaaattctcatccccaaatgatgactctcttgctctggtagatttccccgtgatctttgttttctctgcatcttttttaggagttgcaatcaagtggtgctgtatctatctcacccaacaaacatttcgcttgcctagtgtctctgctttgctgggtgaagtttactggaaaagcaggaaagtagctgcaaattttgcagaaaaagccagaaacaaatatttcctgtagaaatctcagtggaagactagtttgttaatattttttcctacttcatttcttggttttattaccagatgttgattgaaacccatgggagtagggtcacattagcatgataccctgagacactgatggtgtggtcagctctccgaagtctttaacgcctgtactctgaggagaccctcagatcccagggagctgtcgagggaggaagcaatatgcccattggagatgattccagtgctgctggaaccaggacagccagctcagtgctgggcagatggcaatgacaaaatctcccctcccaggtgaagaaatgtttctcgcgcaattgtccttccacgccctcttctcatggtccagtttctagcacaaatatgggacacctgggattcagttgtgatacgtcaattaattagttgtgtgatctcaggcaagtcttcattctgtctgtcccaaagttcttggaggatctaggagtcacagggcgataacgcctgccctacttagcttacagggttgctatgaagaatacaactggatgacaggtggagaaagtgcctgggaaagtttcaactgcctgatagatacaaggtattattatttctgtttattagccctatctatctctgtcacatggtttcgtcttacagacatgtgctttggaattccagacacttacaatgttctagacaacataaaaacactgttttaattagaaatatggctgatttctatgctgcccagcaaggtttctttttattaagcagaccaattacagacacttctaaaaacttgcctgattcaccaaaccacaaaaatgattgtgaaaattttacatacaacatgtgtctcaaagtcagcattggggtgggaagagttagagtcagatggctcttctattctgtaccatttccatgttttctctggactttatctctctcttcccttctctctctctctctcccgccccctgcctgcccccaacacactctcttactctcatacacttttatctctctcagtgtaaaacatgttaataaagcaagtccaaaaatccatacttttgactgtgcaaagaaactctctgtggtgcttctttactaaaatctacaattaagtagaaatggtccagttacaaagctgtcttactaagaggcttactactttggaaaatgactgtaattttctataatttccaacatctaaaaacaaacctataaaccataatgagataaaccataactactcacacccactagagggcactaacaaaaaagatgggcaataacaagtgttggcgaggatgcagagaaactggatccttgatacactgctggtgggaatttgaaatggtatagccactttggaaacagtctagtagctcctcaaaaggttaaatacaaagttatatgatttagcagttccactcctaggaatattatggaaataactgaaaacatgtcttaaaaacaacttgtactcaaatgctcacagcagcattatttataatagccccaaagtggaaacaacccacatggccctcaaccaatgaacaacaaaatgtggtattagtcaacaaaatggatcaacattatggaatattactcaggaattaaaagcaacaaagtactaatacatgacaatatacctggtgagtacatcaatggcaagggtaaaccttcaaagcattatgctaaagtgaaaggagctagacacagaaggccacatcttgcaagattctatttatacaaatgccccaaacaagtacatctacagagatagaaggtagattactggttgcctggggctgaggggagtgggcaatgaggagtaactgctaataggtacagcatttccttttagggtggtgaaaatgttttagaattacatagtggtgatggttgtacaacattgtggatatatcaacaaccactgaattgttcatcttagtagggtggattttatgatatgggaattatgtcttaatttaaaaaataaacctgtgcaagatagacatacataaaattcaaacattacagacatacatagaaatgaaactttccctacactcctctccaacggtgctcccagttttttcttattctctatgctgattttatttatatggtgtgtatatttaggaaacaaactaggaccttgtgcatactgctttgtgattttcacttatgtgacttgttcatttttttttactggaagagaaaaattcccaacctgacttcttaaggaatatagcaaatccagaagtcataaagaaaaagacttataccttgactacataaaactaatatttttttatatgggaaaaggtacaataaataaagaagcagactaagggaatatctaagcaacatttatgagaaagggttaatattcctaatattagggattaagattcctacatgttgatttaaagttaaacaatacaaaagaaaaataggcaaagaggtaaaccagcaattcacaggaaaggaaatataaatgttcaatacacataaaacaagatgtcagcctcattagtagtcaccatttttttgcccatcaaattggcaaaaattaaaaagactggtgacaactagtatgggcaagaataggggaaattggacactctaagttgctgatgaatatgtgaattgctacaacattttgggtaggtcattaggtagtatttaataaatgggcacaacctttagcccatctttgaaactaacccacaaaaataaatgcaccactactaacagtagggtcacaaaatgtttattgcagcaatgtttatcagagggaaaaactgaaaacaactgaaatgtctggtgataagtgacagctgaatgaactacgatttacgagaacgagagatattggagaaacatgtcttggccctgtgtgatcgacctacagccacgtgcatggtagacagctacgtgaaaaaaggaagctgctaactctacaacataatgccattaaaataaaacccaaacccatagagaggtgaatatatatttgtatattgttgtaggcaaagagaaagcctgttaaatttggtatgtttggggctgggtatgctgtgttctagaatttaaaaaagaatgtcattttaaaaagctgattattgataaaggataatactgcgctaatttgatctttctcgaagccagggaacagttaaaaaggatgggagaagccaacgactgtgagatggaagggctgcttaacacggtataactacaacatcttacagaatacaaggtatgttaacacttcacttttggtctaacgttttggctccctacggggtggaggaagacagattgggaaaacacacgcgaagtattacactggcgtctggcaaggggtggaaactcctgtcttgatttctgactctggtgtctccgtggggttcacttgaaagagaaggcacctggatcccatatgaaagcagggcagggcagaattagcccaatagatgctggcttcttctggatcagttcaggaaaacaagttttgacttgtggagaaggatctgccttgagcactattactggggataatacttcaaccagggtcaaagtaactccctaaagcaggttatcaactcctcgagcagcagtcatggcaagtccctgagacagttcttggaaacctaacctcctctactctaggaaaactaagatgtcaaattgggaaaaaccttaactttactgtaactgtcctgtccaaactgtaccactgagaggggctatgttttccaaaatggcatagagctttggtaaatgtctcttctttcactgttcaggaatgcagaagatggatttttctttctttttttttttttgagacagagtctcgctctgtcacccaggcaggagtgcagcggcgcgatctcggctcactgcaagctccgcctcccgggctcacgccattctcctgcctcagcctcctgagtagctgggactacaggcgcccaccacgacgcccagctaatttttttttttgtattttttagtagagacggggtttcaccgtgttagccaggatggtctcgatctcccgaccttgtgattcgcccgcctcggcctcccaaagtgctggcattacaggtgtgagccaccgcgcccagccatggattccttttttaaaggtaaaaataagagtatttttaaaagtagcggtatttctcaaggggggaaggctagtcctgttcatgactattttacaggttgaatgagtcctccttttaattgagttaatatttttagttctaaagtaaacaactgacatggtcccaacatacacacaaaaaatgtgttcttgctgtggccccaagactttaagctctcttttgggatattggcggcgagggtggggggacacaaaagaagatgtatctgaaactgacagttctttgaacatatgcaaatgtcataaaaacaccaccctcccttgagcttaatggccagccttttatttttttttgagacagggtctcactttgtcaccgaggctggagtgcagtgccaccatctcagctcactgcaacctccttctcctgggctcaagtgatcctcccacctcagtcccacaggtagctgggactactggcacgagccaccacgcctggctatttttttatatttttggtagagatggggtttcaccatgttgcccaggctggtcttgaaatcctgagctcaagtgatccacccacctcggcctcccaaaatgctaggattacaggcctgagccaccatgcccggccccaggctcctcttaaaggagagacaaaaaacaaagactgcaggcctttgtgctcttctccctccaccagtccttggtaggaagccatgatgcggatgaggtggacgcagtgacttgccttccacatcaggcacgctcattcacggtttcagaacaaaaggaaaacctcacaaaagaggtcagagggaaagaatgagtgaggagagagaaaacacagcctttcactattttcgggaaagctcaatcttcccaatgtcagggacacagatgtgagcctggcttggggcactgggcacaacccaccaccccaaacctaaggggaggtggtatattcgcatgggaatagctcccattcatatttcctttctaatttattttaaattaaatccttgcagtgtttctctttctccatgtctgctaggcagttaagagaggggcagaaaccaggctagcaagcaaagaaagtgaccacagggcatttttgcagttggcacaggggcctttggcatctattttcaaaacacgcccaaactaaaacctcatgtgcttctcgccaatcttgcagaggctgaataaactgcacgtggctctgtgaaaagccacctcatcccgtatggcatttctgctttctggctgggttaacatctctgccttacagaggctggtaacatccagagagcacagatgggtaccaaggttgccggcctcaggaggaccatgtttcatttcttcctgtgtttttgggatacacagctctgagaagggacttgtcactgggtttgttcaatcccgctcctgaggggggtctgagacacaggtagcagtctcaagctggtaccttgtcaatcagcaagacagtgcagtgaacgccaggtcacgacacagactctctcaggtctttctagggaatgttcatgttattggggaggtgggtcctctgcaggggcctcttctttcctctccttagtcttgtgagtcttgctcacgatgtggctgctgttgcccctgttcccctcttccagcaatggtaagacacacatggagcctctggacatttttcctagcaagtacattgctttcagggtggatgaaactgctactctaccccactacttctcaaaatgtcttcctagcatttgagggagcttgggaaatgatccattatacattatgtgtggctgactagggtgcttctgtgatgaccccaggaccgggataaacggtgaggcttccatcaccttcactgtgatggacatgggatggccctggggtcttctgttgacaaggaaaatctaaaaggtgctgggagagtgttgatctatttggtttcaatcaatcaatctggaaagagattctatatcttcctttacgctgaacgggtgaagggcaaggatgagggtgatgaacatggcatcctttcaaagcaggtgtaggagggggagagagggaggagaaagaggggggtctggagtgcctcagtgtacttcatgcattagacttcagtatatttttactcagcagcttgcctctgcttgtcgagtattgagatccagatcaaatatcaagtgcttttctaggacagaagtggttaatgtggaatcaccttcagcatcctgcctctgtggatggggaaggcagtctctctactgtcatctttaatcttagcacgtaagaacaatgtgggagtggtggggggcagggagtagtccagataaagggcctagagagtgggtcacatgcttgaatttatgtgggttccctacctcctggcccctgtcctgcacaggacacgactcactgtctgcttccgagaacgatccggattcgtcactggagttggttccataagactgctcacatttaatttggggccgcacttggttgtacattccatctcccatcaggcctggttcctgatgttctgtggcaaggaatctggctccctgggaacagggcgaggaggagaactcacagagagggaggctgcagggtgagcccccgctcccgtcctccgcgtaggaataggaagagcaggagctggaagtcctggtcctggtctccaaggggggtgagcgagggcagactttgattggtaccgggcagctggtgttgggccgcatccttcctggcaagtggtcggccatcagcccaccgtgggagtaggcctgcgagctggggagggactggccggctcccacccacagaccctttggcaccggctcagagaggtctttgtccaaactgctcaccccagaataagaatgcaccgaggtgctcacttggtcacaagcgctggaggagaagatcacgctcctccggtccagctctccctcctgtttacagagagcctccaacccaggccccctgaggggcgaccccatggtgaagttggacacctccttctggcccacgtggggctgtccataattccctgtgaaaggggtgtagtcagttttaaggtcaccctgagtgatccccttgtcaaaagggcaggctggactcctggcaaagtgctgctgagatgtactgggcaggccagacagctccacacttttcgttatgctgaacagagaccttaagcaggagggcgaggccacgctcctggatctctccaggcaggcggccccagctggggccgtgggggtaggggcagggctgggctgtttccggtccatctcgacatcccccgctctgtccttggcgtcaggctcatctccagacaggcagagcgtgatgctctcttcctcattctcttcactgggcggctcacttttaatctgccccctggcaagccccggcttgaggctgttgctagagttatcttcccggaatgtgcttgcaaaacctgaggtactgtgtgatgatgcattatagacattcttggtacatgcaagctggtatttcttgtatctggggtactgcgttaacgcgtccttttctgagctctccttggtgtctgtgggcacgtcaggctcgggcagcagggcttcttccttctctgctacggggatggcggcggcctcaaagctgatgggctctggaagcatctggtccctggggcaagccatcttggccgtctctgaatccatcgtctcctcctcttcatcctcctcctctcctgcagagttctcgcagtcctcgtgtgggcgctggcacgcagcatccttccggcacacaaacaggccatcctcactgttcaggagctgggtctgcaggaagctgaagcaggagtcctccaggttgtgcatgcgcaggaactcagcacagcggatgacctcgcggatgttttctctgctgagtaacagcttggcagtgtaggcaaactgtaacagcggcccaaagcccctggctgtgacctgcaaaacaaacagggaaatcgccaacattaccatcagcactgctattgtcccgaatccctcaactgaagcaagataaccagacagtgctaatgtcccagaataaagactgcaaaggggcagttaatcttgtagtactgggtcagcaatgattctgcttccaataattagtgcctgtctcgtgcatgccactgttgtactccatcacagcacaggcagaattgaaaatcaccagggtcaagtggctaaacaagatgacaacgggttcagtgtttacactaatgaaatatcctggcaaaaatgcacggtgacaatggggagcctattaatttccctcccaatcagtcctgttgagagccattctacacgaggggggagtgttgtgacacttcttgcagcttgctggagcccaagagagccttaacgttttcttgtcaaccacaaaaatggcaatgtgaccctgcaaaaaactaactccagggagttgtaaaaataggttttcctcacttacaatgttaaaagagacattaaaacaactcctgttttgctcatccatcacagtttctacttgagactttcggtcatcatgtctacctgatcttatgatgatgatgatctcattatctcaccagagatgacaacaatcaaaagtggtgtgctcaagatgaaatcaacccctggcccataatgaatgggggttgcagagttaaacaaaccggctctcatttaaatggttgaagctgctgagtggcacagggtatgggctattccttccctaattattagcagcagctttgccatgcagctgtctttttttcctggtaaatcttcaggggctaagcctactgtcatttgctgcttatctgttatattttacaaagattgaaagtgtgctatttatgcacagcttgcatatgcacacaaacacgtgtgtgcccacacgcatgcctgctcacacacaatgacttagacaattaagaatatgttgcctaaggccaattgttttttcagatggaaatggattaaacttgctggtgttcatcagggtaagcttccttaccctgcacataaaaccacacatcctctaggttcttgcaagcactgctgaccacacaggaaggtgacgcatgtctacaaatcctgtacaaatcaaatgaaagcagcaatcatggggtccttgctagaggctatggtagcagtgatacaaaattttagcggggggagtgagtgcacagcaaggtgaactggtaaactttgtagctgacttctgtgtgtattaaactcaccgcagcatacagagccaaaattcttgcaaggacctgtaattgatgttcaagattcaacctggacattcactcctttgggagtgctctccagtcctcttagagagaatgaatgacattgtcctctcagctctcatagccagatgaggagacgtgctggattctccagggcagcactgatttcatatcattgcattctttccagtaacggaaatttcttagacatgtaactgaacgggattttaattgttaatctttttaaagtactcaagtaagattccacattaaatttttctgtcagatgatgagtccagagatatttggttaaaaaaacaaaacaaaaagccatgactgctagacccacattataaattctatatgggcaatcagtgccatctcccttttattatacctaattgtgcctgtttctaccataagacagcaagctccttcagatcaggaatggttttgtctgtctttgtaaccttgcatctaatctaacctggggtctctcacatggtaaatacttgttaaaagcttgtatgttaccaaatatgtcatgagtcaaactgtgtcctaacatactactactgtgtatgcaaggtgacaacacagtatgtttagagagtgttgtctcaagttacttttggagcaaggcatcatgtaaaccaactaactgaaccgatcaactgatcaaaggcaggcaggcaagggtctttgtttgccccgtgtcacagtaccagtattaaaaaggaggtctgaccgacacttttgtatcctgctaagctgacatggtaataggttcagcaaatgtagtactgacaatacatctgttttatgtccttttcttccaagaatctttaaaagaaagtaaaaaagcaaggaaatgtgtatttataggtaactgaagaagatgacaagaatgtcacatgacctattcctttactgccacatggctccaccacaaagaaagaaatggtgaaatcaatgcagagttgacccctgccctcgtaatgatcctatgctcctctgtaatgtgccagttgccaaaagggtggataagacacttcttgagttttggcaaaggtgctcactatatgggaaatgtaggaaactaatttcaatgctatttatactgttcacacagtttttctttttttttttattattattatgctttaagttttagggtacatgtgcataatgtgcaggttacatatgtacacatgtgtcatgctggtgtgctgcacccattaactagtcatttagcattaggtatatctcctaatgctatccctcccccctccccccaccccacaacagtccccagagtgttcacacagtttttctcatactcccatccttatcaccattttttttttttttgatgctgtaggtctaagtaagtcttaccactatcttccactgtggcctcttgtaaagaaaatttctaaagaagccagggacatccatggggatctgtagatcaggaagcagtactgggagtcaccctctgccacatggctgcaaggagctggagaaagcatctccgctcagggacgagctgatgcttaaatgtatgaattggaccaaggaggtgaatgagcaaagtctccacatcacaaatcaatggcactccttagatcactgaggcttaggaaacttcctgagcttgaaatgatcgtcatatggtcatgaaagagtcatagataaaaaatctggtttgtaaactgtcacttaagcccaagggcagaggaaatggtgtcctcaccatgaaagttcaagagctcataactagctcttctcccattctggtttcagtcctgctttgtcatatttaagtctgcaagattttgctcagcttctgtgtgtgaggctttgtttggtgagccagaatgaccatttaccaagtatctcctagtgcccagcactgtgctcttgtaacaccctgcaaggcaggcatgactgcccttattctgtagataaggaaactatgaagcagggaggtgaaggagtttatccatggtcagtgctagtcagtggagagctaggattccaaaccaagtccagtctgtttcttcttctgtgctagtggtgtgagggaaggatatgtgtaggactcaggcctgtgctcaagagatctaagatttagctttgtagaagaggtacaaatgatgaaaagttaactaagtaacaatgtaagcaagtcaacaatggaaaagccattgcaagattatatgagtagttgtcaactgagaaatccagacaagttcaggataggagactactgaggctgaggggactagcaagggggccccttgaacacttttatcagcacgccttgagtgtctgctctaggtcaagggttgctttgatacgatggctactttcggaactgtcacaagggtccctcccaggaacccatctctggtctactttcggcagtggtaatcgctccagatacacaaaacagaaagcaagtgcccatcacacctgccagcaagtgttacaacaggcagaggctttctaaatactggcttagcctccatcttgagaaggtggcactgtctacccatttttagggaccatttaaattcattcattatactcagaaggcaaatattcaggtaccagtgaaaagctgtatgttcatgaaactgtgaccacaagtctgcattgttacttactttttgttcttaacaaataaggctctaataatgggaaaaaataagaggggggtgggaggtggagaattacacgcaaaactaacaactcataaaatggtattttaaaaagtaatgatcataaagttaaaatggaatgaagtggctataaatagaagaatagttccaactcactgatgttaatggagttgcatccctctgctctaagcagacccatctagactaaaatccactggtcagcagtggcctcaaggtatgagaaacaaatgcaaaatatggtgttagggacaacttgggataacagtcttgcattttgaatgaaaatattttgaatgcctcatttcgaagaacattttttcattgcacttaaatatgtaactacctggtctcatactgtgcaatactcattctgatacagatgagatgggatcacacattggggccagaatacagtgtgccatgtgggggcgagacctcggagaaggcagaaagttaaccctccaacctcccacagactgcttcctaggaggtgatgacctcagctagcagttggcacatagttggttcaaccctgaaagaaataaggccagggtaccgtgtccgatggtgcaagtcaacatgctgacaatgtgttgaaatttgacccactgtaactatgacccttaatccttcattacattggattctaacatatcatctctctgctgaaaggaagatgggctgatgaaaactcaatttgtagagaaagtttgggcactgtttgcaaagctggggagctcagtgttttggggagctcagtgttttggggagctcagtgtttcatgagacatccattttgctgcaggacagagtttatgaggatacttacaacagttccatctctggactatgatagggatgaggcagtcagccttcaggcatttattgaaaatagggtttgaggatttttgagacttggaacatcattctctatataagctacatgactaaggtgtctccagttggttttggcagtatatacacatggctgtagcattgagcccatctgcagaaggctgatcagatgaatccggaggacaggtgactgctccctgggagagggctggcacgcttctcaaggtcccttaatcacaacttcacaaaaaagggaaacttacatcttcagcaacaccatgtacactttcctgatgaagctgaatctcttacacactgcaggaaccaggaagataaaggtaatgaacccctgcccaagggctttttaaaacgctagaccactgacaacccctctgggttgtatttgcacagcaaggcacttgtcaaatgatgaaagcaatgctggtgacaattaactctcccttcccactctcttactgcactgcaacccactctgcaggatgaaaactgacttagtgatcaggcatcactcctcatcttaattttctataattcatatccacattatcacattcttcttccaaagcagcatgctagacatttagaaagtatttgtcaaattaattcaccttactatttcaacaaagcttctggttattttagtattaatttttattttatctatttttacagacagggtctccctatgttgcccaggcttgtcttgaactcctgggctcaagggatcctcctgcctcagcctcccaaagtactagaattacaggtgtaagccaccacatctggcctcgtattaattttatttatttatttactgacagggtctcatactggttgtccaggctggagtgcagtggcatgatcttgccacttactgcagcctcaacctttggggctcaggtgattctcccaactcagcctcttgaatagctgggactatcggcatataccactatgcccagctaatttttgtatttttagtagagacggggtttcactatgttgcccaggtggtctcaaactcctggactcaagcaatccgtctattttgacctcccaaagtattgggattacaagtgttagccattgtgcctgggcaattttattatgaattttagatagagcttattttgtgttctattcctaaggtaataatataaaaactaaatcaacattgaaattgatttatacatatatcatttcatatggtggttcttttagctaaagaaaatcattatttgtcttagtgaatatgtcttaaaacataaacggagtgtcttttctctcctgtgcaggtttgaacttggatctgcagccataatgtaaaaatccttcccctatttgtaagttttactcctgagactctatctgatcattcagtcacttataatttttttgtttactaattttattttattttttagagatgaggtctcactatgttgtccaggctggcctcgaactcctgggctcaagccattttcctgcctcagcctctcaaagtgctgggattacaggcatgagccactgtgtccatccatactcattttttcattctccaacgatgtgctaggcactcactgtgtactatgcaaggtctggggactccactttcttggattcaagtctcagctctgctgtctaccagctgtgtcacttgggctggttacttaacctttctgtgctttagtttctctatgctttagtttctacaactgtaagacagggatactgacagtgcctgccttatagtaaaacctttggaacaggacctggcattaagtaacaaccagtattattgctgttgctacaaatatgaataaaacaccacctttttctccaaggagctaacaagtgactggggagacagatgttcaatataaatgtttacagtgtcacctgagtacgtaacagaggtatttgcaggatgctgggaggacagggctggagcagtaactgctaagggaattagtgtaaggctacttagaggaggtaacacttgccaagtgttgagggctgagttgaagttcttcagaataagtaaaagaaaggcatgtctcactccctcatcatcttccggcttttcctcaaacgccatttcctcactgagacctttcctggtcctctattcacaattgccctcccctaccacaaaaccagaactggctagatggtttgcagggcctagtgcaaaatgaaaatgttagcctcttgttcagagattaagaatttcaagtgacaagagaacattaaacaaagtgcaggacccctctgagcatggggccctgtgcaattagttgcacaggttttatgctcatgaagctggccctgtcaataacacatgcatgcacaagtgcacacacacacacacacacacacacacacacacacacacacacacacacagttacctattccctgcagttgaaatggactccctgatttgaggagggggtgatggcatcccagggtggaggtcaaacagtagaccaccatttgacttcaactttgggctgaaaaacatggtcagcccaccaaggtactttttgattagtaaaaaaaggaaaatcatgtaggctcagtgagcaaaggcctgactcgaatccccatgatagagagtcatgacttgaatcagttaacagactcagactccctgcaattattctcaggaattcttgaggacagaccctaccataacccacatttttgctatgatttctcctgtcacagggttttccgaaatgtacttgtagttttttcctaaatcatgactcaatacaaactttttaaattaaaaaacacctaaaaaaattattcagaaactgttgaggccagaaccaaaactattatcactctctctgtgcgtgtgtatctctgtaacactactttaatacaacttaactaccttaatacaaacataaccggaaaactgaaatagtccttaccaactactaattttgacttctattatttgactgaattttagtttgatgttgtaaactcatatgttggttatttactattgtctctcggactcacatccacttttctcatatttccctcttgctgaggctgggagttcaaaaactcttgtttcctaggctcttttgctggttaacttattatcggacctgccaacaggtgcacaggtgggtgagctcagaaggtgggaggcatgaagacgctgtggctccttctgtctcttgctctgtttatctttcctttcttggcggtgtgttctggaagtggctgcatccctgactctgtggtggagtgtccggaaggggctgtctgccccacagctgcagctcccgaggcacccgcccctccaccatgctcacaggtccctttcatcccctccagccctaggagtggtagatactttctgcggtcattaatcattaggttagctctccttcccttttctgttcttccagttttccaacacctgtgtaaccaatttcctgttttatagcccctctatttgaaacacctggcatggtttctagttccctgacttaacaatccaatttacagacaaggaggccaaggcccagaaaggtgaagggatttacccaaagtcacagggctgcctggccagggctaaactcatgtcttccgaccgcagagttcaactctcatgctccctttctacctgttgctgtttctctgaagtgaactaggaaagaaatgctatttcatatggaaacatgttattgtaaattttattactctctctaaaatattgttttatatagctctatccaaagaagtctggccaattggatgcagtacatcttttggtatgcagaaggtgaatctcataattggttctatttttccagtgtctgcattcctcctgaaggatgaagataactgctgtgtccctttcctgctcaatgaaactctgcaaatcctacgaagcccttttaccacatggggatttggtaaattatcaggcctagctaagtattggtccttagaatctagaagacaaagcagaaatgcccttctggcggggtgccacatggcaccagagctttgttccacagtggaatggcagtcggatgaagctgatgtctagggggagcgttacgtgtcccctctctgtgatagtcggctcagaatggttatggggctatataatggctgaaactgccccttaggtatttctttggttgtttcaaggttgatgggaacaggagaaggtcccaaaagcaaacattccatattgtctttcctgagaactggcgacaccttgggtatgtggaaccttcgtttcaactgggtggttttgcccatctcatctcacctccttcatatgtggcgctcataattttcccattcaggtatagatggttatatttcctaggttagtgacaggcaaaagtcatatatgatacagatacaaggaactatattcatatttaccctaaaagcatacggtgaaaacagaaaatctcccttctgaaagattataaaatgaagttcacagaataatttttaaaaatccaatttcaatataagtgtaggtcttaaaatagatatgaaatagtagtaatgtttcacgtttttcagtgtaaaataaaagtgaaaagcatcccactcactggtaatgaagtagtaaaacctgcatcaaggtttatggtttcattcgaaaaactgcctccaaaagaaaattatttttaaaaagaagatttagaaaaaattacctaatttccattttaaatgaccctcttcccattccagaaaccagtgattttcctaggcgagaatttcttgactcaaggtctggtttcaccctctcaacccctctagtcatttcaaaccaactatgaaccacttgatcttcaaccagaaaatacaaaacatttttgaaggcttccagtgatgagaagtttggcccctcattagcaccttctaatggttcttcatgttaagtttcaggaatggaagttttggcttagtcagttatgagttcttacacctttcttgttactctcctctgaaccacactgcctgcgactacacccctggcagatatctggattgaataaatgctccaatcattggtacagaggacacactatcacctctctctgtctatatcctattttctagaaatgctcagatttcactgtcacttattatttacaattaacatctctgagcttatttcctcccagtatctattgataagccatgtgtccattttaaccttgcaaaatcaaatttttgacccaagagtgtgtacttgtctagatactcagaaatcattcctattataaaaactactattcagtcaaatttttaaagatccactttcttctctttgttttgcaaattacgatgcaatttctgatctctagtcttttgacactttccttagctccacagtccctgaaagattttgaccatagcaagttgtatcataatcatattattccccctgcagtttgggggctttacttcatccagtctgggagcttagcattttctttttgttcatctacctagggcttcctttcccttttccaagttttttctcacttttcagtcttatggtcattcattcagtcattctccttgatgcacaatataaaattaactctgggctttttgccatcctcagtactacacagtcagccccaatgagcagctgttggttccctcatctttacgctccaaagagaaccacaaattcatttttgttttctgtggtcctcttcgaaaggtctccactcattttgggcttgagttttcttgaacgccttatttgtggttccatacatgttcccatagttgttcgtgtttttccagtgtttaaaataaaactctgaatgaaacacaactgctggcacaatttaccctcctttttcaagaaaagggtcctcatgtgaactttgttttggacacttctagccctcctgaatcatctttccccacagatgcataatttctacctttttcttgttaacataaaaatctgtttaaaaatgtcttgaacccaaaattataaaactctagaagaaaacatgggggaaaagcttcatgtcattggacttggtaatgagttcttggatatgacaccaaaagcacaagaaacaaaagcaaaaatgaacaaatgggactatatcaaacttaaaatctgattctatcaaaggatacaatcaaagtaaaaaggcaactcatggaatgggagggaatatttgtaaatcatatacctagtaaagggttgatatataaagaacccctatgtaaagaactctcatttaaagaactcctacaactcccaacagcaaaatataaaataacccaactaaaagtaggcaaaggacttgaatagacgtttctccaaagacatacaaatagccaacaaacatatgaaaagatgctcaacgtcactaattaacagagaaataaaaattaaaactacaatgagatctcaccttacacccactgggatgactactaccaaaaaaacagagtaacaagtgtcagcgaggccgtggagaaattgaaatccttgtgcactgttttattttttatttttcttgtttgtttttgtttttaagacagggtctcactctcacccaggctggagggcagtggcatgatcatagttcactgcaggctcaacttcccaggctcaagtgctcctcccatctcagtttcccaagtagctgggacaggaggcacataccgtcatgcccggttaatttcttatttttgtagagacagagtcttgccatgttgcccaggctggtcttgaactcctgggctcaagtgattctcctgcctcgttctcccaaagtgcaggaatgacaggtgtgagtcactgcatttggcccttgtgcattgttgaagagattgcaaaatagtgcagctgctatggaaaacagtatgaaggttccttaaaaaattacaaatagaactaccatatgatccagcaaacccagtttgggggatattttcaaaagaatccaaagcagggtcttaaagaggtgtttgtacactcatgttcacagcagcattattcacaatagccaagaagtgaaagcaacccaaatttccattcatgagtgactggatcaacaaaatgtggtagatacatacaatggactctcagccttaaaaggaagaaaatcctgtcacgtgttctaacatggatgaaccttgaggacattacgctaagtgaattaaactaatcataaaaagaaacttctgtgtgattccacttatatgaggcattgaaaagtagtcacattctcacatggacacaggaaggtgaatatcacactctggggactgttgtggggtgggaggagtggggagggatagcatcgggagatatacctaatgctagatgacgagttagtgggtgcagcgcaccagcatggcacatgcatacatatgtaactaacctgcacaatgtgcacacgtaccctaaaacttaaagtataattaaaaaaaaaaaaaaaaagaaaagtagtcacattcatagaaacagaaagtggaatggcgtttatcaggggctgggggaagaaaaagagggggagttgtttaatgagtacagagttttggattttccaagatgaaaaaactttggagatctgtttcacaacaatgtgaatacttaagagtattgaacttatttaacactactgaactgtacacataaacatgtatggtaaattttatgttattttttttaaaatcacaataaaaaaggtcttgaaatattttggaccgtacaaaatcttctttgacttcatgttctttaagatgatactgccgctttcttctaaagatcttctcatgtgtactcttattaattccttttagccagattacgacccgaatagcagttctacctttgcatcttctactttctggaaggtggaattgccaatgtggcaaatcaataaccactcaggtattcaactactggtcgaggagaattctggtagctatttgacctaattctgtacatgggaataggaacatggaacctttaattgtcctgacaataggacccataaactcctacaatatcaattttgctcctctctcttctaatctcctagtgctcttcagagggcccctgccctatgtttctagatttgcttacagaccttattagatgtaattcttttttttttgagatggagtctcactctgtcacccaggctgcaatgtagtggcacaatctcggctaactgcagcctccgcctccaggttcaagcgattctcgtgcctcaacctcccaagtagctgggattacaggcgtgtgccaccacacctggctaatttttttgtatttttagtagagaaggggtttcgccatgttggtcaggctagtctcgaactcctgacctcaagtaatccacccgcctgggccttctgaagtgctgggattacaggcataagccacagtgactggcctagatatacttttggctctgcttgtctttccagtggttacatttttattttgaatatggaattccttcccatagccatatttcactgtgatgtccttctgcttaccaggttacttgggttctctgagaaattctatttatcactgtggcaataatctccaagtccatttttacattactcctgcttcaaccatgaatagacattggagactgtaacttcttgatttatcccatgatttaccaaatattttactttcctaccaatatcaaacttgctgggttctgacctaattggtattatgagttaagcaagatattcttctctcttcctccccactccatcactttcaattgaaagcatgtgccttgtacaccctagagtctcaataactattagttgaactaaaccgagctagccctagtactgcccacttgggcaagcaatttgaatccctctttcacatgacaatccatcacatatttgaagacatctgtcatacctggttagggaattttttcttcaagaactgaagtcatattttccacctgaaatcagaactgaagaactgacagatcacacgtctcttatggaaaatattattttcttcttgcctctggaagcaagtagcttgacacaccactaatcctccaatagccttgagaacccaggtgctaccaggggaggcccactggtctttagcagggaaagcaatctgaccttgatacctgctgtcatttgtccctttcatttgcaaaataggaataaatagggacaagctgaagacatgtaggtagttaatatacttgaaaggcttttgagagaaaagtactaaaaattctgaagatgtatgtatcagcttctcaagcagagccctttccttggcaatagaaatggtgttactgtggcttacagaaggaataaagctacagagtatgccttatcagcatggttgatacagcagcaatgatagtatttctacagtctttagtctctttcatctaagtcctttaccaaccatcatgtaacaagctgagatatgctgactgggctactcaaagctgtacagtaagctgggataaaaatcatacatggaaaccagactttttgccaaagggacgatacacttctgatttctcctcccttcttgtgcttctgcaatgggctctgccaatggagaacagttaatgctgatgcaatgcaggcaccatctgtgctctgtgaggatttaaacagcagccattaacacaaaaccccatatgtgaattggacaatggctgccctgaagctacaggactctcagatagaacataccactctgtagcttttagggatgcagaaattgttatgatccaacacccacgcccctgaataagagcatgaagtcaggtttgtcagtcacccacttcccctccctgcttcttaactgagtttgaatcttttctatatgttattcctgtctgtcaagggaggaaatgaaacgggagccgataccatctatcagcacagccatgggtgccatttttacctgaagccattgggttcttgtcctgaagcttcccccaggacaccagggttccaggcatataaatgacattgacagtgactgggtgcaagcctttgctgggaagagcagtgtgtccaggacttcaggttgctggggcatgaaggcagggtcctatttatttttaatttttgtagagttaggggtctcactctgttgctcaggctggtcatgaacttctgggctcaagcaatcctccttccttggctttccaaagtgctaggattataggccggtagggtcctatttttgacaatggtgtcatctctggcagcagcagagatgctgaggcaggggagaaagaaatttctaacaatgactggttggttgtgtccagtttctgtggggctgaaacacgcttttcacaccaacacaggggatggtaagaaaaggaagtaagtcacaggtgcttcagaatggtaccttggaggctgttctgggccatctattttgaacatggcttgggactgttatgaaagacctcattatttatagctcgtaactgggaaaacaccttttctcctagaaataaagatatccaaacttcctgaaaatgaacctttggtttttgacaaataccaagtctcaagaacaccaggtgttctttttctgggtgaatcaaactatttctgagtttacctttaaggatgtgagttaaaacacctacagcatcccgggtgttccagtatttggatggaattttagtcaccgaggttgcaaatcagaaacctaagaaaccttaaggaaaaataagccctccagtttccttgcactattatagcaagaaatgtctggttcatggcagggaggattcatagagctcatccacagtagtttaatggcaccttcccagagaagcgtagctttgaaaacctcaactaagctagcaggtgtctggatggcatcgtcatttctttctttaacaagcgtgggaggccagggcttaagaatctctaggtagaggcaccattgtggtaaaaatacagagactcaaagcaaaagggaaaactaatactgcttttatatcccacttctgtgctcatgaactctcctctctgttgatgccatctctcctctctcctgcccctccatgatctctctggatagtcaatcaaagggaggctggagagtctctgagttaatgcttctgacatggactatgtttcaagcagcaactccctggtttagaaagcaaacctgattctctcctgcctggccttccaaatttcccccaaatctactcccttttcagtctcatctccagttatcctcttgatcctgactcctagccttttctttgacttactagcatttgcccaagccatgaccactgcctagatgcactgctgactctacttcaccaattccaactgtaaaattccaacatatgaaaactgtggaggacagggaagatggtatccaccaatgtggaatgaaagggccaggggaaaccctggcaaaggaggtggcaattaaactggaccctcccttctatgacctggacaatcagcacttgcttacagaccatcagtttgggcatttaatcacaggagggctgttttgcgttgttatctgaatattccactggacctgtcttgattagaaattcctcaaagtcaaggaccaagtcttacacttcttacatgtcctctgcataaattctaataaaatctgttaaaaatctgcattgtgatgaaagtgtatttttttaagaaggcaataacattacatgtttagaaagaattaacaaaagtccacgttttcatgctagttggatgacagtatttaagaaaagttaaattgataaaacatcattagatcacagaaaggctaaagccataagtattttgtgtacatatgaggcattttgcataaatgttactaaataatcaatgcaaaaaatttacttgagcattcactgtgctggatgctgaagtgaacttgaaagaagcaaaaaatgtagttttaaaaatctgtcttgggctgggcacagtggttcacgcctataatcccagcactttgggaggctgaggctggccgatcccttgaggtcaggaattccagaccagcctgaccaacatggtgaaatcccatctctactagaaatacaaacattagctgggtgtggtggcgtatgcctgtagtcccagctacttggggggctgaggcaggaagactgcttgaatctgggaggcggaggttgcagtaagctgagattgtgccactgcactccagcctgggtgacagaatgagactctgtctcgaaaaataataaaaaaagaatgtgtcttaaaaatgtagtctttttttttttttttttttttaggctgagtttcactcttgttgcccaggctggagtgcaatggtgcgatcttggctcaccgcaacctccgcctcctgggttcaagcgattctcctgcctcagcctcccgagtagctgggattacaggaatgtgtcaccacgcccagctaatttttttgtattttcagtagagatggggtttctccatgttggtcagctgatcttgaactcctgacctgaggtgatccgcccatctcggcctcccaaagtgctgggattacaggtgtgagccaccgtgcccagcaaaaatgtagtcttaagaaggtaagaattcctggaggaactcacaatgtatcacaatcaaataggagaataattgatgctgacctatccattgttgagactcctggtgcagcagaagatgagagacaagggacggatgtgggctgccaccactctaccactacgcttggatgggagcaggtgggggacagagagcgcagcaccaacaggagtcagcctttgtccttcaaatattgtgaccctgaccttggcagcctcatgctttctaggaaaggctctgccatatgcacctgggattaacacccttctctacctgagaaaccagtgccctccaccccacctaaatgaaacttcaaatggggctcataaaagggaatgacatgacaggaagagaaacgatctgttgggaagaggctgacagtgctcggaaaaccatggagcaaaacagatggaagaggacacatataccagtcctgctggaactgcaggatggtgagaaaagactgcaagctggcttggaaatgaaggctgggtgagttgagtgagcaaaactggttcatccttaacctgctaagttagagtaagagaattttagatggtgggggttgggggatgactgtcttttagatcagcttggaaaaaataaaaatcctcttctacactaaagtaggaaagaccacagagttagcaaagaaggcatttcagaaagtcaaatggggaaaaaagaagaatgttagataaataggtgaaattataaagtgtctaaaagcaactccaacaggagaaagaaggtgggcagggtcagagttcggaggatgtgaagggcaacagaggccctgtgaagtacaggccaccctcgtgaggagtaaggacagtgctgtcctgccacctcaaggtagggcctggcagtgccctgttcccagttctgtgccccgaagtgaagcgccgccgacaggctttgatgatctttccacctcctgactcttggcgggcagagcatacagtcacagaccagatattagaacactttatctagcatatggaaggaacagaatgtcaaaggggtttattactgtacctgaccagataatcaggtaattagcactattaacagaacagattggacacatttatacatgcatttgtatatctccggggaggcatagcttcaaaaaaacataatatcaggtgttttttattataatgtttgtgtgtatgtgtgtttttctaaagaacattttatttctcagaaaggataccaggcatgtttcttttctgcacctgtacggccctttttcacttagtcaagctggactgcaaacaatgaagaaggaaatttgtttctggccccccccagatcttacaacaagcactgccgagctggctggcttctttgttcatatgcccaggcccccacctgggtggtgcgcaattctaggaatatgctctggctgaaagacagaaaagaccaggagagggagcacaagaacacaagatatttctatatctgggtcgcagggaaagtcacagaaagagagcaaggcaaagagaagcaaatgcctcaaaaaatatatgcgggatcttaacggtgtattttttaggtgcaataaaaagggaatttggaacttatggtttgttcatcacatagaatacatttttagcaaattatatttaatgcagaataaaggctattttatttattagtttgtcctgaatgatatcattactttatgaactgccaaatctgtcagcaattattaacactccacagctagctgccttcccctaggtgtttcagttcacctttgccacacagtaacatgggaacaactgcgtcagacgacaagcatgcagccccaggcacagatcagtgagtttcagtgacactacagcacttagctggattaagtttataggctgagaacaaggtaatgacaccaggcattctcctccacaggaattcacaatatgggatgtcactggtgggcaccttttcaatataagatacaaatcaccttatccctttaacgaatgcatactgaccactttgcatggttctattgtgtcttaggtgctgggggcataaaacaatgaatatgaaggaaacggtacttggtctgagaggttctaggctattgggacagagacaagtcaacaggtaatcacaacacagccatgataagaactgtcagtacggttcttacttacagggtgtgtaagtccattttcatgctgctgataaagacatacctgagactgggtaatttataaagaaaaagaggtttaatggactcacagttccacatggctggggaggcctcagtcatggtggaagatgaaggaagagcaaagggacatcttacatggccgctggcaaagacagaatgagagccaagcgaacagggaaactccttataaaaccatcagatctcatgagacttattcactaccaggagaacagtatgggggaaaccgcccccgtgattcagtttatctcccaccgggtccctcccacaacacatgggaattatgggagctaaaattcaagatgagatgtgggtggggacacagccaaaccatgtcacaggggaagtacagctgctggcggaagggcatctaactgaggaggtgacaaatgagctgcagcctgagggaggattagttaggttttgggtgggagctggtgttccagatggaagaaatgaaatgtgcaaagacctaagagagaacatagcatgcagtgtggtgtggcaggagcagcagctggggcaagggcacaggtgaaactggagaagggagcaaggggacgggctgggaaggtccttccgtgtccgccgccgaggctggcccaggggcctcactggagtctgttgcgcaggagagtatgagggagactcctttggctgcatttggggaacaagccagacgggcggcaagccagtcacagaagtccaggcaagcaccactgtggccgggatacaggcagtggtgttgggaagggaaatatagacagatgagagaggccattaggaggaagagttggcgaagtctgagagtataggccaattcaagactgagaacgactaaaaaaagcatcatgttgcttctaactaaccaaagccacaacctggataccccattgacgaaaacaaggtatctttggaagctatttgggacgctttacagtgtgtaataggaattatgtacaggttcccaggcagacccaaggcagtttaggtttcagagtcataaattttggaggaggatagggctcagaattctgtagcctggggctttctttaaatggacacctttgatgtcagtctgttgtttcagtttctgcctaatgtaggatttttaaaaacagcacactttcccagtaagtcattctgatctggcaatgagaaagaggtgaaagttctcacaggatgtaaagggtctttaaaaaaaacgacgggctgggtgcagtggctcaagcctgtaatcccagcaccttggcagggtgaggtgggcagatcacgaggtcaggagttcgagaccagcctggctaacatggtgaaacccgtctctactaaaaatacaaaaaaattagctgggcatggtggcgggcacctgtaatctcagctactcgggagtctgaggcaggagaatcgcttgaaaccggaaggcagaggttgcagtgagctgagattgtgccactgcactccagcctgggcaacaagagcgaaattccatttcaaaacaacaacaacaacaaaaacaaagatggctgggcgtgttggcttgggcctgtaatcccaactactcagcaggctgagggaaggggatcgtttgagcccaagagttcaggaccagcctgggcaacactgagaccccatctctaaagaatgaaaataaaaaaataagaaaatataaaaaataaaggtgattggaaaatagatgagctagtataatgtgagatgatgctgcatacagccatggtcagaaacggggaaaaggcaggggaaagttgactttcctcccaggacctgtttgttgatttccatgataattgtggagcaacctaccaaacctaccagttctatgaccagggtctccacttggacctttagaagcttcttcaacacttgagtggacttcaaacttcaaagtggactttgtgattccgaccctcctgcctccctcttttaaggacccttgtaatcattcaggacactcccccacctcaagacccttaacttaatctcacccacaaagtcccttttgctatgtcacatgacacactcacaggtttttggggataaggacatgggtatctttgggggccagtatcctgcctgctataccgggttataaaatctgcctagctggttgcctagaggagtcttattctctcggtgtctcaaaatagaggagttccctggcaaaggtaggttcttatgtaagttaaagtgatgcaggcattaatgtcttcatgtgatcaactgacgtaaattgaggagagccattaatggataaagtgaaagaaaaatgatgaaaatttatttcagatttcagatttcagatattctctctgttatcactttacattgcaattttttttcagcatcctattatttcttgtgtaaaggcaaatttctagtgctgggttcatggtgacttctgtgtggtacagagaaacttgaactagagctggagatactcactgagtctccaaacctaccgctgactggtttgtgaccctggacctgtttcccacctgttaaaaacacagacatttgcatctttagtgagtcttactcttgtcattgaagcaaggagttgagaacttgggctctggagtcaggctgcctggccttaagtcctggctcctctgcttaggagctaaccttttggcaagttaattaacctctcctgctccagtttcctcacctgccatatggagataataatggtagcaatcccatagcgtcaatgagttaaacacgtaaagtgcacagggcagtgcctggcataccctggatgctcagtaaaggttatttaaaaaaatcatcatcatcatcactgtgttagacacaagggatatgcaaaagataaaacagagtccttttcttagtgctgggtcagataattttttaagactaaggttttacgattccccatatatcacgggagaaaaaacgccctgatgtcctcacacgttccatgcatcatgctgtgttagcaagatcttttaacatttctccttgctgccaattaaagggcaccaagtcaaagttgatacgtaaaaattactgtcccattagcaccttctggcctcgctaataaatcctaacttaattaggcatatgtatctttttcgtgggacaagggatagccaaaactagaggtatatgggctccagcttgtttacaaccgtcccttaaaagagctcaatgcataattgcatacccataaatacaaatgctataattttcttggatcaaagatcattttcaaaaagtagacacgtatgtatcttcatggtagcttttaaagcaagttctacaaggtctaacaagtcagttttgagagcaggccttccaatagctgtcctccacttgaaatctgaagtgcggaaagtggagtggatgcatgttttactgaaagagtcagcaacagaaaatagagtacactcacagctgtagcgagccaggatgaatttatacagtgaattttaaatcagactcaaaattggcttgcactatccattgaaaaaaatcccattgattttgggcttcatgatgatgttttctgggagaggcagaccttagattgagagccaagcaaagcttcagatgcagattttttcttttattttccaaggaatttgaagaggcagaaattgctaatggaatacagggataaaaatgaatattgtatttctacttgctagcaactatcttggtatggaactcgactgatactgttctgtcctagtggctgaagcctttcactttattaacttttttagatagactttaacaatttcatttttttctttgtctttttccattttctctcttctattcaaacacttctgcaaaatacagtgtttccattaaagtccctcagctttcttttgtttctcagactctcacatctttgcaattttgctcaagttaccttcatattcacttggcacacagtaggtactcaataaagttggtttcttccttcttcctctgcctggccgctgtctggtaatgtacttcttcctttattttttggtttacaaactacttgttaaataattggctccaagagcctccttcagagtttacatcatttcttgggaagctcagcccaaacagagataactctcctaagatatcctggaaataaggttgcagagaaaaacaaagtcccacttatcaaaatgaagtgcttttgttctcgttttggatctggtggcagaaacgaaataccatctttcagaggtcccaataaaatatttgacaagatatgtgaaatgtttttcttcacttggactgctttcttcataatacagtctatgtgtttcaggagaaaaacaaggtcaattcaattgatcaaacactgtgtcagcgacagacacacatacatataaatgctcacattctctcacagttataacaacatggaatctaatttagaaccacaagagctaggaaattaagagttaatacttaaaccccatcctgaatccatcttgtcatgcctgagtatcacttctcctatagcaagcaagatcgcccgctgttctgaggccactagacagagaataaaatcagctataacattactgtgtcacaaggagggaattagggatgagtctggagaactggcttgggtgctctttgtacgcaagagcgtgaagccggatgggagagaaagaaaggaagacaaaaataaagcgtaaaaatgcaggcacattagccgcaggcaagctcccgcttgccttctatcctattattaccatctcactactgccttagggggcatctgtaaggcaggggcaagctgctgctctcattacagtgggctactagcagtctaaactccaaaacaaacttgaaagatatatgaaccacaatgatcacagccgacaatatgctgtggccttatacttgctcctgcaattgtgtgtgtgggcaggaaaagggggtcttctcttttactcaactcaaatgtcccttgctttgcttattttagaaacggtttgaatgactgttccttcaacagcattatgggtcacgtacccactaaaacgaaacaatcacactttatgtctctatcctgaatcactgttttaatttttaacctaacctagcaggaaatcatgggtttagccctgtttgatcatataaaatctctattaccaaagagaaaaaactcatggtactagcccaaaggcaataacagattttaggagataattgtccagatacctcgttggctctggagcaggtaaaaaaaatcacacataaaatagcaaaaagcaaatttattaacttgcctgagctttttgcctcccttatctactacttcaccagaaaaaggtctgctcgctatttacaaattcacttttctttaaagcttcttcatatgactaggtcctgccgataagtaatactctcaatttgtcatttgtctgtaaacttttaatgttaatactttttcatttttgcaatttggcaaattttatcatgcagtgagaaattattatctagatgctatctgctaggatatacaatgaactttctccttatcctactgaaagtacacctctcaaaaagaatacaaaataagagcccttcttggatttatttgaaaaatgaatacatatattcattattgggacttttcaaatttatgaaaaaatatatatttgaacctaaagccatgtacagaaggttagctattatcttaatcctaaattctgctattatatttgtatcacagatgtactgtgctgatagagaagtctgagctattggatttgccagcttggattaataactacccatttcaaatcattaatgatgctggttccagttcagtgattgaactgggtaaaaaaacatttcatcttattctttccttatgaaagagctgctggctttgcaatccatttctttctgaagaaaagtccttttgaaagggagaatactaaaaacggtgtaagaaccactggagaagaatagaaattcattttaaagcagtgtaccatgtacaaatgctgtcttacaaataggattatttaatttaaaccttagatctgtcaagctctattacttcaaatggagcctatcgcttcttgagttcattatatatcgagattatattacaatttatgttaggttaagtcattgctgagatacaaggcggttgaaaaaaattacacagcagtgtcagtaaatagagcaaagtcactgcagtgttcagaaaggcaaaaagtcatcttgctaaatgaggatccaagctgtcctgtacgaagactgttactaataaataaaaggcctctgggaaaagtgctgagcgtacgctggatctattttcagcttgcatcagcagctgctgcccctgggatcacatctttacgcatactctacaccatatgtaatcactccagtgctgcaaccagtaagataatgaaagagcatggcataaatctatacttgagtggaatgctaaatgagaaaaataatacaaaaaggggggaaataaaccgcattttcaagtcattaggaagaaagactttgacatatgaagtgctgcaaccattaatagcacttatcatatagagtggagacaaagagacaaattaatcaaactgacagaactgggacattttatgctaatacaggctcctgggttttagtctgtattcctctgcgtctggaaaactgataccattacagggcaggaaattgcatgaataacatgcaacagatcataaaaattcacacaccaactgcagaaacactgccaaaagctctgtaaaaacaaggatggagacctcaacagagaaactaccagcaagtaatgaatgcaaataagtccaggaatatctcccattcatgcattgtaattaactataggcttctcgctcataattacagtggtgaaactgaagcctagagagcgaactctgcagttagccagagaaggctgctcaggctctgattcaaggctgtttgccatcagctggggtgagtgccactctgacctaaattttctgactgggttgtgttggctttaaaaaaaaaaaaaaaaaaaaaaaagcaaaataaacagcagaacattagcttaagactttaaagtggaggagggagagaaataaattgataatgcaaagaaaagttgaacaaaattttctatgtatgtttctgtgggtggtacaaataaagagaatctgagactgaaaacatttttataaaatgcacgctgtccctgacttataaacatcccctactttctgaataagctgtatgtacttaaatccgaatggcaggcaagtcctcatgaaagctcgtgggagcaactaccctttgttctccaattgtgaactccgagggggttggtggagaaagagccgctagctcatttataccaatctatagagataaattactgctgccttgtgatctctgcctttccctaaggaaagtgtatgtttccttgatactggaagcagatgggttccttagctggaacaccaaagagattttcccataaaaaataactgtatggacagaagtgtggatgaaaaaaacgcatcagaatttctttctccaatgataccatgtttgctggcattcaaggcttcagggcttagtgatctggtttcaatccttcctctcattctcacctaatacaaaccacatacttgcctgcctctagaactttgctaaatgatctctttcatttatttgacaaacattcaccaaatggctattgtgttggcctggatatatagggtagatttgtacaccgaaaacactcccctccaattcttgcacaaagaactaactgtccaaatgagaagacagataagcaataactcaatgacaatacagtgtaacagctgctatgacaaatatggagaaggtactacagacatacagcagagggacactaaaccccaaatggccatttcccatctactgaaattctacccacatctccctctccacgatgtagtccctcatcttctcattagaattacgtgttcctgctctgtaccttcatagcccttcacttatacctagaccataggattaatttctgtctctcattgatgataaatatctgttcattgaacaaaccgaaacaaaaaagaaatgctatacagatatgagtttgggagctgacttaggaaactaaccattactcataacctgtttctaggaaaaaatacattctgggttcaaactaatttctttacaaacttttgaaatgtaatttatccaaactgtttaatcttccttccttagacactgggctaccgaaaatgtaacctgcatttgcatgaaccaaatgcatgagataatggaaatgtttcaagtagtgcaaatatgaactgaagattcttcttacagtcatataacttgtgtattaaaaatatctgttttagaggccaggcgtggtggctcacacctttaatcccagcactttgggaggctgaggtaggcggatcacctgagaggtcaggagttcaagaccagcctggccaacatggtgaaaccccatctctacaaaaatacaaaaattagctgggcgtggtggtgtgcgcctgtaatcccagctactccggaggctgaagcaagagaattgcttgaacccaggaggcagaggttgcagtgagccgagatcgtgccactgcactccagcctgggtgacagagcaagactctgtctcaaaaaaaaaaaaaaatctgttttaggggacgatcctcatttcacatcatccttggtaaaatgaaaactgaaaagcacacctggacacacacatgagcatggggctctgtttggccatgtgctgctctgtacagaaaagtgcattataagtaagtgccctaggttaatctattgttatgattattgccattatgatgacaatcatcaagtgaggctgcccacagtggctggtccagggacatagctagaccacaagggctaatgttatgacctggtacagtgcctcagtggccaccatctagagggaggagaagggctaggtgtggtttttctttactgttttttggccctgaggacattcacctgagaagactttgggtctattaataacctaacagtggatctgcagaaccctgctggcctccactggaaggtgttgagtcttttctgaagtccatacacttcttatttcttaatatcataggattctgaaatgtattggtttctttctgtttatcttgtgtagttttagcatatttaccattttaaccttttgttctcatcacaatcaggtgtcatactattgactgtgtatggtgttaattttcagtttttttttttttaaccagtgaatggggttagaatgttcttcttccttgtgtattaaccacaaagagacgtttgaattaaagtttaaagatgacaaatggtctaaattctgattaggcttaattagatattggtattttgggaagaaaaaaaatataacccaaatgcaagatagacaatagttgttttagcttaaagatgataaaaactaatagggttcatcgtgattcgctttttttttttttttagacaaacagtctcgctctgtcgcccaggctggagtgcagtggcgtgatctcggctcactgcaagctccgcttcctgggttcaggtcattctcctgtctcagcctccccagtagccgggactacaggtgcccgccaccatgcctggctaattttttttttctttttgtatttttactatagacagggtttcaccgtgttagccaggatggtatcgatctcctgacctcgtgatttgcccgcctcggcctcccaaagtgctgggattacaggagtgagccaccgcgcctggccgattcctgttttaaacagagttaaagagagaacacattctcagtgagagaaagtattggggaatataatgacaaaaactgccaatcgatattcatgttccctgaattgacaagcatctatttgtctacagtttatggctccttatttaagcatattaaaactgagaaaaaaataaaaagatcagaaaagaggtcaaagttaagaaagtcttggagaaatggaattattagcgagaaaataattctagtggtaacattattttcaagtggattctctttaaaaatcctgggtctggggaacagcatgagaagttgacacacaggcaaagctttgagcctttcttgtaaggagttacctagaggaagcgtgtgatttgatacacctaaatcaatgcaatatattatttgacagagttatacggagctcctgataaccaactctgtgctataattacagagactgaagaaagggatatgggggtagggcaggaggggaagtgatgggtctgtgagatgcaggttgctagagatttctttcttttttttttggagacaaggtcttattctgtcgcccaggctggagtgtagtggggagaccactgctcactgcagcctttacctcacaggctcaagcaatcctcccacctcagcctcccaaagtgttgggattacaggtgtgagccactgtgcctggccaaaaagatatttcttaaggaaaggtgacaagtgctgcaggagaatttgtaagttcagggaggtcagctcatagagaaaagagtctaaaacagtgggcctgaggcaggtggtaaaatatagagcagggaagatgagagaagagagtgaagaggctacagtggcaagtgggaggtggtcttgggcacgtgggggtggggtagagaggtcactactgcatctaaaagggcagagatgggatggaaagacacaaggaacatcctggcagcacgcatactgaatcataacaaggtactagaaaaaggctgtggcatcagctttctcagagggtttttaatattaaaagagataaaagtctgatttggattgtttaggttctgttttggatgcagatagaatttgataagttatttttctttttctgaaaggcacatataagaattatattttaatatagctgtgctttttaggagtacgttcggatatcactccagcttgtgtgtaccataataaatatctgaacaatactttatggattataaaacacgattttcctattatttgttcctcccaacaactcggtaaatgaggtattatgattcttattctcattttctaggcaacggtgttttggagagtataagtaacttaatcaaggttacagagccatggcaagcagggccgggtcttgggttctgagcccctcattccaaattacgcacaatctcccccatatctcttcagccattctaacaaatgttttcttttccccattcctgcagaatgtttttcattttgatgattacccttaacatgtttcaaaaaagcataggcattggaagacccagaaacagagaccaagaaggcagggaccacaggacagaccctggccttgcccatcacccagtttcattggttccctttgccttgatttgaccccacctgcaggtgctgagagcttcagtttaaaatctgggaatatcctaaatgtttataggaaatccccatcctctgcctccttctttaagcaggtgccaaaattctcctgaaaggagtatatggatttgaataggacatcatccttgcttctgttttatagtgcttctttgtatttattcattccatcatatttattgagtacctactatgtgctcagctctgtgaaaaggcaggcatgacacttggaacttgtactccagtcctgcactgtccaatagggttgtcacatgttgtctaattaaaattaagtaaaatagccaggcgtggtggctcatgcctgtaattacagcactctgggaggcagaggcaggcagatcacctgaggtcaggagttcgagaccagcctggccaatgtggtgaaacgctgtctctactaaaaatacaaaaattagccgggtgtggtggcaggcatctgtagtcccagctactcgggaggctgaggcaggagaatcacttgaacccaggaggcagaggttgcggtgagccgagatcacgccattgcactccagcctgggtgacaagagtgaaactccgtccaaaaaataaataaataaaataaaaaagtcagttccttagtcacacacgtggctactggctaccatattggccagtgcagaagaacatttccatcatcacagaaaaggctacttagcggtattgaaacatgtaagagtaatcaaaatggaaaacatattctagcaggagtggggaaaagaaaatgtgttagagccactttgttagaatggttatacagttataggggataacacacatgcttatttcatggtcttattactccttgcttagtccgttgcaacaacctggctgttgtctctttcttccccgatccttcctttgtataggtgcctgactgaccttcctgatgacagtgactttatctctttgcttcttgcagaataaaacctaagcccttcaagcatggcattcaaggctcgtttaaatcaggctcaatggacctgtcctctctcccaccatgtcctctccataaactacaatttagtaacagaaagcggggttattaatatcaagcccactgccctccacatccattctgtaggagaatatctacaattacaagatgtccacaaaagtcaaacagacagaccttttaaataacttcattgaactgaaacacaagaaaagagaaaaggagggaagatatggtcacagagaaacgagaggattattgtaaattatctaaattagtcctaaacaagtaatgccacacaaagcactagtaagctagaatgtcattctctaccctcaccataaagagggctacagaaataggtgaggaggctggacagatgcttagggaatccaagcagaagagctaggatattttggaaaaaatatatcagataaccaagaataggtgagtgaaagaagcagacacaagtgtgttcatctacaggtactgaaccctaaaagcctattcctatattctatacacaatttaggataataggtgctcctgacaagatgccactgtggttttctttgagtagagattatacaaaacagacagggctggtggactgaaaaagtactgaattatggtttgtttcccaaactacaggtacttaggacccactgttagaattgtaatattttctctaattgcaactcattttcttctttaaatatagtttaaaaagaaacttgtcctaagcaatatctgcaaaatctcaagtttaacacacgaatcatactttctgcaatacatattaagataaacacaattattttgaaaaaaattctccatataccacctgaagtcatttcacttttaggttatgctgtacatattcctattctgggaaacactgggaacccaaacaattatcctggctgagtcctcgggcaggagacatttggccgtgcctttcctattttccagggataggactgtgagttacttccgtgtggtgggcggtgggtgcttgcaggggtgaagtactaacaggtagcaaagtgttggagacacgaagcattaatcatcagtcaacaacagcagtggcagcactgctatctttcctggggctagtgagaattaacggattaatgtttaggagagcacagaagtttccaagcatctactgtggttctcaatcctttgcagggaagtaaacaactgaggtggccacctgggattctcatctgctggcggggctggtgggagtctgggttttgtgggtggcctcagggggccctggcggcagcttccagcctctgtggtgacaggccatctcctctctgtctagttcacaactccagatgctgtggggaggtggcagcagtccagtgggggcgggacactaagattctcacattaacaatgcacagacatccgtccatccggcactcctgggtcatgtccctgagagtgacacagggctgcccctggggcagacacatgagatcatctgaactggttagctccagagggcctcagctgggcaggggctctgcagcttttgtcagaggctgtttccctgcaaaatggggggaaaatcggaatactcaaacaaaggggatttctgtaactcttctgccatttttctctcaccttttctgtgtagctgagctcttaggaaactggtgttaaagcagttcagtgagaagcaaggcaactgaaagccccttccaacagctgccaatggttgtggacgagcaggcagacaccagggctaggaggaagggagccaacaatcactccacagtggcatttttcaggactcagtcatttctgatgctggaaagaagcttgagaaaccaaagtacagctgtgggaagacagtgtggggctggagggatgcgggtgtgggctgctgcccacgtgctccctggccctgttatagccggacttgtaaggctttcttaagccttgcatctgagaaaggcagagaccagagaatggaaagacaaagctggggagactgatagtggcggcggcgaactgaactcagccccctgcctgtggaggggatgggctgttagtgcctgggccatggatgggggagctctgtaaggatggcttttttcggtatgtgtgttaaagtctgagttttttttttttttttcctgtggggtttacaagctcattccattgtccagaatccttgtgggcatatttctcctagggacgctggccctggatcgctggccttgcctgaaagaggctgcctcctactgcgtttttgttcaacttgctttctctgtaatagagatttgcagcactgtgggcttcagggattcaaagtttttgttttttccctaatatccagcttccatttctggtttttaataatatcccaatcttttcagccattctcccaagaattgtagtgaatgatttttttaaagttttcttttaatttttataatgaatacacataatggagcattcttttctctgacattttccctgtcactaaatttgaatgtttaggtggcacttaaaaaacctttccacccgctctctgaatgttctgatgctcttggtgagtaaaacaaagtctttcaacaccacctccatctgaattgtatacttgatctttctgagcttggcaaacaaaccatcacccactcagaacctagacaggaaagtggcagatgattcaagcttcattaggaacaagtcatgccaaaataacttcatttctggttttgatgggattacagctcagagaatgcagcagaaatagcatcccaggatttcagtatgtcagctgacatctttaggtcactctttgaatgatacgaaaaaatgaggtctggagacagtaaaattgagcaatgagtagctgcttgatggatcaatgttaactgcagctcaaagagaagtgtctggtgatgtgacccagccttccgtcgcctactctgtcacacttaacttgtctctctgtcttagaaaagatgtgagtggcaactggtgagctactccaggagatagaatcaggatcccaaatgatgacccaggctgatattatgtgttaaatgcagaaagatttaacaaaaatagatgtcaaatcctgtatcaggattaaaaaaatcaactttgtaagaagaggatgggagagtcctggcttaaggagttgggtcagtatggtgacacaggtgacaggaaacttaccctgatgatcctgaactacactgaaagatgtgtgatgcagaaagcgagtcacgcctctgctctgctctttaccactcaaatcagatggaggctgtcgaacttagtcctggctgtgtgtgagggatcacactgatcactgagtccatgccccaggtggcatgtggaatggcagaagtacattaaacactgagaaaggcagactcatgggcaccctataagagttgccttcagagagctaacaggctaccatgtaaagatgagattagatttgttctctttcatgccagagggtgtaaacgggatcatgagtgaaattttaaggaagatagatttctgccacaaataaggaagaacttgctagtagtcacggttgtataaaatggaggaaggagctctcttcagtggtggtgagctccccattgttgcatgtgttcaagcagaggctgaagaggtacctatgccattattataaaaaaaaaattccaaattggatggggcctggactctaacatgccttattttttaacctccaatccttgatgcttctccccttatagcacaacagcccaacacgtgttatggttcttagtattccctcagcataaagttgaccaggaagaaagacaaggttgatagtattttcatttactctggataccactagcaaaacaaagagagctctcttgaacttctccaagtctcctataagtctatgaatgacacctacttcgatctacttcagtttggaatgctggcctagtccaaccagtttgctgagatcatgaacaatttgcaggaaacacagggagcattgataggatgaaatagaaggcagtattttaaaaaaatcaagtcaataatttcttatgtaagttttcaaagaccatcattcctattcaacacaaatccatctgtactgttgcagaagcttgaaattaaataaatgttgaccacagcagtctgaatttcatcacatttatacagcatttttccaggcatgagtttccctcactgaaaaataagctttttctacttaggcctatcaggtgagcaagggtagtcagtcacacagacccacagttttgtttgaatggacagcagcctgccccatcttgtattttcttgggcttgacataataactgagccatcaaaaaagttataaatattgtacacaccctgccattctatacaccctaaaatggcaggagaaaatagctcaaagcctttcctccttaatagctccttagacaggttttaggacagaaccgggtaatctcagaatctttgctaacaaatggaaaagaaagcagaagatctgactacaagtagaagagttggaggacgcaagacaatgaaataaggagaggagggtgaagaacatactctaaaagatggctgcaagtactggcatttactcatggtcgatatccaatacatatctattatttatcaagactgggcaaaaattaggaaagaaaatcgtttcttatgagcaactggaggcaaaggcaaaaaagaagttcatgcaatgatgggactgcctaactcctggaggtcccctgtctagagctcctgtttagccatctgttttctgtgacaatggttagcacctgactctgggttaaaattttttgggtagttccctcaggtctgcaaccttgatttaattaccaaatctaggtcgaactctagacacaaatttgaggtgaacaatcgaaccaaggtgtcatgctgtgcattgagcagtggaaggaccttctcttgacctctcatggcccctgatcacagatggctgtgctggcacagagcatgtccctccagttctccaagatggagcaagaaagaaggccctgtatgctaagacaatcatactcttttcacaaatatttcatgtgacctagaaatgtacacagtttggtagtgttaaatatattcacactattgtaaaacaaatctccagaaccttttcatcttggaaatctgaaaatctatacccattaaacaacaactctccttttccacctcctcacacccccggtaaccaccacttgactttctgtttctatgaatttgagtactttaggtatgtcacataaatggaatcatttagtaacttttttatgcggtgggcttatttcttcaatatagctttgaaaataaacccagggaggtgggaagggagggcatacagagcgagagagagagggcaaatccacctcccttctgcttaggtggtggccagaaagggagtatcctgggatatcctccgggcgtggagcatgttggcagcatgcattatagttgcaggagaaggtcctcctggcaggtgggctcaaggctcatcacctccatcaagaagcatctactaagggcccaagttgtccccatgtcaaatacattctctgaagtccatagaacctcagcaattcttgaagaattctcatgaaatgctctcagcatcttcctgggggaggaggaatctgaataaataaggctgcattattttaagagcagtctctgtaggaatcttggagggagagcagaagaggcaatggaatgcgaatgaatagtctcaaagctgccagagcctgctcttgaggaacgaaatatgcttagaatgtgtgtccctcatggactcatgcgtggggcatagaaggaagagaaatttggcttcaaaactgaaagacagtctgtgaaatttagtcacatgtcagagggatcactggcaaaaaatgtctgggaaccactgttacactccagctcaaccttgcggggccactcccacaatgccacctcatatgtcactgtgaatagggccacatcttcaccacatattctccctttcccaccaaaacttccatccagcaccaagaacaagggaggcctcctacagcagctccatgtggggagctatacccttagagacaggagtcggtgcaaactgggagttaacattttcattggagctgattgagctcaacttaccaataggttaatttgtaaatgaaaaaattctattgaaagagtttttgtaaggcaaactcctaattatccttgcacaagtctgctgcgaaattctcaacagaactttaagcttttgcctttttcatccactagactctttcttcatggctgctggtcacctactcatcttgccatccacctacccaaccctgtgtctcctctcccagacacttttctgcttcttcaggccaaaatccatagtcatactggcttttttttttctttatttcacatcccatttctaatcagtttgcaagaaaaactaaaattgtgaaggcaacccatctaccttggctggtctctctcctcccaatacccacccccaccgacccctccaacctctggtccatgttcgtatgtcaccttctcactgagccctgtcctaactactgtattcaaaattccaactcctgtcctccctaactactcccctcctcctagatttattttctcttaagttgctgatcactaacttaggtattcctgcttactgtctgtcatccctaattgggatataagctctgtgaaagctcagagttttgcctgttttgtatccctagtacccgcaacagtgcacacagtagatgctcaatgcaaatctgttaaatgaatgaacagcttcttctggtcattcaggtctcaacacaaagttcttctccttagggaagccttccttggccatcccatctaacgttgcacttccctaaattactgtctatcacatcactctgctttactttgcttctaggacttacaataatttaaactgtcttgttttcttatttgccctccacaatacttgtaggcccataagaactccaacttactctgtcttatccattgctataaccctagcacttaaaacggcttaacacagagcaggtactcagtaaatacttcttcaatgaatggagaaccttcatgacaaaaccaatcaaaatccattatttattttccccaactttcctgatcttgaaaattctaatccacagaaaagatggaagaatcatatatccacctacttttagtctggattcagctgggggtgaatctggaatgtcgggaggaactagactgtgttaaatcattacatttgctaaatttgtgtgctctcttctctcaatgtatatctatacagtcctgttcacgtaagcgtgcacgcgcatgcacacacacacacacacatgcatatgttttcccagaaccatttggaagtaaattgcagacaccatgacatttaaccactaaatacttctgcatatatctcctgagaacgagaacattctacataaccaaaataccatttttccacctaaaaaaagtaatgttgatacaatattataaattaatatatagtctacattcagattctccaaagtgctccaaggatgtcctttatagattttttttttttcaatctgggagccaatcaaggatcactcattacatttggtctcattagtctcttttaatctagggcaatccccccatcattttgtctttcatgacagtgatatttttgaaaagttcaggccagttgtcttaaagaatgttccacagaggatgtctagtcatagcattatgtttaaaagttaatctaatctatttgttctttagtttattattttaatatacggtgagttcatttttgtttgttttaaatttttaagtctgctgattttcatctttgttgattagattttaatttcttgactacttaaaacatttaattggttcaaaagtcaatactgaacaaaaagatacagagtctcactcctatcccaaacctttcactctgttgccacctactttctataggtaatcttttccactagtttcctgtttatcctttctgtttctttttacaaagtatgcaaatgtatgcatgagtatatatttataaatcacacatatatatttatgtgttacaattatgtattattttcccttctttgcacaaaaggaagcataccatatatagtgtacatatccctctgcaacttgtttttctgcttaaaaatatatctcagaaattactcatattggggccaggcgatgtggctcatgcctataatcccagcactttgggaggccaaggcgggtggatcccctgaggtcaggagtttgagaccagcctgaccagcatggaaaaaccccatctctattaaaagtacaaaattagctgggcgtggtggcacatgcctgtaatcccagctacttgggaggctgaggcagaagaatatcacctgaacccgggaggtggaggttgtggtgagctgagatcgtgccactgcactccagcctgggcaacaagagcaaaactctgtcacacaaaaagaaaaacaatcaaacaaacaaacaaaaaaaaacaaagaaattactccacatcggttcacagagaacttttttctttcttatggctacacagtacatgattgattgtgtggctgtatgtggataactttgtgcacatgttgttttgtatctgcacgaatctactattttttcataggttgctatagagttttttagtaggttgttataaagtttactctttaacacatattgaagccctaatccccagtatgattctatttggaggcagggcctttacaaaggtaattaaggttaaatgaggtcacaagggtggggccctaattggatagaagtgatgtccttataagaaggagagacaccagagcactgtccacacacgcacagaggaaaggctatgtgaggacacaaggaggcggctgtctgtaagcccaaagagaggcctctaacagaaaccaaccctggtggcaccttgatcttggacttctggcctctagaactaagagaaaatgaatttctgttgtttaagccacccagcctgtggtattttgctatggcagcctgagtgaactaataatatacatgtattagaagagctaaatgctgtagattcacatgaaaacaagctaaggattgagttaagagaaaatcacttaacttaataaaacttaaaaacttgtctcccaagatatcacttgagaggcataccccttaaaaggtaatttagggagcaactctatatgtatcctcagtctgataaactgtgatttaaaaaaagtgataaaaaagtgaaaaaaagataaaagatatttctggaggctcctgagaaggaagcaaggaaaaccctggcaatccatggaccaccgagtagtttgcgtgaagtcattttaaacattagcgtgagccttacaggtgcagatccattatagcatcaccttctattctgactcactcttctgaagtctcagtcacacaccaattaagttgtcttcttctacatcttaggcatgatgaagggaaaccacctcattaccacagggtccacagtaaatggttcccagactccaattcaagtgacatgtggatagggaggaaggtggcatgaactccaaggacaccagggcccaggacttccaggatctagggtgactttatgtttttttttttttgaattttttttctatatttcatacttgaataaactggctcagaaggtaaatgtcttcttttttataaaacccagttgaggatggaaatggcctcttttactattagtttttaaaatgtcatcattcatctgattaatatgaaaacatgcccttattactgaacattgtgatatatccttgaagaagcagctacttggagatattccatactcaaccagagcctaaagtgtacattatgcttattgagtgacttaccaaagcacacgcttacagacatttatatttgtttgaaaataaccacgaaagcagtcttgttttcttcaacttcagtacttcagtatgtgtataccaagggaatgggaaaggagagacacctttcctcacactccctgcttccttcacagtcatacaagatttgatcagaaggtaagaatttccttgtctgtcagatacagtgtctgacatagagtcagacagttggaaaaacatacgagttatttccactgaaaatgacactagtcatttccagagatgtaactccagaaaacatacaggaatgcaaaggcatctgtaggtttcaatggtcggggcaaatttaaatatgggaaaaggtcttctaactttaaattagaaggaaatggaagaaatctaattgagttcctttgttgctttttggattttcatttaaccaatgagactgtgagtgaaagcccattcagccaaagtttaggactttggttcttagaagaatgaagagccccgagttggacggaagggaccaggaagcattggtccccttaggtcccactggtggctttagagagaaatcccatggggcatgcagaacctttgaaatcacaagcaaagccatactacagagtttcattgttccagtactatgccccatccttttcctgatcttccttccctttcatccacctacccattcaaataaccctttcttcattatagaaatgtaataatgtacactgtaagaaattagaaaatgcacacaaagaaaaagaactccattacatttctaccattcacaggtcaccctgttgatatttttactttgcacacgttctcatggctcttcgtatgtacacaccacttgcactcacatttgtatttttaaccacagtgagatcatactgggcatatcgttcctccaaccactttttctgatcatcacctttcatcaactacttgggtcatatttgagtttctccaatttcccccactccagagtcctttataactggtttgtgtaaaccagtaaccactccaggaccatgaactacatctggtttttaaagctcttaaatcttgtttaacttagcgcagtccatttttatgtcactgacttattgaagaaatcaggcctgcaagaagttgtcctgtagaattaccctcaccctcccaccccaccaccatcccccgaccccagatttgtccctttgcttcctcatggtgttggtaagcttgttcctctaatcctttattttcctctcactggaagttatatctcaaagctttataaggtcaaatcataccgactacgccagtggggatgtgtgacaaagagacatcatggctgtcagcgaagggtattgtatttcatgaatatttggatcagaagatacctaacacctggctgacactccaggctcagattgacccctgcccgggttactgtgaagacagtctgatcctttaatgcacagttctgacttatcgcttgtgacaagaaaagagtgtgtgtgatgttactttgtttccgcatgtgttgttttggtataataatagtgtccatcaaacattcaccttaatggctttgaccccgagtgatcacctgtacctgaatttgttcatggcatttaaaacaatacgtggcactagattacaaacagctttgagaacaagtgctttgtcctttagaaatttagcatccccttgcaggatcttgcactcacctatgctaagtaagagttgatgctcgcgatatcacttgggaggcataccccttaaaaggtaatttagggagcaactctatatgtattcctcagtctgataaactgttggggcttaaatatgttccaaataaatgaagataaacttaacaccagcaattcggagtaaaccttgttcttagtggaggaaccagccatggagcctaaatgttggagctcaatctcagcccctgccccttttttttcctgtttctcaaaggggtcagcgatttctagtgtttccagtcattgcctatgctggtgttcctcctatctgtctatacctttggctctgtgatctcagtgccttaggcacatgtaaagcactacggatacgtatcaaggccatcttgatggcctctttcaccatccatgtgctccctacccaatttcttggtatctctgaaaggccccctcattctcccagttctttacccaggtgtagaccttcctcacctatgctaggctcaggctgtgtctcctgactgtgctctctgtctgtggtgggttgttgttgccatccaacatgcattccattgctagacagatattccttaaactgttttttattatgtcacttcttggttcacaatgtttcatgaattcctattgcttacctggtcaagtctaaattcttttgtctaaattttattcttccatagtaaggccccatgtagtgagaccatattttgacttatttccccaaatctctcatttgtgctgataaaagatgcctcctcaaagtcctgcaagtgcctctttttgggtctttgccacaccagtgtcctctcctgaagggtctctccccacttgctccctagtgaagtcctgtccatcctgtgggtgttgattttaggtgagataaacttcatgaaagagatggaagaaaaatcctgtccttccctccacctgaacctctgcagcacaaacaactgccagtaccctgccatctacaatgaatactcttgaatcactcacctttgatttctatgtttttcttttgattcttcaactgtattgtgggttctttgaaggaggtaatcttgctttacatttctaagttaatcccccaaagaaatgacctctggggtcttgtggtccattcctctgcttctatgaagtgttgtacttaaggattttgtcttattaagcatctggtttaagcacatgcacacgggcacacacacacacacacacacacacatgcatgctcctctgaacgtaattctgtattttttggtgcctctctcccatgtctagcatcttatactgttacaaaatcctcctttaatatagctgaaatccctcctgtatagttgggatgctatttcttcttgtcagtgaatgagacatctggtcaacatctactaaagcagccttaaataggaggaatggaaagactttgttaaacagaactttgaaaggttactgcacttctctacatgaacaccttgtgaattgaatgcatttaactcatccaaaaaaatctccagttacgaaaactgtgcttcaattatcttcccttagtaacttcagttatcttccctgatttcccaaactatgaagttcttaccctgaatctgggtgttccacatttttaatctttccaccttcctatttgtagggtacaattcaattcctgtgctactacagatccacttggcagatataagaaacacaaagaatactcccacatagactaaggcattcagtgggaaacaaacagtgcacacatcagaacgcctctcatggtagtagagtgttcatctttatagagcaagacgcttgagggtcctgtctgttaacagccattctcctggcctttttagtaacttcctgttttccttacacttctcttttcttaactatcatacaaaacaagaaaaacagataagcagggaggcatcagaagggtttctctggatagatcttcaaagtgacccatataaaccttccatttgactggtgccactcaacctggcttgataaacccaagggtgtggccactgctcatagactgccctgccctacccagttctggttgttaatgccacctccaggaatgatgtcatctatgtaacacttttgggaagaataagctgtcatttggttttgcatataaagaatacaaaaattaaagaaatcaatagaaaatgatggcttaaaaataatcaggaaaaaatgagtaacaatgacatttaatagctgtcctttataaaacagaagataaaatgaaataggtatttcttcaacaagctggaggcctgtaattgtgaccttctgtatccttcctttggttttcttctaagcccaggaatctttcattggctaaatcccagcatttttttttttcctcccttggccaacttttggccttgcttgggaacagctgccagtatttctctttgctgccagtcagtcaaaaatgtgctcacgttggaggcctggctccatcccacccagggtgtggaatgcattaactttttcacaaacagccttcgccaggctgcacacgaaagtccatctcagcaaagctcaccgcattactagctggcttggaggtgatgccaatgtcagttacagagactgtcaacatattttaggagtctatggcaaagtgatgaattttactatgtgtaccaaattaatggcaaaaaagaacacttccgagatcctaggaaaccaaaagtgttattatttaattgcttctccactcctcaaagcaaaacaagccaattcttttctagcctgcaatttggttcagaacccaaacaaacaagaaaataaaagtattaactgattagtgcccacaattttattctattttctttgtgcttttaagaacagccttctttcttttttccctttttttttttaactgaccaccatgcatcactccaatgcctgggtatgatccattttattaaaaaattcctgaatcaatttcctggcttacagcttatccaaccaagattccaggtgttctcaccataagaagggcctctttcaaaagctgtctgcttttataactgcacacccaccagaaatgtcatgaacaccccaacaatggagttgaaacctgaagacattgggtgacattccaaatttttgaatggaatgcgaatccattaagattattaggtaactttattgatatcctcagatttgtgccaaatgttaaagctgccaaagaaaagacagaacaaaaactgactcttggattctaactctgagtattttggtgtggaaactgtgttttcttgtaactcacttaaaaaacacaccgtgctttcactgtttaactgcaatctcagttttcaggaagcaagagaaatgagatacataatcaatgtttgccttctattcagctttcagcctaaatgatcctgcacttgtattggcaaatgaggacaggtattaacagcgaacaggaaacctattctaagaaggactggctcaagtgaagcaccactgcatcgtgagtgactcaaccatctactcaaagagtgattactctgcaaggatgaagccatgctaattggacaatggcttgctgccagttcgtgctggcgtgacctacaatacccttggctgacagccatgatgtctctttgtcacacctttttttttttttttccaagggtgtagggtgtaatctggatgggaagtagaaataattttgaaaaactctcacaagtgctatttaaattcttatcataaattaaaaagtttaattaagtaccttggtaaaggcccgggttctatgattaactacgacaaaataatagttatgatgactgatcaagtgaggaactttatagctctgaactttgtctttaaagctattattaattttaattgaaatagctaagagactccataatgggagaaagaaagaaacatgaaggatattttgttcatatacagaggagtttaaaaatgaatagatacgccggtaactattttaaaaaaattgatgcaaacaagtttactttcagaggccttgtcataaatctatttcaaaatgttgattattgtggtcatcctacatcagatagggataaatagacatagtgaaaagaaatcttaaaaacggctttgaaatcaggtcacttaaaatgatttttagatatgtcttaggtttttgtctactcaactcctactactatgccaaaagaggaacacatttctgcataagtttctttaaataggcttactggcctcaggatttaaaaaatgtaagaggtttggaaacagcttatgtgtctcagttttaaaattagctattgctgtggctattttcacactagatttccctccctctgtatcagcaccacagcctccagggctggagtcacaatagtattagctcccctttctgtggcgctgccttaccgcaactccatccgagactgaggaccacatttcagggctagcagtcacctctgcgttactataaataagttctgcctttaggcatttcaaaattatcagtatgattctaggacttgaaaacttctcatttgccagcaagtagttacctgaaatattttgacttcttatttatttgcttttttttcatctgctgccaagtcttactaacgcaacttggaaaattgcaccacagcttttaatgaggattctgaggtaacagccatttcatcagagaagactgttctttccttttaggggaataataacacctactgtttctatagcaccatccttccaagaagtttaacacatcacatttcatttatctgaacagcggccctgcaagtcaaactggtaactagcattgttactccttgtacactcatattgaaattgaggtcattaaatgtgaactaattttctcaaaatcttaacaccttctgacatggttaaagagccatgatccgcctatgttctaggtgatcagatagcccagaagtctctttccgctctttagctgtcatctcctgtgaatgcctgtaaggaaggccctttctgaaaagtcagggaaaagtcataaaagtgggagaactgagcttgtgcctcttctggagtcctgtggttctctcccttcctggccagtttgcctcccatctttatggcttttccctacctctcaatccaaacatccctccactcttcctgaccaacaggattttttctctcttcctccaacaggaagctagccaagttcaaggactgtaaacctgtgtgacataggctaggatctcagagatcatccagccccaatccatcattttcagattaggatgtgacttattgagtctggccatttggttagtagatcccatcctctgttgcatactgaaggcaattgaacttctgtctcctgtatcatcaagttttctctctcttttggaactttcccttcagcccaggtattaggacaggttaggctttgctgtgctaacagataaaacaccacatcttgagagattgtttggagcttctagcaggcagcacagctatgtatatacttgtgaatgaagaacggtcctcctctatcagggaaggtcgtcctcttcaaccaagcctgcagcttcaggagggacacacgtggagcagtgagggagggaaacgacacccactgagccagccagatcagcccaatcaacctggcgatgttggggtgacagatgttgcagccagattgccttcacatccagaaacaccaaatcttgagtgcttaattaacttaaaagtttatttctcatcatgtcagagtctgatttgagtcagatggattttgctggctctcttccaacagtgactcagggacctaggctacagcttcatcactctagagtcctttgacaccagctaagtggatgggacaaagcataaagagcttatacctacttttgactgccttggagcagagtcctcacctcacatttcatcagctagatctagtcatatggcctacctgattacaaatttagtcttcctgtgtgtctaggaaagaggaaaactgggtgtgggtgagcaatggtaatcttcaccacagagtacaaacatgttgggatttcttcctacttaaaataaaaaaccaaatgaaacctcttttgacaccgtttccctccagctactgatctacttctctgttccctttcactcaaaaagccttattctctctagaacacaatcaaattggtttttgtttctactgctcccccaaaagtgctcaacgaaatcacaaatggcctccaaattgccggatggtcagtttttggccttcatcttagcttacagtcagcatcatttgacctagttgatggctctctcctcctcgaaatgctttcttcacctggcttaccacgcactatgctttgttgcttttcctcccacctcaggcttgctccttcttggtctaccttgccggctcctcttcatctccctgacctgttaattcgagaaagctccaaggctcaatcctgggacttcttttcctttctatctccactcacttccttggtgatcgtatgtagtcctgttgcttttagtattcccaatattctggtattacaatttttatctctaggatagacttctcccatgagttctggccatgtaagtccaactgcatactagacatctttacttagatgtcaacaggcatctcaaacttaatatatacaaaatagaaggccgggcatggtggctcacgccttaatcccagcactttgggaggccgaagcaagtggatcacttgaggtcaggagttcgagaccagcctggccagcatggcaaaatcccgtctctactgaaaatacaaaaattagccaggcgtggtggtgcacacctgtaatcccagctacttgggaggctgaggcaggagaattgcttgaacctgggaggtggaggtggcagcgagctgagattgtgtcactggactccagcctgagcaacacagtgagactctgtctcaaaaattaaacaaaaaaataaacaaaactcccaattctacccgagtccccaatcctactcctctcagtcttcgcttcacccatctcagttaatgccaactccattcttccaatagttgaggccctaagcctggatgttatctgtgactcctctctttctctcccaccttgtatccaacatataagaaattcccatgagctctaccttcaaaatatcaccagaatctgacaccaaccaccatgtcactgctatcaccctggtgtaggccatcaggtcacacctgggttgctgtcttagcctcttgtgtcttttccctgcttctgccctggccctctttcaatttattttcacgtggcactcaaaatgacctgtgaaactctccagtggccagctcgttccaaaaaaagaccaatcgctcagtgaggtgcacagtctggaccatcacctctctgactcacctctccccaccctgccttggctcactctgctcctgggtggcaaacacgccctgcccaccacagcctccttgtgattcctcctgtctggctcaccctttccctagacatcagcacagccagctccctcacctgctccaggtctctcttcaaaagtcacccccttgaacaggcttttcttgatcactcttcttaaaattgtaatacttgtatcctaactcccttctctgttttattttcctcaatggcatctaacaaagtatatttaacactgattaatttcctctttttcctcctcctccccactggaatgtgagctaggttcgcctagcacctagaatgatgtctcctggttacatagcagggtcttgacaaatatttgttgaatgaataaataaatgagtgaggaaacagaagcccagagaggaagactagtttgctgaagacctcacatgcagtgataccaaggtgcagagtgtggttttcccagcccctcaaggctgatgatcctagtttaaaaaaatctgcccattactctttttcaggtaaagagtggtggtgtcttcttcagagttttgtttaggtgaatggggtgaggccaaagggcaggctctgtgctctgggctaagtgagtgttttgcccttctcatcctggtcatgccacttcccaaagacttcacccctgtttcccaccaaaactccaccttcccttgtcctcaccctcaggctcagaatgctgttgtcaccctgtgctgtggcgttaactactttctgtactattacatactgaaagggttgcccaaagataatcatgactgtcttattgcttccttaagactgaacctaaaccatcccagagacattaacagctttcatatcctctaaaaacttccagacaagaagattccataatttccttgttggcatctgtgcttggcagtactgctgcaggaatgttctttattgcagcctgtggttaagacttaacaacaaatgccttttctttagaatccttctgggtcagctttctttcctgtatagcactgaaaagtgagatttgccccaaaatgttgagtgagagagagaaagcaaaagatagtgagcacaagcgagcacaaacctgaaatctatttataccgaggaaaacataaggtctacctgcaggggccatactcacccccagcctgtagctgttccctgcatgaacccgtccccttctctagagggtacaaggacacaggaagcaagccagagaaaggtggtgagaccttggcagtaaccttttaacagccacttttcccctagcattctgtcaaggagccaggcagccacgtaagaatagtgttgatgtgcaaacccactgtgggctgagcatcttctaaggaagcacatcccctccctgtcctctgaacttgacacgccataagactgaacttcatagttgtgatgctacttccgtcatggctggcatccagcccgaaatggcctccatgactatagctaaggaggtgtcatactaatgagcagtggaagaacggccctgcaatgcttagcacatcaactactttctcttcatctcttagcaaaacatatacttactcattataaaattgaatgatctgctttattatgtaatgaaagtactaagtacagtggcttatctcctactatttgctgacacaattacctgggtgtgtttttcagtggggaacaaacactcaagtcctagaaatcctagggattgccatttgtttttttttaaaaacgcaagataattcaattattccttgatttctagaaggaggcctccctctatttttgtctgtctttcagtttagagactatgctgggctctgtgagtggctctaatgtgctggtaatggcgtggctcatcaggaattgggatttgggggtggaattgcacaactggacagtcgctggacggcagatctgggtttggcctaaggtggatggggagttggggggaggagtggcagtttgtgttcggaagtttcaggctcctaggaggaactctcaggcctggctgtgctggcccccttgaggagcacagcggttggctgccaagggagtgtagatgggtcaaatgtgactaagaggagggcagggccagaagttgattcaaatttggcgataggattatgatgaggtttaaagatttccaaggagctaatctaatggtttttcttatatcctatgaaccaaatgccgattagttccagaaagctactttctaaggtagtatttagaatgtctgcttatttaccacttaattcaaattttatgaaatcactcactgagctaagtgtgacaattaccattgagcctgcagggacatttcagtgtgcacacagcaagtcaggaaaacaatgcccagcacgtgggtccacaggcaggtgccctgagcagagggggagggctcttcaaaggaggcctcagaaacaatgacagagcctcaaaagaaaatgccactggggctggcttgcatgttccatcaacaagatacttagagctggattactgaaagtatgaatttgcgtttcataagaaaaaaaggatctagttctacctgaagatttcagatacgtgagcaaccagaatgtttcaatggtttcgaggatgtagatgatgcagggatgataatcattttacagggggaggaagaaagaaaatcaacacacagcaaattctcacttaaatgagaacacacagcaaattctcacttaaaaggccaaatagatttttgtgcgatgtctatacagtgtgcctcttatttaaaatgccttttccaatgccatggaaataagcaattatcagggatttgatctaaaaagaaactttaaggttatgtcatatacatttgtatcccagtttcctttacactttactgccttggtattgtatttttggtaaataattcaaggcaggaggatcccttgagctcaagagttccagtccaacctgggcaacagagcaagactccacctttaaaaagagacttacgtttgtcaaatgcctactagaggataagggctgtgctgagaatttttgtatttatcatctcacctagtcctcatggcaggacagctagttaagtatgtccccaacagcgcagttaaggaaaggccagctcaggatcccctggctacagtgcagctgccattcctcggccttcccgttacttggtacccagtccccactccttatcccagccccagtatgtcatttagctgatctgtccttttgcttctagtgttgggatctctctagctacctacttgctagtggtatgtggagtggtaatggagcattctattttgagtatgtaacaaggatacgaatgtgaaaacgctagtgcttatgcagtccttatttatttatttatttttttgagacacgttctcactctgtcacccaggctggagtgcactggtgtgatcatggctcacttgcagcctcgatctcctgggctcaagcaatcctccctcctcagcctcctgagtagctgagaccacaggtgtgtgccaccacctctagctaatttttaaatcttttgtagagatgggggtctccctatgttgcccaagacagtcttgaactcctgaactcaagtggtcttcccgctttggcctcctgaagtaccaggatgacaggtgtgagctgctgcacctggccccagtcctcatttttatcagctggttgccttcctgctcagcaggggtaatagcagatgttgcttaacaagggtctgggatttgaagaaacctccactacccatatcttgtttgtctatcaaatagacaaacacaaatagtgttttaaaattttaattattattattattttttttgagacagggtctcgccctgtcacccaggctggagtgcaatggcgtgatctcagctcactgcaacctccgcctcccaggttcaagccattctcctgcctcaacctcctgagtagctgggattataggcacacaccaccatgcctggctaatattttgtatttttggtagagatggggtttcaccatgttgggcaggctggcctcaaactcctgacctcataatctgctcgcctcggcctcccaagttattatttttttaaagatggggtcttgctatgttgcccaggcttgtctcgaactgctgggctcaagggatcctcctgtgtcagcctcctgagtagctggggctacaggtgcactctactgcacctggcttcttgttttttgttgaatttagatgccttttggtggagcaggtgcttgccccatcacttcctactgtcctatatacaacctacttcactcatttatattatttgccaggcccctgaaggcgtctggtttgtgacttctgtgatttaatactggttgtaaccatcagcatcatatctgggtgatggggtctttggtttctcctaagatcactgtgaagagctgcttagtcaaacaccacacaactctagggaatctatttgcaaaaactatggatgtgagttgtactcctgggagttacaaagtacaaagcttgtgtaactgttggtggtggcccaagagatgcacaccgcgctggtggtacacagggaatgattctgcccgaacacaaagtattatccttagtcccataggaatgacggaagtcaggatgatgaaccaagaggtagtgtatatatggttcaaaggatgaccatttaatggtttgccattgtgaagcccatcttttggggtcctacaacttaaaccatccaattaaatgtcatctctggacagaccaggtccagctactagtgttcccaaagtgccaaaataaccgtattcactgatgtgattaagaaacctgagtgggctgttttcaacaacggtgagaaaagcaagtttacacttcttagaatcttactgaattaatggtgaaaattactagttgcttttatttttcccccaagcaaagaaggtgctgtgaatgctttcgatcttttactctcaagggaaatctagtgatccttacaccatctgaaagacagaaatcatagcaatgattcagatcccacatctaggactgtgccaaacttaggctgaaccactcaaaacctgaagggtaagtgaactagaaactacaagtgactgagccacaggtgaggttcagttcccttcaagaaagatattcacattctgtgcctctgagactttaagtgtatcaaatagaaactgactatgccacagacctaacatgtgacttggacatcaactcctgagtggggacatggcacctagtacatcttctagctcctagtcagccagttttctgtaagtcaataaacattcattaacaatcacacaaaccaaattactgtacctcctcaggcaagctgaccaccaaatcattttttgtctgtccaaccagcgcctgccaaaaatattcactgcatgcggccagcacagcccggtgggcccggaactccttcctctccacgatcaaagtcacgtcacagagaatatcctttttccgctggtcattgaggcccaggaggatgttggtgcagtggactgtggactcatacacatacatgggggagtcaggcttctcatccacagacatgccgttcacaccctgaaagaaagaaagaaacaaagaaagaaagaaagaaaggctgagtcaccacagctgtaggatcagagagaggaggtgagaaagaacatcatggttcctgtgtcccactgccatgagcatggcaggaaggaggggaattaccaatcagcatatttgtgcttactctgtacaatgagctcaggaaacatatctgtaaagtcaagttccacagctgacttttatgcttcctacttaccgcattcttttaccccatggtaacaaagccagatcttttaatagaacatttaaaacatttaaaacacattggtattttaaaacttggtggttctgattttgttagtaggctgaaaaagaaatttcacatgtaaatagcctctatgcaaggactaacttagatttgtgtgaagaggaaatgaatcattttgaagtatttgtaatgttgtcttgatgaagtatatgtaagttcctaaggtgaaatttggctgagatgccaagtagagtaaacatcaaatcacaatacatatttaacaagtgaaccaaactgtctgcacactgaagactcagtagagtcagctattgcatctgccctctgccacttcaaggcaaagcacaattgccataatgcaatagttgctcagctcttagaaagatgtggaattgtgctgtcgttatcccagctgaattgatgtacatcccctttaaggaaacacaatatatcacaatagcagtcatgaaaaaagatgcattcaacagtcaagattacttttacaaaaggttctttgctttaaaaaatatccattgaaatatttctttttcttttttttgagagggagttttgttcttgtcgcccaggctgaagtgcaatggtgcgattctcagctcactgcaacctccacctcctgggttcaagtgattctcctgcctccgcttcccaagtagctgggattacaggcatgtgccaccgtgcctaactaatttttgtatttttagtacagacgggatttcaccatcttggccaggctggttttgaactcctgacctcaggtgatccacccgcctcggcctcccaaagtgctgggattacaggcgtgagccactgtgcctggccccgctgaggtattttaaaatacagtatctgtaattaatttatatagttacatagtttttctgtaatgtttgctagagtagtaagaattccagtagcgagtcctactttctttttggctttcttatttttttaaaacagctttaacatacaataaactgtacatatttatagtgagcaatttgatgttttgattgtgtatgtaactgtgaaaccatcatcacaataaagatagtaaacaaatccatcatcaccaaaagtctccttaaggcccttgtaataatttttcccttgtacctctctgtaccccaccgctacaacgactgatcagctttctgacattctatattagcttgcattttctagagtttcatataaatggaatcataaactacatattcttttatatctggcttcttctattcagcataattatttcaccattcatccatgttgctgcatatatcaagtttgttcctttattacttagcatcctattgtataaatatagcgtaactttttttttatccattcatctattagtggatatttgggttgtttccagtatttatttacaaataaagctgctgtgaacattcacatacaattctttggatggacatatgctttcacttctcttgggtaaatacctgtgagtagaatgtattatatggtatgtgtaagcataacttttaaagagtctgccactgttttctaaagtggctgtaacattttacatttccaccagcagtgtatgagttccagttccttcacatccttgccaacatttggtatggtcactctttctagttttggacattgtaataggtctatcatatttctttttgggtttaatttgctttctctaatgcctgaagttgttgagaatcttccatgtgtttatttgacctctgtatattttctttgaagaaatgtctatttagattctttgcccatttttaattgggttgttttcttatttttcagttttaagagttcttcatatattctgaataaaagtcctttatcagatacatgacttgtaaaaattttttcccagtctgtagcttgtcttttgattctcttaaaagtgtctttcaaggaacagaaagtctttatttgatgaagccaaaaaaccatcttggtgtcacatctaaaaaactaaaccaaggtcataaagattttctcttgttttctgctagaagtgttatttttttagcccttacatttaggtctatggcccattttgagttaatttttgtgtaggtaacaggtatggattgaggttctttttttccttttgcataggaatatccaatcattcccgcagcattgttaaaaatactcttttctctcctgaattacctttgtatttttactgaaaatcagttgtttttacatgtatgaatctatttatggactctgtcttttactatttttatgtttgtctacttttgttttttttggagacaaaccttgcttatttgtacttttactgaaaatcagttgtttttacatttatgaatctatttatggactctgtcttttactatttttatgtttgtctacttttgttttgttttgttttggagacagggtatcactttggagtgcagtggcatggccatagctcacagcagtagctggcactacaggtgtgcatcaccgtatctggctaatttaaaaatattttttgtattcctgtaatcccagcactttgggaggctgaggcaggcaggttacgaggtcaggagttcgagaccagcctggccaacacagcgaaactgcgtctttactaaaaatacaaaaattagctgggtgtggtggtacgtgcctgtaatcccagctacttgggaggcggagacaggagaatcgcttgaacccagaaggcggaggttgcagtggccgagatcacaccactgcactccagcctgggtgacacagcaagactctgtctcaaaaaaaaaaatatgtgtgtgtgtgtgtgtgtgtgtgtgtgtgtgtgtgtgtgtgtatgagtgatgaggtctcgccatattgcccaggctagtctcaaactcctggcgtcaagtgatcctcctacctcagcctcctaaagtgctgggattacagatgtgagccactgtacccagcctctatatctacttttatgttactatcatagtgtcttgatttgctctttttcaaagttagtttgatcctttgcatttccatatacattttataatcagcttgccaatttctacaaaatagtctgctggaattttcactgagattgtactgaatctactgatgaatttaggaagaactgccatcttaacaataatgaatcttctgacccatgaacacagtctctttatttagatcatcttgaatttttctcagcagccgggcatggtggcttacgcctgtaatcacaagactttgggaggctgaggcaggtggataacttgaggtaaggagtgtgagaccagcctggccaacatgctgaaaccccatctctactaaaaacgcaaaaattagccaggcatggtagcgtgtgcctgtaatcccagctacttgggaggctgaggcaggagattgtgtgaacccagcaggaagaggttgcagtgagctgagattgcgccactgcactctagcctgggcgacagagcaagactccacctcaaaaaaaaaaaaaagaaaatttttttctcagcaatattttaattgaaaattttttttggagacagtctcactctgtcacccagatggagtgcagtggtgcgatcttggctcactgcaacctccacctcctgggttcaagtgattctcctgcctcagcctccggagtagctggaattaaagaggcatgtgccaccgtgcttggtcaatttttgtatttttagtagagacgggttttgccaggttggccagactggtctcgaactcttggtctctcctcggcctcccaaagtgctgggattacaggtgtgaaccaccacactgggccctcagcaacgttttatggtagtatataggtcttttatacctcttttgtcagatttatacctaagtatgaatatttttgatgccattgtaaatggcagtcttttaatttcaatttctaatttttcactgctagtatatacatacaaataatttttgtattttgatcttgtatctggaaaccttgcttattagttctcatagcctgttttttcttggtagattccacggtattttctacatagaagattatgttgtctgtgaataaagatctcttactttttttccaatttggataattttaatgtctttttcttaccttactgcattgtctagaagctctagttcaatgctgaatagaggtgatgagactaaatatccttgctttcctgatgttaggaagaaagtattcaaccattcaccattttgtatgacgttagctatagatgcttcataggtgctccttttgagctgaggaagttttatttctttctctccctctctcctccccttccttccctcccctcccctccccttgttttccctttctttttctttttcttttttttttttttgagatggagtctcgctctgtcgcccaggctggagtgcagtggcgcgatctcggctcactgcaagctctgcctcctgggttcacgccattctcctgcctcagcctcccaagtagctgggactacaggtgcccgccaccatgccaggctaattttttttgtatttttagtagagacagggtttcaccatgttagccaggatggtcttgatctcctgactttgtgatccccccgccttggcctctgaaagtgctgggattataggtgtgagtcactgtgcccggcctctttttctatctttctttctttttcttcagtggcactcatggctcactgcaaccttgaattcctgggctcaagcaatctcctgcctctgcctcctgagtagctaggactacaggtgtgcaccaccatacctggctaattatttcttatttttttttgtagagatgaggccttgctatgttgcccaggctgctcttgaattcctggcctcaagcaatcctcgtaccttggtctctcaaagtgttgggattacaggtgtaagccactgtgcccagccctgtgtttgccttcttatacattgttggattcaatttgctaacattttgttaataatttttcatctatgttcaatacggagatttgtctgtagttttcttacatagtttttctggcctggttttagcatcagggtaatgatgatctcataaaatgagctgggaagtatttcttcttctttaattttctaaaagcttttttttttttttctttttgtagaattggttttatttcttccttaaatgtttggtagaatgtacctgtgaagacttctgagctgggatagtctttaactataaattcatttttttaaattgtcaaatttattggcataaaattgtgtgtgtgtgtgtgtgtgtatatatatatatatatatatatatatatttttttttttttttttttttttttagacagattcttgctctgttgccaggttggagtgcagtggtgcaatcttggctcactgcaaactccacctcctggattcacaagtgattctcctgcctcagcctcccgagtagctgggactacaggtgtgcgctaccatgcccagctaatttttgtatttttagtagagacgggtttcaccacgttggccaggatggtctcaatctcttgacctcatgatccacccgccttggcctcgcaaagtcttgggattacaggcgtcagctaccgcccctggcctttttattttttttattttttaaagagacagtgtctcactttgttgccctggctggagtgcagtggcgtgatcatagctaactgcaacctcaaactcctggggctcatgtgaccttcctgtctcaggctcctgagtaactaggactataggccgtgccaccatgttcagctattttttttttttttttgtaagagatggagtcttactatgatacccaggctggtcttcaactcttggtgtcaagtgattctcctgctttggcccccacaaagcactgggattacaggcgtgagccaccacacccagcccatatatagtttttaaaaatattccttctaatatgggttgaatctgtactgatgccacctctcatattactgatactgaaaatttgtgtcttctctttctgatcagtctggctagaggcttaaccattttactgacattctcaaataactagtttttggttagtttttttaaattattctattttctagtttgctgatctctattctcattgttatatcctttattttgcttactttgggtttaattgggtctttttttcttttccagtttcctaaggtggtagttgagcccactaatctgagatcttttttgtcttttctaacacaggctttaatgctataaatttcactctgttttagcagtatcttgcaaattttgaaatgtttaatttttactcaattcttaatgctttaaaatttcccttttgatttattccttaatgcacaaatgatttacacacgtgttttttggcttccaaatatttgggggagtttttagttatctttttgttaatcctctctgatttaattccattgtggtcacagaacaaacttcatatgactttaatccttttaaatttatggagacttgttttgggtcccagaatgtgacccaccttggtaaatactacataagcacttgaaatgtatattctgttgttggctggaatgtcctgtaaatatcaattaggttaagttgtatgatgagtgttgttcaagtcttctaatatcttttctgatcttttgtctataggttccgtcatgtattgagaaggagtactaaaactttccggctacaattgtaggcttgtctgtcagttattgtaattctattagtttctgcctcatgcagtttgaaatcctattagatgcatatatatttagggtttttattttttcttgtagtatttattcctttatcactatgaagtcaccttttaattcctggaaatattctttgctctgaaatctactttgtctcatattaacatggtcactccatcttttgtttggtgttagcacagtatatctttttctactcttattcttttaacctttttgtgtttttatatttaaaatgtgattcttgtaagtaacatataattgggtcttgctttttaaaaaaatctaatctgaaaacgtctgagttttaattctggtgtttaaaacatgtatgtttaatgtgacaattgatttggctaggtttagatctgccattttgctacttgttttctatttgttctttattctcttttccttcatcttctgactctctgtgttaactatttttttatgattcaatttcatttcaattattggcatgttgttttgttatttcattggttgttttaggatttataatatgcttctttaagttatcacaatctgccttccagtgatatcataatatgcttctttaagttatcacaatctaccttccagtgatatcataccatgtcgtgtaaagcacagtagtatgcttccatttctcccttcctggccattgtattatacattttacttgttacttgttaaaacccctgtactatattgtcattacttttgtttagtcaattaccttttaaaaagatataaataatgaggtaacattacttgcagtgcaggtatactagtgataaattatttcaacttttctctgtaaaagcctgctgccttcatttttgaaagttatctttgaagggtatagattccaggttgacaggtgttttttttttttcttttcagtactttgaaaattgtcattccactgtcttttcacctgcattgtttccagtgaaaaatctgtcatcctcatctttgttcctctgtatgtaatgtcttttcttctcctctgttgcctttaggactttttcttgatcacttgttttgagcaatttgattatgatgtgcctttgtgtagttttcctcatgtttcttgagcttcttggatacgtggatagttttaaccaaatttggaaaaattttggccatcattttttcaaatatttttgccacaatttttttgtcttctcccctcttctcccttggggagttacatataatattagaccatctgcatttgtcccgtcgctcacaaatgcccattttttttttcttttggtactttaaagaaatctcttacattttacattggatagtttcttttcttttcttttttttgaggtggagttcagtggtgtgactttggctcactgcaaccactgtctcctgggttcgagtgattctcctgcttcagcctcccaagtagcagggattacaggtgtgtgccaccatacccagctaatttttttgtatttttagtatagacagggtttcaccatgttggccaagctggtcttgaactcctgacctcaaataatctgcgcacctcggcctcccaaaatgctgggatcacaggcttgagtcatcatgcctagccacattggttattttctattgctaacccttcgagttcactaatctcttcttctgcaaggtctaatctgccatcaatcttttccagcataattttcatctcagacactgtggtccttatctctaaaagtcccctttggtcttttataaaaaatcttccatgtctctacttaagatgttcaatctttcttctaactttttgaacacttggaatatagttataataactactgcaatgtccttgtctgttaattctaacatcttctggttcagtttttattgttatttatcttcattgtgagttatatttccttgcttctttgcataactgaacatttttgattggatgccagacagtgtaaaatttaccttgttaaatgctggatatttttgtgttcccataaataatcttgagctttgttctaagacacagttgagttacctggaagcagtttgatcctttcaggttttgcttttgagatttgttagataggaaaagcagcatttagtctagggttcattactccctactactgattcaagacacttctgagtactctatctaatgacccctgatatatgtgttttctagtctggctggtaggaaatgatgttattcccagttctctgagttccctttgttttgggtggctgtctctccatccttgggtagttttcttacctgcatctgctgatcagtactctgcagaatattaaagggaaactctctgaagatctctggagttctctctctgcagctctctcttctctgctaccttgctttctgaactctattatcatctttccagactcttagtgctgtctcttcaactgaagagtcagccagctcttccttggttcttccttcctgtgccatggcctagaaactctcaaagcagtatgctgagttcagtttgttttcctttcctggggattactatcttttggttcctgatgtcccatgtcttaaaaatcattatttcatatattttatctgtttctatagttgttttaggagaaagggtaaatctagaacctattactccatcttggctgaaagtaaaagccataggtttattttttatgctacagctactccaaacactttataaacaataacttatcacaatgcaaaccacatagtataaactttgctctgctatatataatggtttgtaatacccaattacaaagatgcctctgtgaagaattattagttctttggtattccaataaaagataaaatatttgtgaggtttgttatctggaatcattttttaaatggaattagaatagcattctaaataacacaattcagttataatgaccctaagccacggggtaagatcgagttcacctggcttctgtcaatgactaggaaattgctgctaaattctttattatctagtaagaagacaaatattttctattctggcttcttattagtccttcattttcgtggaatgttttcaggattttcttatctcccatatagggtctcaattctgatttgttttctccattcttagttttcaaattattattctttctcctaccacactgagtctcctcaattagtctatagaaattattgagttaaaaatcataatagcttgcatgtataaggaaacactcaaaacttggtggagcatttaatgttctaggtcacggatggtgtgttcaattcataaaaagtaggagatttataagggacatctcatttttccagttcatttatgggtaatacatattaatgtgcctacaccaagatagaagcttgtgttgaaagaaacaaagccataaattctttaatgaaacatgaaatgaaagaaaataaaaagagaaatgaaagtgaagtgcagtggaaacaggagtggaccaggcatgtttggggcttttggtttagctccagcattgaccaactttgtggatctggacaaactgcctaactgtttaggggcctgcttccatgtttgtaaaatgaaaagcatgaactagaagaccaatagtgttcttccagatctacaattctatgagtctataaaagaaatatacctgattgatcacaaagagcgggatactgtcttttttaactgagagaagctagttttctttgaccttctaaagaccattttgtgccgttatattgttgttgatgttgcatggcttaacaaaactgcccctgcagagctggttacagggaatggggtggacaacaaatatacaaggaaaccacagccttctgggagagtagaaactaggacccaaacccctgctctttctgggctctaagatggttgaagttctcaagagtagactccatattctgctaacagggcaggtttagaaaaacaaagatacagcaacataagcatcccaagttgatgaaataggctgtgacagtcacataaacatgggcatctgctttttgggctaaacttacttgagagctttggaaaacactgaaaaagtattagttttgttcatcaaatggtataatctaaaatatatcactttcgtggagctgttgttagactaacctgactgaagattttcttgaatatattacattatttctggataataattctttatgccatgtcagtattactttcttccccttggcctttacctacccctccttgttggttcctcttcaaacataatggaacatacctttctgctttctttaaaaatcagtcagcccttctcaacctccaattatcatgggtgcattgctatgggttgaatgtttgtcccctatgaaaatcatgttgaaacttaatccccaatgtggcagcattaagacatagggccttcaagagatgattgggacatgaaggccctgccctcatggattaatgaattaatgggttattgaaggagtgcattagttatcatgagagtgggtttgttacaaaagtcactttggccctctctcatgagctccctcaccatgtgatgccctgtgccaccttgggattctgcagacagtcctcatcagcaagaaggccctcaccagatgcggcccctagacctcgaacttgccagcctctagaactgtaagaaataattttctttatacattactcagtcttaggtattcagttagagtatcagaaaacaggctaagacaggtgctcttctatgaactccctccaatttgtctgcttttgactggccaatgccaaactgaattctgcttctcctgtttccactaggttttcttttttcacttgccttgctaatattaaacaacattcccctccgccccccactcctccatgcagcaaatcctgaaatctgcagcaggacccatgggatctaagaatgaaatggtttatagtgagtaacagaacccagaatagcatggaggagtatgacagccagtctttaagcattagacaacgtgttaaagtatgtagacattagctgaaatcagattgtaaggaagctttccaaaggttctgatttgggttttggctggatctcattcttccttttgcaggccaaaaaacccagctgcacatgtacatacacatataccccaatcatctcatcatatggttcagcagtaaaagtaaatcactattattttatcatagtatattcatccccttaagaagctacacagaccacaactcttattactcgaaggtatagtattaatgaatacagacttactcattaactcactcattgactcttcattcattatcgggtcatattcagaaatgaaaatgtctaatagttctgcaggtaaaagtataaagcaaaaaagtaaaaaaaaaaaaaaaaaaccaacaaaaaaatcacagtgggatctgaaaagctgcaattcacaaaaaagtagaatgttaagattttcagacaacctgtcatgtctagagtgcttcagatgaaaagaaatgaatatgccttgcaggtaatgaaaaagaccaaattataaaccatttcacttgaaattcaaactacatttctcccagaaacagtgcattaagtaaatacttctgtgaatcaaacactaaattatttagtaattgctgagtaaattcctgctcttataaaacatgcttttaaaaaaagttatttactgtaaaactgtaagggttagttcttataaaagaaagttttcaagtctatagacattttagagtgcacagtgctataaaaattacttacttattacttttggattggaaacactttctaatgcatcaagactaaaacttcttactttaagtgaaaagcaatccaatttcagtattttctaatggaaaactgcagtgcttgtcacttaatgtccctaatgccttagatagctaaagtaagggccctgactgacatggagcagctaaaacgttttgtgttccttatttactcaaacactccatctgcctgcatcctagttagtgccaagggaactgaaatttaaggctgttgttaggaggaagcacttgcaattgtatcatcaaatccttaatagctctgaatggttctcgtaattcagtataaacttctattttccttgaccttctaggggaaagttcaatgttcaaaaactgacaatggtttttactgcactgctgaaaaatataccaaaaactttaaaaaggaacagttgtaacaagtcccaattttttttgctaatttttgttattattgctgcttgtttattctttcaaataggccaaaataaaaaataacccaaatttccaaaatatctggtaataaacttgtggcaactactagcacttttcctatatttaaatgtaatcgacatcggtcaggcgcggtggctcatgcctgtaatcccagcactttgagaggccgaggtgggcagattgcttgaggccaggagttggagaccagcctggtcaacatggtgaaaccctgtctctactaaaaatacaaaaattagctgggtatattagtgcatgcctgtaatcccagctactcaggaggctgaggcacaagaattgcttgaacccaggaggcaaaggttgcagtgagccaagatcgtgccactgcactccagcctgggcgacagagcaagactccgtttcaaaaatgaatgaacgaatgaacgaatttaaccaaaatggagagtcacagtctgatacggaaactgaggtggaagaaatattagaatgttggtagcagactgtatgtattggtccaaaggtaataaagaattaaagatatatagccactaacctagaaacaataagaaagtttgacaatatcaagtgcattgatggtcagatcaacttctttggaaaacagtttggcattatctagcaaagttgaagatatgcatagattatgaccgaataattccatgcctaggttataccctagagatactcctggatatctgtaacagaaactctgtataaagagtgttcacagaattgttcagaataactcccaactggaaacaacatcatgtctatccgtagcagaatgcagaaatacactgagatatatttatatattcatataacggaacaaagcaaattagagccacatgcagcaacgtggaggagttgcacaaacctaatgctgaatactgagctacagaaacaagacacaggataataacatacaatctggtttcatgtatgtcaaattcaaaaatggataaaaaacatctagggatatatactgttatggagtgatatggtttggatctgtgtccctgtccaaatctcatgttcaattgtaatccccgatgctggaggtggggcctggtgggaggtgactggatcataggggaggtttctcgtggtttaacaccatcccccttggagctgttgcctcaatagtgagttatcataagacgtagttgtttaaaaagtgtgtggcactttccccctcctctcttccctcctcctgctctggccacatgaagacgcctgctccagctttgccttccactgtgattgtaagtttcctgaggcctccccacaagcagataccaccatgcttcctgtacagcctgcagaaccatgaaccaattaaacctcttttctttataaattactcagtctcaggtatttctttatagcagtgtgagaactaacacatggagtaaatgtgtcctctcaaaattcgtatgtggaaatcctaatccccagtataatggtatttggaggtggggcctttgggagtgattgggttataagggtagagccctcacgaatgggattaatgtccttataagagaacccctcttactctctttctgccatgtgaggacacaagaagatggctgtctgcaaacctggaagacagcccttaccaagaactggacaatgctggcatcctgatcttagacttctaacttccggaactgtgagaaataaatgtttgttgtttgagccacccagcctatggtactttgttatggcagcctgaattaagacatatacaaaggtggcaaaactataaagaaaagactcagaatagaggctccatttagagcgaggcagtgttcaccagaaagggacaccgtggggtttcaggggtgctgttgcatgctctatttcttgacatgagtgacaggtaaacatattcccactttaagttatacatttgttttatgcacttttctacatctactatatatatatatatcccagctcccccaaattaaagactgtaggagaatgttaacaactcaagtattgagcacctcctttaggttctgtgacttaatcacaaaggtcctagggtgcgctttgggcttcaaatgaaaaaaaacacacccacaccttaaatcctacaacttatggtcaggaaggtccttaaaggcaatcaaatctaaccaattccaagttgtacgttttcagtaataatctacaaaaatgggccaaatacagggatgaggccttttgggagatggtaagaaatctgagcccaggcctttgctttgcagtaaaacttttttcagagatctcgtgttttgtcttctctcttgttaaaaccaaatcacttcatgcacttctatttccttatctatgcaaggaggaaataaactaggtgactttttagttctagtttctatggttctatgaaagtataggaactttaggaaaatcctgaaacatgagcttttctaactgtggttcctgagaagactttttaaggaagctagagatgctcaaaagaacacaactggctggaagggaaaaatgccatcacataacttttgagagagatgaagaagaggggaagacccatccaataacagtgtgaactttcccccttataaacagagtcaacccaaaggatgaatcaaaggtcaactttcacacattaatggaacacagtgcccatcagtactgagcaatagttcggcattctctttccatggccaaaacagtgctctggtgtgcaggtcagcgtctccctcaaaagccgtcttaggtatgtggctctggaattaagcggggtgtccatcctctcctcttgtctccacccagcgatgtcagatgagactaccccgtttagcgggccagagagaaggctacaactgggatttaacaatagcatggtgcataaactgtcatctcaaaaaggagatgaaatcagcgggtgaaagggagcccatgtcaggccatccaaggggcatgattactgttagtggtggttggtggtggtggggcagtgggtgtgtggaccagggagaaaatgtgcaatttagccatgggcagatttggatatgcagctttgtgatcatcgcactggtcttttttatatgttgatgcttgcttttgcttcttttgtgtaaccccccagttaagagtaaagccaaagcctccatctattcttctgggataggtcattttctactcttggcaagccttcttttctatattgtcacttccagtttgtctctggtattacttctttgtgtctatgttctccatttatattcacttctcatacattaatctctgcttcctattagcatgtgcttcatgcctattaggagttagaggacagagaaaagtcatttcttttctgcatttctctttatcagggcatctgtgtgaaatattctctcccagtgtccccttccctccccttgtagccagagaaatattaccctagagcttcacgctgctaatgtgagaagaaattgtgaacagtgattaggaggctaaatgagggtggtggaacctatttacttcattaaagttccttcagggaaaatacgaggatgggaaactgagagataagggttaatactaaaagaataacagatccatttgactcagagcaatcttcagtctgcctggattctatcagacacccttctccatggggaaatcattacagagaaatgacatgcaaagtgcgccataaagcatctgagtcaaaccagagggaggatgactcaacggatcattttacattttaatagaaggcactgcagatttgtacctagtgcacagttcaacacagggctcataactcctccccaaaacttcttcatcgggtgggaggggagttcccagaacctgacagaaattattctgtcttagaaaaaaaccaagtcaaaactcacaacagagaatcaagactaagaaaagacaacagatagtcaaatgccgaaaagaggggagactgcaagtctaatttcaactttagcatttctgtcaaacctaagacacagcctgaaaattgagctcagtaattagtggacttcagatgtcataaaggagtggggaagatggaaggaggaatggagggagagagaggaaagaggagaacgctatcaaagtgctataattaaataattgtgtttcttaaattagttttgcaagattttccaatgataattactgtcagaagtttgcccaccaggtcagtgacaatgctgggcttgagtttccatgtgaagtcaagaagcaatatattagtcatgccattgttcctagtatgtttcccaggccaggtattgcttatagatgctaatatgtataacctgccaaagttagattcatctgaccagggattatgatgttaagagactggattgtcaaacctaactccttcttggaatgggggtgggggttacctccagacacacttttgtctgcctatacataaagaatatctatagtttcacagctgttcatccgcctgatctctactgttgcctgccccagctcctaagagggcacgcggtttacaggtaggaaaggaaacagaagtgaatactgaggcttggcagaaatacagctttcacagaaaagattcttaataaaaggaaacttgctcctttcatgcatgggggtcttttggacaaaatgattctgttctgaaacatcatctctgcagggatgcaggctagaacgaatgaagtttagattgcaagttggttcacccggtaactaagaaaatcgaaattcaagaccaaaggcaggcagcatctaatggggtgaaagtcatctagcttgagggtcattcaggtagtgttttgagaaaggtttgatttccactggagcctaggcacacctgaaacccactcctgtttttccatttaaaaatgatgaaaaccatgaggctaagaccactggttggcagtctgttaagtcccatatcaagtaacaaaagcatctggaccacctgtcaccaagcaggaggtcaaatggaactggaatgttaacacgcaggtcaaatgcccttcagagaacacggggaaaaggcagtgaaaaggaatgggagaaaaagaatgtgcttggagctttccaagtccctgtcctgtccttggcagcttctcagaatgacgattattgtgaccaaaaggtagtgacacacatgctacatgacacttagtatactgtttaagatacagacggtcttatatgcctataccactgccactcacacacgatttcacctcacagaatatgcttcagataaagccaagtatattaaggaagagatttttttttaattcactcattataaaaagtcagaattgtactgccatgggggcagacaataccccctctccaaacggtaaggaatgggtgccacaagggctcattggccaggtggtaccggagagacacagtgtttcgcactttcttgactctaaaatgcacctattttccatttctccttccatccttagatagaggggctccatttgaatccctgctctcctgcttcctagctgcatggctttggctttggggccattgttagactgtgtaatccttggtctttctatgtacaaaatacttatgtgaggattaaacgagatgaagcaataaagtatttaggatggtccttgttttacagtaaacacaaataaaagctattcttatgaaaagaaagttaatttctttgcacattatatacacttgtaattctacatatgctgaaaatttcttatattgaggcaaatctggactgcatgaagaataatgtatatttttgtttgccagattctcttgcttaaacctggggaagggccaatttgcttaatttccatccaagacctgcaagagaatgatgggataggtgtgcattctggtacttgctggcaacttcggccatgacactatgtagacttccttctgcaacatcccttgatgactgtgaaggtcaaataaggcaacagatctgagacctccctgagaagtgcagagtactctgctcgcatcaggaattatcctcaccactatttgactaatcctacacataattatataaagaatgtctgctcttatgggcacttagccctgatatagttcactctcatgccaaaagaaggcatctggcagatgggggacttgtattgattctcatctgataacatttcctaaaagattccattccttcagatttgttaaaagtgcgtgctttggatactctatcctcccattacgggcttttcctattttctctctctgctaccttttgcatgtatgttctgcccaaatcagaatcctctttcatcatgaggggcaggatcctgcagtggtgacaggtcaggctctggggccagcctgcctgcatctgaaccatgaccacaatgctacctcagacaaaccacgtgagctctctgtaaagatttctcatctgtaatccagtggtcacaaggcgtaagcaacttaaaacacaaacgtgggaaacagaatgactcctggagaatagtaagcacccattagatactgcatacaaagatggtctacagaggcaaggtagtgcagtggttgtggatggaggctctggtgccagcctacctggctttgaattctgactctgtcattcactagctgcaaaaccttgcacaagacacttaacttttccgtgcctcagtttcctgatctgtactaaaagtacctgataaagggcacctatctcatagaactgtgaggattaaaatattttacgtgtttgtttgttcattaattcaccaatttaacatatagtaactggtccatcaaattagctcctcttttccaaccatgccaattttccccattcacgtttcatttccagtttgacaatggcttgccttttcttcacgtaagtatttcctgcttttggccctgcccacctaacacccagactctcccggcctgcttcctatctctggaaataacaatagttctctaactgcatagatttagggtaaccacagcaggttcagcgatctgcattttaaccccatgacagctgatttcaaacaaccctacaaactaagactccccgccctgccattccaagaacgaggggacttgggcaatttatttaagtccttagagtctccttatgtgtgaaatgaagataaagactgtctcccgagagactgttaggagatgtaaatgtgatggctcaatccctggcctcctcaggtctctgtgcagacatcacattctcagtgaggcctccctaaccaccctgctccgtttaaaccacaaccccagcctcccacctcactctccatcctccctccctgtttatgtttctttataacgttttcacatctcacacacactatattttactcatattttgttaatgacctatttttctattgagggcaggaatttttacctgttttgctcaccattgaagccgcagaacttcaaagtgctacactcaatacatacttaataagaaagtgactaaaaaagacttttcctaatcccaacaggtccatatgtcacttctgtttctgctgaggtctccttccagcctgtttcttcacacatatccctacgctctccagagctgcttgtcttttctgggcctcaaggtcgccttgcctatccatttatccacagaaaacttactccattctaagcaatgcgaccgttagagaaaactaatgatataacctccaagacacacagccaagataatgggatggtacaaaagcaaaagaaaggcttagattgacacagtgaaggaaaagctcccatttgcagagatgctgagtagaaggtcttgagtgtgctttatttctgaagctctctgtgctcaaatactcacaaatccagaaacacattgcccattggctctatacaatgtggatccttgcagagtagaattaggctgttctctcctggtaaaagcttgtgtgctcttgcttctaagagatggctctgatcccacccccttatgtccacggcctatctcaaactgccaaacagaggaccaattatgcccttcctttccgcagccctcaggaaaacagccagcacacaggaccctcaatggcaccctcaggatgatgctttcagaatgtgacagcgaccacagcccaggcctctgctgccctgggagtagacgtggctctggaaggcctgggtttgagagaagatggtaggaggaaggtttctgattttcgaatgaaaatcagaccagcagggttttttgaaaagatcaacaacattgatagaccgctagcaagactaatcaagaagaaaagagagaagaatcaaatagacgcaataaaaaatgacaaaggggatatcaccaccgatgccacagaaatacaaactaccatcagagaatacgataaacacctctacgcaaataaactagaaaatctagaagaaatggataaattccttgacacatacaccctcccaagactaaaccaggaacaagttgaatctctgaatagaccaataacaggttctgaaattgaggcaataattaatagcttaccaaccaaaaaaagtccaggaccagatggattcacagccgaattctaccagaggtacaaggaggggctggtaccattccttctgaaactattccaatcaatagaaaaagagggaatcctccctgactcattttatgaggccagcatcatcctgataccaaagcctggcagagacacaacaaaaaaagagaattttagaccaatatccttgatgaacattgatgcaaaaatcctcaagaaaatactggcaaaacaaatccagcagcacatcaaaaagcttatccaccatgatcaagtgggcttcatccctgggatgcaaggctggttcaacatacgcaaatcaataaacataatccaacatataaacagaaccaatgacaaaaaccacatgattatctcaatagatgcagaaaaggcctttgacaaaattcaacaaccttcatgctaaaaattctcaataaattaggtattgatgggacatatctcaaaataataagagctatctatgacaaacccacagccaatatcatactgaatgggcaaaaactggaagcattccctttgaaaattggcacaagacagggatgccctctctcaccactcctattcaacatagtgttggaagttctggccagggcaaccaggcaggagaaggaaataaagggtattcaattaggaaaagaggaagtcaaattgtccctctttgcagatgacatgattgtatatctagaaaaccccatcttctcagcccaaaatctccttaagctgataggcaacttcagcaaagtctcaggatacaaaatcaatgtgcaaaaatcatgagcattcttatacaccaataacagacaaacagagagccaaatcatgagtgaactcccattcacaattgcttcaaagagaataaaatacttaggaatccaacatacaagggatgtgaaggacctcttcaaggagaactacaagccactgctcaatgaaataaaagaggatataaacaaatggaagaacattccatgctcatgggtaggaagaatcaatatcatgaaaatggccatactgcccaaagtaatttatagattcagtgccatccccatcaagctaccaatgactttcttcacagaattggaaaaaactactttaaagttcatacggaaacaaaaaaagagcccgcattgccaagtcaatcctaagccaaaagaacaaagctggaggcatcatgctacctgacttcaaactatactacaaggctacagtaaccaaaacagcatggtactggtaccaagacagacatatagaccaatggaacagaacagagtcctcagaaataatgccgcatatctacaaccatctgatctttgacaaacctgacaaaaacaagcaatggggaaaggattccctatttaataaatggtgctgggaaaactggttagccatatgtagaaagctgaaactggatcccttccttacaccttatacaaaaattaattcaagatggattaaagacttaaatgttagacctaaaaccataaaaaccctaaaagaaaacctaggcaataccattcaggacataggcatgggcaagtacttcatgtctaaaacaccaaaagcaatggcaacaaaagccaaaattgacaaacgggatctaattaaactaaagagcttctgcacagcaaaagaaactaccatcagagtgaacaggcaacctacagaattggaggaaatttttgtaatctactcatctgacaaaaggctaatatccagaatctataatgaactccaacaaatttacaagaaaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacattggttagaatggccatcattaaaaagtcaggaaacaacaggtgctggagaggatgtggagaaacaggaacacttttacactgttggtgggactgtaaactagttcaatcattgtggaagtcagtgtggcgattcctcagggatccagaactagaaatactatttgacccagcaattccattactgggtatatacccgaaggattataaatcatgctgctattaagacacatgcacatgtatgtttattggggcactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctcagcaaactatcgcaaggacaaaaaaccaaacgctgcatgttctcactcataggtgcgaattgaacaatgagaacatatggacacaggaaggggaacatcacacactggggcctgttttggggaggagggaggggggaggaatagcattttgagatatacctaatgttaaatgacgtgttactggatgcagcacaccaacatggcacatgtatacatatgtaactaacctgcacgttgtgcacatgtaccctgaaacttaaataaaaaaaaaaaaaaaaaaagaaaatcagaccagcaggaaggccacagagcaacttttcctcacgcacaggaatgtgctttagttctactcacagtggtctgatgacaaagtcctctttaataacttataatttggaattgtaagacattggacccaacacaaccaatgtaaaaacaaaccactcatgatcttcctgggaaaatggaggtgcatttatataggaacagtcttctgtggatggttttctgagcagcttagcaaagaattgattaaataacagcatatgcgttgttaaattccctattacaatgctttcaaaattctttgaaagaaaaagatgctcacctgttaaaaaaaaacgtaagtttctaaaggagacacttgaaaaccagaaaggagcatcaccttcttaaaaaaaaatcaaaatggcacagcagaagttcacataaaatgcccgacaatgtttcttttcaatagaactcaagctgactaaaagacatgcttggattcagagcttttactggttacctaggttgcaaatgataccaaaagagacactaggaattcttagttagaatgccagtcaaggaaaagttcataatcctttcagattttaaatcctgtgtgtctgtgaggaggataaccatttagtattttagacaactggaaaagaagattagaccacactgtgtctataaagttgtgctacaccctgggttaccctcatcaaaggctgaaggaaatggctgttattctctttttgaaactgtagttatatggtgactgctggttatttagttagaatggaaaactgatacacagagaagcataccaaccgtatctaatgtattagcctgatattaacaactagcatctgattacttacaattgaccgtatttgaaatctattaaaatctcttaattattcttatatgcccatagtcactgctttctcttaaggcaacatgaaatgcttaatgattaatataacaatttcaaaagctttattgtacagactggactagactctgtagtcttcacagagtgatcattacttaatgaactcagcacactgtacattttccagccacctgaaactcccaagtattgtgtgagtttttggccaattaattatcaattacaacatcataaaacattagcacaaaaataggaataatgaaatttaattatacattattcttctgagttgctgaaaataatatacaagactgattctgattaataattcattcagcaataaagtatcaggaaagataattatgcagtgccacaattctcacactgatttctataattacagattacaacagtgttagcaatttaaaaggttagagagctgtggtaatttgctatgtcatcctcagctatattaatgtctctctttgagcaccaaagataactgaaaatataataatggaccaaatcagatggcttgcccatgctctcctcacctaaaacatctccaatctgagaacattagtaaagtccttgataattagcctcttatattatttaactagtcctactacacacatttggtttacagctaatcaaagaaagacaatatgtaggaatacatgccaaaatatgcaaacatagaaacataacctatagaaaagttacagggatacaatcacatttggtatgtgacatatctgaccatgaatacacatatatgtatacctgtataattaccccttagataattaaacaccaagtcaagggacacacataatgtaaatctctgtctctggcaacacagttgagtaaatagcacatgaaaaaatacaaagtttatctaactaccctctctgggttgttaacatattatgacacaccaaactactcttgcctttaagttctattacatcctgagaatgaaaatacactcagctgctagaaatactcactctgctctgcttgcattccatgggaaaaaacctagctagaaatttatggcctcttcccataaccagtatttaaatgagaattttcacctggggatgagcccaagtgaactaaacatacagttccacagatataaaaatcactttctcctctgctctttcttctcgctatttttagagaggagatttgtaagacatcttggctttactctcttgaatgccttaagtatctgactaacttcatgttcaactaatatggagaaacagatggaaaattcaccgggactaaaatcttaggcattatttaaatgagttccttgcagagtcttttgtgtgtcttgttgggaccgggggttcctcattctggagtatgccagggtttgaattcaagatttcattacagctggccccaacaagatgataaaggaagacagggtgaaaaaacagtttcatttcagtggtagaaagaacttgtagatcatctgattgaatatgctcttttaaaaattatagacgtttaggctcaaagatattaaacaatttactcaaggtcgcagaaccatttagtaacaataacagaagaaaaactcaagcatgtctgaatcccaggtttccactatattttattaaagaaaatacccaaggagaaggggcatgatgagcagcatatggagacaatttttgttctaaaattaagcccatttacttacatttcatttctacgaaggggttatgtgtaagattgggggtgggtagaggaagaaccattctaagagaacaccatagaactgtagctcttcatgtatttccttaagtgaaaataaaatgggtttcctttgagtcacaaaaataattctaaaacagggcattgcttctcatcagctttttttttctgggctacatgcaggcagttggcacaagatcatatggtaggacaccacactagatataaattcccttcaccttttttcacctacttccttttattcccagcagggcagtaaaacaggctccctgcatatccctgcaaatttgctcttggattcagaagtagacccctagcaggtgatattgttcccttgttaaagtagcagacattcaagcttgtaacaggggataaaaatggcaagtggactttggtcccacatttgcaaggtcctgtatcattttgtactttgaattttttctaacatattatgaacaatttcaaatttacagaaacatttaaagaattttacagtgaacacctacatacccatcacttagattccacgattaacattttattatgcttatttcattacacatccatccatctatatccatcagatttttttcaaagcatatcaaagtaaactgcagaaatcagcacactttcccctaaacatttcagcaggatattacttgctagagtttaagattagtttatagtttttttcttttgaggcaaaatttacatacaatgaaatgtacaaatcttaagtgtgtattcattgagttttgacaaatacatatacccatgtaaaccaaatcttatcaatctatagactataaccatcaccccagaaagatcccttatactccatcccagtcattcccctcctccaaaggcaatcagtgctccagtttgtctaacagactaattgtctgccctaaaacagttgaattttgaaactttaagtagctaagtgttctgtttttcttctttcagtcaacacaaactgagcacctaaaacgagacacacacttaaagccagtaacaacaaaataattattccattaaattaggaaaataccttccatggtggtgagaaccatgggattcattatacttcaagggcaatttagatgcacaaccaaaagggaagacacataccacaccctgcggctgttactcatttggaaacttgctgactcttcaatagtaaattaaaatccatacccatgcccagtgaaaaatggggctatgcaggatccttggattaagtgtgaaaaatgaggaggctttttaaaaaagcccatcttcaaaccaatatcatcgctttatgatgaagatgaactgttataacatgccaagcctgtaacctacaaagacacagccccgagttttacacaactataaaatcatgaaggaggctagtaaaggagccaaaaggctcttcatttattttctttaaacttaactacagtagtcagtgtggattaggccctcattttccagcagctgaattattgtcaaggtgctaacactcttggtggaaacagcattggattacctacctctttctgcaagagctcaacagcacgcttcacatatcagtcactaaaactgcattaaaaggctctcctacagcaactctgatactcttttaaaagttcattaacccctgttgtggattgaatcacaatattctccctccctccaaaagaaatgttgaagccctaacctcctgtagctcagaatgtggccttatttggaaataatatcattgcagatgtaattagttaagatggggtcatactggagtagggtaggcctctcatccaatatcatgggtgtccttttaaaatgaactccatatggagacagagacacagggagaacaacaccatgtgaagatggaggcagaggtgagagtgatgtggctacaagccaaggaatgccaaagatgaatggtcagcaccagaagctaggaagaaggaaggaagagttcttccctataggtttcagagggagcatgaccctgccaacatcctgattttggacttctaacctctagaactgtgaggcaatacatttctgttgtaaggcatccagtttgtggtactttgttatggaagccttaggaaactagaacaaccttaaagaagattttcccctttttggtaattgttttaaacaaaagtgtaatttacatgcagaaaagtataccaaccataagggcacaatcaatgattttctttcaagtagacgcattcatgtaaccaccacccaaatgaagactattatcagcaccccagaattctccttcatgccccatcccagttgttatttccaccaacagaactgctaattctaacttccttcaccttagttttctctttttgaactttaaagaaataatatataattttttgtgtgtctggcttcttgtgctcaacattatgtttgtgaggttcatccatgttgttgtgtataagagtggtttcttctaaagatggtttgaaaaatatcattaagtttttcttttgttttgctttggttggttcaaatttcctaaaatgaataaaatggtaaatactgaaattctccaaaaatctcccaatcccagcttcccagccatccagttccattttctagaggccacgagtgtctcttgtgtatccttccagagagaactgatgcctatttaagcaaagatatatatatttatagatagatctttgtccttttttttacacagaagtttacatatggcccgggcatggtggctcacacttgtaatcccagcactttgggaggctgaggtgggtggatcatgaggtcaggagttcaagaccagcctggccgacatggtgaaaccctgtctctctactaaaaatacaaaaaattagctgggtgtggtggtggacacttgtaatcccagctactcaggaggctgaggcaagagaatcacttgaacccaggagggagaggttgcagtgagctgagattgcaccactgcaccccagcctgggaaacaagagtgaaactccgtctccaaaaaaaaaaaaaaaagtttacatactaagccatgatctgcaccctgctttcacttaaaaatatagtttcttcattcttgttttatggtttcataatacttgactagaaggtcatagtacaatttatataaccaattctctattggcagctatccgggttgtagtcagtatgtgttattataaacaaggttgtaacgtgtaatcttgtaattttgtacacatatccatacattctcctaaatgtgaaattactggatcaaaggatataaactttgtagttttgatactgccaaattgtcctccattgggacagtaccaatttatactcctgccagcaatgtacaagagtacttttttttttgagatggagtctcactgtgtcgcccaggctggaatgcagaggcgcgatcttggctcagtgcaatgtccgcgtcccaggttcaagcgattctccagcctcagcctcctgagtagtcgggaccacaggtgcgtgctaccacggccggctaattttttgtattttcagtagagacggggtttcatcgtgttagccaggatggtctctatctcctgacctcgtgatctgctcgcctcggcctcccaaaatgctgggattacaggcataagccactgcgcctggccaagagtacttctttatccatagtcttgctaatagattatattaccaaacttaaaaacaaaacaaaacaaaaaacccctgcctgtttggcaagtaaaaaacagcgtttaattatagttttaatttgcattaatttttaataaatgacactgatatatttcatgtttatgaacagctatttatatttccacatctgtaaattgttaatagtcttactattcttttaatttttttcccctattgcattgttggtctttttctgccttggagaagctctttaaatattagggaaatcagttctatctctagatgagttgcaaaaatatttttccttctttgtcacttttttttttttttggccgtggtttatggtggtatttgctgctcagaaatttttgatttttgtgtcattgaattcattttatgactttccctttgtggtttctggatttttgtcatactttgaaaggccttcccaacttataaacaattttctcctgaatccttttagaacttttacggttaaatttttttcccaagtaagttttggaaccatttaggatttatcttggtgtaaatatgaaccaccaaactttctttttcccagaaggctatttaattgtcccagcaccatttattgaacatccttttttatcacactgatttgagatgcttccttaatgtaaactaaaatttcaaatgtatttgagattatttctggactctataaggtgccactgacttgcccattaatgccaattcaaatatatgagtacgtttgtagtatattttaatatctaaagagcaattttctctctttttattcttggctatttttgattttttttttttacatgaacttcagcatcagcttgtttggttacaaaatattctgttggtatttttactgcattcacattaaatttgtgatgttgaggttttctgtccaaggacatggattgtctttccatttattcacatctttgttttttctcttcatctcaggaggattttaaaacagtttcatttatttacaagaataaagatttacatcttaaggagttcttgagttcaattcctatatttatacacattacatatatatatatacacatgtgtatatattttatttgaacttttcttttttgctattgtaaataggatattaacttccattatatcttctaatcagctgttgatcacatatatgaagaatgtttagttttacataatccattagtacataatgggttgttattgttaccaccatcttccagctgattcacagaagaaagcatactatccaagtgtgcaatcatatcatctgcaaataacaaacattagtttaacctcgtccttttgactttttacacttctactttctttctcttgtactgcacaggctaagtacgttcagaacaatgttaaagaaataacaatgggcgcccttgtcttcattgtttctgacatggcttctggtgtttccctattactgggtatattcctttgggcatacacccagtaatgggactgctgggccaaatggtagctaatttgactctgcaatcccataaacactacatctactaaagcgtgatgctaattttataataaataatatatataataataattttatgttaaggaggtatccatcacttctgattttataaagtggtttttaatgaaaatagatgttgaattacatcaatgcctttgcagcatctatgaacatgatcaaataagtgttccttaaagatctattaatatgataaattatattaaaagatttttccaatatttatcactcctggaatgaacctcatttggttatggtacactgttctttcaaaatggtgctaggctctgtttgctaatattttatttagaattttacaattgtgttcttctatggtggttggtctgatggattatcctgctctttagaagtcagtgactaaattatattttcttagacaattatggatttttaaatttatctgtaaaaagttgagtaaaacaggctttatgattcctttgtaatcttttatttaccttatttttattatttcctctattttattaatcaagtcagctaaagtttccttgattgtgttgaggttttcaaacaacatgcttttgcatttattaattcttcaatttttcagtttttgaattcaggattttttgatatacttttatttccttcctgctatattttaagtttgttttattattcttttctaacgttttgagttagacacttaattcatttatttctatttttcttatttgccaaaataaatattttaggccacggcttctcttctgaccactgctttaagctgcagctcctggattctgctaaaaacacactgacacactgacacagatacttacctaaacattgcatataaataaactatgggaaactgatcatttaaaaagatgttagaaaagaccactaaaggaacccagcagtaagtctgttgtagggtgaagaataattctttttatttttatttttttgagacagggtcttgctctgtcacccaggctggagtgcagtggcgcaatcatgggtcactgcaacctccgccttttgggctcaagcagttctccctcctcagcttcccgaatagctgggactatgggtacgggacactgcactcagctagttttttgtattttttttttttggtagagacagggtttggccatgttgcccaggctggtattgactgaactcctgggctcatccactcacctcggcctcccaaagtgctggaattacaggcacgaccactgtgcccagccaagaataatccttttgctgccattcatggtgtattgaccaggtgcaccaggcacagtgtgggctactgtgagaataaacatgaaggggtctctgtctttccatcagtaaggaaaccacacatgagcacataaaaacacatactcacatatacaatatcacagaaacataaggacaagtcatacaaaccataaagagatacaaactttcacataaaataatttcccttcttctgctcaaaacatacatacctataatctttaataggcattcatttaatttatactgacctaagttgctcttccaacttaaaagcagttcacaataacaatatttgtttttgcatagaatatgggtcagaagagatgtagaaaggcttgttgggtagctcttgtaacagtctaggtgagtgatgatgatggcttggactagtgaggaagcataagagtggcaaccacggcctgatttggcatgaatttcaaaggtacagagaggtacagttgataggatttgctaatggactggatgtggggtgagagagaatgaaaagagttaagggtaactttgagaatttcagcttctgcaattacatgaatgagggtgtcatttactgtaagggaaaactccaggggaggatcatgtttgggggctggggttgaaataaattgttgcttcctggtagttcatctatccaagctcactgttatggtttgaatgtgtcccccaaaagttcatgtgttggcaacttaatccttgcgacagcagtgttgagaggtgggacctttaggaggtgattgggtcatgagggttctgtcttcattaatggattaatgagggagtgagtctgttataacaggagtgggtctttataaaagccattttggccatgtctcataacctccctcaccatgtgatgccagcctccagaactggaagaaaataccttacctttccttttcctcttccccctttcctttcctttcttcccttcctctctccctccctcccttcctccctcccttcctctctctcctccctcactccctttctttcttttcaaattactcagtttcagatattaacttacagcaacagaaaacaaactaagacactcatctcattcacctctcccataagttggttatattcaagtgtcactgacctttgtcctatcacagctccatgctgttgcatgttccgtttccacccaaagtgtcctgcctactcttctctgtctggcaaacacctgctcatccttcaagaataatctcaaatgtcagctcctttggttacctttctgactcctgcaggcacagttgggagattcatgctggagctttccagcctcccagccatctcagtctcacaaaattgcttatgtgtctgtctctgtcacctggttaagttccccaaggacagaagtcatgcttttttcttcttttttccctggagcacaatgcctgaaacaaagatggctactcaataagtgttttcattcattccatcaatattgatggagtgtctaccatgtataacacatgatgccatgtactgttctaggtacctgaggatatagcaatgaacaaagcaaagttgtgcttgtcatggagccttcattccattggagaaaagggcaatatacacacaaacgaatgaatctacaataatgtgctgtagaggaaaaaaataaggcagggcaagagcagtgaaggatgtgggcggtgaggtcctgttttaaatactgcagtcgtggaagatctcatttaggcagattctaaatgaagtgagggagtaaaccatgcagatatctgggaaaagagccttcctggcagaaataaacagctggttcaatggccctacagcaggagtaggcttgatgctctgatgactcaaaaggccagagtgcatggaggatagtggccagcgaaagctgcagaggtagtcaggaagtgaagggcatgcagttcgaggtaggagtttgggttttactctaagtgttatgagaagccagagtaggcaagtgataggatctgatttacactttaaaagattcctttggcttccatatggaaaatgggttgctgtagggtcagactggaagcaagaaagcatgttaggaggctcctgcagcagtcctggtaagcatgatgatggactgaactatggaaggagcagaaaagtggtgacaaagtgcctggatttgacaggtggagctgacgggatttgctagtggattggatgtggggtgagagaacggaaagagttaacgatggcaccaaggatttcagcttaagtgaccagatgaatgggggtgtcatttattgaaagaggaaaccccagaggaggatcaggtatgggggatgagggcagaacaagtgttggttttggatatgacaactttgaggagttgattagacagccctgtggaggtaagcaactgaacacagcctgattctagagagataaatttgggagccattagtatgcagatggtatttaaaagccacaagactggatgagatcaccagggagtaagcttatgtgggctgaatgaatgaataagcaagtttatgctcaggaaggaaactgttatcaggttgataacatctgactctacagagactggacaaatagataataaacacagggatgaaagggcacagaattaatttttttccatgtctagatggctaatccagacttttcccttacatgcgcagaaaagcctgcatcctaaattattgaggacaaagcagaccgcatgactctgtggagcagtttccactgcttggcttgtgtgcaaggtgtgtcagcctacttcaggcgtcttggtaactaagcacttttctgggtgagcatcttatcacagcatgttgtgcaggctggaacccatgagagtgagtccttcaggaaagaaacgacatcaacagatgtacacaacacgtttcaaattaataaaggtggggggaagatcacaaatacaacatctgtaacactgtacgtgcaacttgtcatctctattgaagaaacaggcaggtaagcttccacaactaagataaaataatctttgccgtaagtccgagataagttgcattgaatttggggtagttaagctgtatttctcaaaagtcaaaaccaagtcagtgggttcaccaaattcttttggttacttcaaatatcatattaccaataccaaaaacttctcaggcccacaggactctcatcccatgtaaaaacactaaaaggatggtgatgcaagaggtatcccactgtgaaaaattccttttgcatactttctaaaattaatatttctttccaagtacacagggttttgtctgccacttattttgctttttaatcatgaggcactaaaagttggcacatttttaaaggtgccagcttccatggacttttaaaatttccattcattcccatagtcttacaggcttctctcccctaaaaaccatgaggactctgttcatatctgctcccctgctccactatgatcaaagatattcctctgtatctctgtgtaatactcaaaacaggaaataaagaccccaaaatgaagcctcagtatctcatgtcttccccagtgtcccatccacgtctgaaagagtgaaagctctgttttagaatgactgctggctgccaatgagagctctggatacgttgacatggatgaacgaaaacacactcaaaaaagagcaaaattgtgtggaaacttggaaacatggaaagattcagtcatttaagcatctaagaaacatttagtatgtgtctaccacatgccagccactttgctaagtgctgggtcacaaacacaagcctctggagctcataatatagtggctaacgagacaaatgccatcaaggacagatgagactcttcccagcaatggcaatgcctaaactgaattctgaaggacaaaacagaaattatctaagggaaggcacagagggagaatcagttaatatttgtggatccctaactgcattctcccttgtaagcctggtactaggtatacaaagatgaatatggtacacctcctccccaaaagaagacaaaagacatagtagctattttgaaatttcaaaggagctagccagaagcagcatccgatttttctgggtgaacctgtgggtgatatcaatatggaaggtactaaggcaggagcacactggagagttgattccatgggctctttcagatgttttttccacagacctatagagacgcttttgtaaacaagttcaagtttacgagcattcaaaaatgaatgcatcagagctactagaatttggtgacttttttttttttaacactgtaattacaagaataaagggaaggatgaagctaaaccatattcttatgcccaagcaactcattaacagaggccaagcccaggccaattgcccatgtaatttctttctttctttctttctttttttgagacagagattcactactgtcacccaggctggagtgcaatggcatgatcttggctcactgcaacctctgcctccgggttcaagcgattctcctgcctcagcctcctgagtagctgggattacaggcatctgccattacgcaggctaatttttgtatttttaggggtttcaccatgttggccaggctggtctcgaactcctgacttcaggtgatctgcccgccttggcctcccaaagtgctgggattacaggcgtgagccactgtgcctgtcctgcccatgttatttctacaaacctttatcctcttggtgctttcaggaagttatcagggatggggggcagaggtggcaggggcctataatgtaactgttctgtgctgtacagccaggttcctttccggttgctggtgagaatccaatgtcagctagagttatactggcacgtccatggtcctggaaaggccttggaaaggctgaggcaggcaaatgcttctccacagatgccctaccccacctcgttcattctcttggatgtcagtgctcttctgctaacagaacctatacttcatgccccatttccccgaatcacttctttcctctactcatacagtatccttgatgaagctgagcaccttcgagtgtccgcagtttttgaaagccgtggctgtcttataataacccatcctgacgttcctaggagtatttatattctgagggtgagttaagttagtggataattgtggtaaagaaaggccttgtcagtgcctcctgtagagtcacaccatcaaaccctggggtatgctggggcctgagttctctccagcaaaccccaaaaccagaacttgggttggcactccactttattttccaagttatggatctcagggctggcaaacacaatcctagacaattgattctcaaaggtctcaaatcatctggtgtctaaagggctaatctaggggctcccctgaaagtctcttggtaaatctctccttaaagatttcaaataaaacctgaagcaaacagagcacctgtctagatgataagaggcctgattcatattccattctattgctgacttgtgacacctagaaattcagtcgtagcttttctgtggcatattctatgaagtgagggtataataaccgagattagtttcaggtctaggtctttctattttttttttatttatatatttagagacaggttctcactctgttgcacagactggtgtgcagtggtgtgatcatagctcactgcagccttgaattcctgggctcaaggaatcctcttgcctcagccacctgagttgctagaactacaggtgtgcataaccatgtgcagctaatttttgtgtttttcgtagagacagggtctcactatattgcccaggctggtcttgaactcctggcctcaagcaatcctcctgccttggtatcccttgggcctaagccttcatgctgccatggcatgtcatcagacatggtatttcacgcttgtttcaaccaggaaccagggcaaaggaaaggtctttggtgtcaatgcaatacaaaactttatgttaatttgccattgtggcagttcctaggaaagatcctaagaacttctgggcaaaaggctgaagaaatataatggtttcttgggaattgagggttgaggtaaacatttctaaaatgtgcaaaaaagttaattttgaaaatctgctgctcatttgttataacttcagagtttcaattttaattattttaaaaattccctctaacaagcacactttctgaatgactactgcctcatcatttggcagccaactcttgaaaccttggcactctgagcaataattatgagtatgtcttaatgtgtatccattgagttactgcttgcctgggaagaagctgaaggatgtaagttaaatttttggctctaacactcactagctctttagatttgtaacagctcttgttgaccttcagatactttttctgtaaaaaggggtaaacagaacccaacttgcagggttctagtgaggattgtgttaatgtaagcaaaatggggaactcaaaagttccttttgttgttatacagagaatccagagtaagcaaaaaatagctagttgcagctatgaggccatctgatgagaaatgatgaaaaaccaactccatatgcaccatctcaatctgatccaatcattccataaacttttattgagtgctcagatgccaagttattattttaagttttgtagacagttactatattgaacaggacagacaaagtccctacattcttaggtcttatattctagctgggaaaaacagacaataaatgtatgtaagtaaacaataaactactaagtagtgataagtgttataaaaacaaaatagggtgctatgataggaagtcactgggtgactacggatgacagacctctctgaggtcatgacatttaaactgagatctcaatgacgcgaagaagagagccacaggagggtctctggcaatgaatctctgtgtggtctgtggaacccctgggaatcccgagaccctttcagaatgccagtgaagtcaattttattttcatggtcatactaagatgctgtatgtctttttcacagtgttgacatgagcactgctggtgcaaacgtaatggtgggtaaaactgctggcatctcagcatgaaacaaagcagtggcaccaaactatcagttcttcactaccatatactcaccatagaacagggtgacagtttcacttataaagggacttgatcaagcagtaaaaattattatttgtactaaatctcaacacataacattttaacactctgtgtgacaaaatgagatgtgctcataaagtacttttgctgcaaaccaaagtaagattgtcatcccaaggaaaagcatttgtgggattcagcggcaagctgcacaagtaactgttttcagagaacaccatttttacttgaaagaatgactgacaaactaaggttactcagacttgggcatttgggagacattttcttgaaattgaacaaggtgagtgagctgtcacttcaaggaaaacaactgacagtatttgttgccactgataaaatctaagctttcaaataaaaacgtgatttttggaaaatgtgtatttcctactgtaagcttggcagcttccccaaatttgagaggcttttctgttaagaatgataataacattaataggtgattttttttgaacattaaaatagtgtcatcattttgaagatctgtgtaagctgataaagcaacatgttccaatcatacaaaatcatacttggtaaaagatttgatgtgcaaggcagagtaatgaattttaatataatggagtttgaaaagttcattgatatggctttagattccatattgcaactaacttttaagaagttaccacttgtcaaattttaacgtaatatcgaagaagaacacccacaatatttgaaaaacctattaactctatccttgtccaaatacacatctgtgaggctgaattttttcatataatgaaacaaaaatgacatatcacaagattgaacactaaaagagatattagaatctaaatgtcttctagtatgctggacattaaaggtattggggaaaatacaaaacaatgcaattcttttcacttttatcttgaaaaatatagttttttcataaagatatgttattcatgttaacatgtagtgagcttattactgtgattttaaaattaactaatagatactttaaatgttcagttttaatttctaataaggtaaatatagataaaacccaaataaacgaaagctctttggggttctcggtaatttttttttttttgagatggaatcttgctctgtcgcccagcctggagtgcaatggcgcgatctcggttcactgcaacctccatctcctgggttcaagcgattctctcctgcttcagcctcccaagtagttgggattacaggtgcctactaccatgcccagctaatttttgtagttttagtagagatggggtttcaccatgttggccaggctggtcttgaactcctgacctcaggtgatccatccacctcagcctcccaaagtgctgggattacaggcttttacaggctggtaatttttaagagtataaagggattctgaaaccaaaattttgagaacaattgacctgagcatattaaacaatacaattttagtttatttaggtcttgcataagttctgttagatttgttctgaggtacttaaatttttgttattatcattaataactttttaaacattacttttctgtgttactggtatataaggcaattaatttttattgatatatattgtatattgatcttatatccagtcactgtgctaaactttctcactggacttactcttttacatcagtcttactgttagtacaggactggcaaattatgatcctgtagactagatacagtctaccatgtttttaaaacaacaatttataggaacagagctctatccacccatttacgtattatctatagctgcttttgcactacagtggcagagttgagtagtagtgagagagactatggcccacaaagtcaaaaatatttactatatgcctttttacaaaaaaagtttaccaaaccctgtattatgaactccattcacagaaccaacttttggctctgttgataccctacatagtatttacaatttcaatttaattaattctgttctcatctttattcatccttcctttctcattcgtctttttttttaccttctcaaagttagcttcttaattttcactttttccttttctagtaacaaacctgcacgttcagcacatgtatcccagaacttaaaataaaaaataaaaataagaaaaacacttgagactataaattttcctccaagtacaacttttactgtatcccacaagttgatatatcatattttcattatcattcaattctaagtattttaaattttccattattacatctttgatcaatgaattattttaaaatgttaaaaaatttccacatataaggggaattttggggagtttatgttttagttaccgaattctaattaaattgtattatgatcagataatgtggtcattatactgattcttggaaatctgttgagacttgttttaggggcatagtatgagggcaagttttgtaattcttccatatgaagaacacatatattctatttgtttgatgcaagattctatgaatcaaactattcagttgtactgcttcaatgttatatttctttactaattatttgttatgtgcttgaccaagcaatatcttggagaaacatgaaatttctctatagttttattagtttttgttttacatgttttgatgcaatatagaaatgttatacctttccagtgaattaaaaccttatcaataggtagtgctctctctatcctgatttttttttgccttaaagtcttttatctatctatctatctatttatttttgagacagggtctttctctgttacccaggctggagttcagtggcatgatcttggctcactgcaacctccgtctcctgggttcaagcgattctcatgcctcagcctcccgagcagttgggattacaggtgcaggccagcatgcctggctaatttttcatatttttagtagagacagggtttcgccatgttggccaggctggtcttgaactcctggcctcaagtgatctgcctgcctcagtctcccaaagtgctggggttacaggcatgagccaccacacccagcccttaaagtctattttgactgatatcaacaaagctacatagctcctttttgattggtatttgctcgaatacgaattgttaaatgtgtatttctctaaacactgtatagctgaattggtattatattttttaaaaaatcttaatgtttactctattttttagccagaaagtttaggcaatttacatatattgtgattgctgatatatctgcatttgtttttataatattattttctatttgtcctactttcctatgctttatgtattttttctttcttttttgatttttaaaaatcaggcttagaagttatacactagttcttttcttttagcagttacccttgaaatccaaagttagtagtttaaccccttcagaacaacaaaaggaacttataatgcaaactctgattatctccttcctcatatatagggagttttacacagtattttaaaccagcaatatttgtttagatttgcctacatgtttaccaatttctttgcttacaatttctatttttcagaccttttgctatctcttttcttctttctgaagtatacgctttttttttcttttatttagagacagggttgtactttgtcatccaagctggagtacagtggtgtgatcaaggctcactgcagtcttcaactcctgtgctctagtgattctcccgcctcagcctcctgagtagctaggactacaggtatacaccacccatttggctaatttatttatttatttttgtagagctagggtctcactgtattgtgcagactggtcttgaactggcctcaagcaatcttcctggcttgacctcccaaaatgctgggattacaggtgtgtgtcaccatacccagcctgaagtatattctttcaagttccttcagtgtaagtctgctggtggtaaactcccttaggttttgtacgtctgaagaaaatacttcactctcattttgaaggttatttttgctgaaaacacaattttaagtcgaaaatcattttctctcagaactttgaaaatatttcatcatctcctggatttagtcattgctgttgagaagtctgctgtcagtctaagtattgttcctctgtggatgtggtctgttttccctatggctccttttaagagagctgtcttcagtgattcacagttttactacggtataaaaagttgtgaaggcctttttatttgtctgtttagatacactgcttcctatatctctggatcagtatttctcattgaaaaattctggaatgccggtggggaggagccaagatggccgaataggaacagctccggtctacagctcccagcgtgagcgatgcagaagatgggtgatttctgcatttccaactgaggtaccgggttcatctcactggggagtgccagatagtaggtgcaggacagtgggtgcagcgcaccgtgcacgagccaaagcagggggaggcatcgcctcactcgggaagtgcaaggggtcagggaattcccttttgtagtcaaagaaagcggtgacagacggcacctggaaaatcaggtcacttccaccctaatactgcgcttttcaaatgggcttaaaaaatggcacaccaggagattatatcccgcacgtggctcagagggtcctacgcccatggagtctcactcaccgctagcacagcagtctgagatcaaactgcaaggcggcagcgaggctgggggaggggcgcccaccactgccaagttagttgtttgattaggtaaacaaagcggcagggaagctcgaactgggtggagcccaccacagctcaaggaggcctgcctgcctctgtaggctccacctctgggggcagggcacagacaaacaaaaagacagcagtaacctctgcagacttaaatgtccctctctgacagctttgaagagagtagtggttctcccagcacacagcttgagatctgagaacgggcatactgcctccttaagtgggtccctgacccccgaggagcctaactgggaggcaccccccagtagaggcgggctgacacctcacacagccgggtactcctctgagacaaaacttccagaggaaccatcaggcagcagcatctgtggttcaccaatatctgctgttctgcagccaccgctgctgatacccaggcaaacaaggtctggagtggacctctagcaaactccaacagacctgcagctgagggtcctgtctgttagaaggaaaactaacaaacggaaaggacatccacaccaaaaacccatctgtaagtcaccatcattaaagaccaaaggtagataaaaccacaaagatgtgaaaaaaacagagcagaaaaactggaaactctaaaaatcagagtgcctctcctccttcaaaggaacacagctcctcaccagcaatggaacaaagctggatggagaatgactttgctgagttgagagaagaaggcttcagatgatcaaactactctgagctacaggaggagctttgaaccaatggcaaagaagttaaaagctttgaaaaaaaattagacgaacggataactagaataatcaatgcagagaagtccgtaaaggacccgatggagctgaaaaccaaggcacgagagctacatgtcgaatgcagaagcctcagtagccgattcgatcaactggaagaaagggtatcagtgatggaagacaaaatgaatgaaatgaagcaagaagagaagttcagagaaaaaagaataaaaagaaacgaacaaagccttcaagaaatatgggactatgtgaaaagaccaaatgtacatctgactggtatacctgaaagtgacggggagaatggaaccaagttggaaaacactctgcaggatattatccaggagaacttccccaatgtagcaaggcaggccaacattcagattcaggaaatacagagaacgccacaaagatactcctcgagaagagcaactccaagacacgtaattgtcaagattcaccaaagttgaaatgaaggaaaaaatgttaagggcagccagagagaaaggtcaggttacccacaaagggaagcccaacagactaacagctgatctctcggcagaaactctacaagccagaagagtggggaccaatattcaacattcttaaagaaagaattttcaacccagaatctcatatccagccaaactaagcttcataagtgaaggagaaataaaatactttacagacaagcaaatgctgagagattttgtcaccaccaggcctgccctaaaagagctcctgcaggaagcactaaacatggaaaggaacaactggtaccagccactgcaaaaacataccaaattgtaaagaccatcaaggctaggaagaaactgcatcaactaaccagcaaaagaaccagctaacatcataatgacaggatcaaattcacacataacaatattaactttaaatgtaaatgggctaaatgctccaattaaaagacacagactggcaaattggataaagagtcaagacctatcagtgtgctgtattcaggaaacccatctcacgtgcagagacacacataggctccaaataaagggatggaggaagatctaccaagcaaatggaaaacaaaaaaaggcaggggttgcaatcctagtctctgataaaacagactttaaacaaacaaagatcaaaagagacaaagaaggccattacataatggtaaagggatcaattcaacaagaagagctaactatcctaaatatatatgcacccaatacagcagcacccagattcataaagcaagtcctgagtgacctacaaagagacttagactcccacacaataataatgggagactttaacatcccactgtcaacatcagacagatcaacgagacagaaagttaacaaggatacccaggaattgaactcagctctgcaccaagcggacctaatagacatctacagaactctccaccccaaatcaacagaatatacattcttttcagcaccacaccacacctactccaaaattgaccacatagttggaagtaaagcactcctcagcaaatgtagaagaacagaaattataacaaactgtctctcagaccacagtgcaatcaaactagaaatcaggattaagaaactcactcaaaactgctcaactacatggaaactgaacaacctgctcctgaatgactactgggtaaataatgaaatgaaggcagaaataaagatgttctttgaaatcaacgaggacaaagacacaacataccagaatcgctgggacacattcaaagcagtgtgtagagggaaatttatagcactaaatgcccacaagagaaagcaggagagatctaaaattgacaccctaacgtcacaattaaaagaactagaaaagcaagagcaaacacattcaaaagctagcagaaggcaagaaataaccgagatcagagcagaactgaaggaaatagagacacaaaaaacccttcaaaaaatgaatgaatccaggagctggttttttgaaaagatcaacaacattgatagactgctagcaagactaatcaagaagaaaagagagaagaatcaaatagacgcaataaaaaatcataaaggggatatcaccaccaatcccacagaaatacaaactaccatcagagaatatgataaacacctctacgcaaataaactagaaaatctagaagaaacggataaattcctcgacacatacatcctcccaagactaaaccaggaacaagttgaatctctgaatagaccaataacaggagctgaaattgaggcaataatcaatagcttacgaaccaaaaaaagtccaggaaccaggtggattcacagccgaattctaccagaggtacaaagaggagctggtaccattccttctgaaactattccaatcaacagaaaaagagggaatcctccctaactcattttatgaggccagcatcatcctgacaccaaagcctggcagagacacaacaaaaaaagagaattttagaccaatatccttgatgaacattgatgcaaaaatcctcaagaaaatactggcaaactgaatccagcagcacatcaaaaagcttatccaccatgatcaagtgggcttcatccctgggatgcaaggctggttcaacatacacaaatcagtaaacgtaatccaacatataaacagaaccaaagacaaaaatcacgattatctcaatagatgcagaaaaggcctttgacaaaattcaacaatgcttcatgctaaaaactctcaataaattagggattgatgggacgtatctcaaaataataagagctatctatgacaaacccacagccaatatcatactgaatgggcaaaaactggaagcattccctttgaaaactggcacaagacagggatgcccgttctcaccactcctattcaacatagtgttggaagttctggccagggcaattaggcaggagaaggaaataaagggtattcaattaggaaaagaggaagtcaaattgtccctctttgcagatgacatgactgtatatctagaaaaccccactgtctcagcacaaaatctccttaagctgataagcaacttcagcaaagtctcaggatacaaaatcaatgtacaaaatccacaagcattcttatacaccaataacagacaaacagagagccaaatcatgagtgaactcccattcacaattgcttcaaagagaataaaatacctgggaatccaacttacaagggatatgaaggagctcttcaaggagaactacaaaccactgctcagtgaaataaaagaggatataaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttcaagttcatatggaaccaaaaaagagcccgcatcgccaagtcaatcctaagccaaaagaacaaagctggaggcatcacactagctgacttcaaactatactacaaggctacagtaaccaaaacagcatggtactggtaccaagacagacatatagatcaatggaacagaacagagtcctcagaaataatgccgcatatctacaactatctgatctttgacaaacctgacaaaaacaagaaatggggaaaggattccctatttaataaatggtgctgggaaaactggttagccatatgtagaaagctgaaactggatcccttccttacaccttatacaaaaattaattcaagatggattaaagacttaaatgttagacctaaaaccataaaaaccctagaagaaaacttaggcattaccattcaggacacaggcatgggcaaggacttcatgtctgaaacaccaaaagcaatggcaacaaaagacaaaattgacaaatgggatctaattaaactaaagagcttctgcacagcaaaagaaactaccatcagagtgaacaggcaacctacagaacgggagaaaagttttgcaagctactcatctgacaaagggctaatatccagaatctacaatgaactccaacaaatttacaagaaaaaaacaaacaaccccatcaacaagtgggcaaaggatatgaacagacacttctcaaaagaagacatttatgcagccaaaagacacacgaaaaaatgctcatcatcactggccatcagaggaatacaaatcaaaaccacaaggagataccatctcaaaccagttagaatggcgatcattaaaaagtcaggaaacaacaggtgctggagaggatgtggagaaataggaacacttttacactgttggtaggactgtaaactagttcaaccattgtggaagtcagtgtggtgattcctcagggatctaggactagaaataccatttgacccagccatcccattactgggtatatacccaaaggattataaatcatgctgctataaagacacatgcacacgtatgtttattgcagcactattcacaatagcaaagacttggtaccaacccaaatgtccaacaatgatagactggattaagaaaatgtggcacatatacaccatggaatactatgcagccataaaaaatgatgagttcatgtcctttgtagggacatggatcaagttggaaaccattattctcagcaaactatcacaaggacaaaaaaccaaacaccgcatgttctcactcataggtgggaatggaacaatgagaacacatggacacaggaaggggaacaacacacaccagggactgttgtggggtggggggaggggggagggatagcattaggagatatacctaatgctaaatgacgagttaatgggtgcagcacaccaacatggcacatgtatacgtatgtaacgaagctgcacgtcgtgcacatgtaccctaaaacttaaagtataataacagtaaaaaaaaaaacaaagaaaacaaacaaacaaaaaacacaaaagataaaactcttcacttaaaaaaaaagaaaaattctgagccacaatctctttaaacattgtctcatctccattctgcatatttttgttgcctttcacgctctaaataggctttagttaggcttgcttattctgccctccaaacttattaacctctcttccttatagttccatctctttgtctgtgctccattgcatgaaactattttagttttattttccagttcattaattagtccattacaaaaaagcttatccactaaattttttgataatttttttttattactgaaggttttctttagctctttttcagaagtgcctggtgattgtgagagaccattgttgttcaccattcaccatttttgtagtctatatttaagttaatttttctttatataaggtagtctagtttcttcttatctgatacttcaaacatctaaagcccttggtggggaaggagtaattaatatattaacgctagttttgctgattttcactcacggtggtttgtttccttgtttgataatcttttttgaaagctcaagatcccaatctgtgaaaaaaaactagaagcctaaattacatttgctttatctggaatttagtggtactaccaacctgggctattttatctcccttctagaatcccaggcttaaactgggagttgcagtacggtccccatttgcacccccacatgaccgtcacacacaaacacaagggatggccaattctgccttttctggcttgtttactgttgacatatatgcacttagctacttgtattttttttcttagatattttcattacttcctaggagttctaaaatgcaacagagatatcctttggagtacaaagtctgttatactggcagaagaagaggtcctctttaaaagtttttagaaagtaggagagtgacatctgattgttgcttttgaagagctttttctagattctctgtaagaatgaactgcagggaggcaggaatgaaagcagagccaggtaggaggctaatgtagtagttcaggtgagaaattgaagcaacatgtctgagagaagtagcagaggagacagaaagaggtgaaatgactcgatatctgattgggcataaaacaggaggagcttttgatagtttggatgtggaaggtgaggtacaggatccctggttgatggctggtggtgtcatttcatttattgagataagaataattgggagatggacagtttccagtgtttgtgtaggttagggcgtgggtagaaattaagagttctgttttgaatatgttaagtttgaaatgattatcaaacatccaagtggacatgtcaagtaccctgttgggtatctaagtctgatatttaggggagagagctgggctgaagatataaattggggagttgctgccataaaggtttgggagcagaggagataacaagtgagagtgcagagagaaaacatagggacagactgagcctcagggcacaccaattcagaaactaacagaggaggagacagcagtggtgattgagaaggaaaaaaaaatccacgagaggagctgtcatggaggctcagagaaaagtgggttccaggaagaagggagtgattgactgtgctggaagctattgagaagctgaggaagatgcggcaacaaggtggtcattggtagctttgatctgaacagttctggtgaagcagtggtgtcagagactttaatggagtgtgtcaaggataacaggagatgagtctagataatacctatagacaagaagttcgaagtgttttgtgtgaaagggagcagtaaagtggagtagaagctaaaggagaatgtgacacaagaagttttttcctggggcagtattaaagattttatatgccaatgggaaagatttagtacaaagggagaaactgatcatgcaggaaagaaagggaatattttcagggaaaatactcttcaaagattaagcacccacaagtctttaagaggtgacgtggaacatgtgtgtggcgtgagccatcatatgacctacaagacagaagggctaggacacctatattacataaggacttgggagctgagtaatctttatttgccaagttctcatgaggtctactccaccctagcttcaaatttacccatgtcacaacggctagtggtagaagctaaagaatatatctgataattatgatctgaaagttgtttgggtagttataaaagtaggtgattaactcaatatacagctaaagaggtcttagaggacttctagtttggtctcgtatccactttaggcaactgaatcctaaaggtcttagaatggacacctcactatcccttgggaattacttctaggatgctgtcacaatgccacgtatttagcacaaatagcaatttcctcttgttttgtgattaatggtcataggatacagctgaactgtaattttcttcacccaaagacctttatgtatttgaaattagaaattaactttactttttcttctctaagccaaacaacctctttctcttgattttcctttacagatcttatcttgtatcatttggctaatcttgcctctttcccttctctccaactgttttttttttttccctaaagtgtagtgaccagcaattgacaaactactcaaacaaagtctgaataatcctgagagcagtgtgggtatttcaacacgtctcctttagacagatgaaaggctgacctggctctgccaagacttgaacacattccagttcctgctgatctgagaagtctcttccacttgcgtttttcttcttttacctggcaatttgaataaaatgaaaatacaaccagatgtatagggaaaagagtttttagtgtacctattctttaaaatcagcttgagctttatgtaaaagtcaaaatgtgcacataccaattccttctaaaatgtaacaaatatctgaatataccaataaaatgttttgtctctcaactgcatattccacaaagtatttcttaaaatccaaaagcaagtattcagatgaggtaattaattaagtgaagtgttgggtttggaaagccttctactattttgaggctaatgatggttgagaaactcctatgggggtgtgtgtgtgacagagattctgcctgctaattacttcccaagaaaaatctaagcatccaacaatcattctaatttttcctaagaagcatgaaatatcacatcacattacattatgttatgccaagtaacaggatgttcttggggtaaacatgacaaaacaatacagctggaaaaaacaaattgaaaggccaaatgatgtgcatataattttgggtaggtagtgctataaaaagaaagaaaaaggtgcacactgataataagacttagaggtgacttacaggttttgatacccacaggtgattttaggaaggcagctttgttttaaccataagattaatgccataagctttggctcttttacttatatttgtttcactctgaacaagcattggagcccttttgaacttcaattttttcctctgtaaaatgggaatactactacccaccctacctctttcatatggctgttgtgagattctaatgcctggcatatttaggtgttttataaatgtctaattggataccgatagatatctgaactggatttaatattctgtatgtcacagattccagtctgtacattttttcatctaatgatatttcagaaataaggatatatcttatagttggtggcttatattttaattaactctttctttcttggtggtacataatatatttaaaccaatggcctcttagaaatatggcaaatgaaagagttgggaaatggcaaaagtgctatgcaaatatcagttatttattcataaaacgaaattttaccaaaagtctcccttatgcaaggcattcagaagaaaatgaaaatgaataagattgggtccttaatctccagaagagtgcaatgcacgaagtggatgactcaggataactcaaatgctaaacagaatgtgatatgtgccatttgagtagcattcacaacttggcaccttgtgaatgcagaagaggaaataactttcagtagggtcaaccaaggaagcagcatggagggggtggcacctggcctggccttgacagatgcgtagtatctcaacaggcacatatgggaaggggagataccctacgcagaaaggacaagtgaggcatggacataggatgcacagcaaatattctgaggaatatggtccagacaagaagcggtccagacaagaaggagcatggggaccatgatgggctgcttgctctaggatattagagatctgggctcaatttggtgaatgggttaggctcctgagcaaggagcagcctgatgaaagtggggcattaggagcctgtacagggggaccagttaagaagaggctggaagcaggggcatcctaaagcaggccttgtgcaggcttgaaaagtccagctaataagtgggtagtaggggtagacaggaaataacaaatggatggtagagccatagttaaacgctaaagatccttaatgagaatcctagagagaaagcccattccacaaatggatagaaaggatgcactgaattgatgtttgactgtgtgctccttgaggatgggaactgcatgctttgtacatcattgtatcccagcacctggtacatggtacttacacaataactatttaatatactcccttcctccaaaaattccatttatatttttaattcaattcagcaagcatgtacctatcacgtgcttgatgctggacactggggtcgggaagaatgggctgatgtggtggactgtttttcaaatggctgcaagaattccttccttacagagtcttgggtggtccctccaaagctgactcggggcttagccataggacttgcttttaccaaaggcataacagaaaacgtaaggtaagcagaaacttggagaaaaaaaaaaaagcctatacattgataaactaacgagttccagtctggacaggttgaatatgaaatccttgaggcatgtccagcaggcagtttggtgtaaagcagtaggtcctgctgccaccccaccccctgccgcccccactttttttttttttttttttttttttttttacccctgagggcatcatataaagaattccaggctagcctcctggaggatgagagaacatgtggaacagagatgagtcatcccaggggaggcctccccagaccaaccatcctagaatggggggtaacaacctttttcttaaaggaccagcaggaaatactttaggcctgtgggccatatgatcatctccattccaaatactcagctctgctgttgtagtgcagaagcagccatagacgatatgggagtggctgtgttccaataaaaccctatttataaaaacaggtggcaggcctgtgggctatggttcgcctacctctatcccagattattcagccccagtcgagccagtccaaactagaagaactgcccagccaactcacagaatcgtgagaaatagtaaatgcttgttgttttaagccactaaatttggaagtgttgttacacagctaatgctaactgatgaaaatggtataaaacacataaagcatacaccctgtttcaaggcacttaaaatccacctgtggaagcacgacacgtgtgggaaacatttaaataaccatagaaggcagtatgtgactaaatgtcaaaatgaatgatgcaggagaattagaattataaggatttataaaagggaaaaatcagtttggacacacaaaaaacttgggcagcatttcataaagaatgggtagaatatgacagttccctaaagattcctgtttccttttcactgcccttctttatgctgcctacttttatgtctatgtaccccagcagactgggagcctcctgagggaaggtcttattttctattttctaggttcccagagtccagtgcagtgcttggttcacagccaggctcagtatgtacttactgaagaaaccaataagtccacaggtggagaggagaaagagcatctatgtggaaaaaccaaacctcatgatcaaagaacactgcacaggaattcacgtggtgcattcaagagaggtgaccagtggctcagggagaagaatgagattggggtaagtagaagctatagctggccatgtgactctgggtcatggggtgggggtgatgaggcaaaatgaaggacactgactttcagggatttgaagctatatgttactggaatatgtgacctagctgacatttatgaagataagtttggtggcagacggtagggtggattccaggcaaggagaatagttaggacaatttactaatccaggaacgagggagcaactagcctgggagatggtgggaatatcaaggtgtcagctcctgataaacaccaaatagagctgatcatgtgcttcagcataaactacaaaagaaaagagagacatctcaggcattccttcatgccacctttactgagtacaaggtattattaagtcatgtgttctgagcccatgaagacactaagtagatctatgttacatttggaaccaagatacataaggtcaaggccaccactatactcatggagaagcacaagacaaccaggaattgtgagtgaggcaactgctagaatgggcagggcacaaggtttgcagtgacacacacagccttagagccgggctccattcttattagctgtgcgatgttggacagaccatgaacaccactgatgatggtattcatcttgcaggctggttgagaattatagaaaggatgggtgacgtgcatagcacagtccctgaatagagcaggcactcgtatgattcacaattacaataaaagcaacatgtaatagggaacacatgaatggtataatctgagtgctgtaatagggcagagaaagaaaaatcacttttggctgggacagtcactttggatttgagagtgagaatagcatgtggtctggtggcaaaaaatgaggacgattttgacaagtaggggaaggggaaggtcgttccaggaaaagaaaacgttctgtggaagggaacagagataaaagacggagcccctcttgtggagtgtggtggaatttagtttggctgttgcaaggtggaaggtgaggctgggaagcaggttagggtcagacagcagagtggcttgaatgccaggaaggggagctgggatgttacgcagtaagtagtgaggtgctgctgaaggatcctgagtgggccagtgacacgatcaaaccccaggtggcactgtgagtggtgtggaggcaggagacactcatgcaaggagggcaggaacaaggtgaggcatgccccttccagggattggccacagcaacggcaggagagggcatgtgagagaggatgcagaggacgagctggccacattgggaaacagtgaaggtcgggaaggagagggtggaggtgaagttcactatgaaatgagaacatagactgactggttgactcattggttcattcagttaagctgccattgagctttgtttgttatgtgctcaacacttctaaatggtggtaatcggctgtgcacaagacatggttgcttctccccaggccagggagtgtcaccaaacacacacgttctttctaaaagactatgcatgcagtgtggtcacagtgtatttatcattgtagctagtccccagagtataccacaggacttgacatatactagatgctcaatgtttattaaactcattcattcactcaacaaatatttattaagcacccattccatgttgggcatagttctaggcaatggggatatatcagtgaatataacaaatatttctgaggttccttgagatctctgtgcattcagtttacacccaaagcataaacaaaatcactgcacttattctaattatgttgtagaattgaagtcagcatttctttgtattttttcctccagagttaaaagatacttattgtgaaagtatcaaacatcccattatggaattaagttcagagcttttaaaaaattgtggtattgattttgagattgaaattaaacatgacatggtacagaatatattcactcaagcaaccatttaggaagacctaatttgtaagctcatctcaggcaccactgagtacagtagtgatgaatcagaaaatccctgtcctcaaaggtctttatattttacaataaaagtccttacatagttagcaccttggttttcaaagtgcttttgcatatgtctcttctcatgtgaatgtcaggacaatgcgggggtgtacacaaggcaagcatttctcttcctgtacctcccatggagacgctgaggcccagggctgctggtgagtcataagctgacccaagagtcaagagccatgctctttccagtagtcagtggctcccagagaaacaccatgctccataaaaggtggggagaaacaggttgttgttgttttttttttttgttttcttggaagggaagaaattcagttttctgacctaaaaattagaaatgactggagcggtaaagttattctgctaagtaaaaagcaacatagctgagtgggagaaaaaccagaagaaattcaacatgttctaagggatgcacctggagagtgtgtggcttctgttctgacttttatatggacaaggataattagcatcgttttcctgtaaactgtattcaaatttccacatgcagcaatgctcccctggattcgcgccgtaatcattacatcacacttacagcatgtaccagtttacaccccggcactaagtaaaatacaatttcctttcttcctttgattattttgccttccttccttctttgcttccctctgtctttctgcttttactgttactcccacatttactgaactagatctcataaggattcctgggcatccacagatgaatgagccacagttcctgatgcttgagtagcagactaggatgggaggaagcctgaagacgggatcctatcattcacttcagtatctgccccacagtccgctgctgggtctgagacaaggacttggttcctgaacactgagtggatggatggaaggatggatgagatgcctgtatccggatggcagtgttccaatttctgactcagtaaaacagttgaaatttatcctccccttcccgttgctttttctgtttcagcaaccccctttcaatgagagaggatgtgaacaagagaatcaaattggcattctgaagctctttatttaaaggcacgtatttagcaatttgctatgtctgagttaatatatgggttaagttccctgtgaatgacactctcctaactttagcaacgtcataaagacaatcagttgctgtgtgtctggcaagttaatgactacaagcccaagggatgcaagaatgggaaaatgttaacgtagaaaaaaagactttaagcaaattcagaggaaaatggaaaaggactcaccactccctccccaaaatgctacacataacatcttgttttgaacaaggaagttatggagaatattattctaaactttgtattcattagaacaatcctttacagaatgcagacaagaaggcgattagggaaattagtaggagataaagaagaaaagagttttaggaaaagatggaagcagaggaggaaggaagaagaaaaagcagagaagaagactccatgctaaggtgacagggaagcaggagaggaatgtgagcatgaggtcaggtctgggggcaggtaaaagagaaccttcggagaacttgactggcagaggtgggtgagaaaggacactcctctcctgtcttcctcagctccagagggtggaatgaggctgacaacacgatcattgtggcagttactctgctgggggcttttatatataacattttatttaatcatccagttcaaagccacctgcaaggaaggaaattatgtccattgtactggtgacaaaactgagtttagaggttgttggtcaaggagcaggggttctggacaagcacccacctacggacagcacactgccatccacaaaggactccttcatcttccttaaacctcaggcaattctgtgaagtgaacaatatcatttccattttgcatggcaagaaatgcaggctttgagggagccactcgcacagctagcaagagaccaggaagcacatggactgggacttgatccagtgctccttctgtttcactaaacagcctccttgaggaagtagctggttcccttcttttcaccccatcctcagctttatcctgtagcctgtggccagatgagtgctgagtaccaggccaagcagacacagcatggcggttggggttgatgtcccacggtcctcctgactgtaattctgcatggagtgaggactctgattctttaaaatcttagggctatctggttcgtgctcccacacagtgcagcagtcttgtctacagcagcccccaaacatagcctaaaaagacaatgactctcattccagtagcagaggttcactgttactaaatgaagccacaggttccactgtgggctagctgtatctggaagaaaattcttgttttgagcccaaatctctttctctataatttcttttagttctgcttttgctagaataacaaatgtctttcagatatctaaatgcagcttttgtgtctccccttgtttttctcttctccaggctaacctttctctgttccttcaaccactggttacaagacagtctctgacaccctctccattcctcatgctgtgttcataaagcactcaagtttgtttgttttccttttctttcctttgttttttgtttgtttttttggggggaagtcagagtcttgctctgtcacccatgctgcagtgcaatgacatgatcatagctcactgcagcctccaactcctggtctcaagcaatcccaccgtcttggctgcccaaagcattggaattacaggcaagagccaccacgtccagtttatgttccttttcaaatgtactggtataatactcctaatgtgatctaagtactgcagagtctaatgaaatcatgactcttccttctgtgggcatgagacctcttttgtcacagttaggataatgttaactttttcagcagccactttgtggaggagaaagctaagtcaccaagctcttgcagtacagcataataagttctgcgaaggaggcagccagtgggctatggcatcacagaggagggacagcaaattttgccagaaaggaacaaagaagccttcttggagatgacacttgaagaacaactcaaagtgagagtaaaccaggtggagagagtggaaggtctttccaggcagatggaaaagattttacaaagatgagctggtgtgagagaacatggcagtacagccttttcttccccattgcttctcttttcaattcctttcttcagcctttctctgacttagcttcactttcggatgttcttttcagttaaggcttgggaagacccttgcataacacaggggttggggcgccgatccccgacgcagtcgaaaatctacatatcacttctgactcttccaaaacttaatagccggctgttggctgaaagcctcactgataacataaatagtccattaacacatattttgtatgttatatgtattatatacctgcaataaagtgagctggaaaaaacaaaatgttattaagaaaatcataagagaaaatacatttcctaagtgagagtggatcatcataaagggcttcatcctcacggtattcacattgagcagactgaggaggaggaagaagagggattggtcttgctgtctcaggggtggcagaggcagaaggggtggaggaggtggaagggaggcagaagaggcaggtacactcagtgtaacttctatcgagaaaaaaatccacgtatatgtggacccacgcacttcaaacctgtgttgtttaagggttaattgtactatgttctcctgttttaagaagtatctgttgcatggagttgaaagttcttcaacttgtttactgtattaagtgagcatcaaatagccaaagcactggcaatgttactataataagtagttttggaggttgtgcctctacttgagtgaactgtttgattaggttagaaaagcaaatggtaccctaagtatcaaaaggcagccaaaggtcactcagggccacaggctggaccacagtgctccagggtctttgccccattatgagctgatctgtttttcccttcaatgcctccagccagcagtgttgaaatgagatattttaggatttccaaactatttctaaggctgttagtcacaaactcttatcaaggcagttttctcaggttggttagcagacaggctcagagcctcacctttgcaggtcaaagctcgagaaaccctccacatgataattcacgcatctgttatttttttacctgtcccttctctgcctttagcttctcagtcatccaaccccgcctctgtgaaaagtgcacaatgactcaaggcttttcttaggcctctgacaggtgaacaaagaaaaacacctttcacaaatccattctatcaagggatagaagaagagagaacagagccttcagtaaagaaccctaaacatcccaccagaaagtcccaaacaaccctgaaaagtgagaataaaactaccaaaagctgacagagggtaacaagcattatttccaacccacacttgtccttctaaaaaaaaccaacccgctactgaaaaaacccctgaaatgtatgaaatctaacatcgttaacatatttcctgtcctcacatagcttataaaaatgtttctgagcttttccctggctcatttacaacgatgagaaggagcaaaaaggaaatgcaacagatggtactgagggaggaggtactaccatcctcgctcacagtcatccatcttcgcagtaagttatccccgcttgggcgaggtttcaaacgtttttcagatgtaccaatggcgtattcttgctcgagaacaatgaagatgaggctcctttaaaaagcttcaggttagaaggcatgtttactactgtctatttttgttgtttctaaaagagatcacctcagctttccctctgaacctccccaaactgactctgcgagaatctaatctggtactgatttagagctgacaggtggtacatgcataattaaagatgacctaacacagaatgctctcattcctggcatattatcagacacttaaggaaagcaattatcagtaggcaatcttttctgtcaacagagatcgagatgaaacatttcttcaattaagagaattctgcaaggatgctgtacatatccatctgcaaatacttgaaaacctttagaggttaatactaagtcagctcaatgaaacacctttggccagttaacacatgctctcctctcctcccacttttcctgggaggtcacatttcaaacatcaaaatcggaacaattttaaggtgctgccagacaccctgacatgagcggacaaggaaatctctgcatttttctgccttgctgaggtctgaaaatataacaagttttccttaaaggttcaaagcaaaaaaggatagggttcacattaaagcaaattcaattaaaatttcccttcagagcaggattattccctctccatgctccacccatgtcagaagtatttagagaattattatcaagccttaaaacttcgtcttgaatctaagtgatttaaaggatttttttctttcattttgaagaaatcaatattactcaaagaaaaaagggacttgacaaaaacggaggaatttcccatttcaggtgaaggagggaagaggtgccgcatttcctgatagaatactgtgctttttataaattatagtgcatgcactttgtataaatgaatgcatttaagctttccttagaacagaaattgctttaatgttatagtgagacaagtgattttcttttcttttttaaaagggtagtttataagttaatggttttttgaagcccatgtaaaaactgccttccacaagacagagaacttcacaatgtttgtggtgcatattttgccacatttcacaagaggtcttattgtttaaattcttatagccttatgtcatatgtgaacaaatgactttattgttcatttgaacatgtctttataggatctctggtggtagagctagtgttgttgtttgcatttttcccctcaacaagccagaacaaaagtctcttttactgaagcgctgggaactcagggacgatggcagtgtggcagcagttgtcagttggaaacaccataatgataatgtaagtgaagtgctcacattaaggggttgacttctgacaagtcaaggtctacagaaaagtttccgctacagcagacattatggtaatgcaaaaacagaagtacttaatagaataattaagaatcatccagtacactattactgcagtagggctcaattcctttcgagatatgctttccttggaagagactccattcagaatattaggggaaaaatatcagtagcctttggggagaacataatcagatgggaggtggaagcgatggcgggatcattaatgggagattcagtaggactcaaagctcaagttcattatattccttagaactaagaatagcttctgaatgagtactcacaattctccacagacctatttctcctaaggagctccccctttctccctttccaattttaatctaagaaaaagaatagaatacagacagacatgggtaggtaagcaggaacaaaggaacctctacagaatggaagagaatctaagctagttccgttttagatgttgttaaatccctttgaccaggattcaatttagaacaactcaaaagatacagtttgacagcatgctgcatcaagaggacaggagaaagaaagaagtcacaggtgtaatgttgtggcaaacaacaaaatgttatttcccagtgcatgtcatggacgaaaagaacatataagatataaggcacatactaccattaaagtaaacagaatacaaaaaggaaagattttagtgagtttatgtagggagagaccctcatttctcacacaactcagagtccctgacttttgtaggacttcagtgaataaagcaaagtctgtaagcacagcctttctatgctgaggatgatatatggcacaaaaacattttacatgatgccttttacacttagatattattttagaatcataaactaaaagcgtttttaaggtggaggtacccggcataaaatagatgtatcttctttttaaccaaggcttctcctgtccacactcaaacctggctttccaagtgtgttggctttactattttatgattggatgaataaaataagactgttaactatggctacaaaataaattacgataccctgaccccaacagagtattattttggaaagaaaaaaagtcaaatccaagatattattatcgtaactgcaatctacttgtgaccctgtttcagaaaacctgccatttggaagccttatggagacatttttcagaatcttatgtattctctctgttaactgatcagagatacttctcaggtttctttcaccaaggacaaaatatgacatatacttaagaaaggatggatattgtttcaggatctctatccattcaggagaagacacttgctttttagttaaaaaatgactgtgactaattccagagcacctggtattggctttttcaagaatgagcatttgaagtcaaactggaaaatggtgactggcacatctgcaatgatctagatgatggtaagagacgatccagagatggtaagagacagataaacccaaaaaggctggcctcactttgctgcagagggataaaagaaaatagaagaagcgaaaaaaatgatttttctctacaagtcccactctaggaatcacctttgttaactttgagttctttcacaaaatgaaatgttatgtgacaatacaatctgtttcccttagggatggaaggtgatgaggggagaccagtgataggtgagatttaaagacacgtaaaggaagggtggaaaagaaatgcattatgttaccgagcgaatgaggattaaatcttcataatgcatgtcagattctcacaaaaagaaaataaaacaagggcaagcttttactgaacacctaatatcacccagctgtgaataaaagaaaaagaatctcactctgaccaattcatacaaattgactaatacttattcccttatggtccatggtaacccatactccaagcacacatgatgttctttcacatgtacacatttgtaactttctgtaaactaattagcgaaggagaatacaaaataggcaggtataatggaaactagtgaattccatccctgaagctagttgtactgtaatatcttctgcatggtgccaacagccccctttccctttgcttgttccgacacaatgccttcaggtctgtctaagtaatgtaatttactagagtggaattccctcggtaccctgtgcagtacttggtgacagtatcatttatactccaccgtgtcgtggcctgacactgatccatccgccttcatccctcattcagaggagagcatgcaatttcaccttcctccgtgcccttctctggtgtgcacgtacacattcactccactcagccctaattacaaacctgggttaaaatactctcattagatttatatttcacactccaaatgtcaatcttgttgaaaattcccgttttccggaggattcatccattagcaataaactttaaagcattctgtgactgagtgcattaaaccagcaatgcggacatgcacttaaaatacatcattagagaaaatctccattgcaaatactttacactattcaaccaaaggaataatgagccccgcctggccagtaccctcaaactgcacatgaaggataagttaaaactggcagttttgcaggaaggagcacacagtgtatccacaggatgcatttcagaatctgtcattccttatgaaagcgtgggagggaatcacagccagagtctaatttatcaccttctctcacctattatttttacagaaacttcggtctatggcaaagggcaagagggacggcgaagataatggggaatatatgagtgtgtacagggaacagaagctgtatctgcaatgccaggaactttgaaagtcacctagaatgatttgctcggcctgaaaagcattcttccatttcgttaacagagaaaagtggagaaagcagcattgtctggagacactggagaagcgggtatcattttaatacaagacagatttccctggcagagttgacctgagaaatgtctttattccagactgatggttcctaacacaaaaaccaaaaatctgatgagaatactaatatataaattataagtcacaagttgtatctgggacagggatggtaggacagactaagaaaaggaaaatttgaagaggattgaaaaacaacccagcaaaatacaacaattaagaaaactaagccaccactgttttatatctgtcctgtattttaattccttagcttataggtttaattcatcacttcttgtcaggtctcaggtgaggcaaagttaagatacagtcataacttctctttaactttgataaatgaagaaacagcattctaggaaagtcctggaggaggttaaagggagactgatttgaagtctcagcatctaatcctgaaggctaacaaaaaagttatgtccacaattatgactttgtactgtgaaatacacaatacactttataatgcaaaactttggtgggtggaaaaggactctagaaggacaggtatacattgtattaaacagaaaataacttgcaaagcataaaaaataaaaataaaagcaacagcaattgttttctacctgtcagcatctggtcaatctgtcagattgttcagtaaccagaattataacagatgcaatattttctgtggggaattacaccaccatggaagctattgctcctgaagttttgcccatttccacctgaaatatttttttagccttacttgattacaacattagcactctctttcataacgtacaccagcaggtactacaattaacatgcacagatgttagaactgaacatccatgtttaaataaaaaacagggagaaggtaaaaattactgaatatgctcaacacagcactaatcttaaaaggaaagagaggcttacattgtgctaacttaacagcaaaataaaaaaaacaacaatcccccagttggcattagtaacctaagaagaagcaaaccactctataaatgcctgtattcttctgaaacactgaaccagaggctgatcttttgtccatttaattccaaaatttgtactccaagaatagaggagaactcccaaatgctctcaaattctccaacacattttatgatgcaactgcacaaatgacgataacaccaacatcattttgtggagtgctggctttgtgctttatgtacgtcatctcactgaatccccacaaccaccctctcattcaggcaggcagtactacttctgttcccattttcaaataaagacacccaggcctaggagaggttaacagatcaaggtcaacaagtagctaagctaagatttgatccggagtctttttttcctcctaaagctctcaactcattgtaaccactgtgccacactgtctgccacagttggggatgccaaagaaaaatgtgatttgcagtcttcatttttcagaatcttctggaactgccctcttgactcatccattttacaaagctcatcagactgaaaggctcagaacacttgcagacattctcattctttggaaatgccacaaccactcagtcagtggaatgggacagcaccatcaatgggattgcgaaggcacaaatttccctgtgaatgctggcgccgcctctctttggtgtttcttctagccacaaacggacacgttatcacttactgtggttgcattcgactcagcagccagatgcaggggagtttttacttggttaactgtccctccaacatctgtgtctacagaagatactacagggcaggcgtgtgctcatccttgtcccttctccctcctccaaccaaacacacaaaaagttttccaatctctagggcaacaccattaagatatcctttccttgctgtgctatgagtttacaagaaataactttctaacaataagccaagaagatggatgttgtaaaactgcatttcaaataaggcaattcctttttaaaaaagattcaagggtttcacgcttctttcttccttccatcaacacaatttgtttatgtatgagttggatctttcttccttcggaagagaaaagtgctgataaactatcatgtgtagacacacaacgcaaaaacttggttgccttttgctatttaaacagagacaaattatttcccaatataccacttaccagacagatgcaaagatgtgggcaaaccagtcatcagaattaacagagtgattttgcttgcactacatattctgatttgtatgactcttatttttagccatgcacaaagggcaataaatggaaaatcttattctaaccgctactttttctgggccacccacactgccccacctaccacacaacttcaaaatgtaaaaaaacccagaccagggtttgtcctaacaagggatgcaaagtggctaaaatgtgtgacattttttccagttagtgtttgtactttcattttttttttttttctgtctcaggactttcagggaaaacaatgttgacttaccaatgggcattttcaaagactctaagttggtatgtcagtcagtgtacagacaacgtgatccgcaaggcacgggcaccaccctgccgtgaaccacatctcagccaatcttccgcaaagaaatgtacccaaaaacttttctgtaaattcaggaaggtgatccacaccttccacattttgttttgaaacaatgatggtattttaaaagttcttcaaattaacaaaagtgatatcagaaatataaacatttctaaaacagagcgggctgtgaggagtgattttgccaaacttaagtcagtagcacttgacttatatctgcttttagtctgcggtggcaccacgcttaccaaggcacagtatccccttgctatccctttccttctgtgcattttttctttctgtatgccttaaccacacttctccacctgataacctgaagcttatcaagcattaattcacacatggttatcactgtggattgaagcatctgatatttagagataaccatcttgacggcaaataataaaaacaaaattgatgaagaggatatttgccaggggcacagagaagatagagatgagagtctatttttgattactatctttccagacttttaataaaaagttattacagtcccaggataccaattaaaatgcttgttcctctgagccctctgcaaaccacaacagcaaacatatgcaggtaacaattaatatttaaaagtctagttcaacaaaatcatcagaatcattaggaaacaaaaggcgtcaaccctgagaaaggcatctttacctgtgtgcctgctcattatccagaaactagaggaaatgttctttcatcgtctggtagttagcacatgccctgcagagctaacaccgtcttcatgcgcggtactcgagcagctctgatgagatgtctcagaaaatcttttttgggtgatagtccactatcgccagaacttctgacttgtgttgtaaaaacacaggcaattaagtattacacaaagtgggtcatacgccactgagacaaccacaccgcccccaaatcagactccaaatgactgtgctgtgacaaggtaggaggggtctgaacgcagcgaaagcaaaacttttatgtggtgaggagcattttagttttcactggtttaggttagagaaagttaatctcaatgtcaactacaaagccaacaaacttttagtgtgttcttgaatttatatgacaaatgctggctgttcatctaatgggaaattcagatccaatgtcataaacagtctgagggacagtctcaggcttaaatgacatgcccatcactaaacaagtgagcactgtgactcagtgaaggaaggcggccaaatcgaaactaaagataaagaaccaaattctcattatccacattagcatctccttctccaaaggaggatcaaagtactgtataccacttccccacacccgtaaccaaccagggcattcaacacaatcgcagatgctacccaaacacccttcaattgctgtaggaaaaaggtcaaatgtagttacctgaattgagcacattcattcatctgtcactgaagagccacagaaatattaatccaatatacactgagttcctattacatacaaggacacagaggacatgaagggatgctctcaaagtcactgctttcaaggaacttaagaatcctttacacgggatgataaaacctagatataaccaatgtcaaagacagactttttcttttttttttaaacaaacaaaatcccttctagcagctagctgcttactaaatacttcctattctacggacataaagtttgtggattacaattctacatttctcagatgaatcttctaacaattccttaaattttaccttggttttctttcagtgctcaaagcccttcctaaccttggccaagtgttaggattcatcctaacctgaaggcctagtactctccaaagggaagcacagagataccagcacaactcaaggagctataaaatcacaccacagcaatcggaagagatgcatctttaaagggggataaaggatgcaaagttaaaggaaaactctgttcacagcacaagaaggcatatatttgaatgaaattttgttaccaaaattataaaatcagaatttgattggagttcatattgtttggattgtgaatgcggaatgggaagatctggctaactcaacctttcccatttctgccaaattgccttatagtacagtgattactaatttctaaataatcagaacacaatcagttgacctaacaccaaagccatcttgtacataactgaatcttcctttatgattccagaggcccactaggatcttacagggccactcactatcattttgactgacagaaggtagaaatgaaaatactggttgacaggaatttccacctgataaagatactagtgagtccacacagctatctgttcttataagagctgattaatataattagaaggaagaaaaaaaaagtaacaaggagatcactgtcctataagatgacacttaaaggcatcattcctaagtgccaccagcttgtaggatgtaatcagtctagagcactgcttgtaaatttggaattagttaattagtttcttgaaaaaagtctggaaaaatacataaaagtatgagttaacaggtaggttatatttgggcagccagattataggtaatttatctctacctttattcaattttctgctattttataaattatgtagaatacatgtatcactttgataataaggaaaacaaagctacttctgttcagataaaaggaaacaattattttctgattgtggttctgtctagaaatcaagaacacttcatcaataagtttctgacactttctgtcaagaaatcaaggacccagcatactaatctgaactgaactgatgacaagtaaggcacagaatacaggaaaaacatgctagaaataacagattatagcttctaattaagcaccgcaaggactctaaaaatcttgctatcctgcaaagctttgtaaatactgttctggggcagaagagcagaagtgcttttcctcctcatgacgcacagtctgtgcaacttccagctgccacaaggctgcaggcacacactcttacaagatctagctaatgggacatccttggaaaaacatgctgcaatgccctgggttaaatctgggctcacagagaggcatcatttcactagtgacaggtgcatccaaaaaagagcacacaaaccatttcttaaaaatcaacagattggaaactattagaataaattgataaacaatttgtactacaactgatgtcactgggcaggcagctttataataaaacatagattatttggagactcacgactcagagaattatcttttgaaatttttgatttatatattaatgtttacaaccatgctggtaacatcactcctctctgtaccattagcagagaatgaaaattaattttgatgatctcttgagcagaacataatctgaatctgaaatggaatattacaaataatcatatcataggttctttttattttttaaaaagaaacagaattggcttcaaaagtatgccgttggttcccaatgactataggagctaaatacataggttcataaaatgatttcatatattagttttaaaaccagtaatatcacaacttttagagtgcttaacataaacagaacattcaacatttaacctctggcactggaaaggtggtaaaagccaaaacttgcagtttctcgagaaggataaaaatgaatggtatattgttctgtcctcagtcaaaatttttagattattattaaagcatggaaataggtatactaaaacctcagttaattagactatttgaggacaagaatattttttattattttgattttctggttaattgacaactacaaaatgctttttgttgaagtttttccaaagcagtttcttttcctctttataaaacatctaaccattctcaatgattcagcaggtcaatgtcatcagctacaagtatcctccagggtttacaccccacctttactcaaaaccaaagctatcttgttttcttcatcgctgaaaaagggaagtgtggtgtgtgcggtagggtggggtgtgtgggagggaaggggagggggtggggaagtatgaaggttagctaattcagggttctggctagttgggttccaggtagcaaaaccgtcagtaaacacaaattcaatgtctggaaccaggcacatctgattcctgcgaatgatgagacaaggacacaaggagatcccactagggtctgtctttgttggtcttctctactttatgtcattttgtctcggtgactgctggtttgatgctcttctctgtggaaaatgtgtcagtgtgtctatctaaaaattctggtctatgaactcatggggggggaatttattttgattagattccatatccatgccctttcaactcaagcttagggtggatgtcaaagatgaataagcccttactttcctctcccttagacttgctgacctgaattttctcctctacaaaaatctttaattccagtttttttttttttttggtatctcagcggctccccatagcaactgactcagaaacctcttttcctttgccctgttttccaatacctaagtgaaaatcatgaagagtttctttctaagcaggtttggaaagtctggcgtgagaatgagtggactaatttatatatattgtactttaacaaattcattttacctcttttcagttacaccttttccttaagcaaaattatatataatggttctgctatagggcctctgtaacagactatatatatactggtatcttaaggagatagtaggataatttaggatagcagtttgtgaactttttgaaaccatggatccttatagatgactcttcaggaattctaacccctggtcagccctaggggtagagggtaaaggtagtgaagacgacctgaataaagtatggctactgggccccataaaactgttgattgttcttcaaagccaaatttctagaaatgtagaataaaacacaaaagccaaaaaaagtagggtacaatggactaacctagtgagttccatcctgtgtgttcctcacaggactaccggccactcactaacctgtctgtgacttacgggtacaataatacccataagtacagagatttggtgatgggggataaatcttgcttcacttggagaatgtaaaacaggcatcataataatcataggccctacagcgggagaactatctgctgtggatttcctctcacagctttcattttctactgcgctggaatctacgggaagtctgcattccctggttcctgcctccatgtccacctccgctgattaagacctttcagaagccacagtgaggcacacagctctgggactctctctgtgctctgtgcatggactggtttacaaacacccatctggaggaactggagcagccccactgctggagcatgggtggctcacgctttccttcgccccagtgaagcaggtcttctagatgtgtaaatggcattttagtagagaccacagttgtttaaggcaaattcccttgatggcttctgacaactgtgtctttactctgataggaaactcattcctgggactgaagtatataccattcagtggatcccttacctttgttggcttctaaaggctgcccaaagggtaacaggaatgagggaggtgtgagagacataatgatctgttcttcctgcaccctcacaaactgcagcatccctatcaagcactagctagtgattctgcacagcactcttaggaggaaagctttaaaaaattatgtaaaatatatacaacataaaatttaccattttacccattttaagtgtgcatttcggtggcattaaatacattcacattgttgtgcaactgtcatcatcattcatctccggaactctccaatcttcccaaactgatacttaatatccattgaacaacaactttcaatttttccatcctcccatcccctggcaaccaccattctactttctgactctgtaaatctgacagttctaggtatctcatataaatgagatatttaatatttgcctttttgtgtctggattatttcacttagcatcttcagggttcctccatgtcgttagcatgtgtcagaatttcatctttttaaaggctgaataatattccattgtatgtattaatatacaccacattttgtttatccattcacctgtagatggacacctgggttgcatccacctctggctactgtgaataatgctgctatgaacatggttgtacacacatctatctgctcaattccctactttcactttttttggtatatacccagaagtggaattgctggatcacttggtaatcctgtttaattttttttgaggaactgtcgtactgtttagtatttaattttttaaatatatgcactttatcataaagagcagttttaggttcacagtaaaactgaccagaaagtacagaagtttcccacatgccccctgtcgccctctgccccacaagattcagttttataggcaccctactcactcggtgactgaacgctcgtccaaagacatggggagtgatccaggcaggtcctgccagatccagcaggagcctgaagccatgattcacctaaggagtcatgacaacttctttccttcctgacctgtagacaggaaactgactgacagcaaaggtcatcccacaggaacactggatgtgtaaacgtggagatctgcggagtggcagagcaggagagggcgctaaggggcatttgatccaacctccttctttcactttatggtgaagatgtctcataaactgataaccttccttccaggaatgcagtgcagaataaactagtgcttgttggagatggtatatttttgagggtggagtaataataattacatcactcacaactctatcagccctaatcccagccctgttaccctttgggcagcccccagaaggcacctctgggttaattccattatagatcacttttaacacttactggtttttgtcttatttttctgatattgggggttttattttaaacattttaacatatacctactgtacatttaagtctatctccaggatttttgactctattaatgttgaggcaatacatatgttctttctttgcttggcaattgctttattaacagtgattattctcaactccagagagttataataagagaactgtaaatcctaagtgctactctgaatgataacatctaccatatccaagtaaaatgttataaatcacagtgcttatccacagatttaaaatgcccagaaatttctcaaatgtttcctggacagtatcactcatactatttttacactcacatcgactcaatgaaacaaaagaaaaaatgctgtttcaaattcctacagtcaaagctcagaaatatacaatgcatatatctattcacaggtacacatgtacatttgtatgtatgcttacatgtgtccaaatgtacatttgtttagtcaaactcttctacttttttctattaacgtggaataaattgttcttgtcctcagcagttaggcaacgggcctgttcgaaagctaacaccacaacatgatgattcacaaagtttttcagtcttgagaacttagaatctcacaaaacctggacttgctggcttgagttactcattggaggtgtgcttcccttcccatgtgtgtgttttttttttatttttaacttttgtgggtatacagtaggtgtgtatatttgtggagtacatgagatgttttgatacaggcatgcaatatgaaatgagcacgtcatggagaatggggtatccaccccctcaagcatttatcctttgagttacaaacaatccaattacacattttactataaaatgtaagttattattgactatagtcactctactgtactatcaaatagtgggccatattcattctttctatttttttttttttgtacctattaactatcccacctccatgccctgcccccaacccccactacccttcctggcctatggtagctatccctcctactctctatgtccaggagttcaagtgttttgacttttagatcccatgagtaagtgagaacatgtgatgtttgcctttctgtcccacatgtgttttgtaaatcaaatcacatttaagtgtgtgaggggagggataatgctatgatgactcactctgaaagggaacaatgtatttcccaactcaggggaaaaaagattttctcttttgagtgtgtctaaaagcatgatgagcacacctgcaaaaggactgtagctgttgttttagcctaataacagcactattagtcacacttgttgaaaaccaggggcaaagaatggctggtactagcagctctggggtaaagctggcacagaataatggcatcaactgggctggacttccaaatgtgaaggtgctaagtgaaccttaaaactcttttctgagacataagtcagtgtattaagcaaagcattaaatttcttaatttaatgctatttattactcaagtatatacagttttctacctttttcattatttcaagcacatgagttaaagcagtgattctcaaattggggtccctggaccagctgcatcagcctcacttggaaacttcttagaaaagcaaattcctagcctgtaccaaatctactgaatcagaaatctgagcttgaggcccagcaagctgtacttcaacaagccctccaggtgattctgattcaagctgaaatttaagagccactgagttaaggaaccaccaatatacagattccaacctttgctcaatgataactctccagctcctttgttaaaaaaaaaaagtaattcatgtgtgcttgggctatttgttactatcacctaagaaaatatttatcattgtttaattaaggaaaataaaccctggtcaaaacttacatgtaatttttccaggtcctgtgctgccttcgagtcttaggatgcagggaactgggcgaagggagagatgagaaggctctggcaatccattcagacatggaccccaaagttttgtggggcaaccttgtgacaggtcagtgagtgtccacctaattgggaaggaaaagttgtccattagcagatgaaagtatgcatgtgaatgtttccccctctctcctgctatctcgccatactccgttctgcttgttatgatctcacacaactgtctgtgtctctggctgtcggcctcttgaccaatcctcatgaacagaataagacaccatagcccgtggtagaaacgcctgggctctgcctactagaagccctattccttgaggtatctcctttaggtgagcagccctcacgaggggctctcctgaatccaaatgcagcctaggagataggtccatgtccagtaagttatcaccttctatatttcatctcacgttttctgtcagcaaatcagaacaccttggtttaaaagacacatgtggccattgtaaatagaagagatttgggaagcaaatgatttaagaattctgaccgaaatgagatgattccctgatgcctcaaatgtgtttcgttttaaaattaatatttattttttcagataacttaatacatgcttattgtagaacatttgaaacatacagaaaaataaagaaaaaaataaagatcaatggtaaccttgacaccgataaatcactaatgatgttttgttgtatgggtctgaaactccttcaccgaaactcttggggccagatatatttcagaattcagaatttttggattttagagatgcagctaccatttattacattagtatcttgtgagagtatggagcagcaccctataatattaaatattaaacattaaatatttgtgcacaaaaatagatgcatattcttattaagtgggggtaaaatagagcctcacatttgttcaggccaggttttcctaccaaagaagttactaaaaatagaacaaaacaaaaccccttttgatttctgaaaacttttagatttagaattagagataagggattgtgggccagtattcttttcagatacatgcacatactcaaagtattgcttctactttttcattcaattctgaaataaaatgtgagttatatgaatatgagtatttccccaagttattaaaaattattcaaaacatgcttttgaatgttcatgtgtattataccccatagaaatacatcttatgtatttatttccctcatttttggagttgcagattgtttttttctttgttattgtaaataacactttaggggatatttctgaatatcagattgtcttgaatttctgaacattttcttacgcaggttcccagaaaaggaattattgcatgaaagggcataaactttgagagtcttgattttctagaaagattgcaccaatttatattttttttcagcagcatgaatgcctggttaattatgaaccttatcacagacagagaaaaatacacttgctcctcacgcaacttaacaaaattctaatcaatgatgatcaaatgtaagatattttatttttgttttccttacacagaagatagtgaacagcttgctgtttttgacatagcaagagagaaatggagttaattttagtttaccatcaaatgaccctcattaggccagactgagttagatgtggacagtgggggagctgtgacttgtccatggggtctccacatggaaaagcatgtgagagaattcagaaataattcccataatatcgtgagaagaaaaaccactgattatttgtgggttgataattcatcttctagagtagtgaggccttgtattttccttccttctggggttttcctatttcttggacattttgctcttcctcaggatggcatcaaaaagcagaaaaagatgcaaagacaaaatcaaatcagaatagctaataataatggctaacccttatgcatgattacagtgtgtccactccaatgccaggtccttgtatgtattatctcatttaacgccaagtgcattggtaacaaaactggtggctggcaagtttgaaagtatgtgcccactcattggtcctccttattccccaataagtttgtaggaatttgggcttcagaattccaaagatgtattcaagcctagtgtctcattactatgttgactcattgcctagctatatatcacaagcttgatctttccactctttggtcagtaccatctatagcatctaaacgaagcagagaaagtctaagaaaattctagacaatagtaaaccctttgaaagtcctatattgacacggggaaggctatagctctttgagcacaatagagaagtgtgaggtaagagtgttatataacacaaaacaggttatacatggagaaagacatgaagacacagataaaatacacacttgaaaaaagaaacatacaaacacattcttcccaaatgtggctacgaattaggaatgctaaagcaggtcttacagccccaggttcttttagatttatagctttttctaataatctctctttctctttcccctttatgtatatttaaccttacaggataactggtatagagaatgccacaattttcatatgctaataaaagcaaactgaagtgacgtttgtttgttatattaaatgaaataacctcactctttcacttatgtataaactcaaatttctgcacccactaatactataagatggttatggtttgaggagtggggggtgcaaaaaatttcaatcctattttgggagtgatttaaattgatctttcccaacaatcttatctaaaaataaggattgtttctatcaaaatgatcaaaagaccaaagagaagtggaccatttccttcactgtggctttacttcataatttaagcatcattttcctgataattaggtgtcaacgcagatagaatagcttataaatgatttttctttgccacattcaggtatatgcctaagtttctaagcagaccagagctacagggagtgaaaaataaaatggtaatagaagaaataaaccctcaaagagtatactttgttttttccaaagggcctaactgcttcaggggaaatacaaaaaacaaaccaccattaataacgcaaacgattaccagacactccttggatactcaaactgtacaactatcattgcaaagctaattacaaatttggattctctcattttaaaaatatacttcgaagcaacccacttctgtttcaatgctgaaccaaagtctgtgcaattggcacactgtcaaagtaaaaaaaaaaaatatatatatatatatatatatatacacacacacacattgcatcacttgcacttgaacaaagttattactttcaatgtcactaaatcctgaactgcaaaacaccgcaagctaaaagcaagtaatgccacatggtatattatcttacatttacaaaagagtttatagttttccaagccacagagatacagactttcccactcacagtagctttgttatgctgggcaccccactcactgcctcggagcctactacctctcacaggttcttgtggggatcacatgagaatgtatacagaattttttttgcagattataagacatacataaaatattaggtatcttttttttaaactaaacaactttgtgaggcataaagatattaatcgccatttcatagtttggaaaagaacacaagaagatgtaacaaaaaaagtactaagttagaagatctgagttttatttctaaattggctacgaactagctgcctgactctctgggacttgatttcttcagtaaaacaagggggttggatgaaatgactgtaaggtcttttggaagccaatggatctgtgatgtaggacgtggccatggtagtgatgggagtgccttaggaagtaatccctcctggaggccaaggaaccatgaggccaaaggtagcatccatcaatctgaggcctgcagtgctggcgcagagtccttgagcagcccccaactcccagagatgagacagacattaactaactcattttgctggactgaggggaggttggtggaatcctaaaggaatggccagggtgtcttgggcattggaaagaaataccgaagaaacttaggacagcaggtctttattaactggtacaggtattttataactttaacaactggtatagccaagtaagtatataccagctgtcagtcttgctaacagttttactgttgtttgtctatcagtctcaaagagacggccaccactgagggccaaccaccttgcttggctaagttcctacagcatggggggagatgtgtaagagggctctttttggtattatgagtgcacatcagggtcacatgggaatttgactttaaaaagacactaacttaggcctctactaatgctattctactaacactgtttaacacaactttctgtaatgatggaaatattcaatatctctgctgtccaatatggcagccacatgaggatactgagcacttgaaaagtacctagtgagagtgaggaactgaatttttaactttagtcaatttaaatcaactgaaatttaaatagccacatattgttagtggttagctgattggacagtgcagccctaggtggcttcacatattagttttcttggacctatttcagactccagaagcccacaggacaatacccaatatagtccttcaataggtattcactgcccttctcctaggtgctgggccatgtttaggtgtctcagaacaatggtgaataagagtaccatggacacttcctgccttgtggcattttgcggctagattgatttccgaagacctcacaaaatcttgaagtagctcaccagactgctcttaggaaaaggtgggtgaggagatatggtaatgctacactaagcatgaaagcactgctttttcatttcttcgtatttactgttagagaagttgggggaaagtttaaaaagaggtatctgaatggttactattcattctcttacaagtaaagtaacatatcccagatatgggaaattatctgtaggtaactacctcttgcataatcttaaccttacttaaaaagaaaagtccgaggaaccgcattctgaagctaagaaaagtaaatggtattcaattacagcaacagccgtagaaaaagtacaagtgggtctccagctgcaaatggtgggcaagggagtgttcttaccaattagttgtgaaatgatcaggttttctagaaggtactttttgtataagtaaggctgattgaattctttatcccaactcaactcttagctaggattttcttagtggctttaatgggatttgatgaggaaagccccatttgcctgtccccaggaaactacaggtgaaaatatttctatttacattacaaatctaataccaagaacataatttctaagaaacacaaaagtggtttaatgatctgatttccagtgttgctctcaatgtcctcctgttgtcaattctctcctatcctaatcacctcttcctaccttattgggatctggagtgacagaaaaaacacaaaacatgatattcaggtttgaactgaatccaggtttgcctaaacttcaaggacgggacactgcatgttgggatacagaatttttaagctaattctctccattgtattaatattatcactggaggtaaaaaatttaccaaataaaacaatctgattttgctcagcatcccaaggggatcatgttcagcatctcaatgggaatgacaccagtcagccaatctttcgagcttcaccatgccacttctggttcccctgccctaagtcagacttttgatttttagggctaataagtgactcttccacaactatacacacacacacacacacttttttcccctctggattgagtagaaagacaatttaatacaatggttagaaaacaaaataagacttcaaaacttagttctaaaaatacaaattgcatttagataccattatcttctttttaaaaaggtcaaatctcaaacgttcagctggttccaggctatataaaaatattactgaaaatctgatgacagctttggtaacaaacatcttgagagtggccctgaaatccttatttatattcagaaacactaagtggagtagtcgcacgccattttatggctgaaggggttcaaaaggaaagaggtcaattgatgttaattgttaattttttggaaattcagagatgaagttttttttttttttaaactcttatctttcaaacagaatttaaacagacacttgtataaggcagaacccctttgaaccacagatcttgtggcttttgtgttttattctactggcatggaaaggtgatgaaagaaagtgggcttttttgctgcaacagagaaagaagtggggagggagatgcagttatttcagacaggatggcgaacattaattgagattaaacagctctgaaagtttccacttcaacatttcaggttctgggactctagctgaagaaccaaagctagaaaattcacttatttgacattcaaggtgtttaagttcccaaatacaacaaagaggttatcagattttcacttctatcataaaaggatggtgcaggcagaactacttgccactaacaagccagaaaaataaaaagtgtgatagaaatgtgttgaaagtacataatttgaaataattcttggatttctgcagactttatacataaaaattggaatactagcctgtattgatacatcatcaccatcaccatcatcatcatcatcatctccaccaccaccaccactgccgccttcatcatctccatttactgaaaatatctatttgctaggaactgtgctagaaattttacaggaattattagcctctctggtacatgagagaaccctgactcagagaggcaacgtgttttgcttaaggtcatactgctggagacaggacaacatgcaatctgaatccaagctggcctgtcaaggctacctcctttcctgtacaacactgccttcctctacaatgtggggagactacatccttcttctgcgaaggaaacatgaccactttcccatgtgccaccagtaaaacatgaaagtaaactgacaaggctgcaggtcccacagcaatttaactatttgtatgaagagttttagtgctaaaatggttatagttcatgaagcataatttcttacttgttatatatttcagtgtcgtttctgtcccttgactatgcaaagcccttgcctggccttgccacctgcttctctctctgcctagaattccctcccacaacccttagccatgctggttacttctccttcactaggtctagttcaaatatgtcacttgcagagacactgtccttaatgtgctctgtcctctcccaaacagctaggcattgccctgcttgtttccatcaagggataaccaaaatccacatgtttatttactgtataattacctatcttctctcttggtccatgtaagacccacagcagcagggacctagcttctcttgctaaccattgatacctgacacttggaatagtgcctggcacaaacttgaatgaatggctacaccaatacatgaatgaagatcagtgtttgcagagtacagtgacaggtacacatagaggaaccagaggagagacattgccctggggatctgcctttgccagccctcgagtcctaggccagagttcatctgctctcagcttgaaccctgcctggagactgagcatacacctgcacttggcccttggccctcttctcctgctgcacctcctgacatagcctcttcttccccaacagaggctcttcctcacacgatgagctcagcttctctccctggatctaatctctacattcccaccaccatccacctcgtataaaaatcaatcgtgcttacttctcctgtggtcacatacccttcagataatctggggccacggccttgggttccatcacacccataaccatgtggcactgtcagggctgactcctggcttgttgcatgcatccctagtccagcctgacatccagcaccaggctctttcccagccttctgtcctgagccacctcacttctttctcctgtctgccctctcttcccaggtccaagctcatggatgactcttggcaggctggggaagagaaagaatgtggaacagaggagagagaaagtcagaagcagcaaaagctgctgtgtgtccacatgggaagcccgtggactacatctgtccacgagaattttcatagtgttctatagattttttttaaaaatagtgagtttaaactatggatcagcagagctgaaagggaccttggagatcactgagtcccactgtctcactgtactgttgaaaaaccaacatgtgagtaatggaccgaggaggaagaaggcagcatttgtggagggcttaacatctgctttgggatatagggtcccaggtcccatagccagtgagtggcagagtggggaccatgcaatgcttaaatgagcacttctaccccatacacactttgccctacgacttacatattcataccacgtgtgggaaagggtgtggcatttaccacataaagatacttggaattcttgcctcaaagggtaagtgggttttccttctgtattagccgatatactttttaaaaattatggtaaaatatccaaaacgtacaatttaccactttaatcatttttaagtatacggttcagtggcaccaagtacatttgtttcgttgtacagccttcaccactatccatccaatacatttttaaagtgagtattttctaaaactatacatccaaaacaagagtgaaggaaacaaaaaagaagtagaaagaaaagacaggtagaaaataaacttttgggcatgcatttcagctgacaaaaacctttcatacgaattagcttctctgtgacatattcattattttcctagtaatgaaacgggaactgtgagacaccatgtgaaaaggcggcttttattgtttctctaggttctatactagctgtatccgcttacaaaaatgttatacaacccagtacatcacagccttccacgcctcctccataaaaggacaagtaaaatagtatttcttggaaagacaggcatttaccaatgcactgcatctagatggagctgtctccatcattctagtctgtttctaaacagggttttaaagtcttggcacagaacacaaagaatgtcccttagctattcagcatttagttcagctccacaatatatttagcaagatttctttgccccccccgcaacccccacccttcccttcttggtttaatgacctcaaatgtaccaacatcctgtcttacctaatcccctaacaagttctatcaaatgccaggacagaatcagacagcactgcaggctgtgagatcattcactaagaattcatttttattccaaaaattaggagtgccagaccatttaacacaatctatcacacagccagaaaattagcctagcgctttaagagaaacatttaaataacttttaaatatcttcttcctgacatagattctttaaaaacctgaagactctctccccagaaccagacgcatagacacaaaacatttccacatgatagcaagagctcaaggaccctttgaagacgatgtaggccccctaagaatccataaacctcaggttaaaatctcttgtaaaagaactccagtacttctctttgtctacaagcccctgtactggatcctgatccatggagcatccagggtaacttcttctggggccacttttgtctctggatgagaaacgacttgtttcagcttccggaacacccctacgtggcttctggtccaactgactgtcaacacggctaggcctctccccaattcagctggctactctgggaacgttcatttctcttactggtccatgacatgctggctctaccccagtgttaggttttgcttttcaattggcaatcttggatcctgtggtcccttctgtcttcctgtcactttccttgtggtccttgtggaacttttgttttaaaaattaaacctgttttttttttctttatcataaaagcaacggcctcccgtttgcacttaattcctttgttttttctccaaaagcatacttcagccttcatacctttgttcttgggaagactttgcccacctctctaagtggcaggtcgtgccactctctgttcagttcgggacagggtttctcctccaggagaagtgtggggcagtgaattaggaataagcctaaagtcagagagacccaggtctagtcccaacatagctgactttggccaagcaatttgaacaaaggctcagtttcctgatgtgaacaaacaaggaagattaaagccaacatatgcttttgttttattttttttagacagggtcttgctctgtcacccaggctggagtacagtggcgtgatcatagctcactgcatcctcgaactcttgggctcaagcgatcctccggcctcagcctcctgagtagctgggactacaggtgtgtgcccttaaaactggctatgttttttgtttttgttttttaaggaagactaagagagctgatatgttcacagcttctgaaacacagaaggtatctagtaaatggtgatgatcatttcattcccttctaactcttcacatatgggattcagcatacattctatattttagaagcaactcctgctgctttctattaggtggccaggaccacttacgtttggaggcttaggcattttttaacaggtttattgagatataatcagcatatcatacaattcacacctttaaaatatacaattcaatgttttttagtatattcacagagttgtgcgaccatcaccactatctaatatcagaacatttccatcatccaaaaaagaaaacctacacccatagtagttactcttcatttcctttccccttcaacccttggcaaccaccaatctactttctgtctctgtggattttcctattctacacattttgtataaatggaatcatctattatgaggccttttgtgtctagcttctttcactttaccatattttcagggttcacacttgatgtagcaaatgtcaatatttcatccctttttatggctgcataataatcaattatattcatctaccacatcctgtttatccatttatatcagttgatggatatttggattgtttccacattttagctattatgaataatgctgccaagaacatttttgtatggttagacatatttggacatgttttcaatttacttggatatatacctggaagtgaaatcgctaggtaggatggttaattttatgtgttaatttggctaagtcaccataccaagacttgtggtcaaacatgtttgggtgtcgttacaaaggtgttttttagatgagattaacatttacatcagtagtctttgaataaagcagattactcttcatgaggtgggcctcatccaatcagttgaaggccttaagaaaaaaggctgacctctcccaggaagaaggaatactgacagcagactccctttggactctaactgcaacatcgatgcttctctgggtctacagcctgctggcctaccctgcaaattttgaacttgctagtctcctcaatcatgtaagccaattctttaaaataaatctgtccctttcctctctctctctacacacacacacacagacacacacacacacacacacacacagacacacacacacacacacacaccctctattggttctattctctgcagaaccctaactaatatactgggacaaatggtaactctgtatttaacattttgaggaactgttttccaaaatggctgtagcaggacaatcccaccagcaatgtataagggttccaatttctccacatcctcaccaacacttattactgtcttttagactttaaccatcctagtgggggtaaagtggtaactcactataattttgatttgcatttccctaatgaccaatgatgctgaacatcttttcattcacttactggccatttgtatatctttttctgagaaatgcatattttagttgtccattacttgtctgggttgtcttttgagcattgagctgtaagaattctttatatattctggatacacatcctttgtcagatacatgatttgtaagtattttctcccatctgtggaccatcttttcactttcttaatggtttcctttaagcatgaagtttttaattttatgaagtcccatttatctaatttttcttttgtcttttgtacttgtggtgttatatctaagaatccactgcctaacgcaaggtcacaaaaatgtatccctatattttcttctaagagttttagaatttttgcttgcatttatttttgtgatccattttgagttaatttttgtatatggtgtaaggtataagtccaagttcattcttctgtgtgtgaatatcctgttgtcctggcactatatgttgaaaagactgttctttcctcatcaaattgttctggaacccttgttgaaaactttgagcatacgtgtactgtattcaagactacactatcttataggatgttttgaaaaaaggaagtgtgagtcctccaattttgttcctcttttgcaagattgttttagctattctgggtcccttgcatttccatatgaattttaaaatcagcctgtcaatttctgcaaaaatgctgcaattttgatagggattgtgttgactatataggtttggatagttttgccatcttaacaagtcttctgatctatgaacattggatgtctttccatttatttatgtttccttaatttctttctatagtattctgtaattttcagtgttcaagtcttgcacttcttttcttaaatttattcctgaatatttaattatttttgatgctatgtaaatggaattgtttttgtaatttcatttttcttgctagggtacagaaattgatttttgtagactgaactttcatcctgcaaaactgatgatcttattattcattctaataggttttttcgtgtgtggtttattttttcttctaatgaattgcagtcaagtatttttaagtattctgaatcacaggaatatcctggcacaaaaacccatgacttaaaacttcactataaatataaggagctcatactattatttgtccccttcctgtggcattgggtaatgatcctgcttttgggttatggtcttggtggcattcctactgctgctgacagcccatataatgatttgaaaagttcctgggactccaggatacatggtgagacacgaatctattttccatagaagtggtattataaaaagaggtcaggtttccagcctatccctaaagtctgtttaaaggggtatcattcattgaggatgccacagggtctggcctcgccattctcaaagggaatctaaagggtttgtttcaatgaaaaaccacattctaaaggagttttgaatgaacctttcaaaaagtgccctcctgggctgggcgtggtgactcatgcctgtaatcccagcactttgggaggccaaggctggtggatcacttgaggtcaggagttcaagaccagcctggccaacatggtgaaaccctgtctctactaaaaatacaaacaattagctgggcatgatggcgggtgcctgtaatcccagctactcgggaggacgaggcaggagaatcacttgaaccgaggaggcagaggttacagtgagccgagattgcgccattgcactctggcctgggcaacaagagcgaaactccatttcaaataataataataataataataataataataataataataataataataaaaataaaaggaccttccattcagttaggacttcttatgggcttttatgtagacacctctgctaacctacttcttctttccaactcagggctgactcctaatatacaatactttgaggggcagtggtagttaccttgcacaaaaactgctaaatttgacacaatacatatatatatatatatatatatattttttttttttttttttttttaccagactatattttgcttcaggttcaaaaactgatttctagccagcattcagagacctactttgcatcttgatccatgagtcactgatttgagcatgcatttgcccagaatacccaggcatgtgaaaggatcaaaatatcacactttgattgatttagaaagttattttctaccaccatgcagtctgagagtttctatgctgcatctgactaattggggaggtgtgggagcagagagagccaggagctgctgtgtggaagaccttgtccctcctcccaggcaccaagatcccagggagtagcaaccctgctctccatggcgaagtgtgtccgtgtgatgctcatctcagcattatctggttatcggagtcatcttttgaagagatcctggtatttcggtttgacaaaaatcgagaaacaatttagaaagaaaatcggatttgtgtgtaaatgaagaatattcctgaaaagaaactctgttacgaaactgaaatctggagaccgcggtggtgctaagttgagtcatcagttccctttacgccctaataattgacggcactttgatcacgatgactgctctgggtgatgcttttttgtttgctttttaaagtacttccttgtgtaaacaggttgtctcactatcatcttgaaaacatgtttacgtttgggggatcatggggaacatctgttagaaacagatttcatgcttttctgtcaacttagggaagtctgaatcctatttcttggtaatatacaaaagctcttggagagttaaatgaagttctactggaaaaaggactgactggatattttgattgttcttcatatatgtatttacaaatttgtcctgaaaacatccatttgaaatagaaacaggcatgaattattgttcactttttgtagatgcagacaatgaagtgtagagaagtgaagtggcctggtcagtgaccgacaaagtggcaaagagggggccaaatgcatcacagggacatactgacccttaatcagcaccaaataaaatccgcaggtatcaagggtcccctgatattatttccaaaaagatgttacaatccttcacaattttattgagatcactgattctggagaaggcaaatattagggctgagtgatgtatcccccaaaagagcagtttctttgtccaggtctcaagttagagatctaggtgtgtgtggagaggtggggtgttcagagggaacaggaacaaagcttgaaggagaggctgaaccaacaagaggacttcaggcaaaatactttactgaaacctcaacagtgaggctgctcctgctgtgcccagaagcgaggtgctcctcttggagggtgtgccaactcgctctggcccttggagttgaggcaggagcggtttctgtgtgaagagaaagaactgctgtcatgaaaaaatgggagatgctgcagattttatttaaatgcccacagacagcacagcccctagacccaggcaaggaaggactctgttctccttcagttaggccagggaggcattgttccccatcttgccttatgatctctcccttaaactcttccagaatttcccacccaaatggttccaagtgagctcccagggtcagtgtatgccctttccctcggtccttcctccctttggtgggctacaccacctgaagggtgagagaatggccaagggcagctatttacagagatatgcatgtatcttggacatgtgggctggggtgtccatgtgcatgtttcaagacccctgtaggatgggggactgggggagtgggaggagaaggagcaggaaagaaggaagcaggtaggtgtatgctggtttcccccatactaccatgttcccatttggaactctaaggagaccgataattctaaatttaaatctggccttccgaaaggtcattacatcaaggcagaaggacagaatgtattttatacaaccagtttgttagcctgattcataaattttaatatttaagcatacagcatatgagcttcaattgtgcctttgtctggagccctacaaatattacagccagacctgtccagagccatgtggatcagggctgggaaggcttcagattgcagatgtgcagttatgcattacacaagccccatgttgcattcactgaccctctggatgataaagtggaggtggctgcaaggcatttccagaatatcaaggtgctcacacaacaaaggtttccttcacttgttttgggaacactgtgctgaagacagcttagccaaatatttctctgtttggctgcagccaaatacatcagggtcttgctacaggccaactaagcaaaccataatttttacaaaaaataattacctaacactttcatctcttgtggtttctttattccatacatactttgtaatgtgtttatcagcagctagttgaacaacttggtgtaccagtgggagacaaaccagcagtagttatacacggcaagtaaggaccaaaacataggcaggaaaataaaaataccaatgaacattaggctgaactgtaagacataattaagtagctgtatatcaaatgcataaatatgattcttttttaaaggcccacacatattacacccactttcaggagtttcccaaagtaatttaaaactatttgatgttgcttcctgtttttcagtacttttatctgtttatgggggtggcaattctactgctaaccaaatgaacaagaagaaaagtgaaggatggggccattttcctggttttagtcaccaaaatctgctttaaaagactgaatttttagaccttaaattttaaaatttggggttctaagcttcaaagtaattatttaagacttatcccacattacaactacagattgcaccaacagttttcttagagttagtgagcctcttgcatcaactttgtttcctgttctctccaaagctcctttctaaagcaactgagcttcagaagagggaagaaggaaacagggcagaggggtttgctgacctcagtctgcattcaatacatttttctttttctctttgagacaaggactgctaagaaagggccttttcatattttaaagctgaagtttcaaaaaagctagaacaattcaaagatatttattccataaaattatcctcaggtaccaaaagtagctctggaaaagtggccacctctttttatttggccttcatagctcattattttaatcaagtagatggttaatgaaaagcaaacttacactttccatgaagtaaataaagtaatgtgctgaataatgacatttcagttgataatagactgcatatataatggtggtcccatagattctaacatcatatttttactgtaccttttctatgtttagatacacaaatacctcccactgtattacaactgcttatagtattttgtagagtaatatgctgtacaggtttgtggcctaggagcagtagactataccatacagcctagctgtgcagtaggctataccatctaggtttgcattaggtacactctatgatgtttgcacaatgatgagactgcctaatgacgtacttctcagaatgcatcctatcgttaagcaatgaatgactgtgctattatgaggtgacaggcattttggggatcagctagttcaatgtgtcatcaaagtcttgaccaccaagtgggtggcgctgattaaatacctctaatgagaagaaaggtactgccaagtcaattttggaaaattattatgtaccacatcactgcatacatcattacacagttctctctcaggccaatctgcctccttgtagcctaaaaacactggtttgccctacagggcaaccagaggaaggataacacctacatacatggtagggagtaagtggtggctccgcctcctctctttcctcaagtcttctcgctggatagttgtttctagttccttcaaatgttatttgacatggtttcaggttctctatcactgtcttgggccactgtcctttaaaaatatttaagttctaaatttaaaaatcatcatttcaatttaaaatcacattataggccgggtgtggtggctcactcccataatcccagcactttgggaggccgaggcgggtggatcacgaggtcaagagatcaagaccatcctggccaacatcatgaaaccccgtctctactaaaaatacaaaaattagctgggtgtggtggcgtgcgcctgtagtcccagctacttgggggactgaggcaggagaattgcttgaatccaggaagcggaggttgcagtgagctgagatcgtgccactacattccagcctggagacagagcaagactctgtctcaaaaaaaaacaaaaaaacaaaacaaaacaaaaaaaacaccccatgttatagccaacaatacatttgccaatatatctatcaaatgtgatctcaaataaagcacaattttattactgaagagtacatagaactatctttcaccttcttagtcctacaatgcagaccatgatttcattaatgctttgggcagctacatcacatctctggctaggattgagcttacagaaatgaaacccccaaggagtcttcacatattgctattgtgttttatttcccacattctctatttgtgatttttttttttttttttttagtgggggtgtgggatacaactgcaggtcttggcacttattcctattactaaatgtcaactcacttgggtctcgtcccttgttttcttcttctttcttctgtctattcactcggtggcaaaggagcacatgaaagagaactgtgctcaagggaatttctttttatcatggaactgtacaaggcttacaaagcagtgggcagtcagggtgaaaactaactcagtaaacaataccctttaggaattggctcagtgtgtatgctgtgtcaaatcctgcttggtaaattccaagaggaaactctgaataaatatttaccatatctatttatttctcctactgagaactatataagacaagaggatgttaaatgatgaaacagatttcaggatttttgctctccgctgagtcttgcccatggggcgtgaggactgatacaagtcccagtctcataatgaaaccagacacagttcacttccttttgtttcttaaaccaccccctcacctgggagatgtcttgaaatgacacagacttagttatgtatcactaacctgagatctcaagggaatgattggtattaattatcattagtaataataatatttaatataccctcctgggaaggtggacagcatgtgcttgggatggaatacagccctgactaagcttacctgctcaagctgtcaatccctattgtctcaaaaggcgaaaagagacattttaactccagagccatctcctcttccaattgacataataaggagaggtcaagaagaatctagttagagattagtggacgctgcattacacttccatggcttcctactgaaagtgaactaccaaagaaatcacaaagcactttctgtctaattcttcccttcttccttcccagcttgggaaacagcctgagatcagcctgagatcagacagaggatgctacctcacaagctggttatcaggtgggctctttgcttactgcagcccagaggaagagaaccaaatggttggggcagtggagaatgtctatcattgctctagacttaagatagtgaaaaccaaccaacaacccaaatacagaatctacgcccttcttgtcttacatcctctggaactttcttcaattttagctattccccagttaacctttttattgaggacagagggatgacctgccccattcttgggctttctgtttgctctttcccctcctcaggaatcaatcactattcttgagctctggatcccatcccctctctctcacttagagaatctgtttctgaatttaccttcactgtccctgggacatcaatttctctctcctggaccatttccactggcatatcttaaatcccttcttgatgccatcgcttcctccagaaccaatccctttctctgcccctgttctgaaggaagaccctcaaaatagttgtctttacttgctgccattatttcctcatttctctttctttccttaacctgttgtagatttttttttgtcactccagagaaactgcttttatgaaggttagtgatgatctccgtcttgccaagtccatgctcaactctctattctcatcttacaagacttctcaccatcacttgactcagtcgtcaacttcctccatgaaaccacttcttcttgtggcttcaggggcaccacactgtcctggcttctcatcagcttcacctgtggctccctcctctgcagagtcctcctctgctcctcctcctctgctccccatctaaatgctggcgttatcttggagctccatccacggactttctctttcctctaactatactcactcccaggcctgtggtttttgtcacctatatgctgaagtctctcaaatttattatatgttgcccctgacctcttcctgaatttccatatccaatttcctactcagcacctgaacttgtatattcaacatgcatctcaagtataacatggccaaaaaaacaattattgtttccatcctccctccaaacctgcttctttccagtctttttcatcacagctgcttgggacaaatatctgaagatgaatcaaagagaatatatagacttccatctgccctgcctccataatacatcttgaaatgaaccactttcattagctcagtgtttagacatgttggtctgaggactcctttacaaccttaaaaattaataaaatctccaaagagttcttgattatgtgggttatagctattgatatgtgccatattagaaattaaaacaaaactttaaaaaaatagaattcattgtatttgaaatacaataaaacattgtatattaacacaaatcacatattttatgaaaattaatacattttacaaaacataagtgagagaattaacacttttacatttttgcaaatctctctagtatctggcttaacagaggactgctggattctcatatctggtactaccttcaatatgttgctctatggtgttttgatggaaggacatgaagaaaatctagctcacacagatacatagttggaaatgggtgaagtattttcatcatcttttgataactgtggatattctctgattctacaccagaaatcaacaagtggtagcttttaaatgtggagtctgaaatgtggtacctgaaaatctgtcaataaactttttttactttgttaatattaaaatctattggtctatcttgcgctttgaatggatttttcacctgtgcataattttataacattacccatttggtcatttggaaatacttgttcactaagttcggagatctttgagatcttttgaatgtttcacatttcatgatccaataccaaattctccacattcattaatatcaccatcaatctcgtcagaaaaagtccttaatgtattgggaagttatcaagctctacagtagcagctatgtgttttccaaaatcctaatttttgtctcaagctcaaattttgtcattggcaacaaatactgtcagttgtttttcttgaagtatcagggcacttcattcatttttgataaaagatctgtcaaacaaatacccaaattggagtaactagagtttgtctgttagttgttcttttaagtcatattggcattccatgaaaaaagcagccagttcagcttgcgactcaaacaactgcacacgggtttttcctggagataaccagtacactctggtatacggtagaagggcttatgtgtccttcccattttgtcacacagaatattaaaaagacatcactcaagagttgagatttaataaaaacagtaattgttactgcttcatacaggatattctgaagtgaaattggcattctgttctattgtaagcatgtgctggtgaagaactagcagtttggtaccactatcttgtttcgtgctgaggtgccagcagttttccccaccattacatttcactagcagtgcacgtcaatactgcgaaaaagacagacagcatcttggtattactgtgaaaatagttttaaccttgcattccctgataagatcttgcgggcccccaggaacccacagaccacactttgagaactgtggcactagcttgccatcttctgtccaggccaccaccatctctctcccgggcttgcaaaaaagcctccttgatggtctctatgcttttacttttgcctctgtagaagcccttctccacagagcagccagataatcttttaaaaatgtatgtcagatcacatcgctctcctgcttaaaactcccacttcagatgtcccattgctcatagaatagcatctgaggtgcaggcccaagcctgcaaggccctggctgcccctattttctcattcatgcctgtactccttttctttccccttctccagtcacttgacctgtggatctctttaaacctatcctgtgtgctccagcctggaaggctcctcccccaggttttagcaggtagggttctcctcatttaggtctcatctcctgtgttaggcattactcaacctgcccatacacatcttcctatacactgccctcctctggattacatagctccatttattaccctgattgctctcatcgttctctgaaatgatattgttcactaatttgacagctggtttgttgtctgtatttctaaaacagaaagtgagtttccacaagggtaggaatcttgaatcttgtgctatgccatatccttaccatctaagacaatacttggaacacatcaggtgattaattagtatttgctgaatggatgcttctgtgagtgacaatgggtggtaggataccatgcaggaaagctctctgcatactgcaaaatatacacatgtaaggtaagggaaatgatgtgttacaacttgtaattctccgtcactagtacatactttgccatgtcaaatttaagtcatagataacattatcaggctattagtgttaccttcttgactatttttctgcagatcaaacaagataagagtccaagatctctttgtctctccccaaactggtctccctgttgttaatccttttcttctccaggccatcttctgcaatgtatgtcatttatttatttatttttttgagagaatcatatagtggctcctgcaagattgtacacaaaaagatcatccccaagacacataattgtcagattttccaaggttgaaatgaaagaaagaatgttaaaggcaactagagagaaagggcaggtcaactacaaagggatccccatcaggctaacagtgaacctctaaggctgaaaccctataagccagaagagattcacggcctatattcaacattcttacagaaaaaagtcttcaaccaagaatttcataactagccaaactaagcttcctaagtgaaggagaaattagatccttttcagataaacaaaggttgaggaacttcattatcaccagacctgccttacaagagatcttgaaaggtgcacaaaatatagaaaggaaagactgctatcagctaatacaaaaacacacttaaacacacagaccagtgttacttgcaaagcaaccacacaaacaagacaacaaaataatcagctaacagcacaatgacataaccaaattcatacatacaatactaaccttgaatgtaaacgagctaaatgccccacttaaaaggcacagagtggcaagctggatagaaaagcaagacccaatggtatgtggtcttcaagagacccatctcacacttaatgacactcataggctcaaaataaaaggatggagaaaaatctaccaagcaaatggaaaacagaaaaaaagcaggggttacaatcctaatttcagacaaagctgatttcaaaccaacaaagatcaaaaaagacaaggaagggcattacataatggtaaaatgttcaattcaacaagaacatcctaatatcctaaatataaatgcactcaacacaggagcactcagatttataaagcaagttcttagagacctacaaagagatacagattcccacacaatagttgtgggagacttcaacactccactgacagtattagacagatcattgaggtgaaaaattaacaaagatattcaggacctaaacttagcactggaccaaacagatctgataaacctttacaaacatctccaccccgaaacaacagaatatacattcttctcatctccacaaggcacatactctaaaatagaccacataattggacataaaacaatcctcaacaaatgttaaataaccacatactctcagaccacagcacaataaaaatagaagtcaacacaatgaaaactgctcaaaaccatacaatcacatggaaatgaaacaacatgttcctgaatgacttttgggtaaataatgaaatgaaggcagaaatcaagaagtttattgaaaataatgagaacaaagatataccagaatctctgggacacagctaaggcagtgttaagagggaaattcatagcactaaatgttcacatcaaaaagttagaaagaacaaccccaaagctagcaggagatgagaaataacaaaaatcagagctgaactgaagaatattgagacatgaaaattcaaaatatcaatgaatccaggattttttttttaaattaatcaaatggataggccatcagctagactaagaataaaagaaagaagatccaaataaacgcaattagaaatgatgaagagaatgttactactgaccacacagaaataaaacaaccatcagaaacgattacaaacacgtctacacacacaaactagaaaacctagacaagatggataaattcctggacacatacaccctcctaagactgagtcaggaagaaattgattccctgaacagaccaacagtgagctctgaaattgaatcagcaataaatagcttagcaaccgaaaaagcgcaagacctgatggattcacagctgaatcccaccagatgtacaaagtagagctggtaccattcctacagaaattattccaaaaaattaggagaggaaatgtctccccaactcactctatgagtccagcatcatcttgataccaaaacctggcagagatacactaaaaaagaaaacgtcaggccaatatccttgatgaatatccatgcaaaaatcctcaacaaaatacttgcaaaccaaatccagcagcacatcaaaaaatgaatccaccataaccaagtaggcttcatccctcggatgcagggttggttcaacatacaaaaatcaatacatgtgattcatcccataaacaaaactaaagacaaaaaccacatgattatctcagtagatgcagaacaggcttttgataaaattcaacatctcttcatgttaaaaactctgaataaactaggtagtgaaggaacatacctcaaaagaataagagccatctatgataaacccacagccaacatattactgaatgggcaaatgctggaagcatttcccttgaaaactggcacaagacaagggtgccctctctcaccactttattcaacatagcactggaattcctagccagctcaatcaggcaagagaaagaaataaagcgtatccaaataggaagagaggaagtcaaacgatctctgtttgcaaacaacatgattctacacctagaaaaccctatagtctcggcccaaaagctccttcagctcataaacaacttcaacgaagttgcaggatacaaaatcaaggtacaaaaatcactagcattcctatacaccaacaataaccaaactgagggccaaatcagaaaggcaatcccattcataattgctacacacacacacaccaaaaatacccaggaatacagctaatcagtgaggtgaaagatctctacaataagaattacaaaacactactcaaagaaattagagaagacacaaacaaatggaaaaacatcccatgcgcgtggataggaataatcaatatcattaaaatggctatactgcccgaagcaatttacagattcagtgctattcctatcaagctaccaatgatattcttcacagaactagaaaaaattattttaaaatttatgtggaacgaaaaaagagcccaaatagccaatgcaatcctaaacaaaaagaacaaagcctgaggaatcacgttacctgacttcaaactacaatataaggctatagtgaccaaaacagcatggtactggtacaaaaacaaacacataaaccaatggaacagaatagagagctcagaaataaggccacacatctatgaccatctgatctttgacaaagctgacaaaaacaagcaacgggaaaaagactctattcaataaatggtgctgggataactggctagctatatgcagaagattgaagctggaccccttttttacaccacgtacaaaaatcaattcaagatggattaaacacttaaatgtaaaactccaaactataaaaaccctggaagacaacctgggcaataccatcctggacataggaacgggcaaagatttcatgaaaaagacaccaagagcaattgcaacaaaagcaaatattgacaaattggatctaattaaacttaagagcttctgcacagcaaaataaattatcaatagagtaaacagataacttacagaatggaagacaatatttgcaaactacccatccaaccaaggtctaatatccagtatctgtaaggaacttaaacaaatttacaagagaaaaataaacaaccctgttcaaaagggggcaaaggacacgaacaaacacttctcaaaagacatacatgcagtcaacaagcatgtgaaaaaaaggtcaatatcactgattatagaaatgcaaatcaaaaccacaagagaccatctcacaccagtcagaatggttgttattaaaaagtcaataacattctggcaaagttgcagagaaaagggaacccttacacactgttggtggtattgtaaatgagttcaaccattgtggaaagctgtatggcaattcctcaaagagcaaaaagcagaattaccatttgatccagcaatcccattaataggattatagagcattctcccataaagacacacgcatgcaaatgttcactgcagcactgttcacaatagcaaagacatggaatcaacctaaatgcccgtcaatgacagactggataaagaaaatgtggtacatatacatcatggaatattatgcagccataaaaaagaacaagatcatgtctttggcaggaacatggatggagctggaggctatcacccttagcaaacttatgcaggaacagaaaaccaaatatggcatgttctcacttataagtgggagctacgtgataagaacttatgaacacaaagaaggaaacaatgaacactggggtctacttgaggaaggagggtgggagagaaagtagcataactgggtgatgcaataatatgtacaacaaatccctgtgacacatgtttatctatataacaaaccttcacatttacccccaaacctaaaataaaaattaaaaaaagagaatcatacagtggtgttattcttgctacttaaaaaaaggtgatgtgatggcagtgatggtcaataccatatggggaagaccaggtccacactttgtctacaatcaactgctaccacataagtcttcttggttaagtaatttgcgcctacagtgacagaataggtccctggatacacttctatgtagaggtgttctcactaggctgggatgcctctggagcacgctttgatatttgatagatgcctccaggaccaagggatgtcttttttctgtcttttctctgaccattccctatgtccaagtacatgtgcagcttcaacttccctctgtgaaaatgatagacatgggttgctccttctttctctggcacagatgaataatatttcccacactaacttgaagtactgtctatgaattcagccattgttcagaagaaagcactaagggttgggtgtttctcgtctctctggccaacttctcaaggtgcatgcgcccagcactctcaataatctttcaacatggaaatctgatcatgtcacttcccttcatcccactgatcttgggatgaagctcaaatatggcttccaaggctgtttatgagtaggacgctgctccctctacagcttcatctttcaccactcctcctaccctgctctctgctccagccatcttgaatttcaattcttttctcatctgggattgacaggctcattccttcttccctcttccctctctctggctaacgcaacctttaggtgtaagattagagagcacttctcctcagaacctttctgactcttcctgtctcatttacttctttactgttagcttgacttttttttttttttgtaattctatagcatcctatacttctgcaatcacagcatttgtcattcctatgatgaatgctcatttatagcctcctccactcaactgtaagctccttaagggcaagaactctgctcccctgtgcatcactgagccctagcacctagactgctacctaagacacaacaggtgctcaaaaataattatggaattatgaacaaaggaactaatccatgaatcccatcaaagacaaaacaggtaattctagagagtgtatatgtggttagcttttcctttttctttaatgtctttgcttcttcctagttcctgtgcttgattttcagcattcttgtttagcttttacttatgttttggatcaatatacatttctccattattttgtgtttttcgtaccaagcgagaataaactttaccttacctaagtttaggcccttttcctctaaagtctttttcaccttctctgctttcactattttctacttcatcccatattaacaagcatctaacttataaagtattctgcagtgtttattgactataatatttttcatttatgactcattatagtttcatttatgtggctatgttaaagacacttaagtctaatagagaatgtaagggtccttaaagttgaagttccaaaagcaattaaaatttaagataataagctttaaagcaaagccgtctcctatggacatccttcaggaatgtcatactaaccaagaaatctgaaggggaaccatctattattcatactaagggaacagggacaatggcttcacacagctgacttctctttgctactgactagctttttctgctctgtggataatacaaacaggatgaaaggatcttgatactccacaagtaaatatcctttttaagcagatggcttgcaagttaggaaaaaaagttgctctccagtgattaaaacagctctctggaagcccactttattgcatctaagtacattgctagtctcactgggagagtttattcctttcaaagatccagcctctcagctggtaagagttttgataaataattttgttctatctatatgtacctcttgttaatacaggcatatcaatgatcagtactcatgagctagaattgacttgttcatgttcatattgtctcagtaattcaagagacatgcatttgatgaatgaaaatgccttagtcatggaaagaccaagatgcgctcttaagaaaagttgaccatattaagccaacagggtcattgtaagtatctgatgtcaaagtggaataaacaaaggaacatctgttatttgcagttatccaagaaggtggcagcacagtacagtacagtacagtcattaaggcgtgggagctggggtctaaccagacctgggtttggttctaagctctgccattcactacctatatctagaaaatgttcctgacctcctttaaacccaataccataaaatggagataatagtacttaccaagtaagatttttatgatgattaaaggagacaatacatataaagtaaaatttgagcccagtctcaactatctatcaaatgttcagaatattttacctaaattaaatatatgttatcatccaccttcctttgcacaaacatgtgacatgatatcatataaaatgaagactttatttatatgcaagtctttaggtggcacttgcaagcttccatgtgcctatgacatttgggaacttctatctgcatgttgtaggaactgttcatatttatacctctcatgcccatgtggctacattttaaaatgattcagtcatgattcttccagggtctcctgtgggcccagctctgtctttacctaattatgttagtttcaatcgacaactataatacgaagacttaatgaggaacacaaatgagagtaattcacatataccaaaaatcaacttaaacacacactaatataatgttgagaaatgcattatttaaaataccctgtacattatagagaaatgcttatcttcaatcttccacttgctttgtggtgtcagtttactgagctattaatttaaacttaaaagcctgaaatttgaatatacagaatagctgaacagctgcagaaacaaacttataaaaatatatactgttacccagcacataaaaaagcaattatttattgaaaaaaatcagaatttaatattacccagtaactgcaaaagttgttgaaaggatataattaacatttactgaagattcttagggggtaaaaatattttaaataaaacaaatatttagaagttcttagttactagtaaaaacaatctctttaaacataacgttcatccaccttgaaaaaaaatctgctgactgggacatttctagataattttgaagctcaaaaacgccaaatctatcaaaatcagagagttgctcttggtttgtgttgtcacaatctgtgacgagacaatgggtcttgctcaggtcaggggaccattaaggacccaggaaagccagcaaaggactaggagattttgatgtactagaaagacacaggatcaagagtcagaagacctggctctcaccccaactttagctcttgctagcagtgtgactggtctcattcattcattcatctattcatgccagctgctggggacatcaatgaacaagacagacatatcacatatcacatatcacaaagcttattcattaaggcctcaccagcaccctaaaaatggggagaggaccgtagagttgagaagaagtttaaatcaaacatcataggaagaggtccatgatggtcaccactctcatgggatgaaatgtctttggcttcgtttctttattcatagaacatgagtacaacacctgctttctctatttcagcaggtaccaaactctgtgggcatttaacaatgtgttaaacaaatttgaaataaaaaaccctactttattaaaataaaccattaggaaaatcaaataagtacaaggttatcagagcaaagcttgcctagttcacaaacatcttcatggatatgtttaatggcccttcagaggaagccaaatatttgcataaccataagcctccttcaaatatcttgagacttgtcatgatcttaatttgccaaagtgggtccctatctatgtttggcagaaccgttcaaatcatctgaaagctacctgctttttgaacgggtttttactgatgaatttttgggaggagttcagaacctatccaatagaaagtcttttaaccaatgggccctaatcaactggatggatcaatcagcattctccatcccctgtataaaatatactgaccaatactgtggtcaaacgaatactgaatgttctctctcgaactctggagcacatcagctctctctgcataaactgttaatgtcagctatacttgctttgtaattacagaaattaaatattatgttggcccataaaatatgagtgtgaaaatagttatttgtatgaaaatttagtaaaattaaagaaatgaaagtaagtcactagaggaaatctgccattgaattagatatgattgagacaactgtgaaagattggggaaataataaaaatttaaaatgactttgcagtcagactgtgttgcaagtgtcttaaaaaattcctcacttaaagagactgaaaatggaaatcatgcaataatgtgcatgaaagattacatgaagttccaatcagcagacccaaactcgaagaaaaggcctcgagcccacatcaaaagattggcaaataactgttcatttgcaactttaggttaaatacatgatttaggctatgtagtatctttttaaaaaatgattcactgtttaattgatttttcaactaatgagaaaacacccagtcaggttagctaagagggctctgactctgtaaccagcctggaaccctgggaagctctaggtagatagggttccttcttgttgttttttctgatttttaaaattttctaacttttcttaacggttattatttgcttatttaaataaaaactattttaataaaaagatatatatctaaatttcagctatcttggagcaaaaagcctttgcattttattaattaattaattaatttattttgagacgagtcttactctgttgtgcccaggctggagtgcagtggcacaatcttggctcactgcaacctccaccttccgggctcaagcaattctcctgcctcagcctcccgagtagctgggatcttacaggcgtccaccaccatacccagctaattttttgtatttttagtagagatggggtttcaccatgttggtcaggctggtctcgaactcctgacctcaggtaattcgcccacctcggcctcccaaagtgctgggattacatgtgtgagccaccgtgcccggccacctttgcatattttaaacaaagaaaaaaagaggccaaatatttttactcatgtgttgcttaaatgtttagtgattctgccttttgccccccatttctggtgtgaggctacctatctattggtaagactgttttaactgcagttcaatgaatatgacccttccaagtaagaaaggctgaacctttccagctgtaaaggttgattctggggcagcagaaccctaccatgtgtgacaaggtttccttttactaatctggttctcctcctgtatattttgggaaatgacacacgtccaggcaaagcacaccatgggccaaatgcacatcctctctgcccttaaggggccatgactcaaagcacttcactggggatgcccaggggttgtgcatgaccagacatcggcaaagtatttttgagaaacctcctcctcaactaaaaatacccactgtgagaaatctgtagcgtgaagcaaggatcgagtcagtacaacacaaaaaaagagacaggcttgtggcagtctcagaatcaaacccagttcgccctcccttaccagaacaacaagaacaatcaaaaaaaaggtttacaggaaaggacttcttgaaggcagtaagatgggatacatggccacactcattttagtcttgtcttttctctttctccttgagggctgggatggggaaagtggccccaaatctgctcaaagtccaactgaacacaatcaataatagacttactatgacattttaaaaaaatttctactgagacattagttttattcctcagtaaacacctccctgatttctgcatcccaggagagcctgggcaaagaagagcacaggcaagaagtgtgaatgtgttcagagaaagtgttggcgaggcctggctctcccagcccctctgatggctgagaaaactgcttgacaagagggagacccaccaggacagaagcctgagcttcacagggcagacacattgctagtgtagctactgactgcccatggcaatggttctatttttttcatgggagaccttcctatagttacacataaaaaagagacataaaaccggagaacttaacggcagagaaaagtaaaatggtaaatctagaatgttttgcttaacttcaaaactgttgttgaatagtttagaaggagtagggggttgaattgaggtccccaacaatacaggtgtcctaacttctagaacctggaaatgaaactttatgttggaaaaggaccttcgcagatgtaattaagttgagaatctcgagatgaaatcatcctggattacctgagtaggccctaaatccaaggggaggtgtccttagaagacacagaagagaagacagaggagaaggccaagagaagagaagaagacagaagtggaggcagagattggagtcatttagccatgagctgaggaacacctggagcctccccagaagctgggacaggcaagggatgattctgccctgaagcctttggaggaagtgtggccctgaaacaccttgattttggacttcaggccaccagaactgtgagagaataaacattgttttaaattgtccagtttgtgataatttgttaagcagacctaggacactaacactgaaggctaggacagcttataagaagaccggtgggggccgggcgcggtggctcacgcctgtaatcccagcactttgggaggccgaggcgggcggatcacgaggtcaggagatcgagaccatcccagctaaaacggtgaaaccccgtctctactaaaaatacataaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaagaccggtgggaaaacataaagaaatttctattagaaatagaaatcttatgtgagaacaccaaaatcgcctcctgatgccccaaagcacaatgattctgaggggagcaggagggagggtgcgactctcctccgaatgcaggcctgggccccaaagctgatgaagaaacccgatggctgcatggggccagacctagtgtgagtcagagtcgccaggggaacttttgtcaaaaactgatatctccacttaagggtggctgagtcagaatttctagaggtcaggttggagaatccatgtttttcaaagtctcccatgtgattctaatgatcttccatccttaaaaatgatgggcccaggtggtctgctccctcccgctttcagtgtttgagaagcagatctgcagctgcagccaacttttaaaaaaacgtgtccaacaggctatttattatttaaaacccagctttattgtttatgtaaagcttgatacagatgcattatgaagtattaaacaatacagaaaagcacaaagacaaaagtaaatatccagattcaccatctcaggaaactttccacgtgtatttccaagtgtttattcacacagagatgtctgtgtacactttaacctgctactcagagtgtggtccacagaccagcagcattgacaacactaaggaaattgttaacaattcagaatttcgggccctgacacagcaggatgtactaaaactgcaaatatgttatatcccttgttttgtaacttgctttttccacactgtaatgtattgtaacctctgtccttggtaataaatacaaaccttatgatctttcttaatatatgtacggtattcttttatgtaccagaatttacttaatgagctctcatttgatgatcatttctagtttcccatttttcccaccattgtaaacaatgctcacctaaaaatccttgagaaagtatctttctgttttgtcattattatttttgggtaaatccctagaagtcaaccagtgtgcaattttacgcacactgatcattctgatacctaatgccagaacaccagcaagaatgcccagtgaccttgcacacgaatgcttgttccctcacactcttgccaacactggaatttttctaataattttaacctttgtctatctgatacttaaaaatgacacttcattgatttttttccttgcatttttccaaaagcaataaaaaagcttctcatacatttatcggccatctgtatttctcattttgtgaactgtccaaagttattttggttgtttaaaataacagttataaaagaatctgtggaattacagagtttagaaatatggtttagtcacaatgaaaagacacggagaagaaaaaaaaggaagagagaagaaaatgtgccataaaaaaagataatcaaaagattagtttgtgtgtttatttatagacaccagttacagcaatccagtgattaggcaaattaatgcagctgtgtatgatcacagctctgggatcagcccctacatccttttcaaatgatgccacctgtcatttaagtattttgcatttgcctttcatgttacatatatttcatgatgatttccattttaaaaaccttcttggttaaccctttgaaggttctcatgatatggattatcctctgccgtcaggaatggggtgagctaaccaccctcccaggtaggcaagagaaacagcacgtttgcctctgaaaaagaccaatcctctccaaacgttcacatcttaggaaagagaacagttgcatccttttcactgggtgtaaaactgcttctctgctcagaaccaatggaaaaaaatgggggacgggtcagatgctgtgtactggttgacttcagtggcatgtgcagaccatgcccattccaccgggcacatgcatccctcacacccccagggtgacctcaggcctgctttgtcacacaggcacccaccttgggctccatacccagcacacgcaacttctctactgaacaagtggcaggggtcttctcacagggcccctggaactctttcaacccataagacaacgccaaatgggtgaaaacccacctcatccacccctgccaccctctagttgctgctttatttgtgaattgagacaaatcagtcatcctcatttgctgaccattctctgcatacagtacagcaagagcactatgccaggtggccaggagggccggctgcagggaaacagaggaaagcgtggagagagaaagtctctaggctccactttgcgatctgtgggatatgaacaggtggaataaggtctttaataaacatattttaggatgttagaacaagcaggtcccattacaaaacctgaaggaaggaatttgaggacaaaaggagaagcatgactttatagaacaggttctatgtaaacacacaaagcacatataccttaaggattgtgcatgctaaaacgtatttcagtagctgctagaatgggaacaatagattattaacatgtttgaaagggatagggactcgggaacacatctcaaaaatgtgggtcagagtcaaggaagcttgctgctacagtgtcaacaatgctctcagtgctactggcagatacggcacgggcagaagagaaagctttgggtctgccacagttacaaagagttgtagacttcaatatttagttacgggatgaagaggggagaaggaacaaagacctttaaataaaaagaaacaaaagagtgaacatgaacatagagctacatgaagtgtcaaccctagtgaagtgattatgttttaactgtgtaaataaagttcaattaaatattcaacataacagcaataaaatgtaaaacactgagaagcatctctctctagtcagtgtttggcagatgtgttgtgtttttgcatcttgctctttatggtggtatctctaacaaatttaagggcaaaagtgatgtagaccatacattctagaaccaattctaaaacagcaagaagtggccagatgcccagtggcttaatcagattcttaattctacacactacatttatcctccagtctcactgaaaatctaacagccgagtggtcaaaagaaaagataaaactgcaaaatgggagtgccacaaatttctgctcctcctactccagccaacttaacttgacagggaggaggcagcctctgtttccttcctccctttaaaggggggatggcaagctgttgacaactcctactgtacaaaagagttgttcacactgcaaaagtgtttactgctcacaagtgacgctcaaaattaattcacagcagcaacaccagcagaaagctttgacagactgtcttatgtgttgacacagttatacgttgttgcataaaaaaaagtaacacacttaccctcttttccagcccatacacactgaagttgctccaaagagagactgtgaaatgcgtctgagattgtaaatgccaccctccaggtaaggatttcccgctccgctccggggttgatggctgcaggcatgagaagacgtggaccccctttttgaggtgaagcaaggctgcgagcctctcccccggcctctgttacaactggccttgctggtggtttttccttcaaaggcatttccctctagggcaagcctcaggcaccagggtgggaagtggggtagagctgtttattataccgccttggcagaaaaggagacgccaggataacagctttctgagacacaaataattcatcttcctcttcctttaaaaaacaataaccctgcacttaaaatggctttgggaggctgggaagatgtgactttcttgctcagaaatgatttacattaaaaaatcagaaagaatgtagtgtgatttaattatctcaagttacctgagatgtttagagttaaaaaagaagccaggtgggacagctagtatttggcctcatgtggaagatgttgtacagactctttggctcagctcggcgatctgctgtggtgtgaggctcttgcgtttgaacagttcctgctgagcagcgtcctctctgagaagtcacgggacttgaaaaatgaagaccgttgacactttaaaggtgcttctggcaattggaagtagccacatgtgtaaaaactacgcagtgcaaggactttctttagatggtgatatgtaagtatctattgaaagtaaggtttgcatggagctaaccccaaggaaaactgtggaccaggattcacagccttcccatgcacttttcccttatgcccccccatctccatttccccagccatggtccacaggtgcccaaagagctcttctggctttgccccttaccccatcctggcctatgcttctccttccctcttattcctcctcagcaccaaactctcctttcttttggtcttgggaaggaagtggaggaaagaatccatatcaagatgcaaatgactgacaatttaaggtattcatcctactaggctttggggattttttttccctcagttttaatttgtttggtggtaagagtctataggccaggcgccgtggctcatgcctgtaatcccagcactttgggaggccgaggcgggtggatcacgaggtaaagagatccagaccattctggccaacatggtgaaaccctgtttctactaaaaatataaaaattagctgggtgtgatggcgggcgcctgtagtcccagctactcaggaggctgaggcaggagaattgcttgaacctggggggcggaggttgcagtgagccaagatcgtgccactgcactccagcctggtggcagggcgagactctgtctcaacaacaacaacaaaaaattttacactgttggtgggactgtaaactagttcaaccattgtggaagtcagtgtggtgattgctcagggatctagaactagaaataccatttgacccagcaatcccattactgggtatatacccaaagtattataaaccatgctgctataaagacacatgcacacatatgtttattgcagtactactcacaatagcaaagactttgaaccaacccaaatgtccaacaatggtagactggattaagaaaatgtggcacatatacaccatggaatactatgcagccataaaaaatgatgagttcatgtcctttgtggggacatgaatgaagctggaaaccatcattctcagcaaactatcgcaagggcaaaaaaccaaacaccgcatgttctcactcataggtgggaattgaacaatgagaacacttggacacaggaaggggaacatcacacactggggcctgttgtggggtggggatgggggaagggtgaagggatagcattaggagatatacctaatgctaaatgacgagttaatgggtgcagcacaccaatatggcacatgtatacatatgtaacaaacctgcacgttgcgcacatgtaccctaaaacttaaagtataataacaaaaaatctataaagggttctggatatcaaatagttttagaaccactgtcccagactactggagccctaaaaacttcattaagtggtttcctacttctctgtcacatatttctttttcttctaaaaaaacggggtacatgtgcagaatgtgcaggtttgttacacaggtgtacacgtgccatggcggtttgctgcacctactgacatgtcctctaagttccctcccctcacctcccaacaggccatggtgtgtgttgttcccctctctgtgtccatgtggtttctttctttttttttattattatactttaagttctagggtacatgtgcagaatgtgtggccattttcacaatactgattcttcctatccatgaggatggaatgtttttccatttgtttgtgtcctctcttacttcctggagcagtggtttgtagttatccttgaagaggtccttcacatcccttgttagctgtattcctaggtattttattctctttgtagcaattgtgaatgggagttcattcatgatttggctctctgcttgcctactgttggtgtaaaggaatgcttgtgatttttgcacattgattttgtatcctgagactttgctgaagttgcttatcagttcaagaagttttttttttgttgttgttgtttgttttttgagacagagtctcgttctgtcacccagtctggaatgcagtggcgcgatctcagctcactgcaacctccacctccagggttcaagcaattcccctgcctcagcctcccgagtagctgggattacaggtgctcaccactgtgcctggctaatttttatattttttagtagagacggggtttcaccatgttggtcaggctggtctcaaacccctgacctcatgtgatctgcctgctttgccctctccaagtgttgggattacaggagtaagccacggtgcctggccagcttttgggatttgttagagtacaccgttgactggtggaattcctgctggtgtgatgagatgcagtgagaagtcgtaagacatcctccaagatagaggaggtctccttgatcagtataggcccatgcccaggatacaggtgacctaggatacaggtgttaatgcagccaccagctaggatgcactggtcctacctgattagggtgatgctgacacaggagctaacaccgaaggagcattttctcttttgcctggcactgtaacatatgtaccacatgcttttacaaatgtggttatcattcagtagagtatgaccctgagcgtgagtacttttagcattctcatttaccaaggtggaaattgaggcttgaagaggttagataacttgcttatggttatcatgctaacagaatagcagaactggaattgaaagccagctgtctggagctcatggacttctatctacctccagtggtttcatcccaataggaaccatcaattgtgaacagctggtacaggccagcaccccctgcttcaccatgggacaatactaagacagctagaggccatactgcagatgcagaggctttgcttacgcgaaggtggtgaagttagaagagcatgaaatctgaaggcaaacaatctggttaaaatcctggccctgtttgttgctttgctttaagacctgcggttaatctgtgaactttagttttttccatctataaaattcatctgatactacctgctttacagagttgtttgtgagaactgaataaggtaatacacatgcaaaatgttttgggaagcataaactcttagatgttattagtgttaatatggtcttttagtgggaagagtcactcctgagagcggaagattgactttcacatcagtatcacctaccccacctgacaaatccaggagtgggctctctggaggaccactggggaaaagggagtagaagcatgtaccagttatcagaggcatttactagtaatagtgaagtttgaccctaaaaaacaacacaagatgaattctgtgacatgtggatgagaaacatgaactttcaatgaattcagaaattccacactcacagcctgcttcaagtcctgtgtcagctgctgaatcagagtaggaggcatcattttcttgttggtgattacacttatgcctttgtacactgccggctggcttcaaaagaaagggtcacctttgtgtagttgactcctcattttgtaataattccaaaatgcagtagcttctcccaaagtagttcaaagacaccaacctgctgagaaccaggggaggccatcaggataccaaacttcctgcttctaatggcccaaatctcagcgaaagcctctgaatagataggcaagctccagaaggacagactgtggtcattaacgtaaccctttattatggcgaatctcaattctttttctacacatgagctcacccttcaaataccacatttatgtccatttttgggcgggctgaactaaagtttaaagcattatgtcattgtaaacaaacaatcacatgtagcgtgactctgtggaaaatacagcatttcaattttgtggtattggttccaccataagaaagggaacccaaatgatgaggtcagtgggccagctgccacggcaaagagaatgccaagctgagcaagctgctttcactcacaactaaaaaattaagctcaccattgttatgccagccaatgaaagtgattgcattcctaaattaagtggaaacagagcttcagagactgctcctccttagtattacatgttcatgccaggaggtcaagaggctgttacttttgctgatgatggacataaccacatccaggcttatcccatttagaagccactgctggctaataaaaagtaaatgaaaacacacactactgtgaatcaggtagcagtaaaaatggatacaacaatgtggtagatgttaagagaggaagctatctaagtcctagagactcatccaaagagtgtaaaccacgctcttctgccaagtggctacgacttctacttgcaagcaatgtagcattacgtaagtcaacctgacttggtcttcgtctattttttcctaaggcagaacattatccttccagcatgcaacagggctggtcataccccctaaacagctttgatcaaatctgggttatataccaagcatcagaaccagcctgggttacataccagccacccctcccaccttcctatgtctaccaatcatacttccaggctcctagacttggagcctcagggtcttctctgattttatctttctggttcctctgttgtcctggccccaccaatattcatattcagttttcaccaacatctcacagattactcctttgatatgtgcccagagtccatctctgtctctttactcttacagtcatcatttttgtgcaggttcctcctcccacccctaccgtggctacaccattacaagaacctctcactggtcttccatctctggtttgtgccccagcaacctgtcagggacaccaccattaagccactgtaatggttttcctgggcttacaaaagggcagtccacaactcagcttgtattcatggcccccaacaacttggtgccagcctgtctttccaatcctatttcccctttctgcctggctgaaccacttcttgagccctgcactgtacccactccctgtatttgcatatcatcttttcccacccaaagtgcccacttctgtccagttacgctccaagacccagttaaaccacatctcctccaggaagacagctctggtcattcctgagaacgtgcagcccagatctggatcactcacttggtgataagtagagtacttccttttgatctcttttatagcacttactgctttgatggctattcaaatgcaaattagttaatttcttgtctcttcaactagatttatcatagctcccagaagattatattttctacttttttatattttctctgcccacctcatcctttgtccttctcctcctccttcaaaacccatgtagcaatcataatattaaataaggacttatttttatctgtgtcctaaggagaaaccaggaaggaaattgaagtgaaatgcaagagtaaactcagcagagatgtaactggcccctctgggtggaagacacagcagaattgaataaacccagaattgagtacatctgctgccagcacatcttcaatgctgccaaatgccctcacctacgttaaatcaggtaatcttaaactcaggctttgagatataattcagtatgtaaggaagggagaagaagaaagaaaataattcctctttagaaaagcattttctttttattttattttatttatttatttatttattttttattgtactttaagttttagggtacatgtgcacaacgtgcaggtttgttacatatgtatacatgtgccatgttggtgtgctgcactgattaagtcgtcatttaacattaggtatatctcctaatgctatccctccaccctccccacaccccacaacaggccccagtgtgtgatgttccccttcctgtgtccaagtgttctcattgttcaattcccacctatgagtgagaacatgcggtgtttggttttttgcccttgcgatagtttgctgagaatgatggtttccagcttcattcatgtccctacaaaggacatgaactcatcattttttatggctgcatagtattccatggtgtatatgtgccacgttttcttaattcagtctatcactgttggacatttgggttggttcaaagtctttgctattgtgaatagtgctgcaataaacatgtgtgcatgtgtctttatagcagcatgatttataatcctttgggtatatacccagtaatgggatggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcattagaaatgcatttttgcccaaacacttcaaacacatgacttcgcttttaatccattttaatttagaaatatttctgtaatacagtatagaaatattttgatgatgtacatcagtgccctgtttgtagtatcaacctaggcatgaagagtgatgaaggctgacattttacaagaggatggatgagaagagtccttcctggtcggatggggttagtgaggcaggagtagcctggagcacctggtagagctggaatcatgggatgtatagttcaggtggtcaggggcctatgggcaagtttcactgggatggtaataattatgcagcagaaacaggcagtgcatagaataatctgaatggtgaccatctccagaatggcagcctccagagtgaggcttttcacagtgcccagtcttcttgaccaaaagtcagggtatttgctagaggagctggtatttatgtctaaatggagagctgtatggtctggttgaattgaagccttgtgcaaataactggcatgtgctttggtcagggcaggtagcctctgtgggagagggtctgacagggctggggcaattccttcccatcaacttaggagggtcatgcctccctgtctctggggccttgagtctttaacagttattgagatctacatggcagatacaggcagagcagatggcaggaaacatgggatgaacagatccagccttagcagtggccctgagatttatactcctggaataattttcagttgcctccttgagtaatttttctcctgccccaatggagtgatgaccgtgcaacagtatcacctccctggcagcatgctaaagccattttcttccgaatggagaatgaaactgaggcagccttgtcctccttcttcaaagtagttttcacatcctacaaacattttctgtacttgttgctaccattgtcctccctcctgacacagccaactaaaaccttatctctagcttcatcataacatgttccctccttgttacctacaccttgccatctatcgctcacattttgagaatctgcaccaagactttagattatgatgcttctgcaccagtaaccctcggctacacttctcgcctaagttttactgaatgcttgacattgatcagaattctgttcacaaacaacctttaaagtaaagcattaggctgggcacagtagctcgcacctgtaatcccggcactttgggaagctgaggtggatggatcgcttgagaccagcctaggcaacagggcaaaaccctgtctctaccccaaaacacaaaaaattagccaggcatggtggtacacgcctgtggtctcagatactcgagagctgagtaggaggactgctggagcccaggaggttgaggctacagtgagctgtgatcatgccactgcactccagcctgggcaacagagcaagactccgtctaataagagcagaccctactatgatcaagattactaggagccttgtattctctttgcattagccctcctcccacttatttcctcactcaccagacattcactgggcacacatcatatgctgactcaggtctcatggctggcggaatgtggatgatacactgagcctctatcatcgtctctgaccctttccactgccgccaggtctgtggccacctccactgctgtttctcaactctgccacggccagctcatcatccctacttcttatcttggctgcttcttgttttctactgctctgcctctttccttctttctcttttgtcacttcacccaagcttcctgaatttctccaaggccagttacccttcctcagacatcacctagccaccagggttctccttcctgtgatcagtcagtcccacgagcacaatcctgtgctgtgactctgcgctgttttgttgttgctcactgctacggctgagtttctttatctccagagatacctacataattgactttcttcttctttttataaacttcagggtcagttctattatggataaataggactattaacactggtggctgctttgtgaatgtaacattatggaaagagcctggttttggagtcagagagatctgatttcaaatccttgccaactgcagcagtagctgcggaatctctgacaaatcatttaagttcttctcagcctcagctgccacactggcaaaatgggactgataattattacctcatatgtttattttgataaggattcaatatataaaatgccttacacatagaaggcaccctagaaacacccctcccctggcccactatttaccttctccttataaatgtgatgcagaaaatggctatagtgaactgttaggaaggagaggggatatcaccggcaaaattaagcaaagctaataataatgaacagattaactacaaatgctacttaatattaccagggctggtgtatcataaaattgcacagattaagatgaaaaaaaggcaaaaattaattccacaggagcagcaaaaagcagtggtcaccaaatgtgaacataacagccaggccctacaataatgagcactaaaccatgctatttttcttttctttctttttttttttttaaatcctacaaagaaataggatacaaggaaattagcatgtgagaaagacttggacttatgtgaagaagctaacagatgtgcaaaaatctagaccagattcccatttcaaaaaggaacttgtagagtcactggacccatcctgacagtgaggcagtcctggtagcatgtcatgtcatcctgtgacactagcactgtgcacatacataaaaaaaaatgtctgttccagtgaagccaggaagagaacagacggcaaagcctgacacagacagaaagagggacaggcttgtcttgactccatctgccatttttaaacccaagacacaataacacctaaggaatactcacactaacatttcattcaacaatccctccactgcatgtcacatgaaataagttagacaagagcagttctgcctaaagtatatgctatctgagaggcatactagttctttgcaaatacctaaacagaactttcagatgtttctgctggagtgagaaaaaacatgtgcatttgagtgtaatgtgatggttttcaactgcttaaagaggccataaatctattagcttgaacttcaaagaaacaaattctgagaacatcaaaaattagggtggggcaaggagaattggatctaactagtttctccgttctttcccagaaaaacaatgagaaccaaaccaggctccagtctctttcttctcccaatttttactacttgccacacttttgaaaacatcttctacatacttctagctctggacaaacacattcttattcaagtttgtggttaactccatgagctcatttttctatgatttgttggacatttttatgtggcttttacggagaacagtttaaagtgaattatctttgagaagcctgtgggattctataattctctggtgctctccccaaccaggatgatttattccaagacaattctaaaccaagaaggaggactcgatgcccagacttctaataagattcggctgctgtcttgcaaagccaggcagtgtgggacagctggatgaagtgagtgggactaggcttagattgactctgtgtgatcagagcaagtgatttcacctctttgggactctgggtttgcaacaataaaacataagaagtggtgacagcgatgacttcgcagattctcccagccctaatactctatgagatcatgactattctaatcataaaacacacacacacacacacacacacacacacacacacagtctctctctctctccctctctgatatgttttctcataaccaaaggctcattctagatttaatcaaagatacaaatgggagaaacatggacacgaactggacagtgagagtccatttaaaccagcagggaggctgggcacggtggctcacgcctgtaatcccagcactttgggaggtcgaggcgggtggatcacccaaggtcaggagttcgagaccagtctggccaacatggtgaagccccgtctctactaaaaatacaaaaattagccatgcgtggtggcgtgtgcctgtagtctcacctacttggtaggctgaggcagaagaatcgcctgtgggaggcagaggctgtagtcagctgagatggtgccattgcactccagcctgggtgacagagtgagatccatctcaaaaaaataaataaaaaataaaataaaccagcagggggatacagacaaatctaatagtgggtagaaaaaggatccatgtaagtcttctccttaaaaaaaaaatcattgaaaaaaatcactataatagcttggagatgacaagccaatatgaattactgaggcgaattcattaaatccaccgaaggacacatcctaggagatagaacatattaaactgagaagacatcttccaggcccacctctccagctctaccgatttcttgccactaaataataactcccaacagctctatcaggaatggaaacaaacacaatgagctggggcatagtaaactcaataccaagaccccactttaatgtctgtatgtatgtattaattcacgtaccacatggttttgtaacaagaaagcggaatgggaaggagactggggtgaagttaaacctgcgggcctcaagtaggacacatcagaatgggagccaggttcatctttttgaaggattgtcctttccgcctcatcatcttcccgtacacatgcactttagcaagaagaataaacaggatatgcctacttgacttccttgtttgctctcagggtgacttcactaaaaaaaaaggcatcaaaggcctttatgaatccatcaccagatttttaaaaagtctgtttacagtgattctatatgcccatggctaaaatctggaatttttctctttttatcctttctccacccttttcttctttctctacgtcttctagtcatcctctgccatgttcctcatgattatgttttataatatttaatgttccatgtaaaaagtggtgtgccttgagctgtttgctggaagagccagacagacctaacacgtgatcataatttagtaagaaaagtgagggagaaggtggggaaaggtcccctgcaggctgtgtgcatgcacagtgactggctccctgaagacactcaagctgactacgtggagctgtcttcgcttatagaccagctgctgcctcatcacctctaggttgccacgccccacttactttctgatagagcagagttcatttgttagttctttatgcaataatctccctcccttttttttctggggaggaggggtaggggttggggatattcaacaaaccaacagtccttcaacagtatttgtgaatgaacacggtaagcgtgattgtgtaacagtgttcggatgtgtccttatcttccatttgaacactaccagttgtacttccacacaggtgggggtggaggtcctctaattcaactaagaaatcccttttagctaatgagactagagaagtaaaatgtaggaaagggaacaggaagataagtggccataaaatctacaagatcattgtttcagacggttaagccagactccagctaatagacaccctccccaaatcagggcttaaataacatggaagtttatttttctcatgtaaaataagtcaggggcaagcagtccaggatgatacggagcttcctcattcatcaggacccaagctcctgccagttttccttcctaccagttctaggatacagtcctcctcctcttccaagtctaaaatgatgctggtgctccagccatcacactcatgttccaaggaaccccatggaaaagggctgaagaagggtgcagtccatccctttaagacttcctagaactctgacgcacacttcttacatctcattggccataacttagtcgcatggccagtgaggctgggaaacacaattttggttagcagctcaactatacaagggattctgctaattggtagacaaagagaagaaagctacttggtgtcaaactagcagtgtctcccataatgaaggctttgcaagcttccttatcttctgaggctgtataatgggaagattagcaacatatgcaacaaatgggaataaaaagaacacaattacagtaaactatagtaatagtattccattgaattgaaggaaaatgatagatttttccacctcaaaagacacagggatactttctaatgatttaatgtcattcacaggaaaagggtaatataccacatggtactacagaaacactttggctgagcccaggtggtagcaaatattttcaatcaataggtttggacagtgaaatagacatgaaatcctctaacttgtatttaatactaattcagacatatgaggtggaggaagaagggagataaaacaaacatattctacagcaataaaatgatcatgctaaagagttactttgaattaattaagacactgtcacaagggaatgataattgaataattccctaagatacaatgaaagtattcctggttggtgcgacctggcaacttatattaaatactttaaaattctgcaagttcctgactcagcaattctatttctagaaatttaacttaagaaaaatagccatagatacacttagagacttatctatgcagatattcatcaaggttacttatcatagtaaggaaatgaaaaaaccttcaatatctaacaagaaaggactggctaaatagatgctagtccacaaattctagtgcagccattacaaatgataaggatgataaggttaagaaacttaaggcatggaaaatagtcataattttataaaatgtacaaagtaggttataaaataaaatgtattgcgtgatacatttttttttccaactgctcccccacccagggatggagtcttgctctgtcctccaggctggagtgcaggggcgtgatctcggctcactgcaacctccacctcctgggttcaggcgattctcctgcctcagcctcctgagtagctgggattacaggcgcatgccaccatatccagctaatttttgtattttcagtagagacggggtttcaccatgttgaccgggctagtcacgaactcctgacctcaagtgatccgcctgcctcggcatcccaaagtgctgggattacaggtgtaagccaccataccccgccccgatcccgtttttttttttttttttaaaccaatgaatctatattaccatatatacctgaatataaggtagcctcaataaatgatctcccattttaccaatgagaatacaaaataacaaaacaaaacaacaataacaaagacaaacagctttgctaacttgagtatataaactctgaggaatgtgataaaataatcatcttcttatgatacctaatttatttagttgtatatacatacttcaaattagattttacacatgataataggttgatttgtaagtgttttctgaaatcatattttattaaaaattctattcaggctgtgtgcagtggctcacgcctgtaatcccagcactttgggaggccaaggagggcagaccacttaaggccaggagttcgagaccaacctggccaacatggcaaaaccctgtctctattaaaaatacaaaaactagctgggtgtggtggcttatgcctataatcccagctatttggtggctgaggtacgagaatcacttgaacccatgaggtcgaggttataagtgagctgagattgcaccactgcacttcatcctgggtgacagaactagactctgtctcaaaaaaaatttttttttaattcaaatgtttcacattcatcttcaatgtcttcatcattgttagaacgtctttcgagtcatctaacacctctcattgtctgagatagaatctttgacttagtatgtgatgctgtcactggatatttgatcctgagtgggaaacatccatttccatcatattaagaaagctggtgttatcatttgggctgtatgtgatctctgccattgcatcacttattgtgttgttcttaaaagtgctctatataaaaaagacttgctcagcatggcatccaatcctaggctatggggtcacatctttagctataatggccaagtttctgttgaatttcaacacttatttttacagcaattctatcaagtgacctctataagcacccaaaactcaagctgattgaggtgatttcaggataatttcaggactatttgcccaaacagtactttgttattcaaaataaaataatagaggagtgtccataatctgagacttacagggagttgattataagatgatgcccactttaaggataatgtttggccaaacaaaacccccttcttgccttatattcagacatatttcatgtatacacaatgaaaaaaagattatagacataaaatctctataaagtctacagtggttactgctgggtaggaagatcattataaaagatttaaattttcttctgtttgcttctattttctaaagtttcaatgagtaagagtgactgtgataattagggaaatagtattaagaataataaaaaaaaggaagagacattatacaaataatacattggacatgattagaggcaggctaagctagccttgggtgtgatttaaggtattccagctaaaaagaattccctattggcatgaaatttgtcactcttctgggtgacagccagttgcaagttagttaaaatgtagatgtgtttcttagaaggctaactcatttatccactatcctccattcactgcagattcctttatcaaattcgtttccagcctcagacagggtctggagggaacgagacagtgacagggataggtctgctttatgtgaagagagatgatcagaaaggtcaggcaccagacacccctttccttctactccccataaagtcttggcagctagagagctggggaataggactgagatggtacaatgaaggaaaaattaatagtaacatcgatgacaatatgaaggtagtgtggcttgcagttaagaatgcagtctctagaacctgcctgcctgcttggttcaaattcacctctgcccattatcggttgtgcaacgctgggcaagttacttcccttctctgtgccttggtttcctcatctgtggaataaggaaaacagtttccactccacaaggttacctgaaccacacctccccaccctggtaggagcagtatgaaaaaggccaaagccttcaaacctttcatactctgaccccagtttgcctttctgaaagcatctcttcaacacttccttctgaggtaccctgaggccattccatgaacccctgtgcacctccacatcctccacttttgctggcattctatctatctagaatgtgcttctcctctttggcaatgttttcctcatccttcatgaaacagctgaaacgtcagctccttgaataagccctgactgagggctgcccccattggttggtcaacaaatactaatattaagagcctactatgtgtcaggcactgtctcaggcactttaaatacagcagtgaatgaaactcctgccccgaccctgctcaacactcataatcatgaactcttcagcatccctgtggagatctgctatgacattactatatatgttatagaactctttcccctgttagaaggaaagtctttggagaaaggggcctgatcttacctgtctttatgtttctagtgtccagcacagaacttgtcacaccaagcacttaataagtattcgttggatgaatgtcatcctgaaaaattttcatgctagaaaatgctcacctacaactactttgatggcaactctaaataggaatatagagatgattcatctagagatattttttcctttatttaaaaaactgattccaatggcttgccttttgggaaaaccacatctgttaattgtgtacaacacaaagaaaagtctatttatttagctctggatccctagaactttatacagtgctgtgtcatcagtaggcactcaataaatgttttttgaaggattgggaaggacagagggaaggagggagggaaaaacagagggaaggagggagggagggaggaaggagagaaggagaaaagtttgggagccaagagaagagctggaagagacagagcattatccctgaggccagtaaggcactggcagagctgccatgggtctggccccagaggaggaaagcaggggttgagccaaaaaagggagatcctggctgggcctgcccgcatctgaggcaggtttcactcctcaggttcgggaaagcaccttcaggaacaccactgtttcagaatgacagtcctgagatatttaaacaatgactgggtgagtaagccccactgaagagagtaataaaaccaatttcttacaaatattctagaagcaaacataaataaattcgtaatccttcctgacacactccatttggggagttaggcttcctattcacctacaatgcaggtgagtaaacacaagtttttcaaaagaaacagaaacatgcttatgttgaaagatcccagagagcgatcatccgtgattgtaaaacacttctcttccattaaccaacttctcttccatttatttgtctggattttaccaaggagacaaataaagatgggagcagcaacatccttgtagacgaaatcactaataaaaaaggatatagttcccagagatcgtgacctttctgtaccactctctcaaacactccctcccaccccccaaataaaccacatataaactgagattatggtggtgattgcagatgcagtttcagggtaagaagagactaaatcagacactgtatgtgggagagacaagcgcatactgcctgacacatagtgggtcctctttaaatgtttaaagtagaaaaaagcaacaaaggaaagaatagctcatctaatctgtacttggaatttctcaaattactcataagagcacttaaaaaaatccagaaagacagaaagtatgcaacccctgtcaaaatagtattaagtgctgaaacacagacaaagataggtaattaactgctactagcttagatgaaaatgtctgcaatcttgttcaagtgcttgggtaatataaagcatttggagataaacttaggaagatgtgggggttgcaagtgaatagaaaaagtgtttacaaaactagtacatagtcagctttttagaaactagttcacacacatataaacttttcagtgaagagtttaaaataggatcaaagctctcccagaatgatggaaaaatgcttgacaaggcttcttgaagctccctcgagggtctctttctgcagatatatcctttaaaattgtgtgaagtgacattctcccaaatatgactggtgtgccaggtctttaaatcaaatcattcatattataatatgtgaacgcattaagtctccctctgacgaatttggacatcttgacccactccactacaaagagtaggatatcatcttccgaaagtacatgattggatttgcacagagaggtaaaacacatgggtttaagtaagagaagacagtgtagaaggcagctggggagaaaccggtagaggaagacaatgtccttgtgtgtctggcagtgtcattttgtgactttttctctttgacttccaaccacactttatattttcaactgtgtaaccaataacacattaaacttcaataagagtttgaagctagaatttttgctttaaaatttttacattaaattctatgtatagacttatgtgcatgtgcacagaaagagaattctgaagatgtgaaagatgaataatttatttttaagattaaatttaggggtagtgaggtttggggttaaatctaagctagaatcaatagtctttcatcaccacgtgtgaccaaagatgacccgcagaagtgatgttacctgactctgttgaactctatgacataatgtactgaccaaggtcatgactctgattcctatggcttgccttttggacaaaccacatctgttaattgagcacaacacaaagcaaagtatatttatttagcactctctctcttgcgtgcgtgtgctctgtgtattcatccttgttttccagtggtgtctgtcctcaaggaccaaagttgattattctatacgattctgaggcacagattctgtcactggcatatatgaaagttttctaaaatgaaatataaaatcagaagtgtctgaaatggctgtaactactccatgacccataactgatggtcaactcttccaagaccttgttctaaaccagatgatcacacatacttaaatagatgactggtctcaacacacacacaaaatagaaaattgaaaaattagtaggtgaattgtttcaatgtgaataatcaaatacattaatacttctaggtaaactctttttgatctctttgttgtttcttaagcactcagatattaggattaagatttactaaaagataggataatgttaaattaacaattgtcctgtaaggaaactctgggagtaaactataagaaataacttctaaaactaactttacaagtggtttgtgaatgacgattaaaactattcatttcagatattagagccaatgacagtgaagaaataaaaaatcttgcagtagcctccaggagacgtaggataagtcaaagtgaacatatcatagctcgatcctactctttcatttctactgctacttaaataaaaaagaaaaaaatttttcccgaaagggtagaatatggcagaaacagtaagtaccaaacccagcaaaaagaggaagttggtttcttacatagaaatgggtaacttgctatatgcaatatttaaaaaaaagccactgcaagaaggggcagtaataaaaataaattattttccttattgcaaagtatctgagggtaggaaattgacccaaactgccagagaatgaggaagcacccttttcaccctgtcctcagaatgttatttcataatttatcccttcctcagatggcctttttctgccacgtccctgctctctgctcttcagctgtcctctctccaaactcctcaattaaattatctcacgtttttctctgatctgctgttcgcagcttgtcacatcactataccataagccttcccacatgctgccgtaacagtacacttggagagccgttccgcggcagccactcgctggtatcctggatcccgggtgcacgagggtaccctacaacagtagtttcattgtctagaaggagcaaggccaacccacctagtcttcttctaaggagcatatgggttcacatccctaaaaattaggaaatgtgctatgatcaacctgtttaagcaacaacccatgtgccagatagtcaattagaaaaaaaaattgtgcttgtcttcttcctgttgtataaaagaacaggcagttttctcctgagcaccgtaattgaaaaaataaagttatctggttatcacaagtgcacagcttttcatcttgtttttgtttctgcaaataaataatttgggtctgtaagacatctttcacaaaatgatgtttcaaaaaatttttacagaatactctatctagaatggcatgaattacccaaaacagtaatacaaagaacctacatgccaaattaaaacattaaatcaaaaggccaataacagaggaaatagaaaatcttgttgcaaaatgagatgagattacagaaagacacacagatgaaatcctctagtttgatgagacagaggtacagagaggctcttcccaaacagtccaactttaaaggaacacctcattgacttaaaggtggcaatttacaggaggcagaggagctaatggctgacaaatagtgaagcatcgtgcactagccaggaagattttccattcaaggagtttaaaaacataggagacttggagccacatccacccaagtgaggaaaaatgttatttttttctctcccgtacccaagtaggacttactgatctaatcagaaaccaggtggtcaaagcctcagatgcccagaggggaggaaatgaacaggtccatcctttcagctgggaaatatgacaatattgtaccaaacacattaaaaatatgcatgcctttcgatctggtaattccatttcaaggatatctgaaaagatagatacacagaagatgctatttgctgcacttttcataatgctctgccttgtttccaacagtggaaaaactagacaacggtggaaaaatgtccagtaataagccatgaagcattcatacatggattctagacagatacttgaaatgatgctctagaggaatattcaagtgacatggtaaaaattgaagagattacaacatttaaaaggatgtgaccaaaaagtgggaatgtaatggttaagtgtctgttttacacacacacacacacgcatacacgcacacctacagtcaggactgtaagacacattcaggaatggtaaaattataagtgttttgattctttccttacttgcctttttttgaaaacatcttttataaaaacatgttgttttttgataaagagaaaaatcagtaataggttttgaaaaaggaacacaatcaggtggtggtctcgtgtacagggacctatgaaacaccagggctggaagggccttgtggctccctgagctgcttctctcatttgagagacgaagaaccaaatgcttccagagtgggaaggttctgacctcagaaaagctaggcaaggcatcccagcaggcagaacaagagagggacacaggctgctaagggttgccccagcagggctgagtaagtaggtggagtggaagtgatgcggatgtatgatttgagagtgtgagttcaacagaggtgtgagtccaaggtgatgctgggcttgggaacaagaacaaataagaacgtaagaaaattaggacaacagagatatgataaggggcaagtaacctacatttttttccagcgcttctatgtaaaaggctcatgtttactcatgtaatgctcaaaagaactcagaaaataccagtactcccaactcactgttaaggacactgaagttaaaataactagcattggtctcagggctagcaagtaacagagctatcatttgctctcaggataaattccaaagtccatcttcttcctaccgtgctacacattgtctcctctgtttgatctcctgagagaaatatctcgattcatacaggttacttatcagctgaggcatctggagtttctattgcatcaaacatctcagttggtgagtcaataacatgggggatgcccattgtaaaatccagcataaacgaaacattcaaaaggatatattcatggaactggaaaggccagctccccctgtgcatgatggagagaagggaagagtggtattacaaaaatccaattgctggatatataggcagatgaaaatcttttcatcctgctctaaaggtatcaagaaatgtggggtcctttccttctaaaacacagcctgcatctttcactgggttccaattagtctgtccttgaactgccagaagtccttagcattaacagtgagctgctgctatcctggctatcatttagggaggagcataagagcaggcactgcaatatcacctctctttggtctgggaaatgggcagcagacagtccagatgccattaaatgggaggtcttaatcacctattagctacttgcagaaaccaagacatgattactctccttcaagcccccagtacttttctcactgcagggttaatgaaaacattaggtctcctcctcttccctttcttattgttctgatcatctccgaggggtttgattagcaccagagccttctctgtagttatccctgtctacagtgataagcaaccaagcccacccctgcagcgtctctcatgcccgtgccagtgtttataatcacatgcactactctagtttggacttttattggacaattgctgtaccctcccaactggtctccttgtttcaattacccttctacatcatcagcaagaccaaataataattattttacaatggataaaccctcctcaatggagcctcagagtctactgagttaaaggtagttttaattcttccatgcagttttcaaagttgcttgcaatatagtctcaattttactttctagtcttattcacatctactatctaacacttatcaattactacggccacttcattacttcaaatgtcctgagaagcagacactaacatgggattcgatgtgctagagatttcttggggtagggtgcaggaggaggcaagaaaagccttcagatcgagatgcaggtctggcccctgggaaggagaggaggaaggaaggaggataggctgtgaagtgtcttggagtgcagcatagttccgagaagggtttagccatgtcaatggggagtgcttgagcccaagcttctcagtggaggaccccttgtgttgctggaatgggcatgccttacttagcacccccaccatgcatggtcaatggctgggagtagcccttgggaagcatagccttggtgccaaaacagtggtgggttcagaggggcagcagttgggatgtcagtcagtcagtcagtcagcggtgttgcctaaagcaagagagctgagcggtgcattttcatggccaccacagtcactgtataattcaccattaaactgggacacttttaagagtagaagagggacctatcaataattacacgaggcagacaggtagaaccagggtccatctaggcaaactagaatttattgtcactctatggcaacagatgcatcaaagggcctactcagtgttgactagcatagatctttccactttttggcattctatcagtttggaacagttttataacccacaccatggctacagaaatcctatgcgttttaaaactgacaaatgtcatcttctgaatgttgtcttttcctccttggaatcatttcgtgtgtccctttcctgaaatactgaccctttcctgctatatattttatttttttgagacagagtcttgctctgttgcccaggctggaatacagtggtacaatcacaccttactgtagcctcgacctcccaggctcaactgaccctcctgcctcagtctcctgagtagcttgtactgcaggcatataccactatggctggctaattaaaaactaaattttttttgtagacacagggtctcactacattgcccaggctggtcttgaactcctgggatcaaacgatgttcccaccttggtctcccaaagtgctgggattacagatatgagccaccacatctagcctctgctatatattttaattaattttatattatctgctcctgccataagacagtaagatctgtaagggtaggaactatgtgattttcagtttttctctggttgactaccacatcttgcagacacagtggacaccaacagaaggcatactcctaaatctgtagtgtcccaactccaacttccttatggcttttcagttttaaacaaatacttgagtcatcttgtatttcttaagtgcaaattttccctatgtctttatagttcagacagagaattcaactatcagccaatcttggtgaatgaattcttttacgatttgttaattactttgtccttttttctgctaaaagcctacattgaattacttcaactttgcctcaaaagaggactaacaaattgctgaatataatttgcactttaaacaataaagctattaatggcattttagcaagaacacccattattttctctgcagcaataaatcagcatttcatctgttataaattgcttggtcagcttcaaatggctttagaataaatctctttctcctttctgcctctgctgtccatgacaaagaaaggaggcagaaggtaaccctgtgttctgcattcccgggcatataattttcatgctgcacgactctataatttatttctagcgataagcatcttgtagtgctacactggctgcatgctcacacatgttcaaatgcacacagaaagacacaggtaactcttcagcagtaatgctgaaataaagaggcttccaggtgaagggctcagtgactgtgtatggtaaaattttgatgccaactgcatattttagtaatagggcagctgtaaatataaacacaaatgttctaataatcagactatttttcagccccacctccaaaatatgggtaaattccacaggatgattagataaggcacagggttatcttgttaatattaggctattgtacattcacatttctgagaaatatacttaataagttttactttttaaaaatcattttcattgaaagtcttgaatgtagcatagcatcacaaagtaggtgcctaataaatatttaagtgaatgagttaacagaagaatgcctttcatttagtctgcttaatgcttaagtcacgttatttagtgttattcattcatcacaactaaatactaatatgtcatctatatttactacaagctagtccctcttctctagtttataatttgctgatacttgggggttatgtttactgtcagttatagcgctaacatttcaaacataaggaggactttgtgaatattactatggataatggtgattagctgcttttggcatcctaggcagagtgagagaaaacagacttaagctacagcatgagggattcaagttagataagaaagaaagcgttctcgtatcaaatctaattaagcaccagagtagatgaatgaagggagctatgaaacattctttcttggaagtttttaaaaataagacgaaatctcatcagtacatatatcattaagtatgctcctccatgaagataaggaggaattggttctaatattctgtgaaaggcaagtatatttattaaggttatatctaaaaatataattttcagagtatggccatttcatgtaaagtactggtatcaattcatagtcaagatcatgaatcacacgcccaagtggtgacttatagttctttcatttactaggtgactctgggcaagtcactgtatatctaagatccagattcttttcctaaataagagtaatcctgcttctaaatactactcctcaaaataaattaaatcagaccttgttgggtaagttatattctgaataaataagcagtagaaaatctgattccttcaatttcaagtcatttcaatactatattctcagttaatgtcctgaaacaaataatctatatataaataagagtttttctttttatcacactagtaacaattagaaaagaaacactaacagataaattttagattgtggcaattaagtgaatagcaatctgatagctataggatttaccttcaaaatccaggcacattcatgtatttataccaatctctctccatgctaatattcttacagaggaattttattaaaacatggctgaatctatcatttcagtattcccaggcacaaggcagtgaggaaataaaacactccttctatgttatggaacctagagaaaataattctttcctaaccagtggggtacattttcctccttgaggttcgtaagacaaattttgaaaaaatcatggtgcagactatgtaatttacgcttaaagtattgtaactgcttttgtgttaggattcatattatgagaaaattcacatatattacccttttacggcttggttatagatctattttgattatggtcattggagcctaaaacatccacaccctaaaaagaacatatcattccaatctctatctcttttaaaatagggactttgggctatagcatgtttttctcaatagcccaactccctactcagagatactactataaaagctgtattttggctgggagtgagggaggaaacaaccctagctatttgcagagtagaattgcaggttccattggcaaaaaagtgccagaagtagaggaaatgcaggttacaaagcatacagaggaagagtgacagatgagatgaacaaaattgattcatggagagaatcagatcaggacaaagggtaaaaaagtctcaagagcccaatcacgtcaaaaagatcaatttttaggagaagtgtagtcaatagtgtcttaaaacaaaattagaagtggaagcaattttgaaggtcatttgaagagtaatctactccttttatagatgagaaactgagacctagaaggagtaggtgactttctcaaggccactctatactaggaggtgacagacatgtgctgcacaattcagaataatgagtggtaggttcagaacccaaaaagttcataatgagccagggtagcccccttcctctttaagggaccctctctctaagcgccccagccttgctcccaaggagcactgcaccttctgaatctggtgagtgatggggaacaacaggccaggaagggaggaagtatatctgccaatgctcaaaacgtgttcattctgatggccctagttctagcctgccttttgaatagcactgcgttagtcagtactggacaggaagcacaagtgttactttggcagggtcctgtccgtagaaagagacccactgagagcctcttgtgtacagccacagacaatgggataacccacatgctggcccctcccagtcagctaccaaggcagactgcggaaaaggggacaaactggcaggaagaacttgaagcaggctcaaccataagtcaggttgcacagcagacatgaggagaaggggcactgcaaagggagagctagggatcataaatccaatgctatttgaggcggagtgtctgcgatctgtaatttatatggatataataagctccatgcctaagacaccgcagccccaaacaaccaccaccaaaacacaaagcacatgtttaaaggggtgaattacccaaaacatcaggtttctccacatggctagactaagaaggctgcaaaatctatcactgttatgggctggaaagccaaccaggagagccttcttaggacttctaaagggaaacattctggatgaacctcttggtcttgtaagaagggaggctagttatgtttaactataaacacatggcagtaggtgtcagcgatatgttccattcgaagactatataataaacatcatttttggaaaaggaaactaaactaagaatagataacctgagaatgccatgcaagggctagagcaacttcccatccttttgcaagcatttagcaatcaggtttcgcctttagctgaactcctttcatttcatgcaatatttaatttatacagagatgattcatttgcaatagtaaatcatcacaacattctgtaaaaacaacaacaataacaaaagactagaaatataggaggcctacaacaagcacctaatttaaaactgcagcctcttcctatccccaaattggccctcctctttcctgctctgtttttaaatttttttcctagcaattaccaccttctaacttactataatttgcttgtttattgcttattttctgttttcctccaatagaatagaagctctaagagggcagcaatttgtgtctgttttgttcacagacacatcccatgcattgagaacaatgcctggcacaagcaggtgtgcaaaaatgctggccgactaaaaaaagtcatggatgggttgtcaatattgcataaagtcctattctcagatgacaattgaggtggcctcatcactaactacaagagattttttttccccaatggaaatcaccaaagttttaaaaaagattggaattccaaggttagtgagggagttccgctatctgatgaagcagtgactcacctgaaaagttccaggggacctaatcccaatgtgcatggggcccaacctcctgaccagccttgcatatctgaaggtggggagggaaactgaggtaggtatcgagtggtgtaaaaaaaacgcttcacaagagtttttctttatagccttacaattttaatacttttgtatagcacttcccaggcataagcaacacttccactgcatcttactctactttcataacaacccctgtaggcagtaagaattatattctgaatcttggagagtgtgctacttgcccagggtggttggccaaagtgggactgttcctattttggtttaagaatgcaagtttttgggttacaaattcagtcctttttctacatggcatggccaaaaataacattctcaaagatgggttacttagctgccccactctcatggtttacttcaggggagcattgtacaaaaatgggtgattgtctagttttcattgccaatatgctgggaaataaagaaaataatgagagaacaccaaagtttctactaccaaacaagtaggcatttcaggtggtctttacttagggccttgcatttcttaggctaagttgtgttatattgagctgaggtggaggactatgaaaaagaaaggcagcagatttcacagggaccattcaaagccctgcaggaacaacaacaacaaaaatgctatgaaacaacacggagtaactcttgcataaaaatggagaaaagtagggtctaaaatacatgcaccaaaacccaaaaaagacatggaatacatgacccaggcggccctgaaaatctcatcctcacacaaagaagaactgtgcagcatccagagagaagaagggatggtagctggggagatgagacctttggagaattaactaccaaaggggatgaatcagctcacgtctgacaacacctacagattctgtcaaacctgccgcactcttcaagagcttcaaggctcacaaacaggaaattgctgggtatgacttaacctgactctcaacctccttagagaagagcttgccccaaaaaggtatgaacaaagtgcagagccaaagggcaagaggtgaagaagaatacgagctcacattccaggtgtggggcatttagtggaaggaaacacttttcgaaacatatgagttatttgggatttagcattgggctcaatgccaatcaacatattcacttggtagaccaacacttcacagaaatgagaaaagagaaaacaattacaaaggaactctaagggcacaaaaatttgtgaagaagtgagattgggttgttaatttattcattcactcatgatattctgcatcagattattttcagaagcaaaaaactttgaattgacctaaacagtaagtaaatttattattttacacgacagagttgcctggaagtaaagccaacccaggactggtttagcccacagctcactgatatcctcgagggcctgggttctttccatctttcggtcctattttgtaggttccagggaaacccataccgctgtgcatgagccaagctgatgaccagatcttgtatatctaacaacaaattcacccactggatcaggaactggggctgggaccagctgcccgagcagatggccgcttagaggagaggaaatactccaaccaaatcagggttgcaccagctagaaaggggctaatggccattgagtgagcccctggagatatccacgatggtcatttgaaaggtattcattgagcacctactatatgtccactcctgtactgatcactagaaacacagagaccaggaactgcctgcacatagacaataatgaggaaggcagacattaatgaaataattatacaaataaagataaaattgcaactgtattaagtgcgatgttggaaaggtatgtggtgtcatgagagcgttaactgagggggaggtgatgcctctctgatgaagggatatggagctgctggggaaggggcatggagaaacatttcagacaaagggagcacaagcagtggccaagtagaaggatggggtatggcacattcaaaaactgtccccagatggaagacagtgagggtgagcttggagtaagacggagctaaagaggtaggcaggagccagtccatatgagttgtatacaacagaagataagattaacaaacatctttttaaattttaaaaatattagaccatttgttcacataaagttttacacaaacaaaagctctaaaatgccttggtgcacaatgtagtgtgactatcaaatggccattccccttccttgcaaaatgcatacttctagccatttcacttacactatctcatcgagaagaaaggcaggtgtgggaggcaaggcacaggtagacccaggagcggggttgaaagatgaagccacacagtcataactgattgggacaggaagaaaataattaaagaggccaagctaggaaagggacatcaggaagagcgtggctttgagacagggttgaacaggatcaggggcctgggcaggggcttcatgatgtgtagtaagtaacgagagacgggtggttgagctgggggatgggaaaagacccaggagcacagggcagagtccagaatttacttccctctcctattctagggaggtaacgatatggagatggcagaactcagtctccctctgtgtcttcttttggtggggggggggcacttactcacatagcaagaggttacacaaaactattcaagggaaagtgccacaaagtcctctctcagcaaatgaaaatatgcttcagaaataaacaacactgccactccctcatggggctgaaaaatatcatctcttaatttgatttcttagcactaataaactacatcataatctctcaatagctgagtataaatggtcgaattaaccatcttctgcccttcaaatacttaatttccatggtgactaattatgcatttcttttaccacatggatgggcaagtaactaaatgggctctatcttctaaagcagacatttaacgtgtgacaaagtcctctcagataaacttgtctcttttgaaatgagataactaattactgggtaagacagcagaatcgtttccctactgggaaatcaactacgtggtctagtagaatgaaaggcacggaccatggcaaatcaggtctgcaaaaacagtaaacaaaacaagccaacagaacaattaacacatgtggaaaaagccaaatacagtatccactgcacagctgatttgattttaagacaactgaatatgtgtttcagaaagaaagggaaaagagtgaaaatatatggaagtataagaaaagaaacaaaacatcctaaaagtaaaataaggcaactaaaggcaaaggaaaacttttatatacgcagacctcatagactacacaaatccctttgtctgcattctctagagaattaagaaatggtcactatacatatattttattgctcaggaaggaagtccacatctcttccagaattctaactattaaatacacaaagcattgagccatgcagataattctcttttcaaaatagggacataacctattttctctagatcagatgtagctggctaactgagagcccatagctattgtggtaaccaggagaaaaggaaatggatgattaaagtaaatctaattcaataagctagtgacattgtactgtacaaaactggggatgggaaagaggcggatacaggccaaaggaggaatagtgcttattttgttccttttgaattttatcaaattgtgtatatatttgtgacttttaccctaaggagcataaaaaactgacaataaaagattatctgaatggaacattggtttttggtaagtgtcaagcacaaaaggaatcataatttttttcaacgagctttcaaagtatgtatgctcttgacatctgctgataagctgcagtttcctcctaaaaacttaaagcttctctaaattcaacataagcttgctttcagtatctgcaaaatatatgtggataaaattgaagttttcaaaagggagttaccatagaaacacacaactccctaaaagagcagtccatcatctcttaaggggaaccgtcatcacagacatgtattcagtatctctctgtgcacgtgaggccttagacaatacacaaaggacagtcagcacttgcacactggacaaatacagaaattagataagccaagtccttactctaagtaagcaaggcggggatgaggccctttgtgtatgtgcatgtgtgggctgtaggggacaggaatcatgtgagctggatcctgtgatgcagctaaaatgcagccatcataacatttatttaaaacacaattctataacaatctggccagtgcacacagttatcactatggactgttttctgtgaattcttttaaaatgaggatctaagtactagaagcagcacgtacaaaaatagttttatttttactagcagagtagactcaagctaaaaataaactaaatgggaattttgtactgcagacttttcaaaaacagtgtctgtatacctaagacaaacaccacctcttaattagaaatttctgtaaagcattccaaaaaggccacactattttcagtcagactatatggttcttcagacttggtttctcttgagacaaaagaaccccatggagacgacatctaagttggagtcttcacttaaaccacttatggtctttatgaaaggatttttgggccaggcacggtggctcatgcctgtaatcccagcactttgggaggccgaggccggtggatcacgaggtcaggagataaagaccatcctggccaacatggtgaaaccccatctttactaaaatacaaaaattagctgggcgtggtggcgtgcgcttgtagtaccagctactctggaggctgaggcagaggaattgcttgaacccgggaggcggagcttgcagtgagccgagatcgggccactgcactccagcctggcgacagagcgagactccgtctcaaaaaaaaaaaaaaaaaaggatttttgcccttaaagaagccaaatcattacacagcccttttacaatgggacagatctaactggaaggaaaaaaaagatatacttttaggcactgtgccccaaaaaactcagcaattaaagtttgggattaaaaaaagttaaagctatctaaactgaggtttgtatagaaatgtgattatttttgcaggtgtattatctgtgattggtactaatgatttgcaaatcatattaatgaccataataatgatattttttctaatgaaacacagcactttacaaacattaagtatttaatccctgttaggtaaattacagctactcttaaccacatcttacaaatggtaatactgatatcactattcatgatttgccccaaatcacagatgactaacatcagaatttattttaaataaatataaacaataaagtacacatgtgcttatttgcatgtgtgagtatacaaagcatcatgattaggcatagttaagcaactgattagaaagtcattcaaggtctcacttaaaaaccaatcaagttaaatctaggtaatacaggcctagtaccatcagttggcattattctggggaaaaaaaatatcagaatgcttagcaactcagaatgcttaacatcctacctttccactgcaacctgtaacagacaacggccagtggcccacaatgccagtgccaaccacagacaggatggatggctctggaaccattagaaggcaccattcaaatagacaatggtaccaaccagcgtctcgatggtggttataggtctgaaaatgtgtactaaaagaagcggaacctctggccgatgaatttatttggatttcatggctattagtactctgacttccacataacctttgagattcagactgagcaggagttcctcagagaagcttctctgagccctgagccggacccaacaatgctgctccagagaatgtcttcagactccaccccagagcttcttcacgatttttggacactggctttcttgaaagcttcccaataggatcaaacttcttaagggcaggagccatactgtcttgtgcctggacaatgtttataaattgatggagctttataaatgttgaataagtcaatgagcataggactaaatttatttaaattactagtgctctcatctatcagaaaatttgttctttcggtgaatatataattaaaatggtgtgggttaaaagaaagttcctgattatcacaaaaaattcagagaccagggccaggtgtggtggcttatgcctgtaatcctagcgctttgggaggccaaggcaggaggactgcttgagctcaggagttcaagaccagtctgggcaacatagtgagaccttgctgctacaaaaaattttttaaaaattagctgggcgtggtggcacacacctgtggtcccagctacttgggagtctgaggtgggaggatcacttgagctcaggaggttggggctgccgtgagctgtgatcatgccactacattccagtctggtcacgagagcaagaaccctgtttcaaaaaataaaaaataaaataaaaacaaaaaattcagacaccagagatttgtctactaatatgcattttaattttctaaggacaagcaagcaaagaatgatcatgattttctgaatttaaaatccaggggtgaaggaactacccagacatctctgatgctgcccattcttttatcttgaaggaacactgctctgggcatgacagatgaggattaagtaattacgctacacactctggcgtgtgtctccgaaatctgcaaacacatctagtgctctgaaagcggacttgtagttggttttttaaagatgataaagagaactttgctactcaaataaaaataactgatatggccttcaaattttcctaagttcccgaaaagcttatttttcctaagtgtacccatctcagataaaggcagaaatcacccctctctcaatacagtcaacttctctaaagatgatgcatacaaacacaccagactttggcagaattctctagcggagatttaaaagaaaatatctcgtggcagtagagagtcacatgaagacttccaacagctcagacattctccttctacacaaaaggggaaaggccctctctgtagcaattgtttgataaacagaccacagtggcgtttttttacttctcctctgatataagtgaaaataagtccttggtactatgtatggaaggcaggtaaaaacaatgaagtgataagtatttacaacacagatttaatttatctacaccaaaattttaaagattttctgctttaagtagagttatcctgcttaacatcctgccccactaatttttatttgaatttggaaaaaagtcaaatgtggacccctaagagtacattcatcttttcagaagcagctaagccctgatttttcaaaaagcattaatctagactattttataaaattataaaattgatttaaaaatattttaaatcaagactaaaggtagatgatatcttcattgtaaaaagaaaaagatactatacattcccatcctgtgaaattacagccaaattttatccattcaggatactttgggaatgaggcgttctatacagcttagtttcccagagagctgaagggctccaaaattttcttaaaatagaaatatttctaaaatgtaccatatatctgtgcttccacgatcacagtctaagacacataatatactttttccttaataacttataattgaagacaccagctcatgtgtacaaattgaatgtagatcaaaatgtgctaggtaatttggtcacagataagaatttatgtactgtgatgcccacaagagaaagcaggaaagatctaaaattgacaccctaacatcacaattaaaagaactagagaagcaagagcaatcacattcaaaagctagcagaaggcaagaaataactaagatcagagcagaactgaaggaaacagagacacaaaaaaccttcaaaaaatcaatgaatccaggagctggttttttgaaaagatcaacaacattgatagactgctagcaagactaataaagaagaaaagagagaagaatcaaatagatgcaataaaaaatgataaaggggatatcaccactgatcccacagaaatacaaactaccatcagaaaatactacaaacatctctacgcaaaaaacttgaaaatctagaagaaatggataaattcctcgacacagacaccctcccaagactaaaccaggaacaagttgaatctctgaatagaccaataacaggttctgaaattgaggcaataattaatagcttaccaaccaaaaaaagtccaggaccagatggattcacagctgaattctaccagaggtacaaggaggagctggtaccattccttctgaaactattccaatcaatagaaaaagagggaatcctccctaactcattttatgaggccagcatcatcctgataccaaagcctggcagagtcacaaccaaaaaagagaattttagaccaatatccttgatgaacattgatgcaaaaatcctcaataaaatactggcaaaacaaatccagcagcacatcaaaaagcttatccaccatgatcaagtgggcttcatccctgggatgcaaggctggttcaacatacgcaaatcaataaacataatccagcatataaacagagccaaagacaaaaaccacatgattatctcaatagatgcagaaaaggcctttgacaaaattcaacaacgcttcatgctaaaaactctcaataaattaggtattgatgggatgtatctcaaaataataagagctatttatgacaaacccacagccaacatcatactgaatgggcaaaaactggaagcattccctttgagaacagtcacaagacagggatgccctgtctcaccactcttattcaacatagtgttggaagttctggccagggcaattaggcaggagaaggaaataaagggtattcaattaggaaaagaggaagtcaaattgtccctctttgcagatgacatgattgtatatctagaaaaccccatcatctcagcacaaaatctccttaagctgataagcaacttcagcaaagtctcaggatataaaatcaatgtacaaaaatcacaagcattcttatacaccaataacagacaaacagccaaatcatgagggaactcccatttacaattgcttcaaagagaataaaatactcaggaatccaacatacaagggatgtgaaggacctcttcaagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttcaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaagacagacatatagaccaatggaacagaacagagccctcagaaataatgccgcgtatctacaaccatctgatctttgacaagcctgagaaaaacaagaaatagggaaaggattccctatttaataaatggtgctgggaaaactggctagccatttgtagaaagctgaaagtggatcccttccttacaccttatacaaaaattaattcaagatggattaaagacttaaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaagttttgaaatctactcgtctgacaaagggctaatatccagaatctacaaagaactccaaaaaatttacaagaaaaaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggctgtggagaaatagaaacacttttacactgttcgtgggactataaactagttcaaccattgcagaagtcagtgtggcgattcctcagggatccagaactagaaataccatttgacccagcaatcccattactgggtatatacccaaaggattataaatcatgctgctataaagacacatgcacacgtatgtttattgcggcactattcacaatagcaaagatttggaaccaacccaaatgtccaacaacgatagactggattaagaaaatgtggcacatatacaccatggaatactatgcagccataaaaaatgatgagttcatgtcctttgtagggacatggatggaagctggaaaccatcattctcagcaaactattgcaaggacaaaaaaccaaacaccacatgttctcactcataggtgggaactgaacaatgagaacacatggacacaggaaggggaacatcacacaccagggcctgtcgtggggtggggggaggggggaggaatagtattaggaaatatacctaatgctaaatgacgagttactgggtgcagcgcaccaacatggcacatgtatacatatgtaactaacctgcacgttgtgcacatgtaccctaaaacttaaagtataataataataataataaatttatgtgctgtggaccatggaacaggaaggagtctgtttgaccctcacagtattctgaaatttgtcctctcaaaaaattcctgatgtcaactcctatttgtatcatttgcctcttcctcacagaggtagagtgaagctatgtggtagagcatggctttgcaaggagtaaaatgttttaaaaaactagttagtgaaccaaggctggagaagtttccttgcaaatggttttcctattccctaggtgggtgtcattttggatgttgctatcagctacctccttttttctttttctttttttttgagatggagtctcgctcttgttgcccaggctggagtgcaatggcatgatctcagctcactgcaacctttgcctcctgggttcaagcaattctcctgcttcagcctctcaaatagctggggattacaggcacctgccaccatgcccaggtaattttttatatttttagtagagacagggttttaccatgttgtccaggctggtctcaaacacctgacctcaagtgatccaaaatgccttggcttcccaaaatgctggggttataggcatgagccactgcgcctggcctgctatcagctacctctgacttcagctggagcttcatctgtaagggctcccaggcgctcctggaaagtacacatttccccagctttcattcactttattcaatgattgagaaagagaaacatgcttggccagttcacaaatctgaatttagatgtttgggagttctccaatgtttcacttctttttgctgaggtaggcttgtaaacttggttaaaagaaactggtgtaacctctttgaaaagacaattgggctctctctccctgtattttacacatggatgtaaaagtcattaaaaagtacatattctttgacctagaaaatcactttctaggaatctagcctaaggaatcactggctatataaacaaagaggatgtgcaaagaggctgaccacaccgctgattataaaagtaaagtaggcctggtgcagtgctgcacgcctgtaatctcagtactttgggaggccaaggtgggagaatcacttgagcccaggagtttgagaccagcctgggcaacatagtgagaccccatctctacaaaaatagaaaaattagtcaggtgtggtggtgcctatagtcccagctacatggaagcctgaggccagaggactgcttgagcccaggaggcagaggatgcagggagtcatgatcatgccactgtactccagcctgtgcaacagggcataaaagtgaagtttaactaaacctctaacattaaaggattggttaaaaaacatggaaattcaaacaatggaaaactattctgccattaaaattttaaaataatgatccacatattattgacatgcaaagatttccacaatatattgttaacccaaagaaaacaataggtttcaaaaatatgtgtggttgtatataggggaaggtccgaaaggatctgtattagaggttcccaaatgattctggtagcccttagagtctcagtaatttttcacaatgcctccaggcccaaacaaatacctaatagagctgtctgttaagtagttagatccaaacaacataataactatttatgtcagaatgatttagcagctgaaaaaaaaacacacataaatgaaaactactatttccttctcaagtaactttgttataacttgtttatagaatgtatacacctgttgggcactgcataactttaaatcttggaatcgctggacaccactaccttatttcctgttccacgctggttttcatgtgatacactttttatcactaaacactcagcaatcactgaaaactcggttttgtaaagatatgatgtcatcaaaaggaatgtagtgtgatctaatgctgaaactgtgaactatctccagctaatagttggcagagtgttgtacgatgtttcccttaatgatggaaagtatctgtgccaaccctagagctgcacccagaatttgctgtggtgccccagagcatcttggcacacagtttggagctgcaggtatataacaagatgttaacagttgctttctctcaggttactggtgattaaaaaaaaaaaaaagattttctgaactttttcccaataaacatctgttattttttacaattagaaaaaccactaaagtgatttatgtatttttcagagttctttatctttacaagaagatggagagtctccccaattttttactgtgaagaaaagtctaagcataaacaacagtaaaaatggagtcttggatgatgccttaatgatgaaaaactccctcatgaataacgttctgcaataactcctcctattctgaccccctccctgatacttgcacaggttggatcaatgaagtcactggtgtcaggacactaacccagacattcaccccacttcctgcgggtagccactacaattgtttaataatagactctctgtccctcagctgatgtgcttgtaatagagcatggtcatgcccttgtgggaactgagctataaatggtgctttgctcttggtctgcagagctttagtctctggattaacggtgctccttttaaaacagtgcctgctgctttgcaccctggtgtacactgctgccgtctttaaaggtctccactgctctctttgttcccttctggttacttttgccctgtttgtcagtttttgcactaaagaaatgaatgggcttttataccttcaccaattgggactttcagaaccagcctagtgagttaagtctaacagatatttagccccctttgatagtcagttgttgctggatattttgtttgtttttgcctttgtgggaattggtgggcagaaaaaaacattttccagtttcatgctatttttaaaacctgaggattttttacaagttttggcatcgtatagttgaagttctattgtgatcaatatttctattcatttactttcttactaaacaagtgtccaaggaattataaaacactttttttttctaatttagaaacttctacaaatgtatacatcaattgcaacttaacctttacaagtttaggaataatgctgtagtagaatatttaaaggaactttctgcataaacttcagttaatataggtcttacttttaaaatatcttctttaaaaaataaataatattgcttactattgggataaaattattttaaaaagaataatgagaacagctcccaattctcctttacctgccccagggttccctcagcacttatcaccttttcaacatactatacactttacctatttatcttgttaactgtccatctcctccaaccagaatgtaagctcagtaggagcaagaatttttgtctgctttaatcactgatacatcttgtctccagcacctaaaatgtaggggctcaacaagtatttgttgaaaagtcagtaaatgagtgactgattcttaaagacctttttgtaactccattttagaagaccaaagaaaaaaagacaaaatcttgaacattaatatttatacaaaccaaatactactttttgtaggtaaaatatgattctattgtgatgtaaagttacctttttgactgtagtgaaatccatgaatggcaaggatctaactaatttactattgctcctcttccaggaaatgtttcaactttcaaataaagaggacttctgattgtcaagcatggcaaattcatgtggaatgcctaaaaatgctgagtactaaaaatatttttaaagatatggctaagcagcaagaaagtaacagcaattgttaaaagttgaaaatgacaaggaaattagaacctagagaagtaagtaggtaagtcctgcataagtcaatccctgatggggatattaagagacaaagggacagcctaatgtccacacaggaaggtcaaagccaatacccttgaaagatgaaatcctcagtgggtaaattaaaaaaaaaaaaaatcttcccagaaatagaagacagaataagtcttggtgatgggagaggagaaaaaagaagaaaatttcctcaaaaaatacaaagcccaggctgggtgcagtggctcacgcctgtaatcccagcactttgggaggccgagacaggaggatcacttgaggtcagaagtttgagaccagcctggccaacatgatgaaaccccgtctctactaaaaatacaaaaaaattagccaggtgtggtagtgtgcacccgtagtctcagctagttgggaggccaagctaggagaatcgcttgaacccaggaggtggaggttgcagcgagctgaaatctcaccactgcactccagcctgggtgacaaagtgagactcttgtctcaagaagaaaaaaaaaaacaaaaccccacaaaaaaacaaaaacaaagcccagaaattacatatccatgtgccctttccaaatccaaatagggtaaaaagtcctgagttggaaatgactacaaacacatagcagaagcaaatacaaagcctctctagaataatgaatattaaatctaagtttcaagagattttcataagaattccaagtaattaagttcacaatcaaaaatcacaaaacaaagaatcaagctgtcatgaacatgaatgagaaaaaacaaaactgcagaatgaaatcatcaaaggctttagctattgaatgtattgaacacagatataaaatagatgtgtttaacatttttaaaaaagtaaacaggatcttaaaatatgaacaaggaagatttcaaaaatgactaggcagatttaagaaacagccaaaaataacttctagaaatgaaaatataataattatatttagagactcacatgagtaagtccaataccaaaatagatgcagctgaagtaggaatgagtgatttggtaaacagatataaagaaattgtacataaacttatacaaaaatgaaaaatataatcttacgtttaagaaattatatggccgggcacagtggctcacgcctgtaattccagcactttgggaggccaaggcaggtggatcacgaggtcagtagttcgagaccagcctgaccaaaatgggcaaaccccacctctactaaaaatacaaaaattagctgggcgtggtggcatgcgcctgtaatcccagctactcggaaggctggggcaggagaattgcttgaacctgggaagcaaaggttgcagtgagccgagatcatgccattgcactacagcccgggtgacagagcaagactccatctcaaaaaaaaaaaaaaaaaagacattatacataacatacagaaggaaaatataaaagaaatatttagagatgtaaagggcagaatgtgaaggaaaaaacagacaatgtgggaaaggcagcattcaaaataatttttttttctgagatttttcagaactagtaatcatcaaattcagaaagccaaatgcatcccaaggatgttaaataaaagaaatgcccacccagacaaagcctggtaaaactgtagaagaccatcataaaaaaagctctgggggaaatctggggaaaatgtctttaaaacactgaaagaaaataatactgaatatgtaagtgtatacctagcaaaactacctttcataaataaagcatgaatagaaggtattttcaatcaaacaaaaaataagaaagtttacttccaaaaacattcattaaaggtacttctaaaggacatgcttcagaaaacagcgatgatctgagaagaagaaatggtgagaaaagaaaatagtaaatacatgactatgtttaaatagagtataaaaaacagctgctactgtatacaaattgtaataatgtgtaatataaaaaataatataaaactataaaccaaataaccatggcatgttaggctgaaaaagaatgatccaaattaaagaactctaaggttactgaactgtttgagaaaagaatgaatactgtttagtgtaacactttattaagttacataggatgccaacatctctagggtaagcgtggaaaaaagagaatggtgtgtacaactgttaaattagtagaagaaaaaccatggaactatatttaaaaaaaaaaacaaaagcaaaatccaaatgaaggcaataaagaaaaaataaggctcaggaaaagcaggacaaatagcaaaaaataatatggtcaaaatgaatataaatgcattagtgcaatcaataattagtgtaatctgctaaacaacatacatcaactgaatattttacttaaaagacaatgactgattgaattaaaaaatagacaacatatgtccacacagacttgcatgtgaatgttcatagcaactttatccacaatagttgaaaaaactggaaatgacccaaatatccatcaacttgtgaatagctaaaaaacaaacaaacgaaaaacctgtggtatatccatacagtgaaattatactgaaaaaatataaaggaatgaaactctgatatgtgtaacagcataaatgaatctcaaaggcattatactaagtgaaagaagccaaacacaaaagtctacttactgtatgatttcatttgtatgactttctggaaaagacaaaataacatagtgataaaaaatagatcagtagtttcctaatgccagacgtgagggaaggaaactgatagcaaaaaagcatgaggaactttctggtgtgacggaaatatctatagctttattgtggtagtggttacatgactatacacacctgccaaaattcatcaaactgtacacttaaaatatgtgagtttgatcatatgaaaattataccttaataaagctagtaaaaagacaaattccaattatgtgatttacaaagcacaaatctaaagccttttgtgtctttgaataaaggaggctgggggaagaactgcgtaggcaaataataacccagaaatctggtgtagctaaattaaacccatacacagttaattttaggcaaagagataaaaagggccatcacatattaatagaaatatttaattccctgggaagatataatatgttcctaataatgtatcttcaaaaatatataaacccaaaaataaaagaacctcaaggagaaactaaccataagacagtctcatttatgaacataaatgcaaaaatcctgaacaaaatattagtaattcaaatctaataatttccaaagaaaaataatgtgtctaaatttgggttattccataattcaaggttgcttcaatatcaatcagtgttattcactagatgaaagaagaaaatatatgattatctcaaagaatatagaaaaagcattcaataaaatacaacattcatcattcatgattaaaacaaagaatagaaagaaacttcctgaactggataaaggatatcacaaagcaaccctataacaaataccatactttataatataaatgaaaagttaaagttttatctatcactattttaatttaacattggagattcttgccagttcagtaagacaagaaaaaagaattaacattttatgggttggaaagggaaaaaaaactatcattacttgtaaatgatataaagaatctacaaattacttttattaataaggaagccaataaggtttccatatacatgataaaatgtaggaccctttgacagtggcatggctaaataaactacagtaaaataaacacaataaaatattctatagcaatgaaaatgaatgaactaaagttacacaggtcaacctggataaaactcagaacattgtgttttgtggggagcaagtcacaaaataatcagtatgattctattacataaaagctaaaatgagatagtatattgctttgggatatatatatggtaaaattatatgtggtacatatgtagtaaaactaaaaaaaaaaaagcaaacaaacaagacagtaagtaactcaaaatccaggaaagtagttggggagaggagaaaacaataggagagaggtacataagggtttcagtagcaatgataatgttcttcagatgagtagcagaaatgtggatgttttctttatttaatcctttaaagtgtatctacatgttatatattcccttccacatgtatgatatacttcataatctaaagaagtaaatgaacctgagtgaactttgttagaaatgcattttaaagtcaatgttacttcaagttggaaaacacaggcatttaggaagttctttttctatatctaagttttgaaattaatatttattattttttcttattccttattctaggaaagttgagagttctcatttatacaatggttttcctattacactgaaatcataagaaactctcttggtaggttttaaaggtaaattatacaaccattttgttttcacaactgcctgtataagacagaagaaaaacaacaaatgaacaattaactggtaaggaaagaatattaactaataagaaatgtcaaaaaggcttgacttctcatattaaaaacaactttttggtggaaaaaacctaatcccttcttttgaaagagaatttttcaaaattctcagtgttggggcggtggggggtgagtggctgggggttgggaaatcagatctcagatcaataaacaggcaaacaggttgactaagaatagaaggtatcattatgtattttacatattttgtattttctgcatattagatgttttgacatcttaaaactacctttctggctagagagagactgtctctttcaaggctagccgattctcagagataacaaagagcccggctggtagcatgcctttgacaagaaaattcaccaatctagagacacccctcctctatctggccctcagaggcaatatttctctgcctttactataccacagccaggtaccaagcaagcagggaccacccagaaagcttggagcctaaccaaactacttcaactagcaattctaaactgttaaccctgccctgccttgcctttcccttggaaactccaataaaggctgtggctggcccaagctctcccctggctcctgccttctgcctcctgactaacacgggtgttttcccttgtggccctgcgtagcatgtggtgacacgcctctatgggacctgtgaatgtaacaaatttcttccttccaagccctgttctcatttccccttcagtggctgtactgattttatcacatatccaacatgtacattcttaaaacacatagcaaagcaggagtttcagatgttaaccaaggtctccaggaatgacaattctggagctcagggcgagcagagattagtgaaggagggagcaaatttacaggaaacaagaatatgcaaatactgagagtttgagagttcagtggtcgaaaaacaggagatagctgtggaaagtgcacactgggaaggggcagctctgaggcacctcacggcacctggacaacctcaaccagcttaaggtgcctaacagaggaatttataagcttcttgctggtatgggaacaaatccccaagtgaggtgcctgctagatagatctgcaggttgaagtagatcagggaaacgacacaccggaggagagggatgtaggggcagaaaagaggggcccatccaaaaaatgtgtgtgtatccccacctacccttacctccttccactttttctacaagcgtcagaactgctcaacatcatcacttccaaatcagttttggtgacagagtccaattgcccaaaccagatgcaatgccctcattatgtcttaccagccctcctgctcctgcctcctccagttcatgcttcacgtagccacagagtaatctttatagaacacaaatatcaccatattacttcccagcttaaaaacctttcaggattgacccatatccacccagagtagcctccaagccacttagattgtcctcctttctgccgtccttctggcttctctggctggagactttagaccacagcactgtaaactgattccaactccatgttaatatgttaatttaatatgttaatattaaaatattatttcatgggtccaggtattagcacattatgtactcttttctccttctgaaaggaagaatctttgcctgccttaacactattattcatcttcaaaaatctgtgcaacacttcattctgaagcctcctcaaacaactgcagtctgctcgctttatggaccaccttgctgctctcattacattcaatgcacactattttattcacatgtatgtctgtcttcccaactacactgcagactacttgagggcagggatggtatcttattttttctttgtatttccagtgggtagcacagcacctgacccataaaaaaactatcatctattgagcacctaccgtacagcagatcccatactaagcttttcaaatgttatgacgtgagttcccacaacaactcaatgaactatttataattacctcttttacaaacgaggaaactgagatttaggaggttaacatccccaggaccttccagttagtaagtggtagaattctgattaggacttgggtctctgacaccattgcctacgttagctccttgggcctctggtgaaacgtaatgcacgaaatgtggatcggatcgtatgaaatctcccccaacttacaccctgggttgaaggctgtgaagcttatgcagaatgctagaggaggcattaggacatggggtttctggttctgccactgattaacctcaactctgggctgtcgcaggctttctctgggcttcactttcctcatgggggaaatgccatccttaacagatcccatgtcatatcctcactcttaaggacctctaaagctgataagaaggtactgtgaatcataaacctaggtactctttctagatattggccttgaaacatctcttccttcactgaaaaactgcttctgaaaaaggatgccagaagccacttttggtcaagaaaatgtccacttttgttctcagcacagagcaggtacccggactttccctgttcccaagtgctgtagaccaaaatagcagggaaccaggatgaagtcagccagaaacacgctttctataactgctcttcacagaagagaaaatcaacaagctagtgtttaaataatgtgcagggtgtgataccaaccgaacctccgccctccttcctggggaaatgcaaagtttgctgtggccttttcacaaacctcggagagaatgaaatgtcagctctaacactgaatttcccagcttcattccacttccctcaccacctcactattacctaagatgacattctgtatattagtatactacatcttaaacatcatccctcactcagacatcagattacaaacaaacagctgaatcctacagctgttcccactagaaacaaaaagattcttaacatatttgaagggaaaaaatctgtttgttcccagatgtctcctgagcccatttctggggcgtgtctactagtaatagtgcgtaaacgctaactgtactcctcgctcctatttacacacactattagttttcagtaaccactccttcccaactcccaaaaaagacagctaagaaaacaatgttcacttggaggaagagaaactaaatttctttttgctgttcctctcaatcaaacccttgcaggaaccaaagtattcactgtggtttaaacacttgtcactcaaaaaaaaagtacccagaaatgccatgagacttcctataatttcacttttatttaaggagctgtgctgcatcaatacttgctttgggcacaaaatgcagaggagcttgatggcattttgagaatggcacagatgcaaagtatttaaaaaatacataccacccagtgtgttcctgggagacatggctggactcaacatgttactatcagcagtgttagcctggttccgcaggggaccacatatgcacatgtaggtactgagcctgtgctctgggatacatgctgtgctaaatggtttacattttttatgactcgttaaaatatacttaggaggaaggtatgttctcccctttttacagatgaggaaactgagcactacatgaactgccccgaatcacattgccagtaagtttgcaaaagtggcatttgaacagtcagtcagactccgaatatgtgaaggagttctttaagggaaccaaggaaacaatgtgcattacaacccttgggagacactctagtgtgtatttctataaattaaaaaaaaaatgggaagaaattgatcactaatgaaatgtatccatctgtcataatgaagattttaatgacgaaacaagtaacctaaaactaaaattaagacattacaaatatcaaagaaacaaagatacaacccctaaaaggggctggggtgctaatatttagaaaaataaatgtgtttcaactactgccccctcctggtggcataaccaaaggtacctttctttttcttaacttgatggatttggaaggttttcttctaactgatctaccaaaacaaaaaatgtaggtaaagaaagactgtatggagcttattgaggataaggcttagttctggactggagtgaaggtctttctaactgagtaactataagaaactatgaagcatcttgtgcctccatcttctcatcagaaaaatgggaataatatccactctatctacctcaaaggttattgtgggcatcaaagaaataatgcatgtgaatgttattttcaatgaatctaaaatctaaggtattatgattaattaaagccatttatagtatcatctattaaatttaaaattacatttactctttaatcctgcaatcccactcctgggaaccaatgccatagaactaatagcactgtatctaagaacaaatacaaagatgtttatgatttcagtgtggacaatggccaaaaaaactgagaccaaagtaaatatccatgagtagggcaattgtagaataaaaaattctaatagttaccccactggaatattatgcacccattaaaaagaatgttctagagctttatcaattgaatgaagagatttcaacacagttttctgagaagagcaaaacataaaaaaagaatgtttaacagggaattctaaaagtcttagtgcattttaaactttaataatttcagaagtataaatgctatacactttcaagaaacaatatatgaaaaataaaaatttaactttttaaaatattgatgttacttattaaaatcaatataaaaactattatgcacaaaaaaactaagagtaaaatttattattcaaaattccaaagttaaataagtataaaagaaatataaatagctaaatgtttaaatgtttctaagtttatagcaattatacctctaaaattatgaacttaaaattgcactaatacttaaaaatgttatttcaatagctttaggcatactagtgtttttggttacatgaataaactgtatagtggtaaatcctgggattttagtgtacctgtcacccaagtagtgtacactgtacccaacaggtagcttttcatgcctcaaccacctctcaacctcctcctcttgagtctccaatgtccattacaccactctgtatgcctttgtgtacccatagcttagcacctgcttataagtgagaacatggtatttagctttcaattcctgaattactgcacttagaataatggcctccagttccatccaagttgctgcaaagacattatttcattctttttcatggctgagtagtattccatactgtgtgaatggaatgtgtggtgtggaatacacaccagtccaatggaatggaatgcattctatttacacaccatggaatactactcagccataaaacagaatgaaatggaattatgtgtattacacacacacacacacacacacacacacacattcctcacatgttttatccactcatcatctgatgggcacttaggttgaacccgtatctttgcaattgtgaattgtgctgcaataaacatacacctgcaggtgtcctttttatatagtgacttcttctttgggtagatacccagtagtgggattgctgggttgaatagtagatctacttttagttctttgagaaatctccatattgttttccacagagggtgtaccaatttacattcccaccagtagtgtgtaagtgttcccttttcactatatgtacatcaatatctattgtttttttactttttcattatagccattctggctggggtaaggtggtatgttgttgtggttttaatgcattaacactttgagaacactctataacatgtttttgttttttaaaaacaaaataacagtcccctcactcccactgtgtggtgtgtgtgtgtgtgtgtgtgtgtaattgtacatttacataaacaggggaaaaatggaaggctatatgtgcagttaaaatgggagaagggaaaagaggaggagagtgatccagacaaaagaggaaaagttgttgttttttttttaaaaatggggaaccaaaaagtgtatatgctattatcacatttatgtacctatataaaatcatttgtattgtacagctatataatattacatgtttaaattttattattttagagacagagttttactctgttacctgaactacagtgcagtgaactacaattgcactggcacaatcacagctcactgcagcctcgatcacctgggctcaagcaatcctctaacctcagcctcttgagtagctgggaccagctacggcaccaccatgcctggctactgattgatggattcattgattgtagacacagtctcactttgttgctcaggcttattattattattttgttttttaagaaaggaaagaaacttgccccaagtcccatactaagctaatggcagaagaaccagaacttgtacctaggtctctctgactctgcagtctgagccctgaaggattacactgtgatttaggatggttatggattcacaggcaggactcactagccctgcaattggcctctccagcatggagttcctgaccattattcgtcaatctcaggagctgctttcaaaacaaccaatcgtcctttgaacctctcacttctggggtggagcatgatagcatggtagatgctgcagacatgaggcttttggttgatgctgatagcaaccctctgttgcacagatacataattttaatcaccactgctaagtaactcttattgatttgttcttctcagaatcaaagacacttttctctctctctctctcaagtaaattaaaaatggaaacatattgtcaatccctgaacacgtggtgtgcttttttccttcaggcccatcacatactgttccttctatctggaatgtccttcatctttttcctctgctgggaaaacccttccatattcttgaagttgcagctcaaatatcacgttctccgtcaaggatttcctacctcatccaggcagaactgcttcaccctttgcatgccctcaagaatcaggacaggcttctcttagcagtgctcactgaggctttgattatgggcttagggactgatcttccactggagacctcatgagtatggtctcactctcaccttgttccagtggccagcatggtgcttggcacattatagccttcaattaaatattggttccatgaaactgtgagattgagaacgtattaattcacaaggtaaataagtcataggtccaatactgaggcaaatgaacatgcaatcttccatgcacaaggccaagaatcccttgcttttaaataatatgaaccaaatcactaccaggaaagaggctacacctcacacagcggatcttcactctcgcctttccccaactcagcaacagcaggacaagctatgaaaagttcttttgtaagtttatgggaataataattcttttaataatttcaatttttattttagattcagggggcgcatgtgcaggtttgttacctgggtatagcaattatacctttgatattttgaacttaaaactgcactaatattttgagaacacaccacataatgttttcatttttataaaacaaagggaaaatcctctcactccctctcaaatgctggcattcagtgtgaaatcatagctggaatgtgacagatgtgtattgtgtgtgtgcacggaaggcctctttactaattcagaccaacctttacctcctcagtgtgagattatctactgaaataataatgactgatatttatatacaacttagaatgtatttgctttcagagacattacctggtttgttgtatgaagcagaaagcaaatcaatcaaccagatttatcattatgtttacactgattttgcagtagatagtaaccgagtttatgccttgaccaaatgtccatatataacatacagtcagtaaaactgttgactggctgtaggttcctgctgtgagaagtgtgatctgtgaaattctaacatgcctaataacatttattcccttatgatctagcatagatttaagccaggcaaaaagttttaacaaaaactgattatgcttgtcaataaccgtgaatagtatcccaattaagacaatggtcatttatttgttcctactgccaccagtgaaagcaggaaaagcatttggcaaatctatttctgtcaccctcagatttcaggaagagaagttcaaacagatgaagctgatgttactggaataactcattctactctaccattcttcctgatctactccccaggctctgtgagctgctggtaatcaaggatgtttgactgggttctgttagctgtcaaggtttactaagctgagttagttaatgagtgatggctggatttcattccaggacttcatatcagccatgaagcaattaggcatgtacttcatgatctcccactggaatttcaaaggtgccttagtctaccaaggaactaaattcagtgtggtctgaaaggaaacaataaacaacatttaaccatgagaggtagcaaaggacgtcttttctcagtgtctatgttagacaggtgaggaatgttgccaatttattttttgtccatataacctctatagctatttcttctcttgtctgtcgttctgaaattataaagggttcttatgagttgtttatgtgaaaccaagtaccctgacccacaggcaaggtattcctggaactgctgaaatagcaagccagataatgatatcatttaaaaaagtgccaggcaagaaagctctgattaactactgaaacatgctcagtggagatatttgtagctagaataaacgccattttaacatctcctctttatctagggtcctccttcctcatgctattattgtgaatatttcctcttcagattcctgcatacaaggaagactgatgaaagagagtaaaaatcacttttggagaaaaaaaggtaagagctggcagaggtaaaagaaagattctgaacctcatcaacagttgttgcaatctcactcacctctctggctaaccttcctccctccaccccttcactgctgctttcctgccactcacccagactggactttctactctgatgctccacaagaaacagaagtggtaagaagacaagcaggctcccgggggaagtggaggaccatatgaagtttcatgaaagaaatggcttcagggatgatgaggcaactcttcctaatacaaggggtaagccctagcccaggggcacacccatcctctaggaggccagggatggtctctgtcactcctgggaagtccctgcagactctacctgctttccaagtgcttcaggaaacatcaccttaaggttgaaggaggacaaactcaagcagttgcctatggtatggctaagggggtggcaaacagagggctggtgatttttacaagtaacctctcacaatacttgcgccattacttctcttttcatttgtgtccatgaatagaaactctcagaggatagtatgttagctccatggcctgtggcactgtagagtgagttctttagagactgaaggagttaagagtacctgtttagctaccagaagctgaatgtcagccggtatgaatggtatgtagctgggcaattttccaaaacccatgcgtggctgcgtatcaggaagactgctataaacaaatgtgcatgtatgcatagagcctgataagtcaatggggggagacagacacggaacagccaaccagcctgaggaaatatgcagagccgggtgagcttccactttaggtgaacaatagctctgtctcggaaacaggtctggatgggctggtgaacagttggaatgatcctttgactttttacacattaaatgtctgtttcaggggaccgaaagctggattctcaattttccaattatcctaatattataaaatcactaaaatggtgttttaaaaaaattcttaatatgtaaaacatgcaaagatacattaggtgaaaaaagcacagggcaaaactgcatttatagaacccaattatgtaaaatatatagatacatttaagatgatacattaaaaatgtcactaaaatataacacgatctttttgtggttgtgggattatacatgatttttgttttttctttctactttactttccaatttttctaaaattaacatatattattttcatagttaagaaataaggttacttaaattaagaagaaaattacctgtggatgaaacgacatctgatgatgggttatgagggttggggaaggccagaaaggcataaaatagaaccaaccacgtttataaaatgttaaattcaactggtcttcacgtctacacacattagtatcttctgtcttacactgtaaactcccagagagcaaaggctgtgtctaattctgtgcaatgtctggctcaattaaaaatgtagacagaatataatttttatgatgattacgcaaatgtagttggttctttttcactctggcagccagtttagtgttactgatgcttggacagtgacacagaataagaacatacattgttttccccctttaaaatcatagtgtattaataggctacttttaaaaaatttttttgcagcatatacactcatagaagagaccgatcctctaccatatttaaagtagaaagtaaaacagtactgtaattttctctgttttagcccatttccatgttatataatgaatgtaattccaaggatgagcttacagtttgatttccatattaattcaattactggactcgccactgactcagacctggaattaatataaaatacagggagacacacacaaaaaatgttccacttaagaaaccaaaacagccctaagtcaaaccactcttacaacactagagtaatatccaatgaagcggcttccatttacagtgttttccagaccccacaaagttcttttcagagttcttatattccctaaaatataaccaaggttactgtaacttttgaagtcactctcaagatgtacctatcaataaacagtagctttttgtttttttagtacggtggctgtaagaagttacaaatgactgtcagtgtggtttcaggtggtattcttattagaaatttaaaacacggtgttatcaaatttggcctaagtctgttcctttcaaggttatcgtaaaatatgcaggaaatgtgaaatcccaagtgcttattaaattaaactggagaagtcactttttgagagctcggtcctcatgcccctcccctgcccccgtgacaatggtagcatttaccaagtgctctcagcaggtgctgagtgttaagtgcttcacttgcatgatgtaacataatactcaaaagagctctggaaggtaagcatttctatcagtattttacagatgataggtttaggaaaaggttagggaccttgaccaaggtctcacaacgcctctgtgtcagagctggaatttgaacccaggtctgataactctcagagtgcaaactcttaaccactaaggacttgttcacttcagagggctaattaagtgtgaaatcaaaagcaatgaataatcgcaattatgccacttttaatttgagtctgttgcatatacataattggtcttcctctatattaagaaggatgccctataaaaaattagaaattctgccaacaaaaacctcctgagggaaactaagaacatctactaaataaataaatcaagtgtcttattgagaacacggcaatactgagaggcttgggtgtggccacctgacagatctggaggaaacctagaggcaaaatgtaccgaatattctattgcacaacagaatctatctgtggaaagcaccccctaaacggaagtatctgtcaaagtaaaaataaatcagggtaacagcatctaaaaaatatattgtgagtgagatgcatacttctctcatttactatggtacacgaatatacttagtttaattgtcttgtttaaaaaagaaacaaacaacttttcagcccaatctataaaactctgacaaggactaacatcaccgtgcagtcatgaagcagggcgagccagctgaggcttttggtagggtcttctctgcaatctgcttctactatgtgatgggtcaccaggagcgcaggctcactgaggactctgctttgcatgatgaagaaatcatctggatctgttcacagagacgggtcattccactcaaactcataaaagccaggctgacagattaactgaaatgcttatcaaccaatctgagaaccagaatttcccagaagagcagaggattaggatcagattattctgttttttaaaaaattaaaacatttcctgagcacctactatgggtcaggatctgtcgtaggcacttttacattagtggtttcatttaactctcacaaccgatctttggtgtgagtactttttaagtacattttagatagaggctgtggcctggagaggcagaggaactctgctgaggtcatgcagttagaggagcagcaaagctcccagaagagcacaagtgccccagtgctgaggctacgggtctcactatgcggaaaatcacaaagttcagaaggtgctggcaagggagcccagtggtcataggttgctgtcatcaagcctaaagacttaaaatgcactggtgacatatggctgccagttgggctgtcataatcaggaacatccctaaaactttcaggctccccaactccttttggtgactgtcatacagaccagcagccagctgtttgcttttgatataaatgtgttctaatttctaaaatgtaaagtttaattatctacatttattttattttatttttcctgatagaatgtcagtagacacaccatgaatttgtatagaatgtcagtagacacaccatgaatttgtttaagtgtgggttaacttatgggaattttatacatagctaacttcagtcatttttctgttgatctgtgatagtttcagtttcaaatgatattttctgccactgttccttgaaattcaaattttgagggtgctcattatttggtacccgggcactgatttattcatatctattaaaatacatatataaaaacaaaaataaaacacgaagaaaaaaagaaaaaaaatacatatacaagtatacacggtacaaaattgtgtgccatactgtgtactcattcatgaccaaaagacactgatcatttgtaagcttattctagtaaactgaataaaataatatagctaatattttatacttactttttctgctcctactgaaaaactggacatcttaatagttacttcatactaccaatctagtaataaggtctggtggccccaaaatgaaaaaaaaaaaaaaaaaaagcgaaaggggactgagtatttacgttttttagcattggattaaaaaaaaataaaaaacaacatcagtttccaaaggctagctctgaacattttgcctcctcttgaccttaaattgtgggctcaccctggagaataaatcttaatagtgaattatacatagcaactttgaagacaaataatattagtgcagcctacccgtaattactctctttttacaaagtttcctaagaaaacagagccaaaatgcttaaaatttaaacagaaacagagagagtaaatggctgtgaaacatacacatatagaaatttatattgtatatttacatttggtctaaaagcaacttcttaaaattcaccaacagaaaaaaacaaatacattttttggagagaagcaacaatgtaggtaaagatcacagattgtttaaaaggcatatctaaacatctaagagacagtctttgtttaaattgaactaggatttcctggagagtagtaaaatgttgtttcagtatagtgaatgtgcaagttaacacttcaagagtgggcttccggccgggcgcggtggctcacgcctgtaatcccagcactttgggaggccgaggcgggtggatcatgaggtcaggagatcgagaccatcctggctaacaaggtgaaaccccgtatctactaaaaatacaaaaaattagccgggcgcggtggcgggcgcccgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagagtgggcttcctttggcttcaaactaaacagctggacaggggatgctacttaattctttttcttccctaccagaaggaggaggtgctcaagtatttttctttattctttcatctgtttatctgctgagcaatagggatcttgcttcaggttggttaatctgctgagccatgacacatatgagaaggttctctggcaggacagtatgctctccaaacagagactatggcagtgaaagaaccaaagatatatcatctcccctctgaagcctctgcttctttggggtaggaattggtctattaactctgagcattttttttttaaagatggagtcttgcactgtcacctgggctggagtgcaacggcatgatctcggctcactgcaacctctgtcacaggggttcatgtggttctcttgcctcagcctcccgagtagctgggattacaggtgcacaccaccacactcgtctaactttttgtatttttagtacagacagggtttcactatgttggccaaactggtcttgaactcctgaccttgtgatccgccctcctgggcctcccaaagtggtgggattataggcgtgagccaccgcaagcagccaactctgagcatttttaggcactaacattccaagcgtctgagattccaaataggaaagtgctattttaaatgactctttaagctaccattacagataactgtaagaaatattcaggcctgaaaaaatgttcattcatcaccaaaatgtgaatcacttctaattgatttactatttctgctcttctgctaataacagaattttgtcactatccacaaacattccagaacacttatcttacagaacagaaaagcagttgtctatagtaaaaacactccaagtttcccttacatgtcacactgtagaaaggaaacaaaacccatttattttctcaactatcttgcctgtgatagtctgtgtacgataaaatttatagaaaactaaaatgctagagtccctacagacttcaaagataatctggcccactgatttctttgtaagctgaagccccttggcgaatctgatgggagctatgaaccattctccctccagaaaaatgtatatgcataccaaatattgtattcacttcccagcattttagagacaacccctgaagccaacctaggctaagaccccagaccaacgactctgatctaattccactgctttgtttcacatatggagacaccaagttccaaacaggggatgtggcttggccataattgctcggcagaaactatgagaaagtaaactggatgaaactgaaaatgatgcagatagcaactctgaaccatcacaaatcaggcctatcattttgctaggaaaggagaaaaggtgaagtgtttcaagaggagagctttctttcattttaggtttctggttgagcttctcactggttttcttcatcttgccttcgggccaggcccatccgtgacttaaggctaccttttcttgtgtttgcttctgtaaatcagtaagacctgcataacctggccacattcagaaaggagggcaagtgtgagagtgtgaagtagaaaccagttttaaggaactgtaagagttctaaagaactctaatttggtcacataatggatatttaagaagtattctgaatcaaacactgctcacatatttaaggaagtggcagtctactaaactgtcaccgagtaaaagtcctagagacttgctttaatgattagatggaacaaattttcaactactgcattcatccgcacatttgcaaatggctcattcttttaagaactaaaacattcattctgggattttgtatttgtgtttagttcattgcaaatttactcaatatatttcgaattcaattcaacaaatacgcttaggacattccaatgtgacggaatggaaacgtgcatggattttggagtcactaagatccaaattcaaatattggatctgctttatctagacacgtgattattgggctcattacttaagggtctctgcgtttccccatctgtaaagtgggaataataccaactactgtgcaaattgggtttgaaaattagcaataatatagtctattgtaaagaggctaatgcagtatctggcaaacagggattccataaaatggtaatacttaaaataatgattatttatcaaatatctacaaaggacaaacttcatcctagacccttctctaaaatctgaattcataatatcaaaatgaatgaggatttaattcattcttaaaatgactcgaatacttgctaagattttgacatattaaaaactataaccattataaatgaaaaggccactgttcaaatgactagctttgctacagtacaactgtcagttttttgaccaaaaggaaatttataataccattggtgggttttaagtctttaggtaaaaactgtgttttaaagtaacagaacaataagacagcaatatagtggtttcttaatgactaaaatcttacattacatattatggttcagtattaatgtgctttcacactacctactgagttttcagactgcaactacttatccttttcaaattgctatcactctctttttcatgggagatttcttacaaattccttggagaatccaaaaatttacagtggaaattttttctcgattcctttttttttttttaaagaataaacctattcaacaggtaaatctaaataatttttagcagttctaaatgtagagaattcataacttcttattgtaattgaaaaggaacatacaaagcaattagtcacttacaaaacccacgttcaaccttcaaaataatgactaacttgataggagaggcaagacttctttaattaaatactaaagtctagccatttgagataagcaaagcaggttatacaaccgtcttctgcactcacaatatccttttctccctcttggaaatatatcatttttcagcaatagtagaacatgtaacaaaaaaagttactgtactgtagaaaatcactctaaccacaagctaagtttttggctaagagttaaacttcattcatttggatttcactagtttcacaagaagaaaaagtgattaaccctagtgtaagtaaaattcccttgagaatatattagattcttaagaaaacaaaacagtaagcaaccttaggcactcacttacatataaatccttagggtgttaactgaaaagcattcctagccatgctagaataggattctcaaacttgaacactgattacctttttgagagctctctggacaggtgtgctcagaagcactggaagatacaggagagtttgatacacattctgagaaagatggggtggctcctgtgtgtgcatgtggccatctagcacaatcactattcagcacgggactacatttcccaggccacttcacctccaggtgcagccacgtgactagtgctcaacaaaggaatatgagaaaagatggtgctttacttcaaggcgactgtgattaagaagtgaggtgcagacaattgcaagatggtgttacaggatgaattatgtcccctcaaaattcacatggtgaagtcctaacccccagtacctcagaaagtgaccttatttgaaaataggaccattacagatgtaattagttaaaatgaggtcatactggaagagagtgtgcccctaatccaatatgactggtgtccttataaaaagggaaaatttggatacacacaggaaaagagggaagatgatgtgaagagactcgggaaaaggtgaccttctacaagccaaggagcaaggcctggaagagatccttgcctcacagtccgcagaagaaaccaaccctgctgacaccttgatcttcgactcctagtctgcagaactgtgtgaccacacatttctgttgtttaagccacccagtctgtggtactctgttacagcagcctgagcagacaaaatagatggtgaggccagaagacggaaggcacctgagttcaggattcctgaatcacctctcaataaaagcacttcactgatcagaaatacttccactgggctgagagctgagcaagaaaggaaactagttgtgtcaaaccattcaattttgagggcttatctgttataccagctgtcattacctactataggacctaattaatttaagtggcaagtaattttaaattattttacatgaaaacaaacatggacctatcacatatcacagggaacaatccatgtaaaattttaggattaaaaacacttcaaagaaaatttgaatttacaggaagatattttggggtaaattctctcaaatcctccatagggtataaatttactctcttctgccaatagaagtagaatttcctcaagaatattaaacaagtcacaatgtcaaagttgctggaacttcaactacgccacataatccacttaattttttttttttgaaattaagtggagcatttctatcaagtagcccaagtatgtaaaattttacttgggtactaaagatgagaacactgtgaaatgagttatcagccttttccaaagttctcaatatttttataatcaatctgaaaagaagtcactaggtacagaataccttctgtttgaatatggacaaaaaatgtaccctcttttatgacagggtaactgatacagaataaatactggataccattttccatttttgattttttttttctgacatgaagaaaaaatgaaatgataactatcttcggtaagacttagagttatagttcaaaatacctcaaaagccgagctggcagctggcttctcatgtttatagaaaagctaggatgattcagcctgagctcagagctcaatttagatcatagcatctggattcaaaacacatgtgagatgtggcagccgattttcaggtcatgactgatccaagacagagattgcagaccactcaccagcattattccaaatggagaaagtgcctgagagaaacagaagtctcaaaggtatttggaagcccactccaaactgttagggaacaggtaacatcagcattttctgcatccagcagctttaagcaggtgccgcagaagccaagggcctgaggatgacactgaacagctttgtcatgacattcagccttgccatggtcagaaaacatccctcacccatgacttctttcctgaactggctattgttcagattaaactatgggaatctggtaataaattggaaaacctctgacagcacacacttcctgctaagatctgtgtttaactttgctttgtttcgaagagaaaaactgtagtaaagaaaaaggaaaaataaatgtaaatgccctttttcttgatgagaagaaatcatagtcacagtaattctaatataaactacacaatgaaatctaaaagaagaggggaaaatccccagctcagtttcaatctctattggaattcaccttgtgccttccttgattttccttggatatgacatgtccagatgtgggtgattctgcagctatggattttatgtgcaataaaaaaatgcttctcctgctgcttttcctcacctcccccctcccccatctcttttcctctctctcctccttgtctctttgttgtgaatgtcagggctgtcagtgtcacagtctgacatgattagcgtttctgacattacaccaagaagcagacagagagcaaggagagcgagcagaggggaaggcagttatgagtagccatttaaagaagtccaaggaaaaaacaagcacaaccacctttctctgaggttccttgattacagggcagtttataaatcaccttggatttttctcatttatcctattagtctgttttcctgttcctctggagatccctaaggtgtggatctagtctgtgagatcaaagccagcggctctaataacagataagacagaattcgtgattcagcggattctaaggttgtgaagtgtaacaatcagcgcactttgggaagatagcgccagtccatttcgagtattgattcgctgcactttgtcactctaatgatgttatctcattaaaagagataaatgccccactgttcttctaagagcatctgcttcttactcttctctctttttcaacagcatggctctcagcagcagcacattaaaatcaaattgaaatccaatgcaaggcttggctacagagcagctaaggtatctttttaattgctttttcctactctcaacccccttccagctcctccactacagtccttcaaagaaacaagcaacataaagagaaagagatgtagaaagtaatcataatagaaagcatttgctgagtgtctgttacatagggactccactgtgtcaacatttaacttattcctaccttgttagataggtagaacaatcctcagtttgcaaataaagaaacggagttttgactttaggtaacttgcccaagatcatgaaggtagcgagagaatgagccacaatttgaacaagggtccattcaatgcaagtactttttttttttttaatctccatttcattcatggaacaaataagaaaatatgattgcaacttgattagaataggtgaaaaaatgtaaaagaaggtagcaattattcttcagcctgctaatagccaagaacacaatgccataggttttgtttcaacagatttcttattaaataaaaaaggtagcaatttttcataatgaatgttttatacattattcctttgtgtatcaggcctctaaagtacacattattaaagtctattaaagtctgtatttagcagcattactaatgtgcctttggggaaattattacaatgaaacagcatcagtctttcacaaaatttcaattgtttaatattccttttcttatcttcaatacacgtgtctatttttagctataatcagacctcatcccaaatgccgtaatcccagcctagagctgtcacagcaaattgtttatgggttggatttaagaaataacaagaaacacagacattgttaatttcacccaacactttttttttcatgattggttgcagttttcctacagttctcattaacaggtgctccttgatcactatgacacgcgatgatactttatctctctggttagggttggttatcttaattaattgcttatatttatatttaactgaaactagcctcaagatgccactttattaaagtttgagagtggtaagaaattacaaaactattccattaaaaaaaatagaaaagaaaaccaaataaaccagaagaacatataaactatgattagtcaaatcaaatctctgcatttaaaagtaaacatcatttactagatgtctactggactagaaatatgtgtcttctgaacagtaactgaggagtttctgcaaattattctgcaaattgtaaataggcatctctacctttttattacattaattttatcacacagtatgaagtttttttaaaaacaaagccaatgatgtacatatattcaaaagcacaagattctctgaaaatatagaaaatactgctaggcttattttacgaagacaaaggacaataggaagctgggaagaataccagcaaacagctatacgttataaggcctctgtatcacaaaaatgaagggaaaataaagccaatctaaagtattacgtacttaaattaataaactggattggaagcaatcattccattataaatttcctttcatacatagcaatcccactgagatgatacctttgtaaaatcaggcaaaaatcaattgttaatattctagagatggacaaaccacagattaagtacctaaataatcatgtttccaatcaccaattaactaagtagaattctcttaattgtatctattaaggcctactaattgacagaaaaagggcagagttgaggacttggagaaagaagacagaagcattcctctgcctgattcataaaggtcagaatcccctggccgttgttgtaggaacccagccatcaccagtcacaaagaaaaaggcagcagcacactttgagtatccaaagggcctctttactgaggctgcatggctgttgtgggcttagtccaacatgatgatgtaggacaagaacctaccagttcaatcaacatgcaattaaaactcctgatgaaggacggcccagggcagtccattggtttggggcaggggacgcagagaagcaaagcctgttttaattaagaaaatactaggcactcctctttaaatcctcaaaaaatgaggatgaacaagattccaaaaccaacaatcacaatgtgtgtgaaagtaccagcaacaagaatgaagtgggactgaatatgtgctttcctacaaatgaaacctgtttgatggtgtaaggaaaatggatgagctgtggtcaagaataggccgaggcagacatctagtccagcatgactcagcgagtttggagtgcaggcacacagctctgcctgttatgtaaccatgccatgtgaggtgcattaagtaaccactcatgtgtgctcatgcttgactcggagccactattgtctgtaaaaggtataattaccctgctaatgctgtatgtaacggcttgcacctgtggctcatcctcaggcttgtacccatggcttgcttgtgcccatggcttgcttgcacccacagctcccgtgtgtccagagaataaagccatgttgaaatgcccccatgattccttgactggtctttcagctgcctgccactcatccaccgactctcctccgacctcagttagaacccgacagatggtcagtagctgcagccatatttcaaagaagttatcatgattcacagctaggcctctcagacttgaaattatattacagtcatgtcaaaacagatcctttcttctctggggcctatagggtcttaacacaaagtccagcttttctattccgaagacttaatttacctcctacctcttcagactctccttcatcttttctgacattatcagatgttaagtcaggccacatgaccctttcactcaagacaaggcattgccatatccatatgacacggtagtgggtgcacagagtctcagggctagagctcactttgaggtgctccaacacaatcattcatcagatgctcaaactctctgtacaaaaaggttcagattttcagcataagccctggaacatgaagactgtgatatggtttggctgtgtccccacccaaatttcaaactgtagctcccataattcccacatatcataggagggacctggtaggaggtaattgttaactgaatcatgggggtgggtctttcccatgctgttcttgtgacggtgaataagtctcatgagatctgatggttttataaaggggagttcccctgcacatgctctctcttgcctgctgccatgcaagatgtgactttgacttcactcctcctcaccttccatcatgattgtgaggcctccgatgtaactgtgagtccattaaacctctttttctttataaattacccagtctcaggtatgtcttttattagcagtgtgagaacaagctaatgcagactgcttcttggagaagtagacaccagccagtgcttcaccacacactgctctgagatttggtggtgagccatgcacacaaagagagaacaacggaaatgtgtttctggttagacagaaaggaggagaagagatgggactgacgtagaagcattaccatagttccatagtcaagatgactgtgtacaaagagaagtctacgtaacttaggaagcaatcctctggaatgtatatgtttcatacatatttacacacacacgcacacattatatgcatgcacgcattttaaagacaaatgagcgttaacatattcagttaattattttaaatttatcttatctctctttcatgccaaatcgaccctctactcaattacatggtaagttgtattttaaatttgcacttccatacctctcagaagggagttatagtgctattttcttccggaaacttcacagaatttcccagtacaaggcaggtggagacagagtctggaggtctaacttgccctttaacatttccatgcacctcacattcgacaggactcaatgtacacgtaacagaggggctacagtggcctggtgccagcaatgtttctttttggcttcacaaactctataaaaatgaagttttttgaagagctaagggaaattattccttaaaaatgtagaaagtgagaatagaagtgctacaatgtccaagggcactcactgaccaggactgagggtccagattcttgttagaggaaagcctgccacatataagacataggcacagtctaactcagtcgttttcaaactcatctcacggcccttttacaggctcacaaatgatcgcagaccctaaagagcttttgtttatgtgagttgtttctatcagtgtttaccatactggaggttaaacccaagaaagttttgcaacatgaagacacaggcacacatcccagaagtgatgtcattgcatgtcacagtctctttaaacaccgttgtgtatagtcaagagagaaagggtgaaacaggtaaattgtatcttagtattattataaaaatggcttttatcttgcaggcagacagcctgaaagggtctaagggtgcccctcccaagggtccctaaaccatagtttgggaaccactggtctagttcaaacttgtacacatcggcagtgtctttgaacacgtaaatgaagaaatggcacagtaccgagtaagaggatgtactgttaatttttaaaaattgaggcactgaatcaaatgatggcatctttttctagagcatttctctactcactactgcccccaaaccattagtaaattaaaatgatccttcctggtaatatgccaagcagaatgaccctaggtccaaatctctgttttgaccactctctgttttctatctgctcactaaatatcttcatccatttgcacctcaaatgcaaaacagctaaaatagtacttattttttaaatgtttggttactaatctggttgttaatgaaatacacaaatattgtagaaaagctgaaaataccaaaaagtattttttaaaaaagaaagaaaggtgtcctatgtttccaccctctgggaaggccatggtcaacattctgggcaatagccttccggtctttttatcatgtatattttaaaaatgcaatgaagttcatattttaaagataattagtatattttatttaaaaatatttttagtatgaaagaaatgcacattgcttaagaaaatctagaacatacaagcaaaataaagataatgctcataatatgttgatgtgtataagcaatctttattctgtgtgcatactgtacctttttttaaaaaatgaaatgattagactgcacatgctgttatataacttgtcttcttcgcaatttatttagaacatctttttatgtcactcagtattcctcaatccctccttggcatttttattatatggctgtactatggttattcaaaaattactattttaagaatattgtgatgaacattttagctaaacttctgaacacatccatggcggttctctttgagttaatgttctagaaatggaaattctgggacaaaaggtatgtcaattttttaggcgttgatacaccttatttaagtccccttaagaaaggtgttctttcattaactgtgtatgacagagcctgatgttccctactcccaacttcactgggtaaatgttacaaatcttcatcaattgtataggtgaaaaatactatctcatcattttaatttgcatttctttgattgctgttgaggttgaacatttttcttctattttgttgatcatatttctttctttgttggtcttacctttctgttcttggcccattttctattagtgtaattatctttatgttataaatctatattaatttgtaagaactcttaataactctttctcatacatgggtaaatactgccccagcttgtcttttatctttcagaatagttcagaatgtcttttgattgaaagaagttctgaggtgttacatagctaagtacattctcttccttgataatttctgacactagaaattaataaggccttctttattctaagatcatttaatttttagttgtattttcttccatgtcacaagtttagaccttgcaatagctcttcaaagtctgccacaaggaggacctggccaatgccttcagaaaaatgactgttgaggcttattaaatatagattggacatttggtgaaacaaaccattgagggtgtcctggaaaggagagagatcttttatgtttattattcaccaattccttacacaacctccagtagctctgttaacttgctctttaagaagtttaaaatgaaaaaagtgttcatattaggtttatgttaaaatattaaaccagtgggcgtgatgactcttcttacctttgccagaacagcagctgtcttagatagaaaatacctttgctacgttcataatgtatttcttgcaagcacagtgcatggcatatagtatgcacttgacaaatatgtgttggagctgatgttttaccaactagagctctgtatatgccaggtttggggtgagagaggcagggataataaagtctggacttcacagcttcatatgaaggaggtgcaatgaaagaaaaactccaaatgaaggtagaaactaaatttcagttttactttttagttgactgtagagatactgatctgcgtgtaaacgtgaaactgcctcagacctgggacagtaggatgtggtgctgaatactggaaaatattcagagaaaaaaaaattctgctgggcagatcattaagcaaaacagtggcatccacccactaaaagagacaaggggcactactctacttcatttggatgctttggcatttgtccaaagcaataaaaatcagatccagcttgatctgaacataacaaggaagaaacagttctcaagaagatcctttttcatgatgggggaagagagagggtcattttgtataataatggaaaaatcaattatttttcaatcagatggagtgtcctcataaatttaaagcacagaacagcatgtgacatgccttcataaaaaacaatgaccatgagggagaagagtaaaggatcataatcccaaagttgctactaagaaggaaagatctttcaagagaagaacaacacttttcttgctagtgtgttttctgtgaatgtacacagtggtcagtatgcactgaacgtacaccatcctgcacaatttgcctctacagaatcctgttcaattggcttcccatttggctatggcttttaagtgacacactgaaatcctttctctatagcatgataatgcagcagtaacacagataaaccagaaatgttggtttttcttactggcaaatatactatatgtaatatatatttacacatattagcaagaaaataaccaagaaagtagtagaaatacttttgacagaatttaaaagttaaattttggccaggtgaggtggttcacacctgtaatcccagcattttgggaggttgagatgggaggattgcttgagtccaggggttccagaccagcctgggtaacatggcgaaaccccatctctacaaaaaatacaaaaattagccaggtatggtggcacacacctgtagtcccagctactcaggaggctgaggtgggaggattgcttgagtccaggaggttgagcactccagcctgggtgacagagcaagaccctctctctctctctccaaaaaaaaaaaaaaaaaaaaaaaaagagttaaattctaattatgaagtttttgatcaacataaagattggaaagtcagctcttgcaaaaagctgcgaagaatgtatgaacactggaaagatggtcaagtctgcatgagggtttgggagaatgcacaccctgggaaaatatgtgccccacaatttctttaacatgtaagaatttacaatggttgtcagaatttacaaccattaatgcctgtttacaatatttaaaaggtgaataaataaatatgaggctgtctactctgtgtaaacccatgagtttgttatcatattccacgtacactaacatattccctgtagactggcctcagggatgacagcagattcttgatgggccttatgcgcaggaatgccctctgcttctctttttagctggcactgatacaccaacatgcgagctatccaaagtcccaaagtacacccctttctggtgtttcctcagaccctggcacagataggagttcaagaatgtgaggaatgaaggccctacctgatggacagcaactcatgaggtatcagggtagtcctgttaaattagtgcggccaactgctaatccttttgtggcacgggatttgggggattctgtgttttctagagggatggtctctaatggattcaaaagagagctgtcaatgtctaactgcaatcagcatcgccctggcacttcaaaggaataacaaggaccctagaacgccagggccaccctccatccgaacacctccctaactgaagtgccccgtcagtgagctgggatttaggaagaaaggagagcattacagtgtgtgtctgaggaagaggagagtgcacaattcgaatgtctccaactttctaggaacaaatccacttagaacgtcagtcacacccacaacaatatttctagcactccaactaacaccataattgaggaggagattctctggttttattcatgctgagaagagctgtttcctccccagagagtgacctattctttgtcttatgccaagaaagccataagaaaaatgctgacctatgaaggtgacacatcatgcttaatcactactttcaattaaaacaatataaaataaagaacgtactgagccactcaggcagaacataatatcccaagcaacagacacacctactgagacttgacatttccgaggagtctggttcccagctgtgtgtggagagtgaatccatgacattagatgttgggttgccctggagaaacttagggcggagctgtcacagcaaactgcatttgctgataacagatttcccgagttgccttagcttttcaatacaccaaactccaaatactaggagccaaaaaaggtttgcagccatggatctcccctcatccccacctccagtcatgaccctggggcagaacacctgcctactttccagtattctagcagctaacttctcaaaggaggcttaacgccaagtgtttaagctggggtggggttgaagcgggaaaactcagcactggtttctttctctttggctcagctcagccaaacaaaaactcctcaaaaacaattgcttgtttttttgctggtctcttcagataggataaagcggccagagtctcccataaaacttgcatctagggaaagagggtaagtgcacagagggcttttccagctttctcccacccctgaagctgcccagggcccttcgtgcccatgagaaggctgagtaaatgaccatgagaaaagtcaccactggaagagggtcctttagtagaagaatttcaacagggaaatgggctttctaaagtctagagattccatatgctcttttcacaaccaaaccatcgaacagggctgtccaactctaccacaatccatacaacaggcccacaataacacacctgtttttgtaggctccggaaacaactctcccctgttttaaatccttcagtggctcataggatctggcccttgcctccttctctgggcttatatttgaccaccttccacttgtgcagcagtttccaaccaaggggtaattctgtccccgtatgggacattgggcaataatctggggacatttttggttgtcacaattagagtgaagggaaggggatgctacaaaaaatcctaaaattcagaagacagtctctcactgcaaagaattacctggtccaaataccaagtgtcaaggctgagaatccctgctccagccataccaaactctttgctgttctctgagcacaccaggctttctcatatgcttttgtgcctaaacacattcctttacctggaatgccttgccccaccttccctgtccaggaaattaccatttcccatctaggatcctactcaaatgtcacctcctctacactgtctttcccagattccccagagttggatgttcctttttctgtgcctccaaagcttctggtacacaccttgctagaacatactcactatgttgacccaagatagtctgcacacgctaaaggcatctcaagttgtattcttcgtttattcccatagggcccatctggtaataaatcaccactcaccaatttaatcagggaataaatcaaaatggaaaagatgcaccttacactctcttggaactatgtctaagggataacagtgtccccaacattaaaaacaacagcagtaaatatgtatcaagtgcttgtaatgtggacaggtaccatattaagcactggtatacgcagtaactcatttcatccttgcaataatcctatcaggtaggtatcattattatcagcattttacagatggggaaattggggaaccaagaagtcaggccacttgtctagggtcactgacactagcatcccaaaaaagtgatatttagtcccaggaaatctagccccagagtctcaatattccaatattcatgccaaggcagttacactaaaacccagtatttcagccactcagaggcccctggcaagtataaatgacacctccagaggactacgcagccagagtagccaccagcacctgtgaccctgcttgtgggggatcacacgactctccaactctgaaatgcttctggcaggagaagcaacctcttcacatcatggaaagacatatgtactccagaaaatcatggtaccgtaaaggaaatacaagtgctgattcctcaaagtacctcttaccttgttcatgctgcagggatgggagcaagggatcagacatgtcacagtgcgaggaagttcttgaagattctcctcattcctggagccctcactttctgaagcagacagctgcactgtgaatataaacaaagaagaaatccatcagctggtgcccaggaaggcatagagcactgccatgtccagtggcacttgctgtcatgatggcaatgatccaagtctgcactgtccaacatggtagccactagtcagatgtggctattattgagcacttgaaaagcagctagtgcaaacgggggctgccaggactcaacagctagaactttcacagatttcctagaaaggcagtgtaccataagggaattcaggaggtcagtcttccatgggccaaatgaactaaacagtccaattccccccaaacagtccaattccccccaccatgttttcattcatgctatttattctttacatggcgttttttgattcatatgaattacattttagagtaaaagggtcattgtacagtttcagggttcttctttgtcttttttgtttttgtttttgtttttttggcatagagtctcattctgttgcccaggtttgagtgcagtggcatgaccacggctcactgcagcctcaaccttctcggctacagtgatcctcccacctcagcctcccaagcagctggggctacaggcgtgcaccactatgtccagctaatttttgtattttttgaagagatagggttttgccatgttgcccaagctggtctcaaactcctaagctcaagtgatcctcctgccttagccttccaacatgctgggattatgagccaccatacctggccagtttcaaggttaatttgtcaaatattaggggaaaatattttaaaaatgacttcaattacttaaatggacttgtagccttttcctctgaaaggtgtttacaggtggaactgagaggagagcaaaatattgtaaggttcctgatactcaatttgtgtgttatttttttaagttgcatctaggagggatttatatatctgcaccttcccataatacatggaatcggaggtttaactggaactgcagtgcttttaaaaatgaaaaatatactatttttaattataatatattaagactatagaaaatgttcaacaggaaaagaaaaaggtacttataaccccacaagcccaccataaccatctttagttcttagtaatcagcctttgtctacactggagaataacatgtctgctaactaagtccaggacatggagaattccaaagctgtattccccatattaacatctttcactgctaagaaaatgattttgcaatttacattttcaaagataaactcctactccatgcacattactattctatgaacataatattactacgttccttttataaatcagatgatagagagaggaaattgcaaatcactccttggctatttgaaatacagattccaaaaaaaataccacatgcggattaaagacttaaatgtaagatctaaaaccataaaaaccctagaagaaaacctaggcaataccattcaggacataggcatgggcaaggacttcaggactaaaataccaaaagcaatggcaacaaaagccaaaattgacaaatgggatctaattaaactaaagagcttctgcacagcaaaagaaactatcagcagagtgaacaggcaacctacagatgggagaaagtttttgcaatctacccatctgacaaagggctaatacccagaatctacaaagaacttaaacaaatttacaagaaaaaaaacaaccccatcaaaaagtgggcaaaggatatagacagacacttctcaaaagaagacattaatgcagccaacaaacttatgaaaaaatgctcatcatcactggtcattagagaaatgcaaatcaaaaccacaatgagataccacctcacaccagttagaatggtgatcattaaaaagtcaggaaacaacagatgctggagaggatgtggagaaacaggaacacttctacactgttggtgggagtgtaaattagttcaaccattgtggaagacagcgtggtgattcctcaaggatctagaactagaaataccatttgactcagcaatcccattactgggtatatacccaaaggattataaatcattctaccataaaaacacatgcagatatatgtttattgcagcactgttcacaatagcaaagtcttagaaccaacccaaatgcccatcaatgatagactggataaataaaatgtggcacatatataccatggaatgctatgcagccataaaaaaggatgagttcatgtcctttgcagggatatggaggaaactggaaaccatcattctcagcaaagtaacacaagaagggaaaactaaacaccgcatgttcttactcataagtgggagttgaacaatgagaacatatggacacagggaggggaacatcatacaccagggcctgtcggggggtggggggctgggggagggatagcattaggagaaataccttacgtaaatgatgagttgatgggtgcagcaaaccaacgtggcacatgtatacctatgtaataaacctgaatgttgtgcacatgtatcccagaacttaaagtataataaaaaagaaaataccacattcagtcatagcaatagcatattttaacaataatgtacaacacagatcttggaattccaactttgtagtacgaatacatccaaacatctccacatgtacatgatgcctgggtaatcatggcttcaaagtcaagaaaattcaatatctaattgtaattgatcttaaagtgactgaaaaaaataatgcatgtaacttttactctttcaatttccagaagcatgtgctaataaatttcttagttttaaagtagaactttatacatgctgtttccttttcaatgtatgtatccatccatgtaaaaactacagcctagcacttaactggaaagcttgcccaaatgcctagcagagatgcctcatgtcacaattcaatttctatgtacacattggtatcaacacaggaaatgtgggcacaagaagataataacagacaaggattcttgaacatcatttccctgaggaaccccacccagctccaatcatgccacaatccccgtactctcagaacttggataaatagcttgcactaaactgattacggatcccttcctgcccccgccccaactgttcttatgtcattttcatgtatgttgttttacaaccgaaacaggctaaaaaccctttgagggaaacatcagacacacagaacgttttaaaataaatattacgatagttttttctttgctgtcactcacagggcctaggatgatacagactcttaagtgtggggtcttaaaaacaatgttaataattgttgcagctgcctttggagttcttttaaaaaggaaaacctcttaatgccagggttgtaaatcttttaaaaaatattaagaatgtcatacaactgtatagtaccccaaactgtacaatgcacttttatatattaatactctcatttaatactaataccaatctgggtggtagttttcctaatttggaaaccagacacagagaggtaaaagaatttttcctggttcttgctataataagcaatagaccctggactagaagtgacttcatttcaagacgctatggaaataaagcatgtgaaagaccagaaataaaaaataaacacaacacacaccccaaaacaacacacacacacacacacacacacacacacacacacacgcacatgcacacaccaagaccaccatttaacagaaaacgcctcagagaacagatgacaattttagaaactgggtcagttcacttctggacagcaaccaaaaagactggccttgttctatcaagtactttccatctcctttgaaatcgagggaacctggttgttttgcagccaattcagtttatgaagaagcttagcaaaatctacagcttaaaaaaggagactgcatcttaaatataaagcattagggaaaaagatacctgagttaccatggtggaatcaagaatgttttcttttttagtttattattcaatgtttctttttattgttttaagaagttggattcctctagtactgaacaaaaggaaaactacagacgtctttaaagggtgccttgagaaagttaatcccataagcccgtgtgacttccactcagctgatcctaacagttggttcaatggtcaatcttagacttctaaaaggttaatgaaacataatttgtctttccaggtggatagaagcatgggtaagaagaaaggtggtccagaattacagaatcccagcactttgtgaggctgagacgggtggaccacttgaagtcaggagtaccagcctggccaacatggaaaaacctcatctctactaaaaatacaaaaattagctgggcatggtggggcaggcctgtaatcccagctactcaggaggctgaggcaggagaatagcctgaaccaggaggcagaggcactgtagcctgggtgacagagggagactccatctcaaaaaaaaaaaaaaaaaaaaaaaggcagagacaaagtaagtctaagaagaagagagaaatgacaagaaaagatgaaagatataaagaatggagaaaaacaaagggcggcaagcaaacaaagacactcagagataggtttggtaacatggccaagtgcccctcaccagccaggtcctcgctatggaagagacccagagatttgggctcctggtgacaattccacatcctatggcttctctgagggttatactctgatgtcttgggtgtcagcaaatgggagttggagaaaacaccaggcgtacctgattcaccactatttatttaccatcaacctccatctaccatggagagaagcctattttacctggatcactgttaatgtggtatagaggtatgctgagaataacataagccacctttaatcctatgctctttaaagagaagcttaaaagtgtcaagggctgtgtgtgtgtgtgtgtgtgtgtgtgtgtgtgtgtgtgtgtgtgctctcctgacccttgaaaatgcaactaatactgccaaatactgaatggaatatggtgagttgggcttttctccccactccaactcccacccccttctatgatgtccattctagaagccttcagtaatatatgtcaaagctgggtagctcaggcactcctgtgggagatagataggccaacaagagcaagcaggtcactcttcgcagtgttaaaggtctcactagcttttagacataacgtaccatgaggccagtctgtgggatggactcttgttcctacccttcccaccaccacgcccagcagcttaggcagagggctggggcatgagggcctatgccaggcccaagagcttttggagaaggagtaagtgaagtaatacaaggtgaaccggctctgaagtctagaaaaaaatgctcttgcatctaggacttagaaacttgggaaatcagatggacaggtgagagcaatatcccaaatttcctctactctattttaaggggtggagtaattcacatggctttgaagttaagtctggacaatcttcaactggagactttcaactgaaaaaatataaggtcattttattacagaaagctaatccctcccttctaccatagggggcatggtgctgggattgaaggatccaaaggcaaagaaactagactcctgcccccttcccccaatgcatacacaccttctttccaagtggctggctcattccctgcttcctaaagaagaggcaagaggaacagagtggagcttgccaaggagattcctgcaggtccctctccatcctcaaagttacagcagatgtgtggctgtggttctccatgacttcagtgtcctcgccaccccacatggaggcagcaaacacactataacatggttctgccccaagagaccagacgtttgccattctgctttgctcccctgtgcgctgccttcacagcataccatggaaaacagacattctaagccagaacaacaagagcatcttcccatcaagcatcaacaacagccttcctccccaaggataggttaggtaatttgaaaatgaatgttctgaaattttaactaatatatgagttatggttcaataggaaatggtaataaagaggaggaaacaagaggattataaattataaaagagagacacattgttggtaacacacgcacacaaatagtctgagagccagatggggagaaacagaggccaggaagggccaagagtgacaagtggtagagggtccatcactttcatacacccacttctggcacacaggctagggggttcttgcacttggtcaaatgataagtcaggatatctaatctttagattcagggctatcactgtaaaatgtaaatcgcagtctccagtgatttaggactatctcaatttaaaggcacaacacagaggagcccccaagaggttacttggcctggcccacttcccttgcctaagtgactatttaaaccaggggtcacaaattcagatgactgcaagggtcaagaaagaatgagatgagtgaaaggtcaggtctgggaagacagtgaggaatggggcatccggggagtctgctactcagctctagccccagcaaagcaggaacaagccccatgtgccaagagcttctgatactcaagaaacggagttgagagactgtgtaaaataatttgctgttttaatgttggaaactcatgctaatactttggaaattttgtaggagttgggtctggttggctagtttgcctcttctactgcacaccttccatgtcagtcaggggattctttgttcctgtaaacctccgggagagaaaactctctacctgcctcttggcccctctgggttgtactgctagggcttcactgcccacagaaagccagggagaagagtaggcaaagagagataggggccaagtcagtctgaatatcaactccacctctcggaatgtgatttttggcaagttactggctctctctcagtctctgttcctttatccctaaagctgggggaaattctttatatctctggagattcttttgaggattgttttgagcatttcacaagaagagatcttgtctattttgtactagtacccaaatacccagcacctatcccgctgccttacatacatacagtaggcactcaatatatgccaaatttaattataatgtttgggaagatctcctgtaagtctggcaccagttgaacctatttcctttcattctctcctcttctgatgctttaatgtcaatattcatatctacttctcgcttggtcagaatattttgaaattaaactttatagaagtccaaattaagaataaatactgaagttttttcttaagaagcatggcacacttttaggtcagcaaggcactatttgggtactactggtgacagctttttgcgcactttagaagaaaaaaaactaaacaaaagagatttcattgtcctattaataaattaaggaatcatgcattaagtttagcattctcaactcatgtttgccaatagtgcacgtcactgcaaagggagtacacagtggctattccaggcaactcttgatccatttgttcactttggattgagaaggctgaattatattcatctagaacaaatgtttactaaccatgtcttatttacctgggtttctttgattttatgctgaaagaatcccagacccctccaaataatttcaacttccctctcccttggcggggcggggggagggggttgctgtacaattcaggcaaacatatttcctatgatttggtgagaaactgaaataacagacagcctgatgggttacttcagagtgatccactgcaatgggagcactgttaaagaagcgttaagggggccagctatctctccaataaaaagtttctaattaaggaactaaaatattctcaagaagatcttggggacaagctataagtaggatgttaccttaattggggctagtgcttacaactgaaactgcttagcaagccagaatgggttatatgccttgttcctcttgagaagaaactttcattaatctgcagaagaaaactctagttggcctgaaggttcactgttaacctctgcttttctggggcttagattctgttccttttttttttttttttttttttttttctgagacagggtctcactctgtcgcccaggctggagtggagtggtgccatcttggctcactgaagcctcaacctcccaggctcaagtgattctcccacctcagcttcccaagtagctgggactacaggtgtgcaccacccatgcccagataattttttgtagagacagggttttgctatgttgcataggctggtttcaaactcctgggctcaagtgatcctcctgtgttggcctcccaaattgctgggattacaggcatgagccactgtatctggccatattctgtacttattatcagcatctccttagtgcagcttattctttttgagggagtaccatgtcccaggttgttaagcctctccacagggatctagtgtttgcctccactatggcctgagggcgttcaatgctctcaaaccagtttctgccaaaacagttgaagttataccatgcaggtagtagtgtaactatgaaccccagagctattcaaacagtgtaaccctgggtttccatccccctggtctgtgccccaacacacagacttaaagccccaaacagactggggaaaatcttcttgcccccctttcacaagcaattcctgtgtgagtatagacaccatagcccctagagcctagagcctacagctgggtctgaaacactctaaggccagtggcatcaatgtcttctggcacctaagaatttccctgtcctgctttaaagctcgtatgtacttgaaaatatttaaccaatataataccttaggactttttggggtgggtggtcagaagtaggccaggcttaggactttttggggtgggtggtcagaagtaggccaggctgcatgagctcagtataccattctgccagaattgggttccctaaatgcaattctgccatatttaggttccatatgtagccaattctagctgtcatttaggctacaactagaattatgttctttgtagcctaagctaattgctgtgactctttcactaactcatcctcattacagagtgccattgggggtagaaagtgcttacgggtagcccaggccttgagaaacctacccttagccagaagcagcaggtccaggcagttaccccaaggaaacaggtcaccttccttcccaaggctgcattttccacacccaagtctgccctcagttctgtggaaaggaatctgccttccattaacttttccataatttagaactggatgactgcacactgatgttttagtagaatgagagaagcaaagacagcaagaaatgcaacaagggcacaaccaccttaacacatcagggaggtctgcagggagtcactgcgttctccgacagcaagcagccaagagaacagccacagaaagcagttccagcagctgaccctggggtcctctctgatctcattacagcagttgacactagtcctcacaaaacaaacagaggaaatttatgcttgccttagctgtggaaagctccacattccttattaacgagagtttcagcttctgagaccacagccgctggaatggggaggaggtcagctgtgctcccaagaaagaactgtggctgctgccttgccctctttctggggctggatatacaggcagcgagcctggggcctaggctgtctgctcaggtgactgaggggaagttccctttctgctaatgtcgacttccctcggctcagacggtggggtcatttcctcttaaacagcactgggaaactcactgtaagggagtcctgaggggatccacctgctaaggtcgcaattccaagagagaggttgttctgcataaccatactcaaaagtactcttgcctgcaccttcaaaaactttacttaacttggaattccaacttaaaacattatttcatatcctttaattcaatcttagaagtaactgagcagccagctcatgacgtaaagcgtgagcttctaaaccagagtaagaaatgtggagcagaagttctgaaccagagtggttttgtctcccaggggacatctggcaatgctgtagacatttttggttgtcatgacccgggggagggtgctactggcatctagtgggtgagaccaatgatgctactgaagatcctaccacgtacaggacacaccccataataaagtattactggtccaaaatgtcaatagtgctgagattgggaaatcctgacggggagggaacattcaaggatatgggtagacttaaaatcatgccaactcataatcacattataataatgtggcaccatgcaacttggggtccccaaaatgtaaacaattaacaaccataaaaatttaccagttctctccttgagcgaagtaaaagctgtaacttacacagagtaagaccatcagagttgcctggaagaagtggaacagcttcagtgttggactatgttatcatcaatatcatcagtgccttgtttactccaggtcaaggtgtgatctgagtgtctactatcaaaattcagtggtagctattaacagaaggagtttatacgtgaagttctatggtcactaaaaccgtctaaataacctaagaatatctagctctggaaaaaactgcaaaatgtttcaacttttaaaataccaacaaaatatgaggaacaatgttgatgttgacctacattctatctagggtggctaaaagaaatagctgcacaatagggttctaaataaatgcagaattgaagaaatgcatcataacaaagataatcagggtgactattttgaaatgctccccatttctgtttttctttctgttttcaaatattccctctcatccacgcggcatattttcattacatttgttgtaagaatgtacatttagataatctactcactattcttttatgcattcttttactccagccaaaaagggaaaaagtccctatccaaacaaagctaatgcatgtaagcaaatttgaaggaaaaaaagaatttcatgaatgagcgggagacaattttttaatggaatgttttaaaggcttgtggtataaacagtaaacaaaattgattcactaacattaatactgtttgccatgatgtgagagttggtctttttttttaatgccccagaagctaaaggaaaataaatactgtggtagggaaaaataataccttacttggcattttgaagtcattgctcaatccttcttgagcaagaaaaccatagtaatgactttgttttacctaccgcaattatggtacacctcgcagcaatccttcacaatattttcctccctctgttcaagtcctgctaaataatctctggaaaccattaactaagagtacggttccaattttcctgttctccctcctctgctgcctcagtgtcatgttggcgtcaggacaaagcaaacttgtatgacatcacagagcaaactcattttctgtaaaccagccccttggtagtttaccgctactggaacccaacgctgtcaacagtgtggtctttgtttggtgggtgttgctctaaaaatttttttaaagtttcccaacaccttcttcttttaaacagaggcaagctgctggaggcgccgtcctcgcctggcccgccccactctgtaaactagacattaccttatacacaaatgactctaggcattcctcagtctagctgcctcactgcaaaattcctatgctcctcagcagcagggcagcgcacattcccctggcttcccctctttcctcttcccccaccctcctctttttcttttctttcttttttttttttttaatttccactgcctcactgtgtttttgtgtaaatgatctcacatgactcaacaaatccatctgcctgaagcaggccaagtctggagccctcccaggagggaggagaagaattgctttgtggaaaggacctggagctctgccctttctctggctcgaattacccgcctgtcaggcctgacggatttggctaaaaataaaaggaaacgggccgtgaaaagcagatgaatgggctcagcagttccttagataacacaggcctgctgttgcccaaagctccccaaacagaaacttcaaatgcagggcctctgagtcagtgatgtggcttccaggtgaacgaggcctgtcaaatccactggagttgggggacatggcctgggctgtgaatttcggtttcctttccgtgtgtgtgtgtgtgtgtgtgtgtgtgtgtgtgtgtgacacagagagtgagagtgcacgcaagagagattgagagagtgagagaaccagtctagtattaaaaggttctcagaaaacagtagacttcagtggagtgaaggcttgtaaaaaaaagaaaaaaaattgttgtttccactacaaaattatccttctccccacctccaacaccagacattttcagcctccctatgatgtcacttctctgtttagagccagcaaagagctaaaagtctttcttgtaagtgtatgcccagcgcctgcagtgggtattaagcacttaggttggcaatgtaatgacacactgtaacaatctgtaatatgaggcagtcagcaaagccctggctctgaaagctatttctcccgaccattaaccatatgtttggctcctcagatagccaagcgggtgttccagcttaccatctggtttctatccacacaagcaactgcaaagcacaggctatgtccctctggagctgtgtgtttctttttctctctcttttccgctcttctcttcccctttcctcctcccagctcctttggttccttctgctaaagaattctctgccattcatcacgtacaaagaaaactttacctgacatggcagcggcagagccattaagaatgcacagctgtattgtaaacacgccagagggccatttaccatccgcggaatctgtacaagtcgggctctaccccttcctcatctactgagtgctgacacttgatccagcatgttaaaaacaggtacattcttgagagatccaggggttgctgtggtgcccttcatactcacttcatattctgggagtggggctttaaaacacatacacacacacacacacacacacacacacacgctcccgaagtttgcctctgcattcaatctgcctgacgtcagtctcacacaggatgacataccaccactgcaaataaccaacttaactacaggttttgattcttttttctgcactaagggtttgatcccaagtgtgtatttttctgagtttttttttttccgcctaaacagcccacattgaaagagatgacacttcagaagaataagaacatgcagccgcttgtaacaaattgacaacctgcaaaacttatgcttatttacatctgcactttttaatagtacacagcaatgaaatggaacctactatcagaatttatagaattttttcacaatgtttccaaagtatttaccccagagtttctccgctacaggatttaaggtcctttataactctatacatttttaaatgtatgaaggaagatgtatttgatatatagaaattaggtcacttttcttcctgtccccctaagaataaggtctgcattagcagcccattttaccgaattaggaaattaaagttaattctttcccacacactgaaaaaaataagggctggtttctaacatatcaagaacaaaagaaagaatatcattaaaaagtgactaaccagaatgtcagattttatcaatgtggcagagctacagaggatttgtcaggggaggactgtttattcaggctaacaagggtgccaggaaggccactacctatgtaaacttcttaaacccacagcccttgtcagtcctcatttccatgatctgaaataggtgttgtgttagctatttctatcaataagggacattaaaattctgctgcatgtaggtttttagagagtgacagaaaaggaaatttttaatttcagaagccttaggaaaattgtccacagatgatggcgtctattaaatgctgtttgaggtctcaaaaccataatacaaactttaaattgcattagcttgactgccaagaaaaacaataacagcatagttaataaaaagaaagaaaaattagcaatttaaaacttcagtattttcatagttaactacctggttttctaagcactgcagaatcattttattacaggtatttgtgcttttcataaatactggtgcctgggcccctttcctccagctcaattatacaaggatccctgagtggggaggtatttttgaaaagcttcccaattttgtgcaactaaagttgagaagtgttgccttatgtgaactaacatgatagtagaaaccatctcatcaaaataaaaatgaaacctttggtatagaaatgtaaatgaaatttaggaatagaacagtagctttccaaacttgttctgaagtgaaatcttcaatcaaacaaaatcttatatgaaatccctataagcaagataggtaaaaagcagtaatttatactgtccttttatacttttagtctgtacaatattcatggattttttaagttcaaagttataattttttaatcataagccacccagtgagaaaaaggaggccattttattgaacacaaaacctgaaattgaggttaaggctgaaaggtccagtcctatacacctcagcatctaattttttccatggccaatggttaagatgatcaaggtctgatgtatataaaaatagcagtgtgtatagcaggatgaaaattagttcataagttaatgtaataaacatccattaagtgcttactacacacgaggtactgccctgtggtcatcagagaaataagttgcagcctttcccttgaggagtctacttaagacgacacctaatggcagaacagcaagacaaatgcaataatggaggtgctgagagacactatatgggaaggagtggctaattctgcttgaggaaatagggcgtgacatcaccagcaagggacaattaagtcaggtcctaaaagtgtgagcaggatttttgacacctaaaaaaggagggacatttcagaaagaagaaactgaatgtgaaaaaaattaaaacccgtaagtataaacagggttggtgagtctgggggttatgagaaattctgcaagggacaggaagggctgggagatgaggccaaagaggtaactgagtccaggttataagaaactctaaatgtcatgatatagcttagaccagtgctggccaacagaaacacaaggtgaactaaacctgtaatttaaaactttttaataaccacattaaacaaataaaaagagagaaatttacttaatattatagaaaaaagtattattttaacatgctatcaatataaaaagtattaatgtgctattttacaaattttgttcatactgagtctttgaaacagggtgtggattctacacttacggcacatctcaatttggacaagccacattttaagagctcaacagccacctgtggctagtgactattatatttggaaagcacaggtttagcccttattttgcaggcagtgcagaccaaaggatatgcttggttttatttcatgagacaatggcaacaatgtgaagaagcagaaacattgggtctgggagaaggcttctgaggtggcttccacagtccatgcaagggacacagagaagaacaaggctcagagcaagtaggatggcatggaagagtcagagtcagaagatacttgtaaaaggaattcagaaaactttagaagactgtatgtgagggatcaagtgaaggactcacagaaccattacatttttttcatgctgaaatttgtgcttagaatgaaagctcactgattgtgtatttaatatgaagtttcattgttccttttgagcttgcttccttctgcagtagaatgcagtgtcacttatgtaggatatagtaaattcctcttcaaagaaccaatatggtacgttcagcatgttcagctctcctgttctttgttctccattttaaagtttaaaacttcctcgttctttatgtctccttgcccctagtttcagtaaacaaccccctcttagcctctatcatctgctcttagtcatccttagtcacctgctctgtccttagtcaactgctctgtccttagtcatccttagtcacctgcactgtccttagtcatcctctgtcacctgctctcaaacagtccttcctgccgaaactactcaacccgccactctggcgcgcacccctgctctctttaaaacagccaatcggaattagcttagactgtgtggtccaaccctagccaataggggaaagacacagcagtagggactagctgcgttaaggataagacccacttccccttccttgtccagtgtgctctcgccattgctccatccatgagacgcacccttctatagaagcaaattgccttgctgagaaaacttttgcctgggtgctattttcacttggtggcaccgagcatttacttccaacacttaataaacatgtgctgagtacccaccacatgttaggcaacgctgggcactggggaagcaaagctacgacataattcttactttcaaagagctcaaatacagtgtaggagacaaaacaaattacaacagagcattaagtaaattaataaacagatatgcaaagaggcctacaaaatgttccataatgtataacttagaactgtttcatataatgtattcaatggcacttgtgagatggagtggggctttcagatagtaaggcttctatcagctgacttttttgagacagggcctcactgcagttgcccaggctggagtgcagtggcgtgatctcagctcactgcagcctcgacctcctgggctcaggtgattctctcacctcagcctcccaagtagctgggactacaggtgcacaccactacacccagctaattttttttttgtttttttaagtagagatagggttttgccatgttgcccaggatggtcttgaaaacatggactcaagcaatccacctgccctgagctcccaaaatgctgggattacaggtatgagccaccaggctcagcctcaattgatttttaaaagtgatccagaatatgatttacttctgtgtctgtatttggttgcactcactgtattaagagaatcctgatactcctaaatacagataacactatctgaatctctgctctcaaaactcaaattttcagacaaatctctcgctatttgctactcttactacttactatctgaaactgagaaacgaagctgacatgaacataacaagttcaaattcctttgcactggaatttacaatgggaaattttggcacctgaattctggaaatgagcagatttgaattgtaaggcacagttgtattggaaattataacagttctttagcatttcatttgataatctcataatatgcctcaaaactaatctaaaagcttggagaaaatgcagcagtcaagattttatttcaaattttaatcactaatgataatttgacaactatttaaggtaaaagagtatccaaaatgtagagtgggtagacatgatcctctaacagaatgtacatcactaagtgatgtgtgtggtgttcacttattgtacaactagccattaatccacacagaagcctccatcccacagaggctctgaaacgctgcctggcatgtcatcaagtgtgctgaatatgtgtgacaagaggaatttgcctgttcaatttatgatcaggctggaatatgaaaaatactgggatggaagttcctaatcaatgattcatttatttataagaagttcaaatatgtaagccaaaatagtggaaaacactatttcaaggttgacttggcagtccaattcaatgtgctggtggtcctaatgtgttaaaatttggtaggtagcacatttgtgtgcattttcttttattatagttataaaacatagtttaaaatatattaaaatgaaatgcaaattagatgtttgcagagcctctgaagtatctccagggaacttctgcagaccagagtttgaagatcactggcttagggactttgaggttaaaatgtaaatggaagaacaacaatttggtgcacctgctattttaaggctcatcaagtcattcccaaacttcagcccagggcagaaaccattcctcattatcctaagagcagtgaagctgagaaacaaaactgcagaaagtgttttcagattctctggtgagttagaatttaaaaggctgggaccaaaatttgaaatacattattcatatctcaatgttgttcatccattaattcattcaacaatttactgagcacctgccacgaggcactgttctagaggcttgaaatacatcataacaacaacaacaacaacaacaacaacaacaaacaaggttgggcatgctggctcacacctgtaatcccagcactttctgaggccgaggcgggtgggtcacttgagcccaggagttcaagaccagcttgggcaacatggcaaaactctctactaaaatacaaaaaattagctgggcatggtggtgcatgcctgtagtcccagctactcgggaggctgatgggggagaatcacccaagcccaggcccgggagttcgaggctgcagtgagctgtgatcatgccactgcactccagtctggataattggagtgataccctgttttttaaaaaaatacagacaaaattccctatctttgtgaaatttagagttagtggggagagacagacgataatcacaaataagaaacttgttgtaaggtaacaggtgacaggtgcactgaaaaaaattgggagtcaggcaaacaccacatgttcacacttatacgtgggagctgaacaatgagaacgcatggacacagggaagggaacaacgcatactggagcctgttagaggggggtggggagggagagcatcaggataaatagctaatgcatttgggacttaatacctaggtgataggttgataggtgcagcaaaccaccatgccacacatttacctatgtaacaaacctgcacatcctgcacgtgtatcctggaacttaaataaataaaaattggagtcaggaattagaactgtggtggaggagaaaggctgcaattttacataggatagtcagggtgtgccttactgagagaaagaaaaagaggatcagagatctggaggggagaggtaaaccaagaggccatcagttcaagcagtggttctccaagcggggtcctaaggccaccagcattaccctgaaacttgtcactagctcagaaatgctagagaggcacccagtggtctgtttttgcagactctccaggtgattctgatgtgctgtaaagtttgagaaccactgccctacagaaaaggccctaaaataggagtgggtctaggatgttctacagaaaaaggggtgaaaccaggcatctggaggtgagagccaggaggacggacggtggtggccacagcatgaatagctttatgatcacagcaaggctttggctcagaaaaatgtggagctatgaaggacttttcttcaggagccacacagcctacatttcaaaatgttcatgttggctgtttggttgagtggaagcactgcatgacttgcctcaagaggagactccctgactgctcaactccattttgggcagtggtatgctgctaaatgtttaaaaacagactctgagggtgaggagcaccaatttgtagtgtttgatttccatggtgtaaactctcccaccatggctgatttcaagctgccagtatgactcactgaacatggagttgtgaagagatgtgcataaacgactcacaatactgactctagtcccaacgtcactgttaccactgagaacatttaaaaataagggagaattctgtaaatctgattggaaatgtgaatgctattttataagtctatataaatgcaatgtcttctattggtctattactgtcaatcaaacacagagcccaagtccttagaattttttttttttaagaggcagggtctcactctgtcatccaggctggagggcaatggtgcaatcacagctcattgcagcctcaaactcctgaaaagttaatacaacaataatatattaacttcatttagagaaaacaccattagtattaaatttcagcttcctttattcaaaaacatttgttattgaatttctcttctcttactacaattaacatcttgcactctcaaaaagtatgcattgactaggatttgccatgcatagtatgtgagattgctgctccaaaggctcacataaatccaagacaggccatcaaggaatgtgcgtgaactgcaagaataaaagtttgaatctatctgaagatgaaatgaagtttgaataaggccttcatccatttgatttgccattaagaaacttttcttagcctaatggaatatccctacttctgtcaatgagatttcagtttgtgaataacattttcaaagtgcagcatcttctgtctacaaaaagacattctatgaactcttaatacacataaagtgtttgcaactaccaggagtctgctccacgcattctcccgtctgcatgatccctcgggcggtataccacccacactcagaccccgggcagccagatcagcaaatgtgcacaagcctgcactcctgtcaaacaatggggtctttcaggccttacaatcttgtgaagaaacaggctaaaacgtcatgggaaaaattaggaaatatcagaggaaaacagctcacaaaatgaggggtggaaccacttgctcacatgttctaatttctgaacaaagagaaacaacagtgacagccccctgcctgctctgacccctccatttcaaaagagaggcatcctaacccctttttcttttcttggagattacagcagcaagatgtagacagacagaattagaaattcttaaacctaaagaagcagagttaatttcaaaagctttatcctcaagagaagcataactaacccatcttaccagccttgtttggtgatctgaaatatcaacaaaattacagactagaaatcaactagacttcaacaaccacataaaggaaaacagaaactcctgatatatccctttaaaaaaaaaaaagctcttccaaagtattcttggtattaaatctcatgcaatagctagctctatccacctcagcaatccttcctcattaactgctacacccagtttatacttttcataccagcctagctagctggcctagtggcctgcaacactccatttgccatccccagcctttatcaagaattgttccacttgtaaattacctgtctctttttatccacaaaataacatctctgtttaaaaatctatttaagacttactgcaaaaatgatttctagattaatccagtacatttgcaaacttgccaacaaatttacacttctgctttaatatacttttataatccatctatattttccagttgattacattaatctgactttactaaaatctctgaggataaagtctgagtcaattcttctttacataatctccaactttccaccatatcactatctatctgtaagacgctatcagccgttaaacactacaggcacatcagctgctgtctcccaatagtgaggctgatggtcagccattttgggaaaagaaccataggtggattattactataatgcattatgtggaagaggtgtttattttgctcctggaagaaaaaaagcaacatgtattaaaatcataaaaatgtttttaggttgggcgtggtggctcacgcctgtaatcccagcactttttgggaggtcaaggcaggcggattgcttgagaccaggagttcaagaccagcctgggcagcacagtgaaaagaaactttgtctctactaaaattacaaaaattagccaggcttggtggcacaccaagctattctggaggctgaggcaggagaattgcttgaacccaggaggtggagggggcagtgagccgagatggcaccactgcactccagcctgggtgacagcaagacactgtctcaagaaaaaacagttttaaaaggtaaaacaacataaaaagaaatattctatagtggaaataagagagtcaaatgaggctgagaactttacaaagggatcttacagacatgtcgccaatatcactgcatgagcctaagtataagaacaacctttggggagaaaccatcatttgacagtgaggtacaattccaagtcaggtagtgaaatgggtggaattaaactcaaattaatcctgccagctgaaacgcaagagacactgtcagagagttaaaaagtgagttctatccatgaggtgattccacagtcttctcaagtcaacacatctgtgaactcacagaccaagttcttaaaccactgttcaaactctgctacacatcagaatcacctggagagctttacaaactcccattgccgaggtcacatcccatactaataaaatcagaggctgggcggtggctcacgcctgtaatcctagcactttgggaggccgaggcaggcggatgacctgaggtcgggagttcaagaccagcctggccaacatggtgaaaccccgtctatactaaaaatacaaaaaattagccgggtgcagtggccagcgcctgtaatcccagctactctggaggctgaggccagagaattgcttgaacttgggaggcggaggttgcggcgagcagagatcatgccactgcactccaacctgggctacacagcgagactttgtctcaaaaaaaaaaagaaaaaaaaaatgtctggggtggaagccaggccatctgtagctcttaaagatccccaggagattctaatgtgcatcagagttttagaaccactgtcctagactctgtcagtacaagattttgctcaatgaggaaaaagcacgataacttacatttaagttggtgacaggtaaaagcaaaggttacctctgaaacttttaagtaggaaatcactgctttggctgcaacaagaagtttgtgctctgattctcataattggtgtagcatacagtctttaaacagccctaaatgaacttgcggctttgcgatttagactaggagagagaaactaggcatggtggtagatatgagcccagataacaactgaattgttgcccattgtgccgtcgagatatttggcttgagagcctacagcctggatgcaagtcctaggtcagtcatctgctggctgtagagctacaggcaactctccaacaacataaccctggtattccatctgaggcagtggttcccagccctggctgcatattagcaaacctgggtctgggacgcaatccccgacattctgactgatccagaatggggccccaagatccttatatttctaaagttccccaggtgtggttatgtcatatgagtgaggagaaccacaggcagagaggttttgagaaaggatgctgaggccatactacgtgggttcaaatccctgctccactagttactagctatggctcagtttccttatttgtaaaaacggagataactgataacacctcctttgttgtgaggcttgactgactgaatccatttattgatctcagtggattattgtacggatttggcataacacctggtacatagcaaatgttcaattttaatcacatgcatcatacctatacatgtgtacatgtgaatatgtcctaaggattaaacagtttgatgcatataaagggcttagcactgtctccatatagaaaatactcagtaaatataagctgagctgatgctgacagtactggtcgtaggacaacttattgcaactgactgtcttctgtctggaatttcatcctttcctcactgcatggcagcctttgcttcagaaaaccacaactttaaaaggtatggggataagaataaatcattttttctctttcttttaattattaagaggtcccactaacaatgaacggtacttctactgcaaagttatgatgggaatgtgggcttaatggcaaagaaaagcgatgtggagacctggctctgcccccacatgatgataaatagcagaacttgacagccagaggaaactcagccccctcatttcctaggggaacccagagttgaaatgtgttttgctcaagatcacagtgtgagtggcagaactgggatcagacttaggaacagagctctttagtttccaggttgcttccattgatcatccctggtgagaagcatgcctgagaggtgcattatcatgtggaagatgctgtccttgtggtcaaggccaatgtgggggatgaggaatgtggtaccctgtttcccaattgcttccttcctctctctgccgaattcccttccctggtccaaattccacaccctgcaggccatttccagctgaaagggaggacacagagcactagaaagcagctgtggtttgtttgtggccaaactgttttcttaggggtgttcagttccaattttataacagaagacaattatgaaaagggtttaatttcccaaattttcattacatacaactgtttagagataggcatatataaatggatatgtgcatactttttatctatcaaggacaggaaatcctgtctttcagttgctaagtctcagactattccatctgagtatttttgctgacaaatgtgaccttgtctaggttctgcgggaatttaaaaattccctcaatgtcatttctacttgaccttagcaacatgaccaaactgcaaattcaaatgccattgagtaaaggtacaacattcacatcctgttaccaaagcgttctccaactccaatccagtgaccctgggccagagcctaatccaaaagattacaaagcaactttctgatgagttgtcatggcaacccctagatgttagatatttcatgtcatccctgggctgcaaattctcatttttagtctactcatatcctactatttcatgtataacaaccaaccaaaatgcaatttgaaatgtcagctgccaaacataataagagatgccacttgctattatagccaataataaaagatttctagttgcttgtttcagagatacagcaaatcactgtgtattctaagtccactgggctggtcctcaaagtgaggctatttagctagacttccttagtttttatttaattagtcaatatttaagagagccttggagataaaaagaattctagtgaaacctaggcattattattttccaaacaggaggaaatgtactgatcttcagactttcaatagacatgatatatttggtctgagagagagagacagagagagagagagagagagagagagagaagcccaaccgttatctaaaccttttaaggacacaattatacaagagtgccttgcaaggttttcaactctttataactggaagagaggaaaacacttattactgaaatccagataatcaaaacactttgttttaatcagcagtttctacccttttcacattctatatcaattcacaaggagtgaccttcatcttaggtataatggggtcaaaacctacctctgcaggtgtttctcccttacctgccttaatctgtggcccaggttaagcacacctgcaggcaggctcaacccaagatagccaggagttctattatgagtagactgatgtagaaagatctctcttgaaattccctttagctgacaaagcattgaaatcacctctgcaaatagctggaattgtgtatttatttttcttttctctgtttaaaatttagcagaaatgttaataagaaaagaaatgtccagtagatgaacaacaggcccagaaggaaagagaaatgaagaccaagataatacacaaaccagattatcaatcttgaaataatccagaagtagacatatgatagatcatactatgtgagtttttctaatcctaaacacaaagggaatataaagaggtgtgcagtagggctgcatgtcaaccactttaaactaatgctagccaatacctgtgtagagctgcaaactatttttctgctagaattttaagagaacttttaagttttgaaaattgattcccatgacacttctctttccgtcttcataatagctgccaaaaagttcaaaaccacatttatggcctgtctctaagaagtccttaaatggtctttcttgacatcttttattaattcctagcctcattttctcacttttttgttgtctgctttagtggggagtatctctgaggccaaattaaaactttttacaataatacaggtgtattattcaacagatagccttcattaagcctcaaatatttatgggggcttctcttccagaccatccctctttgatccatgaggcaggagatatcatgtttcaacaagaatttgtttcagttcacagagaagctgaagcaacatcaatttctcatacttgtttcaatcacatttggaattgataagctaaaatagagaagagtgctatgctaggaagctgggatcatgaggaggtgagaagccaccttttttttatttgggagcttgcactcatgactttggccagaccccagaagacacataagttccctgtggtaaagtatttattggactatcacccaatcctttcttctacatgagaatatcactttggcagatgtacaccaaagccttctctgggtataagtcttcagcctgccttggatggatcttgtctgcttccgtctgcctgtgcacacaggctgccagccccactccaccctccagtaaaacctacttgactatgtatagtgctggcttagaatgacacagatttaggttcaagttttgcatcctttaatggctatatgaccctggacaaggtatcaaactctatgagtctcaggtacctcgcctgacaattgggaataataaagagtcccttttggggtttatgtgaggattacattaatgctcatagggtcctcgacaaaatgcctggcacaccaaagtcaatgctcaataaatatcagcgattggtattacaattatgttattataattctttgaggaactgctggtggccagtgtaaatcctatggtctttatctctcctgaccccatccacaggctcatgtgacaattttcccaggatcatttcaattttctgcgatcagagagaatgccagccacggccctatggaccagggacaagatagcacacctgagcagaaagaaagaggaccactagccttgggatagaattatccctcacttcaccctcactgtcggcatgttcagagactaagtgcttatagaaccagactcagggttttcctgttagtctgaagagtgcttcatctcttctaggctttcactggcagagccacaggatgagaacactctcggccccttatcaccacccacatcagcaacactgaggccagcatcagggtcttctgggctgtgcggattggggagccgatgatgtagttaagtttcctggaaatacaggcagcaatttcctgtggcttcctctgtttttgatgtagagatgagcacaggtaaaaactaaacacatcaaggatcagcgcttcagtcggtggtgcaagtgcggaaaaatactgtcatttcctcacaaacagattcagaagtgcaaagtataagccactttccagagagcatgctccccagcaaggacctgtacagtagggctgtgagttgacagtgaatagatgggcattcccatgaacttacttgcttacccaagtgatcaagaaccagaatttccatgaaggtcaatgttttgtataaaccttagcctgaaaaagctctggtctgctcacagagcttcagtcaagccttctccagaatttgcagccaggtcagaaaaaaaggtcactttcagaagtggaaagcagtacaaattttagttaaaattttagatgaactaaactgtttatacaactatcctaaaagatagtttagaattaaataaaacaatgtgcactacatttgggaaacagccaggttcaaagaaggtggtcacagtgtattcttagaaccagaatggaataaagaaaatgatacatgttatggttatgatagcataacctgctgatgaaagaacagcagcagcaggatgtacagtttgcaaagggtccactcaaatcagagtgaacccagatggtgctagaggcagcctagggccaaatcccacctttggcactcactagctgggtgaccttgggcaagtcatttaaacttccatttcttcatgtgattttgtttctccatcattggctccccttcctttgtgaaaagttgcccctccccataccaactggggcacccatcatcatagtcagcaacctgacctaaagatagctcaggtataagacatggtaaaatcttttttgctttagtccgttgcttgtaaccaaaaaaccaagaccttttttcggctgcaagcaaaagagatttaacacctaatttgcagaagttgctaggagcattaaacgaagtcacacaaagcaaacacaagaaatgctggttgcattcatagaaaggaagattagtgtgtggttaaaagcaaaggtattgagtccatctgcatgggttcaaattccagcaccccttagaacagagataaatcacttaacatctttgctctcggtttcccagtctgtaaaaacagagctaataatagtaattacatcacagggttgtgaagattatgtcaaagtagataaagcatttagaacagtgcccaacacagtaaacattcaagaattagccattattattacaaaggtagaactgttttgattactgttaaggatgttgtaaaagtcagtgatctatagagaaatgcccttcaactaaaaaagccagggattgtggcacaagcctgtagttcccagctacctgggaggtggaggcaaagaggatcctttcagccaaggagtttgagcctgggcgatatagtgagaccctgtctctaaaaaatttttttaaatttaaaaacatttttaaataggaaaagaaaataatccttcttctgggtaatccagcttgatggacaatcccttagagacaattagaaaggatgcatttactcagaatttagtaagttctaatattgggcctcctgaatgaacttactgaccagcaggatgtggcctgagcaaatgacccatgtcagttgtgctgcctggccttcctcttttcattgtcaagaatacatgagcatatcaattatgaattaatctctcataaatttaactataagtcaattcttgcaagtcacatctctcaaaaagaactaataaaactgattttggtcctgtggctattcaccagggctatgcccttatgggggccacccagcaaccaaccagcctcactcttgctgaaatctgttaattgcagctcaagcctgttttactaactaaatgcagtgtctccttcaccactgcttcctgtgtgatatcactaactcattccttcattcatttattcaatcatataagaaacatttattgagcaccacctaggtgccaggtgctgggctcagtatttgttaagcaaaagcaagcaataaacagtgctcaaaatgctttttagagtttagtgaggaaggcacgtcaactaacgattagaaacagtatgctaggccagagacaaacctgagccatgagggacctcaggcctgcatggtgggacccagaaagagttcacacaattagcacaaagcacttgggaagcgaacagtttacccagggcacagaaagagtagactggaaagatacataggtctgagacattctgggatttagacaccttgcaaaggaagagaagtcttcggaagattttaagcaaagtcatgccatgatgtttagttttgcctttagaaagaacatttggttggcagtatggaagatgaaccaaggggctggccatatgtgcaaagcaggaggcaggtaaagagtttcctgtgtttgtccagaagagaaatggtaaagcctgaacacagggcaatagatgagggagcaaaaaagagagtctctgggatttcaggatatgaaaccacctgattccatgaagctatcttactttagctcactgtatagaaaactgtgcctgtcactgttcagctacttcttgaaagaactgagactacaaattaaaattgaaaactacatgcacttatactatgtccatgattccactgtgaaattgtacaaacccattctccaggactcaggaaggccaatgttcttattttttttttgagagagtctctctctgtcgcccaggctggagtgcagtggcgcaatctcagctcactgcaacctccacctcccaggttcaagcgattctcctgcctcagcctcccaagtagctgggactacaggcgcctgccaccacgcccggctaatttttcgtatttttagtagagatggggtttcactgtgttagccaggatggtctcgatctcctgacctcacgatccatccacctcggcctcccaaagtgctgggattacaggcgtgagccactgcgcccagcccagtgctcttgttttagaaatctgggagagcttgaaagtacagaggaagggcccttaagttaaatagtcatccctcctcaacaaacaattaaatgttattatgaccaaccatatctaacaggttcagagacatcctagcctgtctgtcaactttgtaggctaaatgaaagttccaggttgtcagacccagtgtagttttatttcctcagtatctatttcctgccactttactttacaaaatgtttccctttgaatgtaaccagagaattccatgaaccctgccataatgttaatactcacggtgaatgcacacttatatcactagaatatctgaccacatctgtttgttttgtgacatgacaggccttgagactggtgaaaaatttaccaaaccaatagtttactttctcttaaatgtaaaatgcaatggaatctcttctgtacctctggaaacactgtagtcagcttttctgaatgaacctgctgggaaatgtcaagatctctaaataaataagttgtgactttcattgtatttgcagcacacaacctctgacaaggaagaaaggccacaaggggatgttgatcaaatccaggtcagaactccatcaaggtggacagacactcaacgccctggtagataacaaagacaacggtggacgagcaataaagaaatctaacaaggtctcaaaggaacagcaaatgaatttcaattttaaaaggacatgggtcattctagaaatcaatgtgtgtgcaatccaacagttccatatataaataccagaaaatatttatgaagcaagattaatctcgttttagaaattattactaacctggctttattactggtttaaactaaatttataaaacaataggcttgtcccttagccaaatacattcatgtctaagaatgaagtcatactctatacgaagctaaagagaattttataatagtctcataaccccattagggggaaaaatgtatctgttctctcttatcgatcgatcgatcatctatctatgttgggaaagcaaatttaatgaactccctgaaactcttagagaaaaattatgggaagacacacactggctagacatatttcgatagtggttaccatagaaacaagtcattagatttcatttttggagttgtggcttttgataaaatattaaatttcttagagtatttgcatatacagatagcgcaactgctgatgtgcaattgaattatatgctgtaaaaaatatttacactacttctacttttagattactaatatctacaaagaaaaaaactcactcctaataagaatgaatttaaaaactcttcctctaccttgccattgtttcctactgggaaaaagctaaagtgagggtggtgaaggcataaaacaggctgggacacaagacagggatctaaggaaaccagcttggtcttgcttgagagaaactcctgatggctttccaaccacagctgctaatattctgcaggccacctaactgaacagcaactctggtaatttgtttttaatcagactaattcttcaatctcattttcctgtgacaagatggctgtttctcacggtgtaagaaatgatgatgtgcttccttcttgggggagtgagttgtgatactgccttgtgtggagctcatctagtgtctcctttcatttatatttcataacctccctgctgtgagcccaagaacctgaagagcacacctcacttcctattttgaaaattaagaaaaagtatacattttaacacagagtcaaaattgcaaagttaaacgaccactaactcaaatactgattttaaggcaggagcagcagcaggttagctgctgcactgaattttactgactgaaagccactagggtgtttgccaatcaatgctaaaatgatacttgaattaaaatcaatacacaaccccatatgtatgtggtgtgccaggaacagcctaagagttgctcgacctaggatctaagatgtccacgagccacaaacctggtaatctttgaaattagggttggcggatttagttttctgtcagctgggaatgtcctggcattaaaccaaggacctcaatccccttaaaacaatgaattcagcaacaatcttgacttcccagacataagaagtaaatcacattaacagctgagaagaggctatgaactttctgtttgaaggtcaactagaaaacaagcgaaagatcagctgaaaatgtcatgggtgaacctgagccaggtgctggctctaaaattacagcaaggtccccatgaaacattaaaagaacatagccaccctgtaaggtgttataggaggattctcttttcactttaaaaattatttatgtatgcatgtacatgctttaataatctctggcaatatgcacatatttatgtatatagccatacatgactaagatataaatctcgtctatatgactaagagatggaccttatctttatatgactaagagattatgttatctctgaagggatcaaaggtcacgtttgtttttctgttttccccaagctcagcactgacatgcatgatctccatagtaagggggggggaatacacacacacacacacacacacacacacacacacacacacacacacgctgactattcacatacagaaatatatatttgctattaaaaaaattaaaaccacatacaagaattagccaaacagtaggaaaaacgaacacatgaatcaaccccagaaccaccactattttagacttgccaagtaaaataaagatctaaaaattcatcttatagaaaaagaaatctgagaactacttctatattgttacagaaaatacaaaaacagatatattttattatttgaattaagcattaaaaaaattcatcttacaagtaacaggtatatcctaatctttaaaagttctatttgtactagtcatctactaggtcaaaaaaagtttaatacaaaacatttggaagtaaatgaaaaaatactgcatttttccaatactatcttttttaatgaaatatcaaaaagtttaacacatgttaatccttttgaaaacctattttgcctcctaagaaatgcaaaataacttataaagtaattctaacatcagtgaagaatgctactatgtttcaagtaaactgtctcaaaaattttaacttaaatatgaattttaatataatttatgtgaaaatgaaaaatacttgaaaatactttgctttggtctaggattaaattcatgatgtatttcattaaatatcctgctattgtctgctttacgatattaagaaaacaagcataacgaaaaataatggttatctcctcagccccactataatgggaattcttcctcataagaactacaaagcaaataagaggagatgtacttcaaaatcttaaatattcatcacaaaataagaaggcaaatggactttaaaaatgatgacccacgtaaaatcaacatttaatcctcaacatgtagactgtctgctttgtggctttcttagagtgaaccttagctttaccctcctagggaccaaattcctatctcttgcattacaaacatctgcaggccacaagacagcaaccaaaggttaatactgcctccagccaaacattattaagaagctaaatctgctaacttccattaaatataatactaaatataatattatttccaaagccaacagatattacttttgaaccctatcacttgtcaatatgaggctagaaattaagagttgactaaaagtatagaaaaaattagccaggcgtggtggcgtgcgcctgtagtctccagctacttgggaggctgaggcaggagaatcgcttgaacttgggaggcagaggttgcagtgagccgagatcgccccactgcactccagcctgggtgacagagcgagactccaactcaaaaaaaaaaaaaaaagagttgactaaaattatagttatatggtttccagataatatataataatatatatgtataataataatgtgataatgtatcacttaatagattgaaaatgatgagatgatacttctcaatggcagacactagcctgtagggtggtggtattcaccacagctaaaatcaaccgctcacttaaatagcacctggactgggaccaaatcctccaaatggctccccctcccacctactcaacagggggcaggctgggacagagagtcacgtgtgttcacattagcctgatagaggatcagaatggagtcagactgcaagggtaggaatttcctctcttccagtgctctcatttcctcatctacaaaatgggaactgctgtaaggattaaaaaatacatagaaataaaacatttagcacaatggccacaagcccacattttcaccctgtctgttgtcaaaagcaaggtaggagacaactaatgctagggtaggtggaaaagagggacagggtgtggctagggagagggacacctgccagtcacatggtgggcatctctgctcacaatctgaaatgtatgccacaggaagttgccaaactgcttatttttttaactgcccgttactaaaggttgatgagataacacataagataaatgaaaaaaaaattaaaaaacaactagagaaataaggtggggaatattatatgaaagacattatacaaggcttttgttttgttttgtcttggagtattgtttttttatttctaagctacaatctatcctgattttctttttttttttttattagtagactattttttagagcagttttaggtttatagaaaaactaagccaaaagttccctcttccccgtttcccctgttattaaccatcttgcacaagtatggtacatctgttataattaatgagccaatgatgatataggattaactagtcataacagtcaatatagtttacataagagttcactctttatgttacacagttgtatgggttttgacacacctatctatccaccattacaatatcatacagaatagtgtcacagcccttaaaatccactgtgctccacctgttcatcctgtcccctcttccctgaactagcaaccactgatctttttactgtctctatggttttgacttttgccttttctatagtttaaatcgtacagtatgtagcctttccagactggcttctttcacttagcaatatgcatttaaggttcctttgtgtctttctgtggcttcattgctcatttctttttagtgctgaataatattccattatctggatgtaccacagtttatcaattcatctaatgaaggatcccttagttgcttccagtttttgacagttataaataaagctgctatcaagattcgcatgcaggttgttctgcagacataaattttcaactcatttgggtaaacatctagatgcgtagttgctgaattgtacgttaagcctatcttgagctttataagaagctgccaaactttcaaagcagttgtaccaatctatcattttcaatatctaaaaatccatctaccaaagtgtaacttaatatctacacaatgtgaccagtgcattatttatgatctacctaagtgaaggacagttaactttcaggttctaactaaacttgaaagataatgtgatcaaaaaattcaggagttgttgactttgggctgttgactttgggcaaattatctgatttctttttttttttgaggcggagtttagctcttgttgcccagactggagtgcaatggcgtgatcttggctcactgcaacctccgcctcccgagttcaagcgattctcctgtctcagcctcccgagtcgcttggattacagggatacaccaccatgcccggctaatttttttttttttttttttttttttttagtagagacaaggtttctccatgttggtcaggctggtcttgaactcccaacttcaggtgctccgcccgcctcagcctcccaaaatgctgggattacaggcgtgagccaatgtgcccggcccaaattatctgatttccacagcctcaaaaaaatgtattaataactagtcgcaaggatcgtctttaaaaatcctttacagtcattaaaggttatgcaattcttaagaaggtgactatgatctttgtgatgccaataactccattttacttttaagcaaatttgttttagtatcattttcaatgaaacctcaacaaactgtagttcagactttggagaaaatgcttaataatcatgacagtgaagaccacttgggactgttaggctggtttttgttgctgttgctgtttttgttattgttttgcctttagatcacaaaagttttgtcctggtggcagaaggaaacatcagttttccattggaacattctctgactagcattatggtctttacataacgttcattccttatttccacaccctccctaatattacagagtaattactgaatctctttttcctatgaattttaaagtttgacaccactggccaaaaattctatgaatttggcaaaaatgatgatggatccaaaaaagctagcatccttttctcagcatttaaatagtttttttcctcatgaacaggtctactacctgaacagttccccatctcaccccaccatccctgtgggaagaaaaccattagaaggcatctacctttatgtagtaaaatttcattgattggaatagctcaattgaggagcaataaacctcagtcataggacattcattttttattttttatttttgggagacagagtctcgctctgttgcccaggctggagtgcagtggcatgatctcagctcactgcaacctccatctcctgggttcaaatgattctcatgcctcagcctcctgagtagctgggataacaggcatgtgccaccacacccggctaatttttgcaattttagtagggacagggtttcaccatgttggccaggctgatcttgaactcctgacctcaagcaatccgcctgcctgggcctcccaaagtgctgggattacaggcatgagccactgcacccggttatttataggacatttaaaaagaaatactgtcttcccaatttcatgtaatacagtaatagctaacatttactaaatacttactatgtaccagatggtattcaagggcttcgcatacatgttttcaattagccatcaaaataaccccttgaggtaattactattactgcttccattttacagattcaaacactgaagctcagtgaagtcaagcagaaactctgctgtgatctctccagaatctggtctagaatccttggataatggctgggcccaacattctcatggacagacactgctgcctacttggatggattagtatcagctgcttctggggtctccatttgggtatattgctcacctgacagcaaccaccccctccccccttcacacgcgcacacatgcgcacacacgcacacaaatactcgtgtacatgtgctctgtgctgtgcctcacacttgctgcctgtgctatggggaccactggctggtatcatatctgacacatcccatgtttacctactgcacttgactcctccctaaaagctgcttctattgccccctctgagccatcatcaccctcatgggcctttctagctccaagtgatcttccttaagctgctgaaattaaccaaacaagaaccgtgaaggattaacaatacctaatataaattatgctttaaaaataggctttagccaggtgtggtggctcacgcctgtaatcccagcactttgggaggccaaggtgggcagatcacctgaggtcaggagttcgagaccagcttggccaacatggtgaaaccctgtctctactaaaaacacacaaaaaattagccgggtgtggtggcaggtgcctgtaatcccagctacttgggaggctgaagtgggagaatatcgcttgaacctgggaggcagaggttacagtcagctgagatcatgccactgcaatcctgcctgggtgacagagtgagattctgtcttaaaaaaaaaaaaaggctttagtactttttaagtaaactgatgaaaattatttaagcattgcaaactcttccttaaaatacaattcatttttaaaagtaagtggacatttcaaccaggctcagtggctcacacttgtaatcacagtacttttggaggccaaggcaggaggatcacttgaggccaggagttcaagaccagtcagggcaacatagagagactctgtttctaacaagaaaatttaaaaaaattatccaggtgttgtggtgcgtgcctgtagtcccagctactccagaggctgaggtagccagtgaactgtgacggtggcactgcactccggcctggttgacagaacgagatcccatctctgaagaattttttaaatttaaaaacaaaagagtaagcagacatttctaaactggctaaaagcaatttcttaagtaggtaaacatagcctttatatgttcatttacatcattcagtagtttagttagctctgttcctgctaagatgaacttcaagaactagctatgaggtgatcagaaataatctgaatttgaaacaagagaagtctgaatttgaaacaagagaagtctgaatttaaagatttttcatatttggattaaaatatttgtaacagggtggaaacagaaaaaattggacaaaaatctatgaaaacttgctctccaggaattttctccaaaggtctcctggcccagaccctcattccatgacaggaggctggcagtgccagaggaatgcagcacaaaggggtggaaaggatgtcagcaagagaagctatcaagggaggaggagtgggacgtggcagaagttaagttggactgataacgtggcaagctgggtctgagtgactactgctggaacacaatgaacagtgggtccttcactcaacccagattggtgagagccaggagccactaagtcaaaattaacctaaatgcacataaactctaggattccaattttattctgtttttctgtgcctctactacactcccttgacctttaaataatcttcacaaaacagttataaagcagagttgattactgtacttttataagtataatgtgtaaaatggagacatcaacttctgaaagttataaaacatcaattttaaatacaatttttccacttttattcttactgttgtctactgaaaacaatattctccaactaatcagaaaacctcaggctcatccttcaatttctgctcaaaactctttaagataggtttcaacagatttccatacaaaagaaaaatgcgttacattcctccctattgatgtctaatgtagtacagtgtattaagatacatacattcacccgaaacaaaataacatgttctcttagtacaaactggcaaaaaaaaatcatttaccttgtttattgtttgtagaattacccccaattcaagaaaaatgagtacatataaaaattaggatttataaaatatgaattagataatataaatgaatttattttaaggtgatttgaagcaaaaggtcaccaagtatattacaatacaatctgatttacaaaatcatatttcaaaacaaattttctaggaacacagatactccataaagcagggtaccttggctaaaacaccaatgtctcacttacatagaatttgataaggaaaatgaaactttacactaaaattgttaggtagagcatgtggaagtattcaaaagaaacctgacgttaaagtcctatgaaaattttcttaaaatatgcatgaaaaacatacttgtaaatttacgatacttgttacgaatcaagtttttgatattacaaatgtgaaaaaaaaaccttcaaatgtcaggttaccgtttttactgtttaatgaaaaagacaaagctaaagaccacatataaattattgacctgcatactaactaccactataacgagaacatgactgcagtttacaaggatgaagctctttatattctcatttggagaggactgttgtagtacatttgacatgtaatatatttaaacaagtatcaatttctttcttcttcttcttttttttttttttgtagagatggtgtcttacccaggctggagtgcagtggtcatcatagctcattgcaatctctaactcctgggctcaagtgatcctcctgtttcaacctccttagtagctgggactacaggcatgcaccaccatgtacagttatttttttttttgagatggggtcttgctatgttgcccaggctggtcttgaactcctggcctcaagcaatcctcccacctcaatctcccaaagtgctggaattgcaggtgtgagccactgtaccaagtcacaagtatcattttcctaagggctaccaaacagcaatattagtaccattactgccttatttaaggtaattaaaatcaactttttctaaacttagaggaattcttcactcccctaaagtatagcctctacctacttttttagtctaatttcttcttattcaccatcatccaccctatgcttcagttaaaaagggttaatagctatccctggaatgtcttcccatctccatgcctttacccaagtggttcccatgcctagaatttcctccctcatagcttcagctgtcaaagttgaacccattcttcaagtagcacttcggtctctgctttatccaggatgctctctgatgtccctaatcagacagcatttcttaatcttcatccctacagcattctgtatctttcttggagattaattttactctcttatatgttatactcatcacattcaagtgtcttctagcttagagtatatcataggtgctcaacaaatgtttgttacatgaatgaatacatatgctccttgagagaaaggcactaattttattcctcattgtgtctctttgctatctccccaaggtgagacctctgcaaagccaggcaacaacccgtccacatgtactcagcacctagaacagcacatcatagtgcactgtcaacaatctacagatgtttgtgaaatcaaccaattaactaatctgctgtcgttttttcagtacttaacactcctgacagaattgcacattcttagaattggatatttatatttttcatttaataaaaaatatttttaaattattattcaataactcttccttgagtgtgtcctgcttgctaggaagtggatattacatacagcagacaaaatagccgtgatccctaatgggctcatagactaatgggagagaaaactattaaagaaacaaatgtatggccaaatatgaaattaaaattctaataagggctgggaaagaaaggagaaagcaaagtatggacaactgggtggtgctcattaagggtggagatcagggaaggcttctcagaggatgtgatgttaaaatgcaagtgaaggatgaacgagagttagaaaaatgaaaagtgggaggtggggtgggcatttcagggagaaaagcagcctcaggaagagcctggtgcacctggtcacagtggtggtatggggtcaatgaagggaaaatggctgcatgaggccagagagcctggctggggccaggtcagcagactcccaccaactccggggaggaggctggattcttagtgcaacaggaagccatggcagggcagatgaagaataaatgaactggctgcttcactactaccctgtcccaagggcccagaccatgaaacggtcttttatttggtttcaaatccaaataaaaacctatgtaggtatagaatcaaaagaaggagttaaaaatttgggaaggttttatacattttcctgttaacagaaaatttaaatataaaaatattttattatctcagagaggcaacagagatttatgctctttgattcagagataaactttgtcttgtagaatgggaaaaaatgactaggtaagatgattttcctttatcacttttcagaagacaagtcataatggaaatgactcaagataccacaatttggaagatgagtgactgtctttgccatgggagcagagtgagggtttgctaaacatcagctgaaaggagagatgtgctcttgctcttagttacagacaggcactgtatgtgatgtggccccataaaaatcctggcagatgatgtagcttcctgtcatcttcctcccataactgcaaagtccaggagacagagtcccctttccttggtagaaggaagtaaactttggcataagacacattttgtgccaactacctaacagcaatgtttaaataaaaataaaatgctattggagcatttcaatacatatcataaaaacaggccaggcgcagtggctcatgcctgtaatgccagcactttgggaggccaaagtgggcaaatcactcgagtccaggagttcgagaccagcctgagcaacatggtgagactcccatctctactacaaacacaaaaattagcagggtgtggtggtgcgtgcctatagtctcaactactcgagaggctgacgtgggggaatcacctgagcccagggagctgctgaggctgccacgaaccatgattgcgctactgcactctagcctggttgacagagtgagaccctgaaaaacaaaatgaaacaaaacctaagattgaacaacaaaaagcaacactaagcattttatccagaagcaagaaaaccctaccaagaatttgtatttgttcatcagaatagataacccaaatgaatactccacagaacaagactgccgtttatttaataggtggtaggtttttaaatgggagataggttatttcttcctttctccccacccacagagttttggccacttccagaccatgttcagctgacattcttttcaaagactcaaaaaaaggtaatgcactctcagtggaaaggtagtgttccaccagttttggtaaatactgatctaggcctgaacttttgatttctgaatgaaagaacaagatgattcatatatgccttaaggaaaaagtaagtctggtgaccagatctgaatgaaagcaaaaaggcttgaatttaaaaagcgaatcctgtttaaattttgggcaaatcatctaacatatcctctttccttttgcaatctacactaagaatactatttttttttccagtttaagaaaagttgacctaccaaagccagaactgctaaataattacaaaacagttgttttagaaatcacttcaccctccgaaaggagtcaactttccatgtatacttaaaatcactcataaaaatggatttaccatttaagaaataattttcaaacacacatgtagtttgtcaaatgaagcctcactgttcattcattcattcattcattcattcgacagatattgattgagccctgttatgggccagatgctgattgtggcacttgtgatacagcagtgaacagaagagtctaaactccctgccccaatggtgcttgcattcctgtgttacgtccacacagctgtgtaactgactctgaagaaaaatgagcttttaaaacataataaacatttcagttttgccagatgaaaaattctaaagatttgttacactacaatgtaaatatagctaatattactgagttatatactcaaaaatggttaagagaataaatgtgttcatttaaccaaaaatttttttaaatgaaaaaaataagcataacaaacatttactgagtacttaccatgttaggcagagcatcatctcatttaatcacaacaaccttagcaggaaggcactattattattctgttttacagatgggtacactgaggcacaaagaggttaaacaatttatccaggatcacatatccaagggatagagctgagatataggcccaagtaatctgataccagcaacttgtctcctaactccatacaaaaagtttcaaagataatactattttcagttggaactacagttaataatacaaaaatagtaataataatatagtacaaggaataataatcaactttttttttttaatcctgatgatttgtaacccaacttactgtccttttgatggccattttttcctaaaaacctcagtgttgaacaaactgctttcaaccacttctctgtaagccataatattcttttccttcaaatggaaataaagaaaaatcacacaggatggtttcttttagacaagatcaggcacgttcagggtggtgtggccatagacgcggatggtttcttttaaaacagacattactgaaactgtaaatatttttagccttttgtacttttcatccagcagcttaactgagaatgatatagaaacatttaaaaatagccactcagtactctgaaaaccattagtttagcacatacccagcacctgcttgacacatcttaatcaacactcttttgctagtcatattaaaaaaagagagaacccttttgctttcagaattttttcccttaaaaaacgtatgtgtcaccagggtattttgccctctctctttctaacttagagggtaacacctggagtaagtcatgggtgactaatgaagatgcaactttcccctcagcatgatatacttcacaggatggaagtaaaagcttctaataggagcatttattacaattgttaggattgtaatggaaagttaattttgttttatagtttgtagaaatgattcaggatgatatgagaacactttctataaacctgcactgataaaaggaagatgatagtgatgacacatgatatactttctgagttgtttttccaggggtgggaaagttcaatccacagatttcaagacagaaagaagaaaggaaaggagaaggaaggaagaaagaaaacaaaattttttttagaattgactatgctcaaatacactgtgctttttagcatcaaactttcaaccatggtctgagcagcactatgttgtaacaaaactggagtagccagcctgagcaaacatgaacatcacaatattttaaagttcaaataacataaggcaccagttttaagactgcccgggtatcctttttagcaatacaaagattcacacaacttggtgacagacagcttttccctccagccaaatctgatgaagacttgataatatcacctgccataatcaaaattcctgggcacatgggaaggtctctgactcaaatcaaagagagctttgggccccaaagctatgggccccacagctatgggctaccaaagaaaggttataaccaggctccagtgtaaaccattttgtttcttttaacagttttagatcttctaaagtatatgagatgatattaataaaatttaaatttcctgctaaatttttttagtctctttccttaaaagtaaaacttacaatgatcagaaagcatgctttcttctggctttatcattcaacttcccaggcaaagatgatcaacagcaacactcttatctaaagcaaaagtaatggatatgattatcactctggacagaaagtctgtatttgcccatttttatcaatgattgagacaatgatccagaagctgtattggtacaaaaacacaacaccagggatgccagaaacaggattacaaaagttctcacaaggttaaaaatagaccaaaatgaatatagtcaagtttactaggctcaaatgtgaggtcctgtatggtcagtacatggaggtccagcagcctcttgattcaatacaggcagtgtgatgggtttgcaaaaatgtactcttaggctgcattaataaagacactgttctcaaggccagataagccacagtccctctcaaactgctcagaaagagtagctttagggccaggtgcagtggctcacgcctataatcccagcactttgggaggccaaagcaggcggaccacttgaggtaaggagttcaagaccagcttgggtaacatggcaaaactcgtctctacaagacatacacaaattagctaggcatggtggtatgcaactgtagacccagctacttgggaggctgaggcaggagaattgcttgagcctgggaggtgaagggtgcagtgagccaagattgcgccattgtactccaacctggatgacaggagtgaaatcttgcctcaaaaaaaaaagggaggtacttctataatttgtccactaccttttaaggaactttctgataaactggagaaagcaaaaaggagtgagatcagaatgactgtggaactaatattatgagaaatattgaggggaactgggcatagataactttgaaaaagactttattatggcagatttgccaagtaaactgataattagaattattttcgatatagaaattaggataccttagaagaggtatctgcatttgatgggtgttaaacttcaggatgtttaaggtcttgctcaactctaccaatctgtaattacatggggaaaagtgctatgtccctcatgaaattaaatactaagaactggagggaggctgcatcaacagattttctgtatcatgtattgaagagttaattttctccaaccaagctagtgaatgaaagggtaactcaagatgaaataatgatgtcaaagcatttttaatatacctcgtggaagaatccaagtgtattttaaagagaaaacacagcacttgttacaccatatatttcatatttgacctgaagttggttacacagaggccttagtcataataaaaaacttctctctgctcaaatgcagtatgtacatagtcataaatgaaaacatcattgccgaactattttttttaaactatcatggcacaaattgcttttaacaaagaagtcatattccaaaagaccttttgtacacaattgtgcagtgtatctttgtcttactgtttagtatcctaaaagaaatagttttcaaaatatctacattcatttataaaaacttgaatgcaggtaatttagcaacaaatcacaactagctgagaactgacataaaagaatgatctccagggccagaaataaaccccaaaagataagacatactagaaaaacatgagagagagaaacaaaatcaatagactatcatctcaatatctagtatgaagcttggtaaagagttgatgaatagaaataaatgatccctacagacagactcaattaagtatacagcataatttgttcatgaaaaaatgagtatgtgaatcttcctagatcttttcaaaaattacttaaaaatattaaataaacatttttaaaatgggtatattaaagcatcctaataaaatgaagctgattgattggttgctctaagggagtagtgataaaataatctgctatataaatcctggatcatataatggtataatgcccctcaaaggtagtagaggaaggtgggttttaggccacttttaaattaattgctctctacctgtttgaatcacacacaatatgtttggctttaagaaaataaaaaggacctagagcagaaaaatagcttatacatagtatctatatattatatttagaatatacattttatatttaagagacatttcctcttggacttttatcctacaataaacaactacaaccataaaaacagtaccagcaaaacccaatctataaggagatttgtagaaaagtaacaacttgatatattctagctgtataaagaggtctcttgtcaattcattatcatccacttacaagtattttatgtacatcttaaaagcctgaagaagttattgtaatgtttcaaactcaaaactactcccctgagcattgatataacttatactccctacaaccaaccaacccaaatctcagtttgcctccattaacgctccaaaataagtcaagattgtaaatacagtgggttctcaatcaattgactttttcaacatcagatgggtggctggagccttcacaaacttcagagccctaatagagatccccttttctagcccacataaataatacaaatcatatctctatgatcattagagatgcaaaaaatcggtacaggcctttctccccttctaacacattatcttaggcttgttttatttatttaatttttacattcctcatgtgatctgtggccacacaagactgattctccaaactgaacttcattctatctgctccacaataagcaatatttattcattttcactcaacaattgtttactaaaaatgtactgtgtgtaagacattgtgctaagagcaagtaagtactaggaagtcacagttctatcatcaagttttaaatctagtaggtgaaagactcatacagaagtatcaaggcagccatgggccacctgagtggtgaaactgagacccaaagagtgtcaggaagacaggaggcactcaactgtggtaaatggggagaatgacagaggagatggcatttgagttgggcctgagaggacaggttgtccaggatttggattgacaatgatttaagggaagagaagagggaagaagaaaacagccaactttaagcaaaggaaacacaatgagacaaatttgcaaaagcaaaaaatgtaatgagcattgcataccaccagaagagcaggtgaataagggtactagctagaagcagcaaggttcattcatttgtattagagaaaagtgcaagataaatggttcatctgaacaatgggtggtttcacagggtttgaaaacatctctccctctgtaagtcatactatctccgactgaagggtccaacgtgaagcaggaacgaaggggccagtcctgtttggttgtccaggtgcaggacccaaaaccagcaacacacagagtgacatatgttgtgactatgcccttctcatatcaaccccaaaatgtaccgaaacactgaaaagacattttccaacggagacttgcccaagttttccttttaaaactattcagttttgaacctccaaattctgaatttcaaactcaaccacctgctttctcagcaacttcaccagtgaactcaatgttgaagctcctggggaaaaaaaaaatctcacataaaacgtacagtgtgataaatccaggcctcatagcattagctgtgtcctcccacttcccacagggactattccatgaaacttatagtgtcttcttcctggtgcacagctgggccacgttttccagcctcctttgcagctagttggtgacatgtgattgagttctaccacgaaatataagtgaaagtgattatgctaatttctaggcctaatttctatgctaatttctaggcctactccataaaaaccttccatgtgtaacctgccatgtttttccccctctcttgatgtgatgcaaacaagcacagtaactctgggagtcacatggtgaagatggagaaactacaagatggaaggaatctgaattcctgaaggatttccaggaggaaaatgtcacctaccattcatcaacacccatttaagacctcatgtgaataaggaagaaacttgtgttagaacagtgaaatgttgagaagttatcttgtatttttttattttgaaaaataatttttattacgtatatttatggtatacaacgtgatgttataggcttaatatagatagtaaaaaggttactgtagtgaagcaaattaacatatccatcatctcagttaccctatttttgtttttatgttaagagcagctaaaatctcacttagcatgaatcccatacctatagtcttcatactgcacattagatctctatacttgttcatactactttgtatcctctgacctacatctctccatttcctgcccacaacccatatccctggtaaccactgttgtattctctctgcatatttgaaatttttttggttccacatataagtaagatcatataatatgtctttctttggcgtatttcgcttagcacaatgggctttcccatgttgtggcaaatgacaagctctcattattttctagggctgaataatattcattttgtataaaccaaatgtggtatacttacagccacttctttctctatttgtccatcatcagacacttaggttgtttccatatcttagttattgtgaatcatgctgcagtgaacatgggagtgcagacatctttatgaggtggtgatttcatttcctttgggtatatgcccagaaaaggaatggctgggtcatatatggtagttctgtttttaatttctttagaaacctctataacgttttccataacggctatacccaatctacattcccaccaacagtggacaagagtcctccacatcctcaccaacatttgttatcttttgactttttgataacagccatcctaacagttgtgaggaggtaaatcacagtggttttgatttgcatttccctgatatgatgttgtgtaccctttcatatgcctgtggccatctttgtgtcttctttagaaaaatgtctactcaggccttttgcccattttataaatcaggtaattcgtttgttctttgctattgagttgtatgagttcctgataaattttggctactaactccttaccaaatacatgatttacaatatatctgatgtacattggaatattgggatatactgattggaattttttcccaatctgtaggctgctacttcactttgttgattgtttcctttactgtacagaaactttctagtttggtgtagtcccatttatttattttatttttgagatggagtctcactctgtcctccaggctagagtgcagtggcgccatctcggctcactacaatctcggcctcctgggttcaagcgattctcctgcctcagcctcccaagtagctggaattacaggtgtgcgccaccacacccagctaatttttgtatttttagtagagatggggtttcaccatgttggccaggatggtctcgatctcctgaccttgtgatccccctacctcagcctcccaaaagtgccgggattacaggcgtgagccactgcgcccagcccccatttatttaattttgcttttgtggcctgagctcttgttgtgatatccaaaagctgactaccaacgccaatgtccaggagctattcccctatgttcctgtgtaggagttttatagtttctgcttttatgtttaggtcttttatcaattttgagttgatttttgtatgtggtatacgataacagtccaattccattcttttgcatgtggaaatccagttttcttaacatcctatcaaagagactattcttttcccattgtgtcttcttggtgcccttgtcaaaaattagttgactatatatacgtggatttatttctggactctctattctgttccactggtctatgtgtctgtttttatgcctgtataatactgtctttattactataactttgtaatataatttttaaatcaggaagtataatacctccaactttgttttgctttttcataattgttttggctattcagggtctttcatggttctgtacaaatttaagaagcattttttctatttctgtgaagaaggtcactggaattttgatagagattgcaccgaatctgtatattgctttgggtactatggacatttcaacaatattaattcttctgatccatgagcatgtgatatctttccatttttttgtgcttaatttctttcattaatgttttatagttttcagtgtacacatctttcacattggttgaatttattcctaggtattttgttctttttgatgctttgttaagtgggaccattttcttcatgttcttttcaaacagactgtaattggtatgaaaaaaaacgcaactgattttgcatgttgattttgcaccccacagctttactgaattcattcgttgttctaacagtttttttgtgtggaatctgcaggggcttttttccccccctacaatataggatcacaccatctgcaaatagagataactttacttcttcctgacctcaatgcctttaatttcttttccttatctaattactattgctggtacttccagtactatgttgaatagaagtggtgaaagtgggcatccatgcctgcctgatactagaccttcatggaaaaactttcagttttcccccatgtattataatgttagctgtgggtttttcataaatggcctttattacacagagaagctttccttctatacatacactattgagcatttttctcaataaaggatgttggactttgtcaaatgctttttctgtgtcaattaagattatcatgtgatttttatctttcattctgttaatgcaatgtatcactactgattgatctgcagatgttaaaccagctttgtatgccagggataaatcccacttagtcatgacatgtaatctttttgatgtgttgttggatttggtttcctaatattttactggggctttttgcaccaatattcatcagagaaattgggtttaaattttcttttcttgtgatgtctttggctggctgggtatcagggtgatcctggcctcataaaatgtgtttgaaagtattccttctagttctatttttttggaagagtttaagaagtactggtatcaattctttgaatgtctggtagaactcagctgtgaagctatctgttcctgggcttgtctttgttgagaggtttttcattacttctccaatctatttgtgattggtctgttacaggctttctatttcttcctgagtcaatcctggtaggttgtattttcctaggaatttatctgtttcctctaggccacccaatttgttggcatataattgttcgtaatagggacttatcatcctttttattcccgaggtgtctgttgtaatttcttcaatttcatttttggttttacttgagttttcttttttctttgttagactatctatgggtttgccaattttacttaaaaaaaaacccaactcttaagtttattgattcttcctgtggcttttctattatccatttagtttatgtttgttctgatttttatttctttccttctactaatctggttttagtttgttctttttctagttccttgaggtgtaatgtcacactattcatttgagatctttcttcttttctaatgtaggcatatattgctataaactttcctctcagaactgcttctcctatatcccatcagttctggtatattgtgtttccgttgtcatttgtctcaaggcattttttaaatttatcttttaatttcttctttgacccattggttgttctggggcatgttgtttatgttccagatatttgtgaatttttcaagattcctcctgtcactgatgtctagtttataccactgtggtttgaagttatatctgaaatgatactagacataatttcaatcttaaattttgtggcctaacatatggtctatcctggagaatgttctatgtatactctagaaaaactttacattctgctgctgttggatggaaaattctgtacatgtctattgggtccatttggccaaaaatgcaattcaagtcctgcatttcttactaattttctgtctgaatgatgtacatgttgttgaactgagaagttatttttacagcagctagcattaccttaataatatacacatttcgaccaaattctttatgttagtttgggtctacccagaagcaagtaccaagatagaactagaaatacaaaagatatattgagaaaggaagccacagaatgtgggaggtccttcaaaccacacctatggacatggagaggaaaggaagaaggaatggctaggaagtcttggattccaacacagttccaagaaaggtctgctcaggccaataggagttcttgagccaatttggcccactggaaaagtcctgtgtcccacaggaatgagcctgaaataggagcccctattgtgcttggtcatgactgggagacgctagtggcaatttgtagtttagtacaatgcaagggtggctgcagaggggcagcagttgggccatcagtcaactacgcttctagctgtagatctaagcacttattttcatggacactacacccctcaaacttccaactttcaagacctacaatcccttatccatatccacacccagtctttcctcctttgttcccatctattaaaaactgagttgtcctttgtctagcccaaagctaatcttgccatgtgttctagcttacgtgccatcagatctgcttagagacattattccatcagttatctccttcttcttcctgtctaatggattatatctatcctccaggatgtaaacttgcttgagattttaaccttgaaaaagaatattaaaaaaatgttccttgacaactcttgctctccttcccttagtatctaagctccttgaaagagtagtataaatgaaccatctcatttcttatttttcaccacccactaattgctcttgctaggattactgaacctaccagttgacacatcctggaacccttgcttgacccctctgaagtattcaacattcttgactactccctccttctgcagattcctgctttgggttcgtggagcaccctatcctcaggttttcctcataccctcagatcattccttctaaagcttctttttatttgcttcctccttaaaagtccacttcctagggcttatatcattggttctctctgttctctgtttcctacattaatatcgccccttgatctcacgatctaattgagcacttatatacttatatactgatgagatcactcatgtagtcacccatgtagtctcaatactcataaccaatcagttaccaagttctgaggattctatttcttaactggctctcagcaccatcatctccttatctccccactgccactgccccatgaacttctgtaggagcagagtgaccctctcgccttggattccattcctacttatctgtacctccacagtgctgcaagagaatatttctaaagcacaaatttcatcatgaaacctctgcattgagattcctgaagttgttccccactgactacaggatgaaggccagcctccttggcatggtacgtaaggtccttcataatcagttttagtctgatcttcctccactaccttctccatgttcccaaactctcattatatgaagttatttgaaattcatacaatgtggcatatgtttcatgcttctatggccttgtatgggctctttgcccaaaatgctctatgaccctgccctaactgggggaatctactgtgcattctttcaatgtttggtttgggattcatttgtacagcgatgacttttacagaccaattcacctatctgtggagccccttcccatccccacgccccattcccaggccattcaagtggctgttgtgttgttagtacccattcatgggtaccatgcgtgcacatgattccaggacagcaatcctgccctgttcctttttgactagcactgacacagagtaggcactaaatggatgtttactgactgaaagaatgaatgatgtacagacccaatctccgaagtttggcctcacaaaatttgcctctgaaaaacaaaattatcacagagtagccaaaaaccatgatgacaccaatcaacattacatgcacacactggtgtccaagtgcaggtagtgacatctccaatttacacgtgaaaagtggatacttggcattaaaggagaaagattcaaatggtctacgtaagacagccacaaagatagctcaagagctattatcccaagggacacgcattaactgttagtaagtatataaactagagttcacatttcacacagaactttctaacacaaattggaaacaggagacgattaagctgatctaaggaaaagcatggctttgatacacaagaaactacacatgcattttacattaaatgctttttaaaattcactcacagaaaagagtacaacaattattttaaaagtcacagtttgtaaatttgatatgtaaaattggaatttaaaataaaaaatctccatggccactgaaggctgaaagagtaaaaagaaaaaggaaataaaagacaaaatgtgtagtttcaaactctctgtgatgcatctcacccctgatcagtgggaagccagttatcacattgaagacactaggtaagcacaagagtttactgaaaatggaccttttcatgaaaaatcatgggtcaaacatctctatgacatacactgctgttaaaggaaacacatagtttctcattcttgacatgatgatgcctgatgtgcttagttagacagacagcttaatatggttcccctcccaaagcttagtgaaaatagcttttttaaaaaatttgaaaaataaatccccaaacataattcttctggcaaaatattaaatcctaccgaagaaggaggctttcagggaaacagtccaaataaaccttttaatttgtttaatgttctataagctattggtatcaagaaaatgtatatctttgttttaaaatagacaaattagtgatgcatctacatgccatccacttaactttgttcctgctgttcagcctttataagagtagcattttttcttgcgctgactcctgaagcctaaatctgcaaaagtctgtgatgacatcaagcttaacattttgccaagcctgtaaaattatttctcaaaatagtgtgctaacacatcagcttttactcaaacctaaattaaatgtcaggaaaggactcccatgtttacactaactgcccattagtaaacatttctgactgtaataactgaaggtcccatgttctcaaggtaatggcaccagcaaaatcccttgaaaatttgctcctaaccacaagtctaagtaggatgtggtcactcaggttttagattgatgatgctgaagaaatgtatttacaggctgaaaagcttataaccctggccaaaacactgacttcagagcaccaggagaaactccttggactagataaagtaaatatttgaagaaaatctgcattcattgagtgatttgctggtatatacaaaatttatcctttaaggaaccaaacaggagttctaattacctccctatatttcttctccttatactttccaagttcaattacagctttgttcaatctctgccttttttactcttttgtcctctgtctgaagttttcaattaagacttactttataacaggattgtggttacgtaggaaaatgttcttattcttcagaaatgatgctgaggtcttcagggaaaaatgtcatgaaagtaagtctgcaacttacttttaaatagttctaaaaaatgaacccctcttgccaacacacatacaaaactataaattcagagacaaaataacaaatattaataattggcaaatataaacaaagggtatataaatgttcttcatatgattctttcatctcctctctaggtttgaatttttcaaaaggaaaagaaaaaaattttaaaagaattacttaatgagcaccaggttttcaaattgtaaatgcatttcttgagcatcacatatccaaaacttgagaggcctagggctaaagaaatgtcaagactaacaaaagacatgttgttgtcctctacagacatgatgttgactcaatttgcacatcctggaagtgtgtatctgggatggaggtgaagaggcattcacagccaggcatttttctccagaaagctgtccctttggggtttcctcgtctttccctcccagtgagaccctggttcacctgctgtctctccagctgtcaagcagtggttcctgggaagtctgggagacccgtgagaggttggaggtagattcaaagcaccctcatggaatgaatttaccaaataaacaactgcatgttagacctgtacatttaaaaacataagtgctacaaatattcttaaaaggctttcaaaatttcagtgaagacaagaatgctttttcaaatgtttatgtaaaaatcttatacaagctgtttgctattatagtcaggatatatttggtgagaaaaacaaaacattgtaactcaaggcatgctccatttcagacaaaacatgaactctctcctttaattatatcagccattacaacaagaaaaccttgtaaaaggttcacacatggggcccacattatggggatccacttcaccctcagagaggcttgttacacagctgagagagagcatggtggaggacagttgcttctcccttttttataaaatccttcccatttgctctaaaatagaatttctaaataacagcacccaaagagtgctcaaaataggatactaaaccactttggagggcaagacagaagtctcttgtcagcttccacaagaaagagaactttaggctgtacaagtattttctttgggatgcaaacactttgatataaaagtaactttctttaatatatttgtgctaacatgatgggaaatgcccaactcacacatcaggatcttagtgatagtgcatctatcctgaacatggctgtcttaattagcccgatgtgtctatggtaataaacaccacgctgcagaacaactcaatatacccaggtgaaatctttaccacttaaaacactttagacggcttgtaatcaattggatggcattttcccaatgagaaatcctaactgcaaggtaaggtacctttctatctatagtgagtgttgacttacgttgcaggcatggtgctaagagacttcctctgcattatcaactcattttaaacttaatactaccttgtgaagtatgtaatgtcctgggcaccagatagaagaggacagagaagcactgagaacagaagaaatgaacatttatcaagtactaccacatggtactgtaacagtgctctctatacattatcccatgtaactatctctacaaccctatgatgtaagtattagtaatgccattttaccagggagaaaactgagagatacataactggactaaggctgcagagatgggaaatgagcctatactgtcatatgcccaggtactatgtgggcacaattcctcctgatcaccacattctacaagctccaacccagatgctaaaggtagaggcaacaaccatggaggaatagccatgaatgttccttgcggccactgcacccatggaggctagagcagacctagtgccctgagggtgggatgtaaattcctttttaaatccagagggtgtgatatggagggtctatctctggtttaacgaagatactgaagccagtgaaaacagatcccaaatctggccccacgactgacccagcctcctaaagagcctgtagatgaccaactacagagagaggaaggctctagaagacagaagatgctccctgggaggttcttttcagctgtctttcttcttccctcatgcctctctatgacttaacttggcatctaggtgcacatgggcaattgttcacagcagccaaaaggtggaaacaaccctaatatcaactggtaaatggataaacaaattattgtatattgtagcatacaataaaattttatccagccacaataaggaatgaagtactgatacacacaacaatacaaatgaacctcaaaaatgttatgctaaatgaaaaaagccagacataaaaaatcacatactgcatgactcaatttatatgaaatatccagaaaaggtgaaaccatagacgcaggaagcagagaagtggtttccaggggttgagggataaggggaatgaggagtgactgcttaatggggacggagtttcctttggggtgaggaaaatgtttcagaactggatagaggtcccagtcgcacggcactgtaaatgtactatatgccactgaattgtacacttgaggagggttaattctatatgaacttacctcaattttttaaaagtacacatggcaacgcatagtctttgagcaatcttgaataacgatatacactatgccaagctataaagatgccccaccctgtgccctttttacattacacacaaatagggacggatttcctgtaagctgatcttgaagaaaaaaaacatgttagacaaagaaaatcagaactaagacatctcccccccaccaaaaaaccctcaacactgtatctttgttcttttcccatgtcctctaccctactaaaacgaacaaataatataaaccccaaccactgagtgtaccacagacagaaaacttggtacacaaaagacctaataaaataaaatctgtcaagttttgttgcccccaaattgaatagaaagatccagcaggcccttaaacatatgaaaagaagcacactcttgctggcaatcaggggaactcaaattaaaacagctagtgatcactttacaccgcagagagagaacacttaaaaagactcctaacacctggcaggggtgaggcaaacaggtactctcatattttgcaggtgtgactctacagcaatgcaacttttttggagtatcatctgacatcatgcatgagtcactgactccgtttttaggaatctatccttcaaatatcaaagtagatacacatgaatatatgtacaagaatttaactgcagtgttgttaggaatggtaaaaacctagaatgctcttgaaggtatatcagctggggaataattgaataaactatggtacaacgataccataggatattatgcaactgttaaaaagagccactagattcatatttgataaggataaatgttgtaacaaaatattaaagaaagttgcagagtattgtttatgatgccattttcatagcagaaaaaatgtcccttctccatgtaaaggtatatgtttgtatgtatgtatatgatgtatagagaaaggaaaagaaccagaggagtgggagaaagacaatcaactttttctatattcacctaaatattattttatgcattgtcctacaattttttttaaaatagaaaaagtttaagtaaacagcatttttttctgcacttgccttttttgtttttttttttttttcaagacagggtcttgctctgtcgcccaggctagagtgcagtgccatgatcttggcttactgcaacctctgcctcctgggttcaggcaattctcatgcctcagcctcctgagtagctgggattacaggtgcacaccaccatgcccagctaatttttgtatttttagagacgaggtttcaccatgttggccaaatttgcctcaaacccctgatctcaagtgatctgcctgccttggcctcccaaagtgctgggattacagccatgaaccactgtacccgaactgcacttgccttttatacatgcaagaaatgtgaaggggacagtccccaaaaacccactttgaggatatgttctgaaattagtatctactgaacttcagtctcctaagttgtatatattctgtccaacagtgcaactcgaactggactctgcagaccagccctagtcccagaataagcacagaaactgagagtagacctttagaatttttttacagcagcttgccagagtaattttatgtctgttgactataagaataataaatgtttaatcaggcttatgtttttagtttctttaaatttcatttttctagtatttcatttttctagtaaatcatttttattgtattttataaaattatcaatccatgacatactggaaattaaaaacaaaactggtccttcacccaagataattagagaagcaaaactctaaacaatgagagtcaatgttcataatgataaaacatagtaatataagatatttaggaactttaataatgaaagattagattctattgagaatacatgctaatatattcaaactcttatgaaaaaagatactaaatagatcagaagaaagctttctggtaataagaacagattactaaccattctaggtaaataattaagttcattcttgtcaggaaaaatgaactctagtttctattttcaagtgaagactaagagacctggagaataaatgaaaccccatacaactccaaaaccagctacccagagttcagccagacactttaacttttgctgaacaaaattaacttcattttcatttttttctcccctctcgtccttctgaatgaagatgctaatagcaacagaaaacagtaacagagacaagtggcagggttaggtggggctaaggtctgactactccgtgcagattctatttaataaagtttcacctaccaatattctatgctgggggtgaggggtgggaagggaagggagagagcttacatactcctaagtcttctgagttttctaaaagttgatacaccaagttacagttacccagaaaaactggtgggaagaataaagaaccaaaaaacatacttacagtccaaaagtaaaaaatatcatttgtacatacaaatttcttctccccttcctaaattttttaaactaatgctatagtgaggtgcatttccaaatctggcagcttaaataaaatcaactgtaactagcattgtggtgaatgaaatgctttacaactcacagctgtgacactgaaataaggaaatcctggattcccaccaaggggtaaccagcatcaaaagacagggcacattttgatgttttgagaatttctgagaagtcagagaaaatttaggttattttcatatcggttggactttccataataaaagagccctaaaacaaatagcagccccaagtgtggcagtgctatattgtttggattccttataacaatcagtgtgttcataagatgcttagaaatacacagaataagctgatggccccggtgagtgggacacacgctgggcagctgtgtgaacttttaaaattttaatttaatttttattttatttcaatagttttgggggaacatatggtttctggttacatggataagttccctagtggaacttcactctgagtctccagagtccattatatcattcttatgatacactatatttggttttccattcctgagttacttcacttaggataatggtctccaattccatccagattgctgtgaatgccattattttgttcctttttatggctgagtagtatttcatgatgtatatataccacattttctttatccactcattggttgatgggtatttaagctggttccatatttttgaaattgcgaattgtgctgctacaaacatgcatgtgcaagtgtctttttcatataatgacttcttttcctttgggtagataatagtgggattgctagatggaatggtagttctacttttagttctttaaggaatctccacactgttttccagagtggttgtactacctaagaaactctaaagactcatccaaaaagctcctagatcagtaaggtctcaggaggcaaaatcaatgaacacaaatcagtagcactgctatacaccaaccgtgaccatgctgagaatcaaatcaagaattaaatcccttttacaacagctgctaaataaacaaataaaatacttaggaatacacctaaccaaggaggtgaaaatctctacagggaaaactacaaaacactgctgaaagaaataatcgatggcacaaacaaatggaaacatatttcatgctcatggatgagtagaatcaatattatgaaaatgaccatactgacaaaagcaatctacagattcaatgcaattcccatcaaaatactatcatcattcttcatagaactagaaaaaacaatcctaaaattcacaaggaaccaaaaaaaggtacacatagccaatagaacaaaagcaaaaagaagaaatctggaggcatcacattgcccaatttccaactatactacaaggctatagttgccaaaacagcatggtgctggtataaaaacaggcacatagaccaatggaacagaacagagaatccggaaataaagccaaatacttacagccaactgatctttgacaaagcaaacaaaaacataaagtgaggaaagaataccctattcaataaatggtgctggaataattggcaagccacatgtagaagaatgaactggatcctcatctctcactttatacaaaaatcaactcaagatgaatcaaagacttaaatctaagacctgaaaccataaaaactctagaacactggaaaaactcttctagacattggcttaggcaaaaagttcatgcctaagaacccaaaagcaaatgcaacaaaaacaaaaataaatagttgggacctaattaaactaaaaaatcaacagagtaaaaagacaacccacagagtgggagaaaatctttgcaaactatgcacctgacaaaggactaatatccagaatctacaaggaactcaaatcagcaagataaaaacaaccccatttaaaaaaaaaaaaaaaagaaaaaagaaaaaagaaaggaaaagaaaaaaaaagaaaagaaaaaacattgtttatgaagttcagagcttggagattcattcaagtattgattgcagttttattttgaaaagaatgctacaatttatgtggtttttctcatgtttatattaaaagctaataaactaatttaaaaagaacctatcaaaaactgggcaaaggacatgaacagacaattctcaaaagaagacatccaaatagccaacaaacataagaaaaaatgctcaacatctctattagggaaatgcaaattaaaagtgcacgagataccatcttactcctgtaagaacggacataactgaaaaacaaaaaataatagatgctggcgtggatctggtaaaaagggaacactttcacactgctggtgggaatgtaagctagctgtgtaaacttatgaaacaaagaccaagctgaggtccttgcctcacctgctgtgcttcaagggctcatcagcttggtcccaaatgatgtcttcagtaggtggcgaaatgttaaaactgggagctatgtgaacgaacgcgctgaaagacaaaacacgttagatcagttaggtcactataacaaaacgtagtatcatgcaaccaagtgctgttaaccaacttccttctctgcttgacattgaactacctgcaaatttagtgcttagaaaaggtccagggacttgcccatgaggaagaactcagcaataccacagactttaatgcaactggatttcacctcctcatgtcaccaagacttactgtgcagggtacaaatggccttcttccgtgtcaaatcttatgtccccctttcactcttgttctccttgacttctttgtagtgtctgacactgttcagtagttttttttttcctctttttattctcctctctctcctgcttcgcctgtttcttttatggtttcctgctcctctttctccttctgcttcttgaccaaggacactttttaaggccctgggtttttctctctccctcagaaatcgtctgttcccagcacatcaattctctccttgcagatagccccccaatcatccccattccctcccttgaactcctctcctttattctcaactctccagtgagccatttttcctgcatatggtatctctactgcatatgctcttcaaaagccttcatttcttgctgcaacactactgctgtggaaaaatgagcttgtctattgacctcattgatttctgcaatagcagaattatcctcccagccaaccaagctccaaatcttagattcatttttgctcattccctcttcttcaattccagtcattcatcaaggcctcttgatttgttacatctcacctctatcttttgctacccacttacactgaccagatcctgcttagctgagaaaaactccctcttctcttctttcctaatgtttcctcttgtaaaattggccagcgtgctgctgccattttgatctttctatcactacccctgccattttcatcttcctctcgctatccccagcaatttgagaatcctcatcacccctctaacaagcaacctgcattgcccagtagagagaaaacaagacagcagagtagctaagaactcaggctctggatcctggtggccatgctttgaatcacagttccacaacttaactgctatgtgcctcagtctcctcatccctcaatgaaggccaggtgcagtggctcacacctgtaaccccagcactttgggaggctaaggcggaggatcgcttgaggccaggtgttcaaaaccagcctggataacataacgagttcctgtttctatggggaaaaaaaattagccaggcatggtggcacacacctgtagtcctggctactcaggaggctaaggcaaaaggatcactcgagcccaggagttcgaggccaccatgagctacgatcataccactgcactccagcctgggcaacagagcaagactctgtttctaaaaaaagtgggggcaggagggacttgataatatctcctgcaaaggcttgctgtgaagataagaatagttaaaaggtgtgaagaacttagaagagtgcctagcacagtaagcactccattaagtgttaaatggtaatggctcccagctggactggcccacacagcatctcctaaacctgtgtgctcacccttcctttgttattacaccttccatcatttggcttatacagtgtggaaactcttcttctcttggctcctctatacaaattctgcccactgtcaaggctcgggtctgatttcccactcagccagtgggaaatctgagtacttcagctgcaaactagcttttctgcctctgaacttctagaatatttactagatgtccctaaatcaagttgttttttaaattactgagtgtggagggaagctcacaggctggaaattactggtgatggagctggaggtcttgctctttcctctgggtgcccctaagtgggtaatgtctcagaaccccagcttctttctctgaaaaagttattatcttatttataaggtttcctcaaagactgaataagaacatgtaaagctcctatcatataatcaggcgtaaacattagttcccttccagtgggactataaacctccaagggtagctcacgtttctccgtgctccaaggacagtaatatgcagagattaaacagacagataggggaatacagactgaataaacgaaaacctttccaagtctgattttatgacaatattctgaaaagggcttttccatgcctattctaaacaactgacagtgcttccatcataaaatgcattttgacacacttaatcttccaagaacatacgttgattctatgccctgatgagagaatatattagctacttaacctttatctaactcttacataatattaagatttttttaagattcatttttacaaaacccagaaagtccacacacaacaaaaacaaaacaaaacaaaaaaaggaacacaaagtaattgaaaagacttttcatacctaaaaagggaatttttaatcacaaccttagtcataaacctcaacaggcaagtcagaagcagtgaaagataaaagtgccaacaagaaaatccggttgaagtgccactcgggttcatgcagtgggttacagggcgcacaagacaagctggcggaagtgggtgctgtacctttatcacagccgcccccacctgaccacctgtagcagcctcagaggaagcagacaacccccacacactttccagctgcatctttgcagccacaaagtacgcacatacaatcagctaacgtataaaagtatatcagaagcatcaatgtgaaaagggaaaaaatctttaactcgtgatgagtaacctgtgttatttagattctgtcattgagacctgatgctaaggggagacccctctaaagacacccacacaaccctgataactggcagcataagtgcataatctttgcatcaaatacctggggcactgaagaggctgaagcagcaaatcctctggtagagggtgaggaccaaatgggggtacctcagaggctacagttcctccccctagtgttcaatgacaaatggaaacatgtcactgggtccaaacgcagggaggactagtctttgctttggcaccaggctagacaaagaaaagaccccttgccccgtgaccccacattgtcctacaaaggaaaaggctggattttgttgatgaatgcaattcacatgtttggagcagtgtcatttgaaaggactgcttcagaaattcatgcaagtcacataagtggagagaaaacaggaaaaaattaagaatggctgtttacaagtcacttctaaaactttgctttgttctacttgaacaatttttatcatcatttaaagcagttaaattaaaatgcacctgcactgtaaatcgtgagagaacatacctgctcttcaaatatgacttgaaaattatttggtttctcccctacctccccctacctgggatgctctcattttacatttaatttggaaaattagaagaaaaatggaataagctcaaatcctaaccaaaatttgtttttacttttaaaatacaaccattttagaatttttaaataaatgtaaaatattttattatttacttaacttttaccttcagggttacatgtgcagatttgtgatatgggtaacttgcgtcatgggggtttgtcgtacagattattttgtcatccaggtactaagcctagtacctgataggtttttttttttctgctcttccccctcctcccactctccactctccagtaggccccagtgcctgttgttctggatgggcgtagcggctcacgcctgtaatcccagcactttgggaggccaaggcggcctgaacatctgaggtcagaagttcgagaccagcctggccaatatggtgaaacccagtctctacaaaaaaattagccaggcatggtggtgtgcacctttagtcccagctacttgggaggctgaggcaggagaacagtttgaacccaggaggcagaggctgcagtgagccgagatcacaccactgcactccagcctgggtgacagggctagatttcgtcttaaaaaaaaaaaaagaaagaaatcatcaatgggcattaaagaaaagtgtaacttttaaacctactttcatagttcaaatacacccagtatttggaggtcagagtagtcacacttcactaactttataaaggagaggctttcaataaatgcaaggaatgtctaccacagcaatacatgtgtaaaacgtttcatctatgacagccatgttctaaattaatgttatatttcctactctgaaataattttaatttatgactaaaaatggtaacaaatgttcttttcattgaggcccaagaaagtatgagagtatttattcacatattctcatttcccatgtaacatgcctagggccatcctgaatgagagcacagaaaatgtgaaggatttctctgcctagtctgcttaagatcaacaacacctataagtctaaacataaaacacacacctttaaatgatcaccattaatgttaataagcattaaaggtagacactgaagtcttttgtgttggcaaatcctagaactacattttcattcagacaggttgcctctggataaacgtctaagattttttctaaaaacaagttatggtatttataattgccttctttaaaagaatgcaaattcttttgcctacagattacgctaagcaaaagagtgagagagagaggaaatttcagtaaaattttgagaaccatagcttgcattatagattttggaatgtaccttcctgccatttaacccaaccccattttcttatttcctagtaaatacactccccagttattcatcccttattataccctgggacaatggtcattttggtaccaatcacaccttagttttccactatcacctgctaaaagttctcttgaagaaaaaaaatataactgtaagagaaacctgagtgatataacgtcagtattttaacatcctaaccctttcaaattctctctatatgagaattgactattttcatcctcccttgaaaaaatgtgttcgggcattaaaattcctctaccttggaccttttcataatggctgccttagtatttattttgatatactattcaagacaccaacagtttgaggttttcacttcttttcttgaagagtgtcacaaagtcaaatttcagcctcatctacaagacatttaaaaattacactgctttcctgatttaactcctaaatatgcccaacacaaataattatgttgttcacctgaagatatgttctagaatcttcacattgctactcataatggccccaaactggaaactatacaaattaataaatagtggtatagtcacacaatataatactatatagcatggagaatgaaaaatcaactaccatagtcaatatggtgtcatgcacaatatgagttaactgtgcatattatcgagtgaaagaagttagacacaaaatagtacattctgtatctccattgatataaagttcaaaaacaggcaaagcaaatctatgctttcccaagtcagagtagtggctaccacgggtgaagtagttactggaaggaagcctgagggatttctagggcgctgataatgctgtgtcttaatctgggaactggttacaacagcgtgttcactttatggaaattcgtcagtaagatgaatatatgttatatgcatacttttccctatttatattatcattcaattaaaaagaaataaaattaatcagcttctcttaagaaacagacttacaggaatgaaaactagtgtgtttcacacagtaaaatggaagaagcttaagagctaggttcaaattccagactctaccattaattattcaatcttagcttctctggcttccagttctataaaatggagccaacagcaaagatcaaatgacataacactgaaggcattttaagcaagaagaatatacaaatgctgagcactactgcctgaaatactaataatgtacttatccgagaagcctttaaagttacatggttctacacaaaatgttagtataaacataactggcaagataatattatcagttttgccatttaaagaacttcctaacaatcaaagatatgcaacatttattctacccaaagttaaagtgtcctgccctaacctctactttgagacacttggtaaataattttcggaagagtgtcaagatacataatattataggagacgatgtcaaatattaaagcttcaataataagtggactagagaatgattctactcacagctcacagttcaatccatctcttcttctcactgacttctcaaccattctgtgcttttccatgttttcctccttcttcccactctaccctgcctcctacctggccatgccccctttctctctgcccactgaaattctacccactcgtcagtgcccagccaaggcattcctctggtgggacacccttccaggccatggagacctttccaggccgtggagacctttccttcctttgaagcactttttttagtgcctcaaccgtctgtttgcaacagtcttggacctgagcattgaacagctatgtatctctcaagccatgatttaacaactcatgtgctcatatcttgcttccccagtagactatatgttttccctaaaggcagggacctgtgtgatacttattttaatcccccttcaatgctctgtacattgtagatattaaatgcttgctacccagtgctctactttgtgggttcaagaaagcagtaatctctaaaagtagggcaaaggtgcagactgggatttcttcaagtaagtggattctgtcggtggcacctcatctctaaaactctctgttaagctctgatcttcttttctctgagagctctcaatcactctagactttagagactaaatcagcactttgaaatcaaagtataaggtgaaccacatataattttaaatttctagtagccacattaaaaagtaaaaaggaacaggccaaatgtatcttaatatttactagttaatcctatatatgtaaaacattatcatttcaacatgtaatcaacataataaaaattatcaaggagatatatatcctttttgtttgaaagctggtgtatattgcacagcacatctcaaccacatttcatatgctcaaatgccacatgtggctgatggctaccatactggacagaccaggtttagagttcaagctagaatatgtgatttcaaaccattctgaaaaaatctaaaatcgaacaaacgctataggaatatgcagtaatcttcctaaatcttgctcttaaaaaaaaaagaatacggccaggcacggtggctcatgcctgtaatcccagcactttgggaggctgaggtgggcggatcacctgagatcaggagtttcagaccagcctggccaacatagggaaaccccgtctctactaaaaatacaaaaattagctgggcacggcagcacatgcctgtaatcgcagccactcaagaggctgaggcaggagagtcgcttgaacccaggaggtggaggttgcagtgagccgagatcatgccactgcactccagcctgggcgacagagcgagactccgtctcaaaaaaaaaaaaaaaaagtctacactactttatcattttataaagccctctgtcatacattatctcatctagatgacatacgtacagcaaacattaagccataaagtagtttcttggtcctatataccaaaagaacacagacctggtaacacacgcttaaatcaaataactcacagccttaaagaacatctattcatgagacgttttctccatttttactatacagtaaagcatattttatctcttattttaagtcatttaagaactttttattttggaattttatgactagccctttaaatattagttttgctaggaacatcaaaagaacaagtgactaattacataaaggggaaaagattaaatgaatcatggattccacttgaacttcatcagttaaaaggataattagcaaaatatttaaggaaaaagtaaatgagcttgttagtcatggccttttgaggggaaaaaggtaaaactattttacttgcctgatctcagatctagaatctaaaagataaagaggtattgtggagaatcattataaaatactcagacttcaaaggttcccataaggtcaaaatatggactatgtataagaagaaaaaatatgctaaatataaaatcaatgtattaatgagatatatttatttaaatatcccttttgagtattcttaacaggtattcagaaccctaatctgcttttgaattttcaatgaatataaaagaaaaatttgaagacattaatggagaattttaaagcaagaatctaatcctgtatgttagaaagaagaaaatacaacgttatgtaatattttaattcttataggtgcccaaatacataagcaacctaactttgacatcgggggaaactggacaaatccatttaaaactaatttagcaacaaatacttacatggttctgtggacatgtaacatcccaaggtgttttaaattgataatgtcaccatatgaactgataattttcagttgaacatacagtttattctataaaatcattaaatcttaagaaccatgagggatcttagagacatttagcccagtgcctctcaaattttgatgtttatgtgagaccccaggggcaccttgagaaagtgcagattcagactcagtaggtgtgggtggccctgagacttcatttctaacaagctccaggtgatgccgatgctgctggtccagggaccaggcagtgggtattgtggccccagtcaagtctaagggaggtcccacagcctctgcttgggcatctccagtatccaggacttgaaacctgcctccaagggtagacattacagggagggacttgtatattacagagagggaagcaacaaggaaaggctgcttccacttctagtgatggaagacactctttctctcccaacatctcctcttctccatgttgaaaatccccacttcctttggccactcttagaactgataggtttccagacccctaaacatctttatcacagaaaatgctccctctgtggtgaaaatctttcttaaaataaatcccttgggacaagacatagcatcccacacatgggacatccagacctgagagtagttgagtgagaacattacattccctgatctaaaggggacagctctcttaatgtggccttaaggaggtgtcgccttctgtaagaatcacactgcactggtggctcacaatgttgtggaggaaataataccaagcaagtgttcccatgtgcacttgaacaattatttttaactaaaatgtagcaatttacagttatttctatttaatgtcatcttgctactataacaactcacataaatcctttaaaatgtttactaataggtcacacatatataaaaaacatagacagtttttaaaaacaattaagaagaaagaatatccttgggaccactgtccaggttgggagataaaacactgccaggacctcagaagcccccagtgagccccttctctatcatacccactccttcacctctggaggtagctgttatactgctttttgtgacaatcatattaaatcatattaattttctttatagttttaccatctatgtatgtatccctaaataacatatttagttttgcatgcttttgaactttacatgaatagaatcacactgtatatattcttctatcttgcttctttctttccatattgtttgtaagattcatccattttgatgcacttttatttgtttaacaaacacatatagaatgtattgtctgccagtcattctcctaagcatgtcacaaacattgactcatttaaacttcctaacaacactatcaggtagacatcattttccctgatgtacagatgagaaaactaaggtacactgaagttcagaaattcatccaaggtcacacaataagtggcagaaccaaaatctgaacccaggcacaatccttcctcttgaccaccaagaaatgctgcctctccacacccttctatatgtggttatactagttgatttttcattgccaaatagtatcacagtgtataaatacctcacagcaaaatgtgctgattcgattcaatgttgatgggcatttatttgggttgcttccagttttttgctcttatgaacaatgcttctttgaatatgtttgtccatgttttttcttttaagttcaggggtatgcacatgtactggtttgttacacaggtaaacttgtgtcatggaggtatgctatacagattatttcatcactcaggtattaggcctggtatccattagttattttccctgattctctccctcttcccaccctctaataggtctcagtgtccgttgttcccctctatatgtccatgcgttttcatcatttagctcccacttataagtgagaatgtgcagtttggttttctgttcctgtgttagtccgcttaaggataatggcccccagctccatctatgtccctgcaaaggacatgatctcattcttttttatggctgcatagtattccatggtgtatgtaccacattttctttatccagtctatcactgatgggcatttaggttgattacatgtctttgcttattgtgaatagtgccgcaacgaacatacacgtgtatgtgtcttagaataatttatattcctttgggtatatgcacagtaatgaaactgctgggttgaatggtatttctatctttaggactttgagcaatcatcacagtcttccacaatggctgaactgatttacactcccaccgagagtgtgtaagtgttcctttttctccataaccttgccagcatcaattattttttgttttgttcatgtttcttaaagcacataggtaatcatttttcttaggtgtatacctaggggtaagatggctgtgttgtaagttatttgcaggttgaacttggttaggtaacagcaaattgttttccgatataattgtaccaagttagactcctgtcaactaaatacaaaaactcccattcattcacatccttacatggtattgtcaggttttaaaatttctgccaatccagagagtgtgtaatcatatgttactatgattttaatctgcatgtgtttgtttattaatgaagctgagcatctttttatatatttactagccaattgggtttcttcctttgtgaaatgcatgtttaagaatatgaatgtacagtatcatttttctttttggttatctggcttttttattgattcacatgtgtgctgaaccagtattatttatgtgccacaaacgtctttaccactttgggcttgttttctcattctccatagttaccactcagtgaacagaagtcctactcacttttttttccaacaataagtgaaagacccctcatgcttttttttttttcttttttgagatggagtttcgctctgttgcccaggctggagtgctgtggtgcgatcttggctcactgcaagctctgtttcctgggttcacaccattctcctgcctcagcctcccgagcagctgggactacaggtgcctgccaccatgcccggctaattttttgtatttttactagagacagggtttcatcgttttagccaggatggtcccgatctcctgacctcgtgatccacccgcctcgacctcccaaagtgctgggattacaggcgtgagccaccacacccggcctcctcatgcatttttaacttttgaactattttataagaattttttaggtctggccaggcacggcggcttacacctataatcccagcacttagggaggctgaggcaggcagatcacttgaggtcaggagttcgagaccagcctggcaaacatggtgaaaccccatctctactaagattacaaaaattagctgggcatggtggcatgtgcctgtagtccagctactcaggaggctgagccaggaggatcacttgaacctgggaggtggagggtgcagtgggccgagatcgcaccactgcactccagcttgggtgacaggacaagactccatctcaaaataaataaataaataaataaataaataaagcacttagaaaggaaaagaattatgttaaatatacatgttggtcttacagtctagaaattcagttgctttgactataaaatacaaaaagcaaaggctctgggataagaccactgtgatacgaagctaagatagtgatctctgatagtctggccaaactgcagcaaaaccaaccaaaactaaacaaaaaacaaaaatgtccccatatgtagacatacggaaatgggctgcaaaaagatgaacgtacacctgaattcctggtgacatctgggcagcccctcagcaggtagcacagttcttcctgagctagctgctccactctgctgtttcctctgactcgcattttctgttaaccttcctcttggaatcctttgacaatgactcacagggttatggggctacttagcaataccacagccctccgcaatagatgctgtgtaggagggacgcagctcagtggattgtagtctgcaccagtattttcctttctgcattcagggaggatttgcttttcagccacatttccctcaaacacagccccgacaggagatgcttagcgcagagatttctaaacgatgaaatgatctgagtttggctccttaatcataatgaaactaaaaacagtaagatgagaaaacaacagggggatcatcattcctacaaaaaacaactttatacttgggcaaaatcaagagattaaaaaaaaaaagctcaaactaacattttccaacctttcactaagagcaagggctaaaaccacatgttttgaaggtcttgcactgtgttattattagaagtcacaattctattgatactgatgagtcattcgtatcggcggaaaccaagaacttccatcaacatcatgttacacacagtcactgtggcttttctttattactggtcaaagctgcttcagaatgcttattgaaacttaagaaaaagaaggcaaactcctcaagggtgtgcaaagctttcccttccccagctgatcttactttaatcatcctttttcaagacagtttatgatgattggatcaacttgtatctacaaaaggaagtttatttagaagcctcagaaaagcaacatttcacactttccgatgaaaataagcaaaactgaactctgaaaacaaacagtgaaaccatctctgaaaatacatgctagctttaaaatgacctgaggtcaagttttttgttttgttttttaacctcaataacagggaacggatataaacaaaagctgtcatcacttagggacttcagccacataaaacaatgtcaggctagtcacttgcaccctcgcccctgcttccctactcaggacacactgctttgcactgagggagaagtgggtcaggtttcagttacgccaagaaagcctaactaagttaaaggtttatgaaaactctttctgatcttagtaggaaataacagcacattcccttttcatttattatcagccccttttgcctctccccttaaatattcccagaaaaataaagtgaagcaaaaaaaaagttttcctgaggcatatccagaaatgctatgaatctttatgcagtccctacaaaggtagaaatttgtccaattttctcccctgcaaccagaaggctgtgtctggctgctggcaggagaagaggacccagctcagcagtgaccacagatctgaaaatagcctcccagtagctaaccagcccagcagcccggagctctccaagggcggtgctggtactatgggcagtttacagtgcggccagctgagtgctacaacagctgcatgagtcagcaagcactgctggtaggaaagtgctgacatgctaaattactctcgtgtacttgagatgcacacacctacctggcaaaaacaaaaacagggtacatgcaaattagcaaacgggaacctctctacgcttgcagtttctattttccaaggttagaccaaaaatataaataatctatgccactgctcaaaaagaagtaacaactaataataattaatcatggtaataaacaactcactcttagtgttgctatgtgtggaacagctgcactgaaatctcacgagccagttaattttaactggttttaattttaactagatttaactgcttttcctcccttctgaaaaatcaaaatagttaccatatcgaccacaagaactggtaacagacaagcacagttcctgtttttcagaggggacttactttcaaacccacaatatcaacacgcttaacataagtggaaatttaaaatgtactgtttaatgtgggaaatttaaaacctgtatgctaattgagatctcatgtgccaggctttgtctgacaatgcctctcattcatctatgttctctcgttttatacgggacctaaaaatctgcaggaacactggttgtctggaactgagaatacattttcccacagaaatagggccaggccaatgagctaggattccttgatagtccgtgaaaatgtcttgaacttaaaatatgagaggttaaatttataatctaaaaagaaaatgatactacaatgatagttccaaaaccatttaaaagaaaatactcttgattaactgtgtttgaggaaatgtctaactacaggaggatgaagggacacagtcttccaagtgacactttcagacttcaactttagggtcattctggttctctaacatggtttcaattgatagtttcatttaaaatgcatagaattctcttactttggcataaagtattgttagaaaaaaaatctttatacttaccggttttaagtactgttttgttctccaaaaaaaaaattgagacttggaaaacaaaaaaggaggagaaacaagtacaaagagggggtactagagagagggaaacaaattaagtctggaacaaagaaagacacggaggtataactaaactgcaaaaacaaaggagaggtaggaactagagggcagttccccgctagacagtgtgttcccagagaaagaggactcttcatcatacccagctctggaggtgacagtgaagtcctgcaagacagttccacagactggcactagatggagccatcaactcaacatagcatggttgctggagaagggtatggtgggggagaggtgggactgaagggcgttgactctacagccaggtatttacctgccaacaactctatctaaaataagtatagtttaattaatcaaccaactctcctaatgtccagatgtcaccaccatgctgacaccactatgcttgtggtatgtcaaattgggacacaccaattttgaaataaatttatcaattcaatttgtatcaatgcaactggggtggggaggtaagtgaagttggatccgctgctttttttttcttctaaaattcaacatgcaaagataatatagaatttcaggttcattgctactgaataacaaaaatccctaaccacaaaccaaatggctttccctggaagctttgtttaaatgttaaataacataccatcttgctatagaggtttatgtgatcaactccaatgtacggcaaaaggcgggaaatgctcactgacaaatgtattattaaaaataatcttctctttgtattttaatactactttgatttaaatactgtaatccatttgcctatattctctgcctagggttgtgtttatttatcacgagccctctctccattcagaaatggtctcctatcaccaggttaccagtgtgcgaaattctattgtttttatctttagggttttacttctttggctttgtctcctattaacatgctgatgcttcagaaaagtaacacattaagtatgctcagttacttatatattagtaaaactgtgttcataaaatctttctctgagattggttttggaagggaaggacaaggactagttgaggggactgggtggccaaaaggtaagagagcatgaaacaaaaaagtgagcacagaaggaggatgggggaactggctgcaaaccgtgcctagcttctttacatctgggacacggaccatcatccctggcacttatcttcccaagaaaatgtatgaaaaggaagggttaactctgtctacattttcctcttgctgaatgggtaataatatctttcacagttaatttcatttttttttcagtttgactcttcagggcttattcatttgcataatatggaatcttgaacccacatagatattctacaaatcaatgcaagtaattctcacactaaatcagcagctttaatttaagctcaacattgtttgcatagaaatctttatgcactcatctgcttgattttttaaatcacttaaaacctccaacactgacacactaagcatctcccatttagctttctccaaaatttgaactaaatgctgaaaaataagcacagtactatacattcatacacttgatcatttcccaaattgagcttcaaatgtgtgcttaatgtttcaagtggctcctgagaatgatgcttcttgactaaagatgacaacttcggtgtctggcccaggcagagctgagtcagcattctaaacagtgaccctgcaaacctgaggtaattgggggttactgccataccaactgcctgagtcctttaaaaccattcaaatctccagctgagagttgcaacatgctaatctggcaagataatctcttcctgaaattgaccagaatgagaacaaaggttacctccttttatctgttactggtagctaatatttctaattaggatttctgatggaattagttctgaatgaacatcttcctccttggtagaatactctacctcttacaggtatagttttttaccttttcctacccaccaaaaaaacaaaaaacaaaaaacaaaacgcaaaaaacaaattccctccacctaacaagagggtaggagtgtgagttacaagtaaaccctggagacagagccatggtatttcagttatatgcctagtacttcttttgcctttatatgcatcacttttactttccgatccctaaatggacactaaaacctaaggaatgcaattattagaaagcaggccatgtgaaagacaggagatatactcactcagatttactgagaaattattttttaactttaagatagatgtcaacaaaacatccaatattttagagtgagatgacctttatttctacttctgggaactgctaaagagagttccaacttcaaatgaagaagaaaaggaaaagggagagccataacatggtaagagaacaggcccaagcatcagacagctagtgtccaactccagttctaccattcattagctgagcgacacctatgctgcggcttctagtgatcacacctagccctgggttgttctgaggattatgtgagttaatatgagcagcacacagaggaagctctcaatacaagttaactatcatcaaagaaaaagaaaatagaggggtgttagcatgaagtataatcaatttattttaaatagatgctgtcaaaattccttaattttgcatctaagaatggtctaaataagacgtgtccaatcttttggcttccctgggacacactggaagaaggagaactgtcttgggccacacataaaatacactcaacactaatgatacatgatgagctgaaacaagaaaaatagcaaaaaacaaaaaacaaacaaacaaaaacaaaaacaaaaaacctttgtgttggtccgcattcaacacgcaagaggcctgctggccatgggttggacaagcttggaataatcttcgggccacagaggatggagaccctctgctctggagtagccagggacttcagacagactatttagactcactttttcaccaaaggccctacacacatcagctgactgggagagaatatctttgtagcttctgatcattcaaatattgtcaaaaccaacctaaatatgttcaaaataagaatgttaacttgtattttttccaagtatggaaatgaacagtactcttggcagttaacttctgtttttatcaggttctaaagacccaggtaaataaatcaattctggactctgtatacaggaactattatttgccaaaatggccccagaggttccagcatggcttaggcaatactccaaagggccaaagatagtagtgaattaataggattaggaagctggagaaaaagtgaatctcaagtttcagactgtccctgatggaaggtcactccacaattcctcagggagggcttccccaacctcccgaccaggttaaatctgcccattagacactctggtgtatgaaatactttccttcacgagcagtgggttatctgttactaactgatcagtgccattcttcctaccagatgacgtgcttcatgagaccaggggccaggactgggtttgctccccattagcactgtggtcacttaacactatgcctgccatgtaagagatactcagtatatatttgtttaatgaatgaatgaggcatctgcctctaagcaacagtatttctggacacttggcccattttgcactatccacgagcttctgttgcttagaagaatacaggataggaaaaaaagaaaaattgccaaaaatctatggatactgaaatactaaggaaagatgctgagcatgtacattcactttgtttcctacttgtggaatggaaatcatcacattgggatctcccaactttaaaatccgaagtgaaggtctaagctgtctttgggttagactcctggaaagtcttgaggaaattcctgaagtatctgcagaaagtgacaggggagggagaatagaagatggcccaagactagagtgatggaagacttggaaactcgaaaagctttcttctaactaactgggactttgtctacatgccagctacaggctcaggcacacatgaagagaataatgagatgaatgggaggactggaaagtggaggatttaaatgcttaggaaaggagccaatgaaagctgacacaaggacaggagggacctagcaaccaagcgccggctctcatcacatcagcagcagcatgtcctacagccttcaggaaaagaacaaaaaggtcagggaggaaaatgacacatctcagaaccaaagggcaattcattatgaggctaaggaacaaaggagaagtcaaccagggaatatgctgaagaaacggtgattatgaagtcactggggaagactgagaggcattttggctgtagttccaatgactagaatgaaggatgatgtgaaatgcttttggattgggaagatttattattttggaaaaaaaatagctcaaggaaaaacaaatggcaaaattcctgcctgaattttgaagtagtgtcactagcaggatgaggttcaatttatacattctttagaaatgaaatggcccttggaaaagacatagtggtaagattcgcaggacatttccagccttacggaagctgagtagcatgctgatagtaaaattaagtttcagttttagatagactgacatttgaaattaacaaaaaaaaaagtaaagggaaaaaattaaaagaccctgaactgacaaaaaaaaagaaaaaaaaaagcaactactgtcttttttttttaaattaaatgtcatcacaaacaaaaaaaaaaaggtgaaagttgagttgtattttgggcaatcttactgagtttacaaaatgtttagttcatagcaggtttcagtttggacatgaacagtttgtaaatatttacataaaatttaaagataggaggacagcagaggtcatatattgctattaacaatacagaagcgattttccgtcattcccaaggccttggtgctgcgttcccatatgtggccccagctctgccaaaagcttgtcttcttttccaaagaaattccaatttttgcaaccagcattgacttctgaactgtgagtacctctgacagggtcatatgtcgctgaaacttcttcaacatccagacagggaaaggagaaaaacagggaggcagatttacagcgtctgctatctgaattgcagattttgacaaatatgttacattttatattgttctctgttctatgtgagggcagggaccatgttctctgtatgtcacagtcctacaccatgcccagtcattgattcaggactggactgtgtaatggaatggggaaataaccttcagacattcaagaaaacatgcactatattcagattaagttcattccaacatgagattagttcttccaactctgcagaatgggcaggcacgacacctacttcaaagggttgctttgaggaatcaatgaagtacattcaggcaaggtagtcagcactgggtctggcacatggtgcggattcagtaaatcaaaactattattttggtgagtgttctcaaatgtcaaactcccatggaggtcctcaggcattacccagccaagttaccccatctggtcagtaacaactaaatagagggcaggtggttcaaaagtaatggattattcacctgcaaggaatcacactgtactcatggtattaaattattcggcctttcatgtcgaattctctgttaaaaaggaagctgatcaatccctgagtgggactcaatgttgatttgaagttttgtttttttggcatctttctattttccaggtagttgtaaccattcattgggtgcatactcacaaatcatccactatatgccaggcctttagaaaacagagacacacaaagatattaaacaaaaaaagatgtttcagtctgttcagtagtgggagacaagcagcccccaggccgacactagctcttacatatgctttcatccaaaaattttttaaagatttgagccaatatttaaaaatcaggaaattccacataaatatccaatattcagcttcccctggaaaaatcaaatgatgtggcaacacaaagccagtagtcctaccaactgttccctagcaagagtctacaatgagttgagtaggggcggcctgccactccacactatgccctgctcctcaccagaaccaggtaagtacataatttgcagggctcagtgaaaaatgaaaacgaggggccctttgttcaaaaattattaagaatttccgaagaaaacagcagaaccttataccaaatatgaggtccttctgagcagggaagaggaagggggcctatgtaactgcacaggtcttatgcccatgaagctagtactggctctcaccccctggacacacaggaagatatttatttatctaagtattctctcattcattaacaatcaagcctgcatttacaataagctagatgtcacacccctgaaatctgaggttcaaaaactagagtagaggggccaggcacagcagagatagagagccactagggtctctttcctttttgttaagactggatccacaccagagacactgaaagttaatccaagtaaaattaaactgctctcaacaatacagattggcttgagcccttttgttggcatcacaggagcctcgattaggaattctgagaaacagctcacaagcgctaatgaataactaagtcctgtcggctgtgcagacagtgggcccagaagtgaagggctggcctaggagagatctgaacatgaacctgaccatctggccctctgtgactcactttgatcacaaaatgaattgcaacaaattgaagagcacatggctagagttaattgtctcatctgtaatctgaatctacttttaagcagttattattaccctctatcaggtggaaacatttcctaccatcactgcaaagtgcattttcctgatgaactataatggatcattaaattccatatctgaataacaatactgtgcacttattcagtgcctttcatccagggatttcaaggcagtttgcaaataattaagccccttacacagcagccagaggtgagctactggaaaagaattgcctgaagatactaagtcaaagggcataattcaataggaaaataataaatggctttctcccaggcactggtaatacagaaagtgaatcctgatcccctccctctctttcacctcaccccttcttcttcatagcagatcctgacatgcaacatacaaagaaccaaaaaagtaactaacaggagtgttcacaatttagctatgagttcagacacacacttaactgagaagtgtgtgtctccatgtaatcctggcaaacacactaccaactgacatttcagtccacctgcagaatagacagacagcagaagaatttactcaacacattcatgattaccaaatggcaaacctgaagcctcctgcaatgcaaaacgaaaatacggctctgcaccaataaagttatgttctaacaaaaatactttattccatggttgtgtgttccatttctgggacttcgctctatttcaatgatattcaggtttcgagagtaaaaaaaacgttggaaatgggcaatcaataaatttctttcaaaaaccagaatactagaagggaaaacatttcagccactcaaagttttgtggtgaaattataaactccagaaaaactgaatttataatggaaatgctgacagacctttcagtggagcagtttgaacgcaacactgtaatttggcaatctctcttacagactaaagactaattctaacaagatgtcattttgactcacgtttattattacctgcaagaatgaaaaacgccgtttactcgggaggtgcccgagaaccagggtggggcgatctcacattttaagcaagacgcccgctgccttaccaaaatagccctctccgccaaaggaggggcagcctttcacgctcagcttctttcatgtcagcccgagcctttgcagcaagacgtgcctttcctacatgttacattttaatgatctgagaaaaccgttatcagcgttaacatctctaattttactctaaacagacaaaagcaaaatatctcattaggcatcatctccgccaaggttcccactaggcaggaaaggatttttatctaaagtaattaccctttttagttaaatacactcaacagatgaaatttacagagagtgagagactgcagcactagacagcgaaggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccctcgtgggcacctagggtagcccgtgagcgccgcccgccgccgtctccagcggcgccgggctcccgaacacccgccgggtgagcgaagcacagcggggccacggagcgcctcgacgcggggacggggagggcagtgtccccttcataaaccagtctcctgggtgaagcttctggggcttggagactggagtgtagggtgtgtgtgtgtgtgtgtgtgtgtgtgtgttgcaccttgacttcatggaggatctgtgggagaggaggtgcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccggcggcggctgacagctgagcgcaaaggcgccgcggccaaggtcctcgcggagcagcccgggatgcgcacgccgagggttaaggaggaggccgcccggcctggagctgggatcgcaggctgggggccgggacacccgggcctcgccgggccgggggcagggccgcgggtctgacagctgctgcggctcgcgcggacgcgcgcctcctgcagcccgccctccccatgcctgacttattactctctgctcctcctccctctgctgttccaaaacacccttcgacgccagcaaaatacaatgcgcctcggccgccgtaaacagccgggagggagagcacacattcggcgcggcgcggccgccggctcggctcccacccccttcccgttcctagaaaatgccataaaagcgggcagggcgcggggagggcggctgcgcgcccggcggccggggctcccttcccgcgccgtttccccacgcctccccgcccgccccgcgcgcccgctccccccgcaaacttgccccgccaccccgcccagcggcggggcccggggcccggggcccgggactcacctcgccggagaactttgcgtccttttccgcctcctcttccccgcgtcttcccggctcgcagccccctcccggcagccggcgaggtgggcagttcgtgggtcaccgaaagctcgcggaggggacgcgcatcacatggcagctcgttcccagccccccgagtgcgccgggaagggggaggggaaggggcgaggggaggccggggggaaagcgagagcggggcggcggcgggagtgggcaggcggggtggcgagggcggcggccgctcacgttagcgctgtgcgaccgcagcccgggcgtgcacggccgctgctgccgctgctgctgctgctgctgctgctgaggcggcggcggctcggcgctgtttgctccgcgccgcgcggcttgcgctctccccggaacgcccacactctcaatcgctacattgttgac

SEQ ID NO: 1541 - DNA, 370316 bp, Homo sapiens
  source 1..370316: mol_type = genomic DNA
tcagtttacaatgcataatgatatgtctttatttcatcaacagaaatggtgtctagacaaaattcagttaacactagcaattcaattgagtgaaaactttttttgcacaatagtgtatttacaatgagtaaatgaagtttcaattcattagttcatagcaatgcttttttcccccaaaaggtaaaaattcttagttacagagaataagcatcaacagcctttcattttttacaataaaaaccacgagaaaaaccacaatcacttagaaaaaaataaggacaagcctaagaactagtacaataaaatgatgcattgaattaaattacattaatcgcatagaatctgtgtaaaaagtatgtagaaaaacacctgatgtaacctgttacagtcgttgaccagttatgagaggtacagagggttatacaggtagatatgtgtgaaaactgtccgtattgttcaacctggggaggaagagaagaggggctgcagccccttgcatacactgagaagaccctgttttgaatatggcctctggagtttgtaaggcatatattagaggtgcacttgcatcagactggttctggaacaaattgtcaaattgtcacaggctctcttggcctcactagcaaaggtggtgcttgccttgaatggctcactgtgtctaacaagcacctgaagctcccaaatgcatatggaatcttcctgatcactcactagaggtgccatgtctttatgtcagagcgtgaaacgggcatcccaggatttgcacacacaaaatacattgttaggacttaaggggaggtcatagttctgcctccaaacatgttttggtagaagactgagcatccatctgtaggaaaacccctctttgtccaagtcccttcactctttcgcaacatatgcgtctgattattcccatgggagcacttggcactgaatgtgagtctacctgaaatgaatggtcttggtgcacacttctgcttctaagaagggccagtgttttatctgaggtcaataaactggaatgagaatgaaagtcagagctgtttatccattgcttgacagcaaaatgcatacaccgtgtcacaacattaaatcaaagctatgaaagttggcctctgcaaccaagtgggtattcttcacaaaatggcagcatcgttttcatattacatttaaaatgcactgatattcatttgatagaaatatcatctcccagggtggagtgtaggaaaatactataaacttttctttgcaagtaatgtttttgcaccgtcagttgaataatttatgctcaatctgccacaatgagacttttctatgtacaaatgctatttgcacacactatttgtgtacagatatgttctgttctacagcatcggttttggacgctggggtcatgagatggctcaggcagtactataaacatacactttcaacacacaatgcctcgtgcacacagatttcctgtatgaataccaactccacacagggcattgtattgtggactgactcaccagaaattgcacttccaacacagtcttcagtttggggaagaaacactaactcatgatacaacgaacagctttattcttagaaaacaaaaacaaaaacaaaaaacaccttgttctttagtctatttacagtcatttgaggaccaaacttgattcttgctccttctggatctgagactcctcctaaactgtaagcaatagtgaagcagtttgaagtcatttctaagacagctcctagtttaaatggggcataatgtagagaagtaggtagccaaatagggacttgagaaagctttgcaggcagctcttcctcattttgagaggattatgctactccacaggatgtcaagcagcttcacgggacaggagtttttggtgtcttaacaggcttatcattttcaaacctttgtctgttccttctttttcttcttctttgatggcaatcataaaatattaaaagagaaaatgtgggtttaggcctcttgacaacagcattaaacttcacactgtgcacacttcactttagccagtcctctcatgagtcttgtcgctggtcctggctccttttgaaggagtagtggcagttggcatactaatcactagacttttgttcccttccttggaaaagcaatgtaaggattacatcccgaattatagtgcatcttaaaagcagcaaacctttagaaagacagttaataaattactcgcacaacattcagttgcagacacacagagtcaggttttccactgcagcatcatctctgatgcctgagtcattgctgggaactcagaagataaatagcaggatggcctcgtaactttgtcggtttttttttttttaaagtttttctaactgttttgttccagaatcagtatgtaataaagttcgattttaatcaaggcacccccaggtaacgcagagaaacaaacacatacagcaaatcactcacctgtccaaagcctgaccaacttgaaaagaggttgcctggatacacaagcaggacaaaggcagatccaaggggaggactggatttaggtgggatgttcattagtctcagggtcactcacctccactggctctgccccaacaaccattcctaccccagccatttggagacccaagcaggcatcctcctaaacagcccgtggttggagggtctcttatttttgtaagaaaagagccttaagaacaaccaaatgttactgtactgtgcaaacactcttccttgctgttcactcacttttctttttcctaaaaggcgtggggttgacagagggatcccagggaaaagagacaggctaggttttaaaattccacttgaggccgtttggattctggtccccagcaagtcctccctttgaatcaacccagaaataattttgacaagcacatagttctgaataggaaaagacacacacacatcacatgaacaactgcacgaagctagtcactgttcatggtggattatgaatgaaataacttgtgagaaatctctatgaaattggaagatggtttttagagcagtgtttttaaccagttcccatggcagaagttaggttgggggaagaggaagaaaagcaaggcaggggtgggtgggaggaaggtgaggtctgagttagggtggagagaaataaagaggccccgcccctgctagaaatggctgccaaacaggtctgggctactgaaccacagaaacctgaggaaatggatggaatgtggtcaagactaccagttgcacatgagttgttaccagggtaaacctcatgccaagaagctgggttggacctggttatgatatgagcagaaagtgttctttttttaaaagaagaggagaggtcacttggaaaggcaacaatagagttaaaaagcaaaatactgtcagctgactccactgtaacacacgcctgcgaagtatcacgtgattcacattgagtttatattctcactgtcaccagttttccacaaaggcaaacctcatggtgaagcacagaactgtcctagtaggccaagaaattccaacaaccataacaaaaaccagcagctccaacacagagctttatcaagatctgtttcagacacacacacacacacacacacacacacacacacacacacacacacacacaaacaagaaaaaacaaaaacccagaggcaggttttaaaagtggaactgtttaaaaagaaaagccttttttttttttttttttttttttttatcctactgcatgaactgacaaatttctggcattcatacatatttaaacatttagtgctaatatttgtacagaaaaaagttaataatactaaaacatatgttactatgatttcacttttagcctacatcatatactaatttccccttttacatgcagctttaatattgtccaaacaatggcacaaataaagaaacaaagtcaaccatctattccccactgcccaccaccccatccccacatcaaaccgttcaggactctcttccccagccgggctggagtggccctcgggctgctcagtgagacccggacccaaggccactggagcgagggagctgattcctcctcctctggggcacaccttcctgtaaacgtggctggggccaacacggccccagagccaagggaagctgctctctctgggttgcaagccaaccagttttgcagcaagaagagaaaattatcatcaggtgagggtagggtatgtgtgtgattcgggaaggggacagggagggttcccggtgatagcttgtccaaagcctcagaatgaagtctgccttcagacaagacactggcagaaaaacctcagaagaaaactccaagcctttggagaaggaaaggagaaagaatgtgtcagcctgtgtcagggatggatcgcagatgccaggatgccctgctctctcccaatggggtgaaggcaggaccttcggggctgtgattcaaatcccctcaggccagatgtcctgggaggccaagcctgggcaggaaagccagtggctggttggccccgtccttcaggggagcaggtcctactgcacaacacttccaagagcaagccgaggcctcaggacgtgttgaaatgaatgggacttactccctgggtgaaaactttctaacttgatttctaggagccaatgcctgctgagttctggtataaaatcacggattcctgtttttctgatgtacttttgagtgagatgtccaaactctctccccacttaggaatctgaacatccagcatcaactctgaactctctatctgcgtttaaactttgcttagggaaaggtggggaggaggtgaaatataaaaatattcaagcagattattgtctacacatcctaggatgaattcattatttggcaagattgtttttcctacataattatcacctgagtgctttttaattagctaaaatgttttacttttttaactaaaagcaaagaatatacagtatacttgagttataccgaagttacaacttcatttaagaaaataggtttgacccaaaactcagtgcaagtggcaaagttgaccattactgtacagtatctgcaaggaaaacaaaaacaaaaacaaaaacaaacaaaaccccccaaacaaacaaaaaacaaacctacaatgctcaaatgacaccacttggaggtgccaaaaccaaaccaaacgaaaaagaaatctgaaataaaaccttgggaaaaagcttccaacactgaattttgtccataaataagtacgaattgaaaattgaactgtgaagcaagaaaaatgaccatgttaacagttaccaaactagttctagcatcagagacaaaagaagaggaatgttggaacctgtttctaaatgagaaataagtttccagttttaggatgagaaagttgaggcatgcaggacttttgcatatggatatatatatatatatatatatattttatatatatattatatataatatgtacagtctagctataaaactttgatgtgtatagaagctgtcttcaatgaaaaaaattgaacattcagaagaaattcctgagatagggtttgtgacatgggccactgagaaaaaaaatccgtggttggggcctagaggtgttgtagtctatccctgtgaagactgaaattgagccacagacagacagtgtcatcactgctgtctttccttgcctgggcaaggggtagcaccattgtgaaggtaactatcactcctgctcgagaagaggagaggatacttcggaacagtattgctgctaagaccgctgtagtgtgcaccaaatgtgttctcggtttcttcgggacagcagatgaacagtgccacaggctgactgaagaacgcctggatgggagaggtgtgcggactgggaggcagagccgagtcactaggtataatctttcctgggctgttcgtcagttgtacacttatcagtcatttcctggcagaagtccacggtcactgtttggctcctgggttcaagaggaggtcctctctctgagaaggttcccgggtcagtgccttctagtctcctcccagaggtacaattctcggaggtgttgctgggtgcccaggggggtccggggggagccgcgcctggctccaagcagcagggcacgttttcccccactgcgcattgggaggccgcaatgttctgctcagcacccaagggcgcagggttaatactggaggccgtgggcaagtccatgggtctgaggacagggcaataccgatgcagggcctggatctgctcggggctctggatgtctcggcaaacttcctgggaaaggcaggagaagttgtccaacagttcccccatgcatgctttcagttgattcctctctgacaacagtttctctttctcacacacctggacagtagagaaaaaaagagaagggttgatcaagcctgaactggaggacagaaggcctcgtttcaggttttccagcctttgttttgcatcctccattataatgtaactcaagaatgactaggtcaggctctagaaacttaaagatacatattcagggggcccagacacaggcttctgccacaccttccatctgatgccaacaccttccccaggacatctcttcatccctctccaaggcccgggcaaacaaccggcaaaatcgtcacgaatcagaaaacttcagagtccatgttttggtttcctggaatttggggtttgtagagagttaaatgaaaaactctcagtcccaatcttgtgactgaaaatctcccccaaatgtatcaggttgccatttttgaaaggcaaaaatctaccattccaaccgtatgacatttcgaaaaaagcaaaactatggaagcagtaaaaagatctgtggttgttaggggtaaaaggggttgaacaggtggagcacagaggatttgggggcagtgaagccactctgtatgacactatactggtggatccatgtcattatacatttgtccaaaaccatagaacgtgcaacaccgagagtgaactctaatgcaaactatggacttgggtgataatgatgtgtcagtgtaggttcattgactaacacatgtaccactttgtgggggatgctgacagtgggggaggctgtgtgtgtgggaacaggaccatatggaaactctctgtatagtgtgttcagttttgctgtgaacctaaaactgctcctaaaaaagtaagtcaggctgggtgcagtggctcccacctataatcccaacactatggaaggccaagttgtgcggatcgcttgagctcaggagtttgagaccagcttggggaacatggcaaaaccccttctctacaaaaaatacaaaaattagccaggtgtggtggcacacgcctgtagtttcagcttcttgggaggctgaggtgggaggatcacttgtgcccgggtggtggaagctgcagtgagcgagatggtgccacagcactcaccctgggtgatacagtgagaccctgtctccccgcaccaaaaaaaagtttattaaaaaaaaagacaaaaaaaaagtcatcaacaatttcctgtcgttgcctaacatacggagtttcatatagaacccagtatcagcaggctctctggccttggtagcagagcagactgaacaggagggaccctccctaggacagctgggaaaagtgcagtctggagcagcgattctccccgacttgggaagggagaagtaaggatggagcctgaacccttgagtactagcccaaggttctgagatgttcttctccttaaacaaaatcctacacatgctcctgtgttactgaaattcaccatcccaatagagaggtgacttcagcagcagactggagactaattaaggttttaccatcaacatttgtgagaagggggctgggcatggtgggtcatgcctgtaatcccagcactttgcggctgagatgggcagatcacttgaggtcaggagttcgagaccagcctggccaacatggtgaaaccctgtctttactaaaaatacaaaaaattagctgggtgtgttggtgcgtgcttataatcccagctacttaggcggctgggacatgagaattgcttgaatccgggaggtggaggttgcagtgagccgagattgcaccactgcactccagtctgggcgacagagcgagactttgtctcaaaaaaaagaaaaaaaaattgcgtgagggtgaggggaggagatggggttccatgaggcacacacaatgaagtggatgaagaaaaggggcatctgaagcagcatgaagtcagttctcaccaaccctttgcaagcgcaggcaggagaagaggacgggagagaaaatgaagaggagaaagggaggagcaggcatgcgacacgcacaaggaacaggtctccgacacgggagctgcatgtgccgtaacatgaatgcaatctggcaggcggcgtgggcatgtgtgtcggaaagagagatttacaccgggaaagggcacctcctaaaatatttataaatttatcaagaaaatatgttttaaaaatgaaaaataaacagatgtacaagtgcaacttgagagaaatacattatgcgagtttgcaacagctgagtggcgggtgtgtgggagacggcgtgggagtggggagtgagtgcagggcctgctggggaccgggcagggcagggagggacttggggagaggtggaagctgctccgcccaccagcgccatccctgtcaggacatagcatcctcaccacagggtggcagataagaaacaaaacacatctgggatgtctccttagggaaaaaacttatatgggtggctgtgcaacctggagctctccccttttagtacagaaatctgcaatgtgaggggcaatactgcttgggcgctgggagaggaaccccaggatcattctgccacattaccccggccaaagcacggacccctccaggcctactcatctgttaaatgttccaggccactttctagggggaagaaaatgaggtgccgcgtgtgacagcagcaggggaaggcattgcaaatcatgccttggttaaaaccatgaagctctcagtcacagacgtacactgatgaatgtgttcttattcggcactgaaacacaacgtgttatttaaggggatgccaaaaagtggttggagaactagatgatgctctaatttggttttttggttgaaaaatgctagcaaagcgctttagatatctgcctggtctgtggcttggaatttatttgttcagtatcacaaaattacactaagcagaatgcaaattaccaaaaccaggcatttctcaaatgtgggtgactgaagttattttactaccttaagaggagtgcagggcactatagacatgtgcctaggcccctgtagactcacacccagtggacttaactacctaagcccagcaggctttcagaagacccacactcaccagcaggaatgtcgtctccttatgtgatttaaattaaattttgttgtttaacgacattaaacatgttaaagcaatatttgaaagaaagaagaaactcataatcccctgaactgaatagtcacaatgtccagcgaattttagggcaatagacattttctgggcgccagcaatgggtccaacactggatattcagagatgatcaagtcactgtccttgtccttgaggaactgacagttgagggctggggagacagacaaatgtatagataactcaagagtaagtgataagcactaagccagaggtcagatcaggcttccacaggcaggtgcccagcctaactggggactcaggaaaggggcttcctagagaggtgatgcataacctgactcattcattcatttagagatggggtcttgctatattgcccaggctagtctcaaacttgtggcctcaagtgatcctcctgcctcagcctcccaaagtactgcgattacaggtgtgagccatggtgcccagccatgacctgactcttaaagaacaaaggagatagaaaaagtggaggaatgtccaaggcagagaggaagtggcataggcacaagtgcagagtttgattttatcagggatcaagtcctaggaagggagtggatggtgacactggagaggtagctacagactggaacacaaatggcaggagatatcctactaagaagcttggactttctttgttggtgatgggagctgctaaacacagacattttccctggtggtgagtgtcaaagaaacccacaaaacaacaacaacaacaataacaaaaaaccctgacgtccagggctatcttgataacatataacatcctgtgcttttctaacatttcatccttgtgctttcgttctcattagctggtggctcaccatgaggccaggaggtgctgcaaacagtctgaggagccacacttagatcatgaccataccatgtggcctccctcttcttcagcctgacacagacatggcacctgagatgagtttctgttatttggtggcagaaaggtggagctgaaggaggttgagttggttgtcttcaaagctacagtcaggagccagaggtcacctggatttactttctgtagtttatggttgcttatcaaggagaaggggcgggggcacatagctctgagtatgggggagcctgggagacgggagtttgttttctgtgacaaaacactctcaggcacagggatggcgatgacagccaccttgaggcagaactgcaaaagaaaggaccctgggcctgcaaagaatgtcaggagatcatctcctgagcaatggcccctctgcaggtaggcgtcctatctctattccattctcttctgccaggaggcaggagaaagcagtggtacaagacacgatttggaatcagacacctgggtttgcattcaagttctaccaagtactgggaagttttccagcccttctgcagttccctcctctgtaaatggggataaaggagtgcctgagtcatagcgttcatgtgaggattaaatgggatcatccataaaaacagtttagaagaatacctggaccatagatgctcataatcaacatcagttatttattcatttttttttgagacagggtttcactctatcacccaggctggaatgcagtggcgtgatctccactcactgcaaccttcacttcccctgctcaagtgattatcctgcctcagcctcccgaatagctgggactacaggcacgtgctgccatgcccggctaattttttgtatctttagtagagacagggtttctccatgttggtcaggctggtttcaaactcctgacctcaagtgatccacccgccttggcctttcaaagtgctaggattacaggcgtgagccaccacatctggccaacatcagttattttcacatgttggatggaaaataaaaaataactacctctatatgaataatgactgaaggatataaaatattgacacactattacacacctgcgcgcatgcatgcgcgtgcagacacacaaacacacacacacacacgcacagatgtaaagctattatttctgttgagaaacttcttaaaaaataaacccaaacttccgcaaagggtgacccttctgtctacttttccaactttcattgctgttactttacattagtcctggtcacttcaggttgctgatcacaatggatgggtcaactcaccaatttgcggatttcacattctaaattctgaatacagtccagtttccttttgcggcagcgctgggccgcgatgcggttcttgctgcgccgtcggacatcatgaataaactctaactgttctgaggttagcttgtgcattttaatcatcatctggaaatcgttccttggaagatctgtgatttgatctacaggaaaaggaagttttacctgaaaccaagaataacagaaaatgattatggcagctggattttaattctggcaggcggaacatcaaaaatgataaaacctcctttttatgatgaccaagtaatatggaaactactgaaagcaagcagtgattacttatttcctgtttaaagacagataagatgtaataatacctggataatcaaacagaataagaacacatatattgcaatgttattgtctctgagatttttgaagcaaatgacatgaacaatattggaaaatgtgtcatttttcattgatgtagcacttttgtaagaaagattctagttagttgaaatgtacttccataagacctacagcctaactcaataaaatgacaagttatagggagataccacataaggacatatctaaagcccctgaatgaagagagccccatgtatcctgaaaatgctggagacacaaaaaacccagtgtgattcttagttacaatagcatatgggagataggaggagataacttggataggcttcactagcatatagtaggagtcaaaagaaccgggctttcatccttctcaccagacatgagacctcaggctagctactccacctctctgagattcaatttcctcatctgaaaaatagggcattttaaaaaagccgtacagtgctatacaagtgttgggcactttgggaatttattttccaattttacaatgaaatgttgacattcctttatcaaaaggtgagatgcatttttcctgccttttgaccaacagaatgcagcagtagtaatggtgtatagtttctgaggctaggtcgaaaattagctgccatgcctcgaggacattcaagcagctctgtggagaggcccatgtggagaggggctgatgcctctagtcaacaaccagcatcaccttgccagtcatgtgaacaagccaccctggaaagattctctagccccagtcaaaccttcagttgagtgtagccccagccaacatctgacttcaccttatgagagatcttcagcccaaactgctcagatgggcaactcctgaattcctgactcacattcacatttctcatagaaactgtaagaggtgttaagtgattactattgttttaggtcattaagttttggggtgatttattatgcaacaatagacattggatgcaggtacttgccagcaaaattccaaatcttgacaaattccaattcttgacaaatcaaggcaaataagcattatctaaagcgaggacagcagtctcctgaaggatgggtttgtatccttactatgttgttaaatgattgcttatatttcttttttttttttttttttttttttttgagacagggtcttgctctgttactcaggctggagtggagtgttatgatcacagctcactgtagccttaacctcctgggctcaagcaatcctcttgccttggcctcccaagtagctgggacaaccctgcccagttaattaaattttttttttttttttttttttgtagagatgaggtcttgcgccacagagaaggggaaaaaaagagatgaagtctcacaatgttgcccaggctggtttcaaactcctgggctcaagtgattctccctactcagcctcccaaagtgttggtattacaggtgggagccactattcctggcctgaaatatttcttttcttttttcttttgagatggagtctcggtctgtcacccaggctggagtagagtggcacgattttgactcacggcaaactccacctccctggttcaagcgattctcctgcctcacctcctgagtagctgggattgcaggtgtgcaccaccatgcccagctaatttttgtattttcagtagagatgcggttttgccatgttggccaggctggtcttgaactcctggtctcaagtgatccgcccgccttggcctcccaaaatgctgggcttacaggggtgaaccatggtgcctggcctgaaatatttcttaagaatagcaaccagtgaaaaagactgcatgaaagagccccaagtgcggaaggtgagcagcaaaccactactctatctcaagagcctccttggcacccatgaggtgacacaggcttgcacctttgagcagtttgtcactccccttcccgaggctcttggggattcagcagcttctgggttcagtctggtcctgcttcagaagctcctggaataaaaaggttgtgtgctgccaggctaagagacaacgtgtgggttagctcagattgcttcattcttgtttacattcacgtctgctccggatgagccagcagatggcactacaaacctaaacttccttcaagcactagcccagccctgtctaatacaaacaatacgagctacatttgtgattttaaattttccagcagctacattaaaagaagtaaaaagaaacaggtgaaatgagtttgaatactgtatgttatttaacccaatagataaaaatacttccaacatatagctaatataattattaatgagatagtttacagttttttttttttttgtgctaaactttccaaatccaaagcacattttatccttacagcacatcataattcagactagccactttcaggggctcaacagccacgtgcagcatgaggcaaatggactggacagtgccactctaggagacagaataaatggactcaatgaatcccagcagccagaaaaacatatgggtctgggctgaactgatcaaaatgctcttgggtgaagaaaccaacccctcgatagtgttcagatgctgcagggttaagtctgtgttcttcaagggagtgaggatgaagacatttgatcctgagcccaggtttctctttggttacatcatttgcaggcagacacgagtcccggctgccggcatgtgtggctagtcaattcccgtgcacaaaggcaaatgtacaaaatgatcatttgacttttctgtggttgggtgcaagctctttgtcaggttccatcacagctccgagcttgtgcagtgtggcatttactgaaggttcccagcaggtgatctgattcaacttctacctggtgagctctgtcccatgacacctgtaaaattttggtccaagaaagcaaaatcgcagtagggcccatgacaccactgtcggcttggccctgctccgactgctaaagacaggcagccaggacaaacagttccttgttatgggctcgggaaaggcctttgtgcacggggctgtgtttgcacagggcttctaatgatatgaaagaatgtttgatttccctcttatacccgttggataacaaacacactcagatcctgcacggtgtctccggaacacagaggtctgtctgttggagatgtggatgttccaacacagcagaggtggtggcgctttgggggcttgtggagttttccctctgatgacaacaaagccattctgcttctgctctaaatgtgtttacttactctcagaaagaagatatccctatagttcaggccacagggaaagtcaaaaggatgtctataccaagagctactgtatttaaatcatccagacagtgaatataaaacactaggggaataggagggagagttgccaagaaaaagaaaaaaatcaccaatgctagtttcaaagtccttgagacaaaaagccatacaacacttcagcagagctgctgcaacacaatctgctttttaaagagggtcagaggaaaaggtaatgggtcaactatagactttctcccaggtgaaaaaaaccccaactcactcttgtttctctttacaagtcttggttccccctctagcaagggaggacttatgttcactgacatgcgggggtctctgaggtgttctcagacaggcaccgggtcggggtgggtgggaacttgaccacatccaagttgtttcttgagtaataagttccaagccaagaacatcttgtctggaaataaggagtagccactgactgtttggtcccgtggaggacatgcctctcccaggctctcggcactcaaaacattcctcaaatggggctgaggagtcagagaaggccaacagaccttggaaagcggaaacacatcaagaaggttgaggcccacctcttttccttctagataattattctgagccaaacaggcccagttgggcttaacatcttattaactgtccctccacacacttgctcctccaggatctcacttcccagcagtggcttggtttcctaaagagtcccaacagccaatgtgatgaggtgaagagtcctgtggactgtcgccatccccactagttatactcagccacccacacacagctccggacacacaggctgcatataaggggaagggcacgagggattcatgggcgccactctttagccaggggtctaccactttggttctcagtggagaatcggagaatcagggcagccactgagtcagcaggccaagggccaaacagggcaccagaggcctgtgccacagttggcacaataagctgctgttgattttattcagcccagcaaagtgttgactcttccccctctggaacacgacaggagcagcaggaccgaggtgggtttttagcacggtacctgccctgtcctgctaagcacggctataggagggttagttcttctggagattccagctttacacattttttttcttttaaagacagggtctcgctctgttgcctaggctggtctcaaactcctggcctcaagctatcttccttccttggcctcccaaactgttgggattataggagtgagccaccacgcctggctaggctccagctcctgagcagtcagtaaaatggatagtccctgcagtgtgtccagggattcttaggtccaggtgtgacatctggacagtgcatggaacctacatatgtctccttgcatgctgtctgcaccaacgaggcagaggggaggctgtaggctgggccctggaatgccggtgcttccttctcaccaaacagaaatcggctgctttatttctcttccctgccaacagccacgaccattcttcagcctaaaccatcatccccttcctcccagttaaaaggaaacattgaaaaattatataagtattatataattatagattattctgtaagtattatataaaaattacatattatataaatatagctttcataaaatataagacaaaagaagggaaaaaaaattctcatccccaaatgatgactctcttgctctggtagatttccccgtgatctttgttttctctgcatcttttttaggagttgcaatcaagtggtgctgtatctatctcacccaacaaacatttcgcttgcctagtgtctctgctttgctgggtgaagtttactggaaaagcaggaaagtagctgcaaattttgcagaaaaagccagaaacaaatatttcctgtagaaatctcagtggaagactagtttgttaatattttttcctacttcatttcttggttttattaccagatgttgattgaaacccatgggagtagggtcacattagcatgataccctgagacactgatggtgtggtcagctctccgaagtctttaacgcctgtactctgaggagaccctcagatcccagggagctgtcgagggaggaagcaatatgcccattggagatgattccagtgctgctggaaccaggacagccagctcagtgctgggcagatggcaatgacaaaatctcccctcccaggtgaagaaatgtttctcgcgcaattgtccttccacgccctcttctcatggtccagtttctagcacaaatatgggacacctgggattcagttgtgatacgtcaattaattagttgtgtgatctcaggcaagtcttcattctgtctgtcccaaagttcttggaggatctaggagtcacagggcgataacgcctgccctacttagcttacagggttgctatgaagaatacaactggatgacaggtggagaaagtgcctgggaaagtttcaactgcctgatagatacaaggtattattatttctgtttattagccctatctatctctgtcacatggtttcgtcttacagacatgtgctttggaattccagacacttacaatgttctagacaacataaaaacactgttttaattagaaatatggctgatttctatgctgcccagcaaggtttctttttattaagcagaccaattacagacacttctaaaaacttgcctgattcaccaaaccacaaaaatgattgtgaaaattttacatacaacatgtgtctcaaagtcagcattggggtgggaagagttagagtcagatggctcttctattctgtaccatttccatgttttctctggactttatctctctcttcccttctctctctctctctcccgccccctgcctgcccccaacacactctcttactctcatacacttttatctctctcagtgtaaaacatgttaataaagcaagtccaaaaatccatacttttgactgtgcaaagaaactctctgtggtgcttctttactaaaatctacaattaagtagaaatggtccagttacaaagctgtcttactaagaggcttactactttggaaaatgactgtaattttctataatttccaacatctaaaaacaaacctataaaccataatgagataaaccataactactcacacccactagagggcactaacaaaaaagatgggcaataacaagtgttggcgaggatgcagagaaactggatccttgatacactgctggtgggaatttgaaatggtatagccactttggaaacagtctagtagctcctcaaaaggttaaatacaaagttatatgatttagcagttccactcctaggaatattatggaaataactgaaaacatgtcttaaaaacaacttgtactcaaatgctcacagcagcattatttataatagccccaaagtggaaacaacccacatggccctcaaccaatgaacaacaaaatgtggtattagtcaacaaaatggatcaacattatggaatattactcaggaattaaaagcaacaaagtactaatacatgacaatatacctggtgagtacatcaatggcaagggtaaaccttcaaagcattatgctaaagtgaaaggagctagacacagaaggccacatcttgcaagattctatttatacaaatgccccaaacaagtacatctacagagatagaaggtagattactggttgcctggggctgaggggagtgggcaatgaggagtaactgctaataggtacagcatttccttttagggtggtgaaaatgttttagaattacatagtggtgatggttgtacaacattgtggatatatcaacaaccactgaattgttcatcttagtagggtggattttatgatatgggaattatgtcttaatttaaaaaataaacctgtgcaagatagacatacataaaattcaaacattacagacatacatagaaatgaaactttccctacactcctctccaacggtgctcccagttttttcttattctctatgctgattttatttatatggtgtgtatatttaggaaacaaactaggaccttgtgcatactgctttgtgattttcacttatgtgacttgttcatttttttttactggaagagaaaaattcccaacctgacttcttaaggaatatagcaaatccagaagtcataaagaaaaagacttataccttgactacataaaactaatatttttttatatgggaaaaggtacaataaataaagaagcagactaagggaatatctaagcaacatttatgagaaagggttaatattcctaatattagggattaagattcctacatgttgatttaaagttaaacaatacaaaagaaaaataggcaaagaggtaaaccagcaattcacaggaaaggaaatataaatgttcaatacacataaaacaagatgtcagcctcattagtagtcaccatttttttgcccatcaaattggcaaaaattaaaaagactggtgacaactagtatgggcaagaataggggaaattggacactctaagttgctgatgaatatgtgaattgctacaacattttgggtaggtcattaggtagtatttaataaatgggcacaacctttagcccatctttgaaactaacccacaaaaataaatgcaccactactaacagtagggtcacaaaatgtttattgcagcaatgtttatcagagggaaaaactgaaaacaactgaaatgtctggtgataagtgacagctgaatgaactacgatttacgagaacgagagatattggagaaacatgtcttggccctgtgtgatcgacctacagccacgtgcatggtagacagctacgtgaaaaaaggaagctgctaactctacaacataatgccattaaaataaaacccaaacccatagagaggtgaatatatatttgtatattgttgtaggcaaagagaaagcctgttaaatttggtatgtttggggctgggtatgctgtgttctagaatttaaaaaagaatgtcattttaaaaagctgattattgataaaggataatactgcgctaatttgatctttctcgaagccagggaacagttaaaaaggatgggagaagccaacgactgtgagatggaagggctgcttaacacggtataactacaacatcttacagaatacaaggtatgttaacacttcacttttggtctaacgttttggctccctacggggtggaggaagacagattgggaaaacacacgcgaagtattacactggcgtctggcaaggggtggaaactcctgtcttgatttctgactctggtgtctccgtggggttcacttgaaagagaaggcacctggatcccatatgaaagcagggcagggcagaattagcccaatagatgctggcttcttctggatcagttcaggaaaacaagttttgacttgtggagaaggatctgccttgagcactattactggggataatacttcaaccagggtcaaagtaactccctaaagcaggttatcaactcctcgagcagcagtcatggcaagtccctgagacagttcttggaaacctaacctcctctactctaggaaaactaagatgtcaaattgggaaaaaccttaactttactgtaactgtcctgtccaaactgtaccactgagaggggctatgttttccaaaatggcatagagctttggtaaatgtctcttctttcactgttcaggaatgcagaagatggatttttctttctttttttttttttgagacagagtctcgctctgtcacccaggcaggagtgcagcggcgcgatctcggctcactgcaagctccgcctcccgggctcacgccattctcctgcctcagcctcctgagtagctgggactacaggcgcccaccacgacgcccagctaatttttttttttgtattttttagtagagacggggtttcaccgtgttagccaggatggtctcgatctcccgaccttgtgattcgcccgcctcggcctcccaaagtgctggcattacaggtgtgagccaccgcgcccagccatggattccttttttaaaggtaaaaataagagtatttttaaaagtagcggtatttctcaaggggggaaggctagtcctgttcatgactattttacaggttgaatgagtcctccttttaattgagttaatatttttagttctaaagtaaacaactgacatggtcccaacatacacacaaaaaatgtgttcttgctgtggccccaagactttaagctctcttttgggatattggcggcgagggtggggggacacaaaagaagatgtatctgaaactgacagttctttgaacatatgcaaatgtcataaaaacaccaccctcccttgagcttaatggccagccttttatttttttttgagacagggtctcactttgtcaccgaggctggagtgcagtgccaccatctcagctcactgcaacctccttctcctgggctcaagtgatcctcccacctcagtcccacaggtagctgggactactggcacgagccaccacgcctggctatttttttatatttttggtagagatggggtttcaccatgttgcccaggctggtcttgaaatcctgagctcaagtgatccacccacctcggcctcccaaaatgctaggattacaggcctgagccaccatgcccggccccaggctcctcttaaaggagagacaaaaaacaaagactgcaggcctttgtgctcttctccctccaccagtccttggtaggaagccatgatgcggatgaggtggacgcagtgacttgccttccacatcaggcacgctcattcacggtttcagaacaaaaggaaaacctcacaaaagaggtcagagggaaagaatgagtgaggagagagaaaacacagcctttcactattttcgggaaagctcaatcttcccaatgtcagggacacagatgtgagcctggcttggggcactgggcacaacccaccaccccaaacctaaggggaggtggtatattcgcatgggaatagctcccattcatatttcctttctaatttattttaaattaaatccttgcagtgtttctctttctccatgtctgctaggcagttaagagaggggcagaaaccaggctagcaagcaaagaaagtgaccacagggcatttttgcagttggcacaggggcctttggcatctattttcaaaacacgcccaaactaaaacctcatgtgcttctcgccaatcttgcagaggctgaataaactgcacgtggctctgtgaaaagccacctcatcccgtatggcatttctgctttctggctgggttaacatctctgccttacagaggctggtaacatccagagagcacagatgggtaccaaggttgccggcctcaggaggaccatgtttcatttcttcctgtgtttttgggatacacagctctgagaagggacttgtcactgggtttgttcaatcccgctcctgaggggggtctgagacacaggtagcagtctcaagctggtaccttgtcaatcagcaagacagtgcagtgaacgccaggtcacgacacagactctctcaggtctttctagggaatgttcatgttattggggaggtgggtcctctgcaggggcctcttctttcctctccttagtcttgtgagtcttgctcacgatgtggctgctgttgcccctgttcccctcttccagcaatggtaagacacacatggagcctctggacatttttcctagcaagtacattgctttcagggtggatgaaactgctactctaccccactacttctcaaaatgtcttcctagcatttgagggagcttgggaaatgatccattatacattatgtgtggctgactagggtgcttctgtgatgaccccaggaccgggataaacggtgaggcttccatcaccttcactgtgatggacatgggatggccctggggtcttctgttgacaaggaaaatctaaaaggtgctgggagagtgttgatctatttggtttcaatcaatcaatctggaaagagattctatatcttcctttacgctgaacgggtgaagggcaaggatgagggtgatgaacatggcatcctttcaaagcaggtgtaggagggggagagagggaggagaaagaggggggtctggagtgcctcagtgtacttcatgcattagacttcagtatatttttactcagcagcttgcctctgcttgtcgagtattgagatccagatcaaatatcaagtgcttttctaggacagaagtggttaatgtggaatcaccttcagcatcctgcctctgtggatggggaaggcagtctctctactgtcatctttaatcttagcacgtaagaacaatgtgggagtggtggggggcagggagtagtccagataaagggcctagagagtgggtcacatgcttgaatttatgtgggttccctacctcctggcccctgtcctgcacaggacacgactcactgtctgcttccgagaacgatccggattcgtcactggagttggttccataagactgctcacatttaatttggggccgcacttggttgtacattccatctcccatcaggcctggttcctgatgttctgtggcaaggaatctggctccctgggaacagggcgaggaggagaactcacagagagggaggctgcagggtgagcccccgctcccgtcctccgcgtaggaataggaagagcaggagctggaagtcctggtcctggtctccaaggggggtgagcgagggcagactttgattggtaccgggcagctggtgttgggccgcatccttcctggcaagtggtcggccatcagcccaccgtgggagtaggcctgcgagctggggagggactggccggctcccacccacagaccctttggcaccggctcagagaggtctttgtccaaactgctcaccccagaataagaatgcaccgaggtgctcacttggtcacaagcgctggaggagaagatcacgctcctccggtccagctctccctcctgtttacagagagcctccaacccaggccccctgaggggcgaccccatggtgaagttggacacctccttctggcccacgtggggctgtccataattccctgtgaaaggggtgtagtcagttttaaggtcaccctgagtgatccccttgtcaaaagggcaggctggactcctggcaaagtgctgctgagatgtactgggcaggccagacagctccacacttttcgttatgctgaacagagaccttaagcaggagggcgaggccacgctcctggatctctccaggcaggcggccccagctggggccgtgggggtaggggcagggctgggctgtttccggtccatctcgacatcccccgctctgtccttggcgtcaggctcatctccagacaggcagagcgtgatgctctcttcctcattctcttcactgggcggctcacttttaatctgccccctggcaagccccggcttgaggctgttgctagagttatcttcccggaatgtgcttgcaaaacctgaggtactgtgtgatgatgcattatagacattcttggtacatgcaagctggtatttcttgtatctggggtactgcgttaacgcgtccttttctgagctctccttggtgtctgtgggcacgtcaggctcgggcagcagggcttcttccttctctgctacggggatggcggcggcctcaaagctgatgggctctggaagcatctggtccctggggcaagccatcttggccgtctctgaatccatcgtctcctcctcttcatcctcctcctctcctgcagagttctcgcagtcctcgtgtgggcgctggcacgcagcatccttccggcacacaaacaggccatcctcactgttcaggagctgggtctgcaggaagctgaagcaggagtcctccaggttgtgcatgcgcaggaactcagcacagcggatgacctcgcggatgttttctctgctgagtaacagcttggcagtgtaggcaaactgtaacagcggcccaaagcccctggctgtgacctgcaaaacaaacagggaaatcgccaacattaccatcagcactgctattgtcccgaatccctcaactgaagcaagataaccagacagtgctaatgtcccagaataaagactgcaaaggggcagttaatcttgtagtactgggtcagcaatgattctgcttccaataattagtgcctgtctcgtgcatgccactgttgtactccatcacagcacaggcagaattgaaaatcaccagggtcaagtggctaaacaagatgacaacgggttcagtgtttacactaatgaaatatcctggcaaaaatgcacggtgacaatggggagcctattaatttccctcccaatcagtcctgttgagagccattctacacgaggggggagtgttgtgacacttcttgcagcttgctggagcccaagagagccttaacgttttcttgtcaaccacaaaaatggcaatgtgaccctgcaaaaaactaactccagggagttgtaaaaataggttttcctcacttacaatgttaaaagagacattaaaacaactcctgttttgctcatccatcacagtttctacttgagactttcggtcatcatgtctacctgatcttatgatgatgatgatctcattatctcaccagagatgacaacaatcaaaagtggtgtgctcaagatgaaatcaacccctggcccataatgaatgggggttgcagagttaaacaaaccggctctcatttaaatggttgaagctgctgagtggcacagggtatgggctattccttccctaattattagcagcagctttgccatgcagctgtctttttttcctggtaaatcttcaggggctaagcctactgtcatttgctgcttatctgttatattttacaaagattgaaagtgtgctatttatgcacagcttgcatatgcacacaaacacgtgtgtgcccacacgcatgcctgctcacacacaatgacttagacaattaagaatatgttgcctaaggccaattgttttttcagatggaaatggattaaacttgctggtgttcatcagggtaagcttccttaccctgcacataaaaccacacatcctctaggttcttgcaagcactgctgaccacacaggaaggtgacgcatgtctacaaatcctgtacaaatcaaatgaaagcagcaatcatggggtccttgctagaggctatggtagcagtgatacaaaattttagcggggggagtgagtgcacagcaaggtgaactggtaaactttgtagctgacttctgtgtgtattaaactcaccgcagcatacagagccaaaattcttgcaaggacctgtaattgatgttcaagattcaacctggacattcactcctttgggagtgctctccagtcctcttagagagaatgaatgacattgtcctctcagctctcatagccagatgaggagacgtgctggattctccagggcagcactgatttcatatcattgcattctttccagtaacggaaatttcttagacatgtaactgaacgggattttaattgttaatctttttaaagtactcaagtaagattccacattaaatttttctgtcagatgatgagtccagagatatttggttaaaaaaacaaaacaaaaagccatgactgctagacccacattataaattctatatgggcaatcagtgccatctcccttttattatacctaattgtgcctgtttctaccataagacagcaagctccttcagatcaggaatggttttgtctgtctttgtaaccttgcatctaatctaacctggggtctctcacatggtaaatacttgttaaaagcttgtatgttaccaaatatgtcatgagtcaaactgtgtcctaacatactactactgtgtatgcaaggtgacaacacagtatgtttagagagtgttgtctcaagttacttttggagcaaggcatcatgtaaaccaactaactgaaccgatcaactgatcaaaggcaggcaggcaagggtctttgtttgccccgtgtcacagtaccagtattaaaaaggaggtctgaccgacacttttgtatcctgctaagctgacatggtaataggttcagcaaatgtagtactgacaatacatctgttttatgtccttttcttccaagaatctttaaaagaaagtaaaaaagcaaggaaatgtgtatttataggtaactgaagaagatgacaagaatgtcacatgacctattcctttactgccacatggctccaccacaaagaaagaaatggtgaaatcaatgcagagttgacccctgccctcgtaatgatcctatgctcctctgtaatgtgccagttgccaaaagggtggataagacacttcttgagttttggcaaaggtgctcactatatgggaaatgtaggaaactaatttcaatgctatttatactgttcacacagtttttctttttttttttattattattatgctttaagttttagggtacatgtgcataatgtgcaggttacatatgtacacatgtgtcatgctggtgtgctgcacccattaactagtcatttagcattaggtatatctcctaatgctatccctcccccctccccccaccccacaacagtccccagagtgttcacacagtttttctcatactcccatccttatcaccattttttttttttttgatgctgtaggtctaagtaagtcttaccactatcttccactgtggcctcttgtaaagaaaatttctaaagaagccagggacatccatggggatctgtagatcaggaagcagtactgggagtcaccctctgccacatggctgcaaggagctggagaaagcatctccgctcagggacgagctgatgcttaaatgtatgaattggaccaaggaggtgaatgagcaaagtctccacatcacaaatcaatggcactccttagatcactgaggcttaggaaacttcctgagcttgaaatgatcgtcatatggtcatgaaagagtcatagataaaaaatctggtttgtaaactgtcacttaagcccaagggcagaggaaatggtgtcctcaccatgaaagttcaagagctcataactagctcttctcccattctggtttcagtcctgctttgtcatatttaagtctgcaagattttgctcagcttctgtgtgtgaggctttgtttggtgagccagaatgaccatttaccaagtatctcctagtgcccagcactgtgctcttgtaacaccctgcaaggcaggcatgactgcccttattctgtagataaggaaactatgaagcagggaggtgaaggagtttatccatggtcagtgctagtcagtggagagctaggattccaaaccaagtccagtctgtttcttcttctgtgctagtggtgtgagggaaggatatgtgtaggactcaggcctgtgctcaagagatctaagatttagctttgtagaagaggtacaaatgatgaaaagttaactaagtaacaatgtaagcaagtcaacaatggaaaagccattgcaagattatatgagtagttgtcaactgagaaatccagacaagttcaggataggagactactgaggctgaggggactagcaagggggccccttgaacacttttatcagcacgccttgagtgtctgctctaggtcaagggttgctttgatacgatggctactttcggaactgtcacaagggtccctcccaggaacccatctctggtctactttcggcagtggtaatcgctccagatacacaaaacagaaagcaagtgcccatcacacctgccagcaagtgttacaacaggcagaggctttctaaatactggcttagcctccatcttgagaaggtggcactgtctacccatttttagggaccatttaaattcattcattatactcagaaggcaaatattcaggtaccagtgaaaagctgtatgttcatgaaactgtgaccacaagtctgcattgttacttactttttgttcttaacaaataaggctctaataatgggaaaaaataagaggggggtgggaggtggagaattacacgcaaaactaacaactcataaaatggtattttaaaaagtaatgatcataaagttaaaatggaatgaagtggctataaatagaagaatagttccaactcactgatgttaatggagttgcatccctctgctctaagcagacccatctagactaaaatccactggtcagcagtggcctcaaggtatgagaaacaaatgcaaaatatggtgttagggacaacttgggataacagtcttgcattttgaatgaaaatattttgaatgcctcatttcgaagaacattttttcattgcacttaaatatgtaactacctggtctcatactgtgcaatactcattctgatacagatgagatgggatcacacattggggccagaatacagtgtgccatgtgggggcgagacctcggagaaggcagaaagttaaccctccaacctcccacagactgcttcctaggaggtgatgacctcagctagcagttggcacatagttggttcaaccctgaaagaaataaggccagggtaccgtgtccgatggtgcaagtcaacatgctgacaatgtgttgaaatttgacccactgtaactatgacccttaatccttcattacattggattctaacatatcatctctctgctgaaaggaagatgggctgatgaaaactcaatttgtagagaaagtttgggcactgtttgcaaagctggggagctcagtgttttggggagctcagtgttttggggagctcagtgtttcatgagacatccattttgctgcaggacagagtttatgaggatacttacaacagttccatctctggactatgatagggatgaggcagtcagccttcaggcatttattgaaaatagggtttgaggatttttgagacttggaacatcattctctatataagctacatgactaaggtgtctccagttggttttggcagtatatacacatggctgtagcattgagcccatctgcagaaggctgatcagatgaatccggaggacaggtgactgctccctgggagagggctggcacgcttctcaaggtcccttaatcacaacttcacaaaaaagggaaacttacatcttcagcaacaccatgtacactttcctgatgaagctgaatctcttacacactgcaggaaccaggaagataaaggtaatgaacccctgcccaagggctttttaaaacgctagaccactgacaacccctctgggttgtatttgcacagcaaggcacttgtcaaatgatgaaagcaatgctggtgacaattaactctcccttcccactctcttactgcactgcaacccactctgcaggatgaaaactgacttagtgatcaggcatcactcctcatcttaattttctataattcatatccacattatcacattcttcttccaaagcagcatgctagacatttagaaagtatttgtcaaattaattcaccttactatttcaacaaagcttctggttattttagtattaatttttattttatctatttttacagacagggtctccctatgttgcccaggcttgtcttgaactcctgggctcaagggatcctcctgcctcagcctcccaaagtactagaattacaggtgtaagccaccacatctggcctcgtattaattttatttatttatttactgacagggtctcatactggttgtccaggctggagtgcagtggcatgatcttgccacttactgcagcctcaacctttggggctcaggtgattctcccaactcagcctcttgaatagctgggactatcggcatataccactatgcccagctaatttttgtatttttagtagagacggggtttcactatgttgcccaggtggtctcaaactcctggactcaagcaatccgtctattttgacctcccaaagtattgggattacaagtgttagccattgtgcctgggcaattttattatgaattttagatagagcttattttgtgttctattcctaaggtaataatataaaaactaaatcaacattgaaattgatttatacatatatcatttcatatggtggttcttttagctaaagaaaatcattatttgtcttagtgaatatgtcttaaaacataaacggagtgtcttttctctcctgtgcaggtttgaacttggatctgcagccataatgtaaaaatccttcccctatttgtaagttttactcctgagactctatctgatcattcagtcacttataatttttttgtttactaattttattttattttttagagatgaggtctcactatgttgtccaggctggcctcgaactcctgggctcaagccattttcctgcctcagcctctcaaagtgctgggattacaggcatgagccactgtgtccatccatactcattttttcattctccaacgatgtgctaggcactcactgtgtactatgcaaggtctggggactccactttcttggattcaagtctcagctctgctgtctaccagctgtgtcacttgggctggttacttaacctttctgtgctttagtttctctatgctttagtttctacaactgtaagacagggatactgacagtgcctgccttatagtaaaacctttggaacaggacctggcattaagtaacaaccagtattattgctgttgctacaaatatgaataaaacaccacctttttctccaaggagctaacaagtgactggggagacagatgttcaatataaatgtttacagtgtcacctgagtacgtaacagaggtatttgcaggatgctgggaggacagggctggagcagtaactgctaagggaattagtgtaaggctacttagaggaggtaacacttgccaagtgttgagggctgagttgaagttcttcagaataagtaaaagaaaggcatgtctcactccctcatcatcttccggcttttcctcaaacgccatttcctcactgagacctttcctggtcctctattcacaattgccctcccctaccacaaaaccagaactggctagatggtttgcagggcctagtgcaaaatgaaaatgttagcctcttgttcagagattaagaatttcaagtgacaagagaacattaaacaaagtgcaggacccctctgagcatggggccctgtgcaattagttgcacaggttttatgctcatgaagctggccctgtcaataacacatgcatgcacaagtgcacacacacacacacacacacacacacacacacacacacacacacacacagttacctattccctgcagttgaaatggactccctgatttgaggagggggtgatggcatcccagggtggaggtcaaacagtagaccaccatttgacttcaactttgggctgaaaaacatggtcagcccaccaaggtactttttgattagtaaaaaaaggaaaatcatgtaggctcagtgagcaaaggcctgactcgaatccccatgatagagagtcatgacttgaatcagttaacagactcagactccctgcaattattctcaggaattcttgaggacagaccctaccataacccacatttttgctatgatttctcctgtcacagggttttccgaaatgtacttgtagttttttcctaaatcatgactcaatacaaactttttaaattaaaaaacacctaaaaaaattattcagaaactgttgaggccagaaccaaaactattatcactctctctgtgcgtgtgtatctctgtaacactactttaatacaacttaactaccttaatacaaacataaccggaaaactgaaatagtccttaccaactactaattttgacttctattatttgactgaattttagtttgatgttgtaaactcatatgttggttatttactattgtctctcggactcacatccacttttctcatatttccctcttgctgaggctgggagttcaaaaactcttgtttcctaggctcttttgctggttaacttattatcggacctgccaacaggtgcacaggtgggtgagctcagaaggtgggaggcatgaagacgctgtggctccttctgtctcttgctctgtttatctttcctttcttggcggtgtgttctggaagtggctgcatccctgactctgtggtggagtgtccggaaggggctgtctgccccacagctgcagctcccgaggcacccgcccctccaccatgctcacaggtccctttcatcccctccagccctaggagtggtagatactttctgcggtcattaatcattaggttagctctccttcccttttctgttcttccagttttccaacacctgtgtaaccaatttcctgttttatagcccctctatttgaaacacctggcatggtttctagttccctgacttaacaatccaatttacagacaaggaggccaaggcccagaaaggtgaagggatttacccaaagtcacagggctgcctggccagggctaaactcatgtcttccgaccgcagagttcaactctcatgctccctttctacctgttgctgtttctctgaagtgaactaggaaagaaatgctatttcatatggaaacatgttattgtaaattttattactctctctaaaatattgttttatatagctctatccaaagaagtctggccaattggatgcagtacatcttttggtatgcagaaggtgaatctcataattggttctatttttccagtgtctgcattcctcctgaaggatgaagataactgctgtgtccctttcctgctcaatgaaactctgcaaatcctacgaagcccttttaccacatggggatttggtaaattatcaggcctagctaagtattggtccttagaatctagaagacaaagcagaaatgcccttctggcggggtgccacatggcaccagagctttgttccacagtggaatggcagtcggatgaagctgatgtctagggggagcgttacgtgtcccctctctgtgatagtcggctcagaatggttatggggctatataatggctgaaactgccccttaggtatttctttggttgtttcaaggttgatgggaacaggagaaggtcccaaaagcaaacattccatattgtctttcctgagaactggcgacaccttgggtatgtggaaccttcgtttcaactgggtggttttgcccatctcatctcacctccttcatatgtggcgctcataattttcccattcaggtatagatggttatatttcctaggttagtgacaggcaaaagtcatatatgatacagatacaaggaactatattcatatttaccctaaaagcatacggtgaaaacagaaaatctcccttctgaaagattataaaatgaagttcacagaataatttttaaaaatccaatttcaatataagtgtaggtcttaaaatagatatgaaatagtagtaatgtttcacgtttttcagtgtaaaataaaagtgaaaagcatcccactcactggtaatgaagtagtaaaacctgcatcaaggtttatggtttcattcgaaaaactgcctccaaaagaaaattatttttaaaaagaagatttagaaaaaattacctaatttccattttaaatgaccctcttcccattccagaaaccagtgattttcctaggcgagaatttcttgactcaaggtctggtttcaccctctcaacccctctagtcatttcaaaccaactatgaaccacttgatcttcaaccagaaaatacaaaacatttttgaaggcttccagtgatgagaagtttggcccctcattagcaccttctaatggttcttcatgttaagtttcaggaatggaagttttggcttagtcagttatgagttcttacacctttcttgttactctcctctgaaccacactgcctgcgactacacccctggcagatatctggattgaataaatgctccaatcattggtacagaggacacactatcacctctctctgtctatatcctattttctagaaatgctcagatttcactgtcacttattatttacaattaacatctctgagcttatttcctcccagtatctattgataagccatgtgtccattttaaccttgcaaaatcaaatttttgacccaagagtgtgtacttgtctagatactcagaaatcattcctattataaaaactactattcagtcaaatttttaaagatccactttcttctctttgttttgcaaattacgatgcaatttctgatctctagtcttttgacactttccttagctccacagtccctgaaagattttgaccatagcaagttgtatcataatcatattattccccctgcagtttgggggctttacttcatccagtctgggagcttagcattttctttttgttcatctacctagggcttcctttcccttttccaagttttttctcacttttcagtcttatggtcattcattcagtcattctccttgatgcacaatataaaattaactctgggctttttgccatcctcagtactacacagtcagccccaatgagcagctgttggttccctcatctttacgctccaaagagaaccacaaattcatttttgttttctgtggtcctcttcgaaaggtctccactcattttgggcttgagttttcttgaacgccttatttgtggttccatacatgttcccatagttgttcgtgtttttccagtgtttaaaataaaactctgaatgaaacacaactgctggcacaatttaccctcctttttcaagaaaagggtcctcatgtgaactttgttttggacacttctagccctcctgaatcatctttccccacagatgcataatttctacctttttcttgttaacataaaaatctgtttaaaaatgtcttgaacccaaaattataaaactctagaagaaaacatgggggaaaagcttcatgtcattggacttggtaatgagttcttggatatgacaccaaaagcacaagaaacaaaagcaaaaatgaacaaatgggactatatcaaacttaaaatctgattctatcaaaggatacaatcaaagtaaaaaggcaactcatggaatgggagggaatatttgtaaatcatatacctagtaaagggttgatatataaagaacccctatgtaaagaactctcatttaaagaactcctacaactcccaacagcaaaatataaaataacccaactaaaagtaggcaaaggacttgaatagacgtttctccaaagacatacaaatagccaacaaacatatgaaaagatgctcaacgtcactaattaacagagaaataaaaattaaaactacaatgagatctcaccttacacccactgggatgactactaccaaaaaaacagagtaacaagtgtcagcgaggccgtggagaaattgaaatccttgtgcactgttttattttttatttttcttgtttgtttttgtttttaagacagggtctcactctcacccaggctggagggcagtggcatgatcatagttcactgcaggctcaacttcccaggctcaagtgctcctcccatctcagtttcccaagtagctgggacaggaggcacataccgtcatgcccggttaatttcttatttttgtagagacagagtcttgccatgttgcccaggctggtcttgaactcctgggctcaagtgattctcctgcctcgttctcccaaagtgcaggaatgacaggtgtgagtcactgcatttggcccttgtgcattgttgaagagattgcaaaatagtgcagctgctatggaaaacagtatgaaggttccttaaaaaattacaaatagaactaccatatgatccagcaaacccagtttgggggatattttcaaaagaatccaaagcagggtcttaaagaggtgtttgtacactcatgttcacagcagcattattcacaatagccaagaagtgaaagcaacccaaatttccattcatgagtgactggatcaacaaaatgtggtagatacatacaatggactctcagccttaaaaggaagaaaatcctgtcacgtgttctaacatggatgaaccttgaggacattacgctaagtgaattaaactaatcataaaaagaaacttctgtgtgattccacttatatgaggcattgaaaagtagtcacattctcacatggacacaggaaggtgaatatcacactctggggactgttgtggggtgggaggagtggggagggatagcatcgggagatatacctaatgctagatgacgagttagtgggtgcagcgcaccagcatggcacatgcatacatatgtaactaacctgcacaatgtgcacacgtaccctaaaacttaaagtataattaaaaaaaaaaaaaaaaagaaaagtagtcacattcatagaaacagaaagtggaatggcgtttatcaggggctgggggaagaaaaagagggggagttgtttaatgagtacagagttttggattttccaagatgaaaaaactttggagatctgtttcacaacaatgtgaatacttaagagtattgaacttatttaacactactgaactgtacacataaacatgtatggtaaattttatgttattttttttaaaatcacaataaaaaaggtcttgaaatattttggaccgtacaaaatcttctttgacttcatgttctttaagatgatactgccgctttcttctaaagatcttctcatgtgtactcttattaattccttttagccagattacgacccgaatagcagttctacctttgcatcttctactttctggaaggtggaattgccaatgtggcaaatcaataaccactcaggtattcaactactggtcgaggagaattctggtagctatttgacctaattctgtacatgggaataggaacatggaacctttaattgtcctgacaataggacccataaactcctacaatatcaattttgctcctctctcttctaatctcctagtgctcttcagagggcccctgccctatgtttctagatttgcttacagaccttattagatgtaattcttttttttttgagatggagtctcactctgtcacccaggctgcaatgtagtggcacaatctcggctaactgcagcctccgcctccaggttcaagcgattctcgtgcctcaacctcccaagtagctgggattacaggcgtgtgccaccacacctggctaatttttttgtatttttagtagagaaggggtttcgccatgttggtcaggctagtctcgaactcctgacctcaagtaatccacccgcctgggccttctgaagtgctgggattacaggcataagccacagtgactggcctagatatacttttggctctgcttgtctttccagtggttacatttttattttgaatatggaattccttcccatagccatatttcactgtgatgtccttctgcttaccaggttacttgggttctctgagaaattctatttatcactgtggcaataatctccaagtccatttttacattactcctgcttcaaccatgaatagacattggagactgtaacttcttgatttatcccatgatttaccaaatattttactttcctaccaatatcaaacttgctgggttctgacctaattggtattatgagttaagcaagatattcttctctcttcctccccactccatcactttcaattgaaagcatgtgccttgtacaccctagagtctcaataactattagttgaactaaaccgagctagccctagtactgcccacttgggcaagcaatttgaatccctctttcacatgacaatccatcacatatttgaagacatctgtcatacctggttagggaattttttcttcaagaactgaagtcatattttccacctgaaatcagaactgaagaactgacagatcacacgtctcttatggaaaatattattttcttcttgcctctggaagcaagtagcttgacacaccactaatcctccaatagccttgagaacccaggtgctaccaggggaggcccactggtctttagcagggaaagcaatctgaccttgatacctgctgtcatttgtccctttcatttgcaaaataggaataaatagggacaagctgaagacatgtaggtagttaatatacttgaaaggcttttgagagaaaagtactaaaaattctgaagatgtatgtatcagcttctcaagcagagccctttccttggcaatagaaatggtgttactgtggcttacagaaggaataaagctacagagtatgccttatcagcatggttgatacagcagcaatgatagtatttctacagtctttagtctctttcatctaagtcctttaccaaccatcatgtaacaagctgagatatgctgactgggctactcaaagctgtacagtaagctgggataaaaatcatacatggaaaccagactttttgccaaagggacgatacacttctgatttctcctcccttcttgtgcttctgcaatgggctctgccaatggagaacagttaatgctgatgcaatgcaggcaccatctgtgctctgtgaggatttaaacagcagccattaacacaaaaccccatatgtgaattggacaatggctgccctgaagctacaggactctcagatagaacataccactctgtagcttttagggatgcagaaattgttatgatccaacacccacgcccctgaataagagcatgaagtcaggtttgtcagtcacccacttcccctccctgcttcttaactgagtttgaatcttttctatatgttattcctgtctgtcaagggaggaaatgaaacgggagccgataccatctatcagcacagccatgggtgccatttttacctgaagccattgggttcttgtcctgaagcttcccccaggacaccagggttccaggcatataaatgacattgacagtgactgggtgcaagcctttgctgggaagagcagtgtgtccaggacttcaggttgctggggcatgaaggcagggtcctatttatttttaatttttgtagagttaggggtctcactctgttgctcaggctggtcatgaacttctgggctcaagcaatcctccttccttggctttccaaagtgctaggattataggccggtagggtcctatttttgacaatggtgtcatctctggcagcagcagagatgctgaggcaggggagaaagaaatttctaacaatgactggttggttgtgtccagtttctgtggggctgaaacacgcttttcacaccaacacaggggatggtaagaaaaggaagtaagtcacaggtgcttcagaatggtaccttggaggctgttctgggccatctattttgaacatggcttgggactgttatgaaagacctcattatttatagctcgtaactgggaaaacaccttttctcctagaaataaagatatccaaacttcctgaaaatgaacctttggtttttgacaaataccaagtctcaagaacaccaggtgttctttttctgggtgaatcaaactatttctgagtttacctttaaggatgtgagttaaaacacctacagcatcccgggtgttccagtatttggatggaattttagtcaccgaggttgcaaatcagaaacctaagaaaccttaaggaaaaataagccctccagtttccttgcactattatagcaagaaatgtctggttcatggcagggaggattcatagagctcatccacagtagtttaatggcaccttcccagagaagcgtagctttgaaaacctcaactaagctagcaggtgtctggatggcatcgtcatttctttctttaacaagcgtgggaggccagggcttaagaatctctaggtagaggcaccattgtggtaaaaatacagagactcaaagcaaaagggaaaactaatactgcttttatatcccacttctgtgctcatgaactctcctctctgttgatgccatctctcctctctcctgcccctccatgatctctctggatagtcaatcaaagggaggctggagagtctctgagttaatgcttctgacatggactatgtttcaagcagcaactccctggtttagaaagcaaacctgattctctcctgcctggccttccaaatttcccccaaatctactcccttttcagtctcatctccagttatcctcttgatcctgactcctagccttttctttgacttactagcatttgcccaagccatgaccactgcctagatgcactgctgactctacttcaccaattccaactgtaaaattccaacatatgaaaactgtggaggacagggaagatggtatccaccaatgtggaatgaaagggccaggggaaaccctggcaaaggaggtggcaattaaactggaccctcccttctatgacctggacaatcagcacttgcttacagaccatcagtttgggcatttaatcacaggagggctgttttgcgttgttatctgaatattccactggacctgtcttgattagaaattcctcaaagtcaaggaccaagtcttacacttcttacatgtcctctgcataaattctaataaaatctgttaaaaatctgcattgtgatgaaagtgtatttttttaagaaggcaataacattacatgtttagaaagaattaacaaaagtccacgttttcatgctagttggatgacagtatttaagaaaagttaaattgataaaacatcattagatcacagaaaggctaaagccataagtattttgtgtacatatgaggcattttgcataaatgttactaaataatcaatgcaaaaaatttacttgagcattcactgtgctggatgctgaagtgaacttgaaagaagcaaaaaatgtagttttaaaaatctgtcttgggctgggcacagtggttcacgcctataatcccagcactttgggaggctgaggctggccgatcccttgaggtcaggaattccagaccagcctgaccaacatggtgaaatcccatctctactagaaatacaaacattagctgggtgtggtggcgtatgcctgtagtcccagctacttggggggctgaggcaggaagactgcttgaatctgggaggcggaggttgcagtaagctgagattgtgccactgcactccagcctgggtgacagaatgagactctgtctcgaaaaataataaaaaaagaatgtgtcttaaaaatgtagtctttttttttttttttttttttaggctgagtttcactcttgttgcccaggctggagtgcaatggtgcgatcttggctcaccgcaacctccgcctcctgggttcaagcgattctcctgcctcagcctcccgagtagctgggattacaggaatgtgtcaccacgcccagctaatttttttgtattttcagtagagatggggtttctccatgttggtcagctgatcttgaactcctgacctgaggtgatccgcccatctcggcctcccaaagtgctgggattacaggtgtgagccaccgtgcccagcaaaaatgtagtcttaagaaggtaagaattcctggaggaactcacaatgtatcacaatcaaataggagaataattgatgctgacctatccattgttgagactcctggtgcagcagaagatgagagacaagggacggatgtgggctgccaccactctaccactacgcttggatgggagcaggtgggggacagagagcgcagcaccaacaggagtcagcctttgtccttcaaatattgtgaccctgaccttggcagcctcatgctttctaggaaaggctctgccatatgcacctgggattaacacccttctctacctgagaaaccagtgccctccaccccacctaaatgaaacttcaaatggggctcataaaagggaatgacatgacaggaagagaaacgatctgttgggaagaggctgacagtgctcggaaaaccatggagcaaaacagatggaagaggacacatataccagtcctgctggaactgcaggatggtgagaaaagactgcaagctggcttggaaatgaaggctgggtgagttgagtgagcaaaactggttcatccttaacctgctaagttagagtaagagaattttagatggtgggggttgggggatgactgtcttttagatcagcttggaaaaaataaaaatcctcttctacactaaagtaggaaagaccacagagttagcaaagaaggcatttcagaaagtcaaatggggaaaaaagaagaatgttagataaataggtgaaattataaagtgtctaaaagcaactccaacaggagaaagaaggtgggcagggtcagagttcggaggatgtgaagggcaacagaggccctgtgaagtacaggccaccctcgtgaggagtaaggacagtgctgtcctgccacctcaaggtagggcctggcagtgccctgttcccagttctgtgccccgaagtgaagcgccgccgacaggctttgatgatctttccacctcctgactcttggcgggcagagcatacagtcacagaccagatattagaacactttatctagcatatggaaggaacagaatgtcaaaggggtttattactgtacctgaccagataatcaggtaattagcactattaacagaacagattggacacatttatacatgcatttgtatatctccggggaggcatagcttcaaaaaaacataatatcaggtgttttttattataatgtttgtgtgtatgtgtgtttttctaaagaacattttatttctcagaaaggataccaggcatgtttcttttctgcacctgtacggccctttttcacttagtcaagctggactgcaaacaatgaagaaggaaatttgtttctggccccccccagatcttacaacaagcactgccgagctggctggcttctttgttcatatgcccaggcccccacctgggtggtgcgcaattctaggaatatgctctggctgaaagacagaaaagaccaggagagggagcacaagaacacaagatatttctatatctgggtcgcagggaaagtcacagaaagagagcaaggcaaagagaagcaaatgcctcaaaaaatatatgcgggatcttaacggtgtattttttaggtgcaataaaaagggaatttggaacttatggtttgttcatcacatagaatacatttttagcaaattatatttaatgcagaataaaggctattttatttattagtttgtcctgaatgatatcattactttatgaactgccaaatctgtcagcaattattaacactccacagctagctgccttcccctaggtgtttcagttcacctttgccacacagtaacatgggaacaactgcgtcagacgacaagcatgcagccccaggcacagatcagtgagtttcagtgacactacagcacttagctggattaagtttataggctgagaacaaggtaatgacaccaggcattctcctccacaggaattcacaatatgggatgtcactggtgggcaccttttcaatataagatacaaatcaccttatccctttaacgaatgcatactgaccactttgcatggttctattgtgtcttaggtgctgggggcataaaacaatgaatatgaaggaaacggtacttggtctgagaggttctaggctattgggacagagacaagtcaacaggtaatcacaacacagccatgataagaactgtcagtacggttcttacttacagggtgtgtaagtccattttcatgctgctgataaagacatacctgagactgggtaatttataaagaaaaagaggtttaatggactcacagttccacatggctggggaggcctcagtcatggtggaagatgaaggaagagcaaagggacatcttacatggccgctggcaaagacagaatgagagccaagcgaacagggaaactccttataaaaccatcagatctcatgagacttattcactaccaggagaacagtatgggggaaaccgcccccgtgattcagtttatctcccaccgggtccctcccacaacacatgggaattatgggagctaaaattcaagatgagatgtgggtggggacacagccaaaccatgtcacaggggaagtacagctgctggcggaagggcatctaactgaggaggtgacaaatgagctgcagcctgagggaggattagttaggttttgggtgggagctggtgttccagatggaagaaatgaaatgtgcaaagacctaagagagaacatagcatgcagtgtggtgtggcaggagcagcagctggggcaagggcacaggtgaaactggagaagggagcaaggggacgggctgggaaggtccttccgtgtccgccgccgaggctggcccaggggcctcactggagtctgttgcgcaggagagtatgagggagactcctttggctgcatttggggaacaagccagacgggcggcaagccagtcacagaagtccaggcaagcaccactgtggccgggatacaggcagtggtgttgggaagggaaatatagacagatgagagaggccattaggaggaagagttggcgaagtctgagagtataggccaattcaagactgagaacgactaaaaaaagcatcatgttgcttctaactaaccaaagccacaacctggataccccattgacgaaaacaaggtatctttggaagctatttgggacgctttacagtgtgtaataggaattatgtacaggttcccaggcagacccaaggcagtttaggtttcagagtcataaattttggaggaggatagggctcagaattctgtagcctggggctttctttaaatggacacctttgatgtcagtctgttgtttcagtttctgcctaatgtaggatttttaaaaacagcacactttcccagtaagtcattctgatctggcaatgagaaagaggtgaaagttctcacaggatgtaaagggtctttaaaaaaaacgacgggctgggtgcagtggctcaagcctgtaatcccagcaccttggcagggtgaggtgggcagatcacgaggtcaggagttcgagaccagcctggctaacatggtgaaacccgtctctactaaaaatacaaaaaaattagctgggcatggtggcgggcacctgtaatctcagctactcgggagtctgaggcaggagaatcgcttgaaaccggaaggcagaggttgcagtgagctgagattgtgccactgcactccagcctgggcaacaagagcgaaattccatttcaaaacaacaacaacaacaaaaacaaagatggctgggcgtgttggcttgggcctgtaatcccaactactcagcaggctgagggaaggggatcgtttgagcccaagagttcaggaccagcctgggcaacactgagaccccatctctaaagaatgaaaataaaaaaataagaaaatataaaaaataaaggtgattggaaaatagatgagctagtataatgtgagatgatgctgcatacagccatggtcagaaacggggaaaaggcaggggaaagttgactttcctcccaggacctgtttgttgatttccatgataattgtggagcaacctaccaaacctaccagttctatgaccagggtctccacttggacctttagaagcttcttcaacacttgagtggacttcaaacttcaaagtggactttgtgattccgaccctcctgcctccctcttttaaggacccttgtaatcattcaggacactcccccacctcaagacccttaacttaatctcacccacaaagtcccttttgctatgtcacatgacacactcacaggtttttggggataaggacatgggtatctttgggggccagtatcctgcctgctataccgggttataaaatctgcctagctggttgcctagaggagtcttattctctcggtgtctcaaaatagaggagttccctggcaaaggtaggttcttatgtaagttaaagtgatgcaggcattaatgtcttcatgtgatcaactgacgtaaattgaggagagccattaatggataaagtgaaagaaaaatgatgaaaatttatttcagatttcagatttcagatattctctctgttatcactttacattgcaattttttttcagcatcctattatttcttgtgtaaaggcaaatttctagtgctgggttcatggtgacttctgtgtggtacagagaaacttgaactagagctggagatactcactgagtctccaaacctaccgctgactggtttgtgaccctggacctgtttcccacctgttaaaaacacagacatttgcatctttagtgagtcttactcttgtcattgaagcaaggagttgagaacttgggctctggagtcaggctgcctggccttaagtcctggctcctctgcttaggagctaaccttttggcaagttaattaacctctcctgctccagtttcctcacctgccatatggagataataatggtagcaatcccatagcgtcaatgagttaaacacgtaaagtgcacagggcagtgcctggcataccctggatgctcagtaaaggttatttaaaaaaatcatcatcatcatcactgtgttagacacaagggatatgcaaaagataaaacagagtccttttcttagtgctgggtcagataattttttaagactaaggttttacgattccccatatatcacgggagaaaaaacgccctgatgtcctcacacgttccatgcatcatgctgtgttagcaagatcttttaacatttctccttgctgccaattaaagggcaccaagtcaaagttgatacgtaaaaattactgtcccattagcaccttctggcctcgctaataaatcctaacttaattaggcatatgtatctttttcgtgggacaagggatagccaaaactagaggtatatgggctccagcttgtttacaaccgtcccttaaaagagctcaatgcataattgcatacccataaatacaaatgctataattttcttggatcaaagatcattttcaaaaagtagacacgtatgtatcttcatggtagcttttaaagcaagttctacaaggtctaacaagtcagttttgagagcaggccttccaatagctgtcctccacttgaaatctgaagtgcggaaagtggagtggatgcatgttttactgaaagagtcagcaacagaaaatagagtacactcacagctgtagcgagccaggatgaatttatacagtgaattttaaatcagactcaaaattggcttgcactatccattgaaaaaaatcccattgattttgggcttcatgatgatgttttctgggagaggcagaccttagattgagagccaagcaaagcttcagatgcagattttttcttttattttccaaggaatttgaagaggcagaaattgctaatggaatacagggataaaaatgaatattgtatttctacttgctagcaactatcttggtatggaactcgactgatactgttctgtcctagtggctgaagcctttcactttattaacttttttagatagactttaacaatttcatttttttctttgtctttttccattttctctcttctattcaaacacttctgcaaaatacagtgtttccattaaagtccctcagctttcttttgtttctcagactctcacatctttgcaattttgctcaagttaccttcatattcacttggcacacagtaggtactcaataaagttggtttcttccttcttcctctgcctggccgctgtctggtaatgtacttcttcctttattttttggtttacaaactacttgttaaataattggctccaagagcctccttcagagtttacatcatttcttgggaagctcagcccaaacagagataactctcctaagatatcctggaaataaggttgcagagaaaaacaaagtcccacttatcaaaatgaagtgcttttgttctcgttttggatctggtggcagaaacgaaataccatctttcagaggtcccaataaaatatttgacaagatatgtgaaatgtttttcttcacttggactgctttcttcataatacagtctatgtgtttcaggagaaaaacaaggtcaattcaattgatcaaacactgtgtcagcgacagacacacatacatataaatgctcacattctctcacagttataacaacatggaatctaatttagaaccacaagagctaggaaattaagagttaatacttaaaccccatcctgaatccatcttgtcatgcctgagtatcacttctcctatagcaagcaagatcgcccgctgttctgaggccactagacagagaataaaatcagctataacattactgtgtcacaaggagggaattagggatgagtctggagaactggcttgggtgctctttgtacgcaagagcgtgaagccggatgggagagaaagaaaggaagacaaaaataaagcgtaaaaatgcaggcacattagccgcaggcaagctcccgcttgccttctatcctattattaccatctcactactgccttagggggcatctgtaaggcaggggcaagctgctgctctcattacagtgggctactagcagtctaaactccaaaacaaacttgaaagatatatgaaccacaatgatcacagccgacaatatgctgtggccttatacttgctcctgcaattgtgtgtgtgggcaggaaaagggggtcttctcttttactcaactcaaatgtcccttgctttgcttattttagaaacggtttgaatgactgttccttcaacagcattatgggtcacgtacccactaaaacgaaacaatcacactttatgtctctatcctgaatcactgttttaatttttaacctaacctagcaggaaatcatgggtttagccctgtttgatcatataaaatctctattaccaaagagaaaaaactcatggtactagcccaaaggcaataacagattttaggagataattgtccagatacctcgttggctctggagcaggtaaaaaaaatcacacataaaatagcaaaaagcaaatttattaacttgcctgagctttttgcctcccttatctactacttcaccagaaaaaggtctgctcgctatttacaaattcacttttctttaaagcttcttcatatgactaggtcctgccgataagtaatactctcaatttgtcatttgtctgtaaacttttaatgttaatactttttcatttttgcaatttggcaaattttatcatgcagtgagaaattattatctagatgctatctgctaggatatacaatgaactttctccttatcctactgaaagtacacctctcaaaaagaatacaaaataagagcccttcttggatttatttgaaaaatgaatacatatattcattattgggacttttcaaatttatgaaaaaatatatatttgaacctaaagccatgtacagaaggttagctattatcttaatcctaaattctgctattatatttgtatcacagatgtactgtgctgatagagaagtctgagctattggatttgccagcttggattaataactacccatttcaaatcattaatgatgctggttccagttcagtgattgaactgggtaaaaaaacatttcatcttattctttccttatgaaagagctgctggctttgcaatccatttctttctgaagaaaagtccttttgaaagggagaatactaaaaacggtgtaagaaccactggagaagaatagaaattcattttaaagcagtgtaccatgtacaaatgctgtcttacaaataggattatttaatttaaaccttagatctgtcaagctctattacttcaaatggagcctatcgcttcttgagttcattatatatcgagattatattacaatttatgttaggttaagtcattgctgagatacaaggcggttgaaaaaaattacacagcagtgtcagtaaatagagcaaagtcactgcagtgttcagaaaggcaaaaagtcatcttgctaaatgaggatccaagctgtcctgtacgaagactgttactaataaataaaaggcctctgggaaaagtgctgagcgtacgctggatctattttcagcttgcatcagcagctgctgcccctgggatcacatctttacgcatactctacaccatatgtaatcactccagtgctgcaaccagtaagataatgaaagagcatggcataaatctatacttgagtggaatgctaaatgagaaaaataatacaaaaaggggggaaataaaccgcattttcaagtcattaggaagaaagactttgacatatgaagtgctgcaaccattaatagcacttatcatatagagtggagacaaagagacaaattaatcaaactgacagaactgggacattttatgctaatacaggctcctgggttttagtctgtattcctctgcgtctggaaaactgataccattacagggcaggaaattgcatgaataacatgcaacagatcataaaaattcacacaccaactgcagaaacactgccaaaagctctgtaaaaacaaggatggagacctcaacagagaaactaccagcaagtaatgaatgcaaataagtccaggaatatctcccattcatgcattgtaattaactataggcttctcgctcataattacagtggtgaaactgaagcctagagagcgaactctgcagttagccagagaaggctgctcaggctctgattcaaggctgtttgccatcagctggggtgagtgccactctgacctaaattttctgactgggttgtgttggctttaaaaaaaaaaaaaaaaaaaaaaaagcaaaataaacagcagaacattagcttaagactttaaagtggaggagggagagaaataaattgataatgcaaagaaaagttgaacaaaattttctatgtatgtttctgtgggtggtacaaataaagagaatctgagactgaaaacatttttataaaatgcacgctgtccctgacttataaacatcccctactttctgaataagctgtatgtacttaaatccgaatggcaggcaagtcctcatgaaagctcgtgggagcaactaccctttgttctccaattgtgaactccgagggggttggtggagaaagagccgctagctcatttataccaatctatagagataaattactgctgccttgtgatctctgcctttccctaaggaaagtgtatgtttccttgatactggaagcagatgggttccttagctggaacaccaaagagattttcccataaaaaataactgtatggacagaagtgtggatgaaaaaaacgcatcagaatttctttctccaatgataccatgtttgctggcattcaaggcttcagggcttagtgatctggtttcaatccttcctctcattctcacctaatacaaaccacatacttgcctgcctctagaactttgctaaatgatctctttcatttatttgacaaacattcaccaaatggctattgtgttggcctggatatatagggtagatttgtacaccgaaaacactcccctccaattcttgcacaaagaactaactgtccaaatgagaagacagataagcaataactcaatgacaatacagtgtaacagctgctatgacaaatatggagaaggtactacagacatacagcagagggacactaaaccccaaatggccatttcccatctactgaaattctacccacatctccctctccacgatgtagtccctcatcttctcattagaattacgtgttcctgctctgtaccttcatagcccttcacttatacctagaccataggattaatttctgtctctcattgatgataaatatctgttcattgaacaaaccgaaacaaaaaagaaatgctatacagatatgagtttgggagctgacttaggaaactaaccattactcataacctgtttctaggaaaaaatacattctgggttcaaactaatttctttacaaacttttgaaatgtaatttatccaaactgtttaatcttccttccttagacactgggctaccgaaaatgtaacctgcatttgcatgaaccaaatgcatgagataatggaaatgtttcaagtagtgcaaatatgaactgaagattcttcttacagtcatataacttgtgtattaaaaatatctgttttagaggccaggcgtggtggctcacacctttaatcccagcactttgggaggctgaggtaggcggatcacctgagaggtcaggagttcaagaccagcctggccaacatggtgaaaccccatctctacaaaaatacaaaaattagctgggcgtggtggtgtgcgcctgtaatcccagctactccggaggctgaagcaagagaattgcttgaacccaggaggcagaggttgcagtgagccgagatcgtgccactgcactccagcctgggtgacagagcaagactctgtctcaaaaaaaaaaaaaaatctgttttaggggacgatcctcatttcacatcatccttggtaaaatgaaaactgaaaagcacacctggacacacacatgagcatggggctctgtttggccatgtgctgctctgtacagaaaagtgcattataagtaagtgccctaggttaatctattgttatgattattgccattatgatgacaatcatcaagtgaggctgcccacagtggctggtccagggacatagctagaccacaagggctaatgttatgacctggtacagtgcctcagtggccaccatctagagggaggagaagggctaggtgtggtttttctttactgttttttggccctgaggacattcacctgagaagactttgggtctattaataacctaacagtggatctgcagaaccctgctggcctccactggaaggtgttgagtcttttctgaagtccatacacttcttatttcttaatatcataggattctgaaatgtattggtttctttctgtttatcttgtgtagttttagcatatttaccattttaaccttttgttctcatcacaatcaggtgtcatactattgactgtgtatggtgttaattttcagtttttttttttttaaccagtgaatggggttagaatgttcttcttccttgtgtattaaccacaaagagacgtttgaattaaagtttaaagatgacaaatggtctaaattctgattaggcttaattagatattggtattttgggaagaaaaaaaatataacccaaatgcaagatagacaatagttgttttagcttaaagatgataaaaactaatagggttcatcgtgattcgctttttttttttttttagacaaacagtctcgctctgtcgcccaggctggagtgcagtggcgtgatctcggctcactgcaagctccgcttcctgggttcaggtcattctcctgtctcagcctccccagtagccgggactacaggtgcccgccaccatgcctggctaattttttttttctttttgtatttttactatagacagggtttcaccgtgttagccaggatggtatcgatctcctgacctcgtgatttgcccgcctcggcctcccaaagtgctgggattacaggagtgagccaccgcgcctggccgattcctgttttaaacagagttaaagagagaacacattctcagtgagagaaagtattggggaatataatgacaaaaactgccaatcgatattcatgttccctgaattgacaagcatctatttgtctacagtttatggctccttatttaagcatattaaaactgagaaaaaaataaaaagatcagaaaagaggtcaaagttaagaaagtcttggagaaatggaattattagcgagaaaataattctagtggtaacattattttcaagtggattctctttaaaaatcctgggtctggggaacagcatgagaagttgacacacaggcaaagctttgagcctttcttgtaaggagttacctagaggaagcgtgtgatttgatacacctaaatcaatgcaatatattatttgacagagttatacggagctcctgataaccaactctgtgctataattacagagactgaagaaagggatatgggggtagggcaggaggggaagtgatgggtctgtgagatgcaggttgctagagatttctttcttttttttttggagacaaggtcttattctgtcgcccaggctggagtgtagtggggagaccactgctcactgcagcctttacctcacaggctcaagcaatcctcccacctcagcctcccaaagtgttgggattacaggtgtgagccactgtgcctggccaaaaagatatttcttaaggaaaggtgacaagtgctgcaggagaatttgtaagttcagggaggtcagctcatagagaaaagagtctaaaacagtgggcctgaggcaggtggtaaaatatagagcagggaagatgagagaagagagtgaagaggctacagtggcaagtgggaggtggtcttgggcacgtgggggtggggtagagaggtcactactgcatctaaaagggcagagatgggatggaaagacacaaggaacatcctggcagcacgcatactgaatcataacaaggtactagaaaaaggctgtggcatcagctttctcagagggtttttaatattaaaagagataaaagtctgatttggattgtttaggttctgttttggatgcagatagaatttgataagttatttttctttttctgaaaggcacatataagaattatattttaatatagctgtgctttttaggagtacgttcggatatcactccagcttgtgtgtaccataataaatatctgaacaatactttatggattataaaacacgattttcctattatttgttcctcccaacaactcggtaaatgaggtattatgattcttattctcattttctaggcaacggtgttttggagagtataagtaacttaatcaaggttacagagccatggcaagcagggccgggtcttgggttctgagcccctcattccaaattacgcacaatctcccccatatctcttcagccattctaacaaatgttttcttttccccattcctgcagaatgtttttcattttgatgattacccttaacatgtttcaaaaaagcataggcattggaagacccagaaacagagaccaagaaggcagggaccacaggacagaccctggccttgcccatcacccagtttcattggttccctttgccttgatttgaccccacctgcaggtgctgagagcttcagtttaaaatctgggaatatcctaaatgtttataggaaatccccatcctctgcctccttctttaagcaggtgccaaaattctcctgaaaggagtatatggatttgaataggacatcatccttgcttctgttttatagtgcttctttgtatttattcattccatcatatttattgagtacctactatgtgctcagctctgtgaaaaggcaggcatgacacttggaacttgtactccagtcctgcactgtccaatagggttgtcacatgttgtctaattaaaattaagtaaaatagccaggcgtggtggctcatgcctgtaattacagcactctgggaggcagaggcaggcagatcacctgaggtcaggagttcgagaccagcctggccaatgtggtgaaacgctgtctctactaaaaatacaaaaattagccgggtgtggtggcaggcatctgtagtcccagctactcgggaggctgaggcaggagaatcacttgaacccaggaggcagaggttgcggtgagccgagatcacgccattgcactccagcctgggtgacaagagtgaaactccgtccaaaaaataaataaataaaataaaaaagtcagttccttagtcacacacgtggctactggctaccatattggccagtgcagaagaacatttccatcatcacagaaaaggctacttagcggtattgaaacatgtaagagtaatcaaaatggaaaacatattctagcaggagtggggaaaagaaaatgtgttagagccactttgttagaatggttatacagttataggggataacacacatgcttatttcatggtcttattactccttgcttagtccgttgcaacaacctggctgttgtctctttcttccccgatccttcctttgtataggtgcctgactgaccttcctgatgacagtgactttatctctttgcttcttgcagaataaaacctaagcccttcaagcatggcattcaaggctcgtttaaatcaggctcaatggacctgtcctctctcccaccatgtcctctccataaactacaatttagtaacagaaagcggggttattaatatcaagcccactgccctccacatccattctgtaggagaatatctacaattacaagatgtccacaaaagtcaaacagacagaccttttaaataacttcattgaactgaaacacaagaaaagagaaaaggagggaagatatggtcacagagaaacgagaggattattgtaaattatctaaattagtcctaaacaagtaatgccacacaaagcactagtaagctagaatgtcattctctaccctcaccataaagagggctacagaaataggtgaggaggctggacagatgcttagggaatccaagcagaagagctaggatattttggaaaaaatatatcagataaccaagaataggtgagtgaaagaagcagacacaagtgtgttcatctacaggtactgaaccctaaaagcctattcctatattctatacacaatttaggataataggtgctcctgacaagatgccactgtggttttctttgagtagagattatacaaaacagacagggctggtggactgaaaaagtactgaattatggtttgtttcccaaactacaggtacttaggacccactgttagaattgtaatattttctctaattgcaactcattttcttctttaaatatagtttaaaaagaaacttgtcctaagcaatatctgcaaaatctcaagtttaacacacgaatcatactttctgcaatacatattaagataaacacaattattttgaaaaaaattctccatataccacctgaagtcatttcacttttaggttatgctgtacatattcctattctgggaaacactgggaacccaaacaattatcctggctgagtcctcgggcaggagacatttggccgtgcctttcctattttccagggataggactgtgagttacttccgtgtggtgggcggtgggtgcttgcaggggtgaagtactaacaggtagcaaagtgttggagacacgaagcattaatcatcagtcaacaacagcagtggcagcactgctatctttcctggggctagtgagaattaacggattaatgtttaggagagcacagaagtttccaagcatctactgtggttctcaatcctttgcagggaagtaaacaactgaggtggccacctgggattctcatctgctggcggggctggtgggagtctgggttttgtgggtggcctcagggggccctggcggcagcttccagcctctgtggtgacaggccatctcctctctgtctagttcacaactccagatgctgtggggaggtggcagcagtccagtgggggcgggacactaagattctcacattaacaatgcacagacatccgtccatccggcactcctgggtcatgtccctgagagtgacacagggctgcccctggggcagacacatgagatcatctgaactggttagctccagagggcctcagctgggcaggggctctgcagcttttgtcagaggctgtttccctgcaaaatggggggaaaatcggaatactcaaacaaaggggatttctgtaactcttctgccatttttctctcaccttttctgtgtagctgagctcttaggaaactggtgttaaagcagttcagtgagaagcaaggcaactgaaagccccttccaacagctgccaatggttgtggacgagcaggcagacaccagggctaggaggaagggagccaacaatcactccacagtggcatttttcaggactcagtcatttctgatgctggaaagaagcttgagaaaccaaagtacagctgtgggaagacagtgtggggctggagggatgcgggtgtgggctgctgcccacgtgctccctggccctgttatagccggacttgtaaggctttcttaagccttgcatctgagaaaggcagagaccagagaatggaaagacaaagctggggagactgatagtggcggcggcgaactgaactcagccccctgcctgtggaggggatgggctgttagtgcctgggccatggatgggggagctctgtaaggatggcttttttcggtatgtgtgttaaagtctgagttttttttttttttttcctgtggggtttacaagctcattccattgtccagaatccttgtgggcatatttctcctagggacgctggccctggatcgctggccttgcctgaaagaggctgcctcctactgcgtttttgttcaacttgctttctctgtaatagagatttgcagcactgtgggcttcagggattcaaagtttttgttttttccctaatatccagcttccatttctggtttttaataatatcccaatcttttcagccattctcccaagaattgtagtgaatgatttttttaaagttttcttttaatttttataatgaatacacataatggagcattcttttctctgacattttccctgtcactaaatttgaatgtttaggtggcacttaaaaaacctttccacccgctctctgaatgttctgatgctcttggtgagtaaaacaaagtctttcaacaccacctccatctgaattgtatacttgatctttctgagcttggcaaacaaaccatcacccactcagaacctagacaggaaagtggcagatgattcaagcttcattaggaacaagtcatgccaaaataacttcatttctggttttgatgggattacagctcagagaatgcagcagaaatagcatcccaggatttcagtatgtcagctgacatctttaggtcactctttgaatgatacgaaaaaatgaggtctggagacagtaaaattgagcaatgagtagctgcttgatggatcaatgttaactgcagctcaaagagaagtgtctggtgatgtgacccagccttccgtcgcctactctgtcacacttaacttgtctctctgtcttagaaaagatgtgagtggcaactggtgagctactccaggagatagaatcaggatcccaaatgatgacccaggctgatattatgtgttaaatgcagaaagatttaacaaaaatagatgtcaaatcctgtatcaggattaaaaaaatcaactttgtaagaagaggatgggagagtcctggcttaaggagttgggtcagtatggtgacacaggtgacaggaaacttaccctgatgatcctgaactacactgaaagatgtgtgatgcagaaagcgagtcacgcctctgctctgctctttaccactcaaatcagatggaggctgtcgaacttagtcctggctgtgtgtgagggatcacactgatcactgagtccatgccccaggtggcatgtggaatggcagaagtacattaaacactgagaaaggcagactcatgggcaccctataagagttgccttcagagagctaacaggctaccatgtaaagatgagattagatttgttctctttcatgccagagggtgtaaacgggatcatgagtgaaattttaaggaagatagatttctgccacaaataaggaagaacttgctagtagtcacggttgtataaaatggaggaaggagctctcttcagtggtggtgagctccccattgttgcatgtgttcaagcagaggctgaagaggtacctatgccattattataaaaaaaaaattccaaattggatggggcctggactctaacatgccttattttttaacctccaatccttgatgcttctccccttatagcacaacagcccaacacgtgttatggttcttagtattccctcagcataaagttgaccaggaagaaagacaaggttgatagtattttcatttactctggataccactagcaaaacaaagagagctctcttgaacttctccaagtctcctataagtctatgaatgacacctacttcgatctacttcagtttggaatgctggcctagtccaaccagtttgctgagatcatgaacaatttgcaggaaacacagggagcattgataggatgaaatagaaggcagtattttaaaaaaatcaagtcaataatttcttatgtaagttttcaaagaccatcattcctattcaacacaaatccatctgtactgttgcagaagcttgaaattaaataaatgttgaccacagcagtctgaatttcatcacatttatacagcatttttccaggcatgagtttccctcactgaaaaataagctttttctacttaggcctatcaggtgagcaagggtagtcagtcacacagacccacagttttgtttgaatggacagcagcctgccccatcttgtattttcttgggcttgacataataactgagccatcaaaaaagttataaatattgtacacaccctgccattctatacaccctaaaatggcaggagaaaatagctcaaagcctttcctccttaatagctccttagacaggttttaggacagaaccgggtaatctcagaatctttgctaacaaatggaaaagaaagcagaagatctgactacaagtagaagagttggaggacgcaagacaatgaaataaggagaggagggtgaagaacatactctaaaagatggctgcaagtactggcatttactcatggtcgatatccaatacatatctattatttatcaagactgggcaaaaattaggaaagaaaatcgtttcttatgagcaactggaggcaaaggcaaaaaagaagttcatgcaatgatgggactgcctaactcctggaggtcccctgtctagagctcctgtttagccatctgttttctgtgacaatggttagcacctgactctgggttaaaattttttgggtagttccctcaggtctgcaaccttgatttaattaccaaatctaggtcgaactctagacacaaatttgaggtgaacaatcgaaccaaggtgtcatgctgtgcattgagcagtggaaggaccttctcttgacctctcatggcccctgatcacagatggctgtgctggcacagagcatgtccctccagttctccaagatggagcaagaaagaaggccctgtatgctaagacaatcatactcttttcacaaatatttcatgtgacctagaaatgtacacagtttggtagtgttaaatatattcacactattgtaaaacaaatctccagaaccttttcatcttggaaatctgaaaatctatacccattaaacaacaactctccttttccacctcctcacacccccggtaaccaccacttgactttctgtttctatgaatttgagtactttaggtatgtcacataaatggaatcatttagtaacttttttatgcggtgggcttatttcttcaatatagctttgaaaataaacccagggaggtgggaagggagggcatacagagcgagagagagagggcaaatccacctcccttctgcttaggtggtggccagaaagggagtatcctgggatatcctccgggcgtggagcatgttggcagcatgcattatagttgcaggagaaggtcctcctggcaggtgggctcaaggctcatcacctccatcaagaagcatctactaagggcccaagttgtccccatgtcaaatacattctctgaagtccatagaacctcagcaattcttgaagaattctcatgaaatgctctcagcatcttcctgggggaggaggaatctgaataaataaggctgcattattttaagagcagtctctgtaggaatcttggagggagagcagaagaggcaatggaatgcgaatgaatagtctcaaagctgccagagcctgctcttgaggaacgaaatatgcttagaatgtgtgtccctcatggactcatgcgtggggcatagaaggaagagaaatttggcttcaaaactgaaagacagtctgtgaaatttagtcacatgtcagagggatcactggcaaaaaatgtctgggaaccactgttacactccagctcaaccttgcggggccactcccacaatgccacctcatatgtcactgtgaatagggccacatcttcaccacatattctccctttcccaccaaaacttccatccagcaccaagaacaagggaggcctcctacagcagctccatgtggggagctatacccttagagacaggagtcggtgcaaactgggagttaacattttcattggagctgattgagctcaacttaccaataggttaatttgtaaatgaaaaaattctattgaaagagtttttgtaaggcaaactcctaattatccttgcacaagtctgctgcgaaattctcaacagaactttaagcttttgcctttttcatccactagactctttcttcatggctgctggtcacctactcatcttgccatccacctacccaaccctgtgtctcctctcccagacacttttctgcttcttcaggccaaaatccatagtcatactggcttttttttttctttatttcacatcccatttctaatcagtttgcaagaaaaactaaaattgtgaaggcaacccatctaccttggctggtctctctcctcccaatacccacccccaccgacccctccaacctctggtccatgttcgtatgtcaccttctcactgagccctgtcctaactactgtattcaaaattccaactcctgtcctccctaactactcccctcctcctagatttattttctcttaagttgctgatcactaacttaggtattcctgcttactgtctgtcatccctaattgggatataagctctgtgaaagctcagagttttgcctgttttgtatccctagtacccgcaacagtgcacacagtagatgctcaatgcaaatctgttaaatgaatgaacagcttcttctggtcattcaggtctcaacacaaagttcttctccttagggaagccttccttggccatcccatctaacgttgcacttccctaaattactgtctatcacatcactctgctttactttgcttctaggacttacaataatttaaactgtcttgttttcttatttgccctccacaatacttgtaggcccataagaactccaacttactctgtcttatccattgctataaccctagcacttaaaacggcttaacacagagcaggtactcagtaaatacttcttcaatgaatggagaaccttcatgacaaaaccaatcaaaatccattatttattttccccaactttcctgatcttgaaaattctaatccacagaaaagatggaagaatcatatatccacctacttttagtctggattcagctgggggtgaatctggaatgtcgggaggaactagactgtgttaaatcattacatttgctaaatttgtgtgctctcttctctcaatgtatatctatacagtcctgttcacgtaagcgtgcacgcgcatgcacacacacacacacacatgcatatgttttcccagaaccatttggaagtaaattgcagacaccatgacatttaaccactaaatacttctgcatatatctcctgagaacgagaacattctacataaccaaaataccatttttccacctaaaaaaagtaatgttgatacaatattataaattaatatatagtctacattcagattctccaaagtgctccaaggatgtcctttatagattttttttttttcaatctgggagccaatcaaggatcactcattacatttggtctcattagtctcttttaatctagggcaatccccccatcattttgtctttcatgacagtgatatttttgaaaagttcaggccagttgtcttaaagaatgttccacagaggatgtctagtcatagcattatgtttaaaagttaatctaatctatttgttctttagtttattattttaatatacggtgagttcatttttgtttgttttaaatttttaagtctgctgattttcatctttgttgattagattttaatttcttgactacttaaaacatttaattggttcaaaagtcaatactgaacaaaaagatacagagtctcactcctatcccaaacctttcactctgttgccacctactttctataggtaatcttttccactagtttcctgtttatcctttctgtttctttttacaaagtatgcaaatgtatgcatgagtatatatttataaatcacacatatatatttatgtgttacaattatgtattattttcccttctttgcacaaaaggaagcataccatatatagtgtacatatccctctgcaacttgtttttctgcttaaaaatatatctcagaaattactcatattggggccaggcgatgtggctcatgcctataatcccagcactttgggaggccaaggcgggtggatcccctgaggtcaggagtttgagaccagcctgaccagcatggaaaaaccccatctctattaaaagtacaaaattagctgggcgtggtggcacatgcctgtaatcccagctacttgggaggctgaggcagaagaatatcacctgaacccgggaggtggaggttgtggtgagctgagatcgtgccactgcactccagcctgggcaacaagagcaaaactctgtcacacaaaaagaaaaacaatcaaacaaacaaacaaaaaaaaacaaagaaattactccacatcggttcacagagaacttttttctttcttatggctacacagtacatgattgattgtgtggctgtatgtggataactttgtgcacatgttgttttgtatctgcacgaatctactattttttcataggttgctatagagttttttagtaggttgttataaagtttactctttaacacatattgaagccctaatccccagtatgattctatttggaggcagggcctttacaaaggtaattaaggttaaatgaggtcacaagggtggggccctaattggatagaagtgatgtccttataagaaggagagacaccagagcactgtccacacacgcacagaggaaaggctatgtgaggacacaaggaggcggctgtctgtaagcccaaagagaggcctctaacagaaaccaaccctggtggcaccttgatcttggacttctggcctctagaactaagagaaaatgaatttctgttgtttaagccacccagcctgtggtattttgctatggcagcctgagtgaactaataatatacatgtattagaagagctaaatgctgtagattcacatgaaaacaagctaaggattgagttaagagaaaatcacttaacttaataaaacttaaaaacttgtctcccaagatatcacttgagaggcataccccttaaaaggtaatttagggagcaactctatatgtatcctcagtctgataaactgtgatttaaaaaaagtgataaaaaagtgaaaaaaagataaaagatatttctggaggctcctgagaaggaagcaaggaaaaccctggcaatccatggaccaccgagtagtttgcgtgaagtcattttaaacattagcgtgagccttacaggtgcagatccattatagcatcaccttctattctgactcactcttctgaagtctcagtcacacaccaattaagttgtcttcttctacatcttaggcatgatgaagggaaaccacctcattaccacagggtccacagtaaatggttcccagactccaattcaagtgacatgtggatagggaggaaggtggcatgaactccaaggacaccagggcccaggacttccaggatctagggtgactttatgtttttttttttttgaattttttttctatatttcatacttgaataaactggctcagaaggtaaatgtcttcttttttataaaacccagttgaggatggaaatggcctcttttactattagtttttaaaatgtcatcattcatctgattaatatgaaaacatgcccttattactgaacattgtgatatatccttgaagaagcagctacttggagatattccatactcaaccagagcctaaagtgtacattatgcttattgagtgacttaccaaagcacacgcttacagacatttatatttgtttgaaaataaccacgaaagcagtcttgttttcttcaacttcagtacttcagtatgtgtataccaagggaatgggaaaggagagacacctttcctcacactccctgcttccttcacagtcatacaagatttgatcagaaggtaagaatttccttgtctgtcagatacagtgtctgacatagagtcagacagttggaaaaacatacgagttatttccactgaaaatgacactagtcatttccagagatgtaactccagaaaacatacaggaatgcaaaggcatctgtaggtttcaatggtcggggcaaatttaaatatgggaaaaggtcttctaactttaaattagaaggaaatggaagaaatctaattgagttcctttgttgctttttggattttcatttaaccaatgagactgtgagtgaaagcccattcagccaaagtttaggactttggttcttagaagaatgaagagccccgagttggacggaagggaccaggaagcattggtccccttaggtcccactggtggctttagagagaaatcccatggggcatgcagaacctttgaaatcacaagcaaagccatactacagagtttcattgttccagtactatgccccatccttttcctgatcttccttccctttcatccacctacccattcaaataaccctttcttcattatagaaatgtaataatgtacactgtaagaaattagaaaatgcacacaaagaaaaagaactccattacatttctaccattcacaggtcaccctgttgatatttttactttgcacacgttctcatggctcttcgtatgtacacaccacttgcactcacatttgtatttttaaccacagtgagatcatactgggcatatcgttcctccaaccactttttctgatcatcacctttcatcaactacttgggtcatatttgagtttctccaatttcccccactccagagtcctttataactggtttgtgtaaaccagtaaccactccaggaccatgaactacatctggtttttaaagctcttaaatcttgtttaacttagcgcagtccatttttatgtcactgacttattgaagaaatcaggcctgcaagaagttgtcctgtagaattaccctcaccctcccaccccaccaccatcccccgaccccagatttgtccctttgcttcctcatggtgttggtaagcttgttcctctaatcctttattttcctctcactggaagttatatctcaaagctttataaggtcaaatcataccgactacgccagtggggatgtgtgacaaagagacatcatggctgtcagcgaagggtattgtatttcatgaatatttggatcagaagatacctaacacctggctgacactccaggctcagattgacccctgcccgggttactgtgaagacagtctgatcctttaatgcacagttctgacttatcgcttgtgacaagaaaagagtgtgtgtgatgttactttgtttccgcatgtgttgttttggtataataatagtgtccatcaaacattcaccttaatggctttgaccccgagtgatcacctgtacctgaatttgttcatggcatttaaaacaatacgtggcactagattacaaacagctttgagaacaagtgctttgtcctttagaaatttagcatccccttgcaggatcttgcactcacctatgctaagtaagagttgatgctcgcgatatcacttgggaggcataccccttaaaaggtaatttagggagcaactctatatgtattcctcagtctgataaactgttggggcttaaatatgttccaaataaatgaagataaacttaacaccagcaattcggagtaaaccttgttcttagtggaggaaccagccatggagcctaaatgttggagctcaatctcagcccctgccccttttttttcctgtttctcaaaggggtcagcgatttctagtgtttccagtcattgcctatgctggtgttcctcctatctgtctatacctttggctctgtgatctcagtgccttaggcacatgtaaagcactacggatacgtatcaaggccatcttgatggcctctttcaccatccatgtgctccctacccaatttcttggtatctctgaaaggccccctcattctcccagttctttacccaggtgtagaccttcctcacctatgctaggctcaggctgtgtctcctgactgtgctctctgtctgtggtgggttgttgttgccatccaacatgcattccattgctagacagatattccttaaactgttttttattatgtcacttcttggttcacaatgtttcatgaattcctattgcttacctggtcaagtctaaattcttttgtctaaattttattcttccatagtaaggccccatgtagtgagaccatattttgacttatttccccaaatctctcatttgtgctgataaaagatgcctcctcaaagtcctgcaagtgcctctttttgggtctttgccacaccagtgtcctctcctgaagggtctctccccacttgctccctagtgaagtcctgtccatcctgtgggtgttgattttaggtgagataaacttcatgaaagagatggaagaaaaatcctgtccttccctccacctgaacctctgcagcacaaacaactgccagtaccctgccatctacaatgaatactcttgaatcactcacctttgatttctatgtttttcttttgattcttcaactgtattgtgggttctttgaaggaggtaatcttgctttacatttctaagttaatcccccaaagaaatgacctctggggtcttgtggtccattcctctgcttctatgaagtgttgtacttaaggattttgtcttattaagcatctggtttaagcacatgcacacgggcacacacacacacacacacacacacatgcatgctcctctgaacgtaattctgtattttttggtgcctctctcccatgtctagcatcttatactgttacaaaatcctcctttaatatagctgaaatccctcctgtatagttgggatgctatttcttcttgtcagtgaatgagacatctggtcaacatctactaaagcagccttaaataggaggaatggaaagactttgttaaacagaactttgaaaggttactgcacttctctacatgaacaccttgtgaattgaatgcatttaactcatccaaaaaaatctccagttacgaaaactgtgcttcaattatcttcccttagtaacttcagttatcttccctgatttcccaaactatgaagttcttaccctgaatctgggtgttccacatttttaatctttccaccttcctatttgtagggtacaattcaattcctgtgctactacagatccacttggcagatataagaaacacaaagaatactcccacatagactaaggcattcagtgggaaacaaacagtgcacacatcagaacgcctctcatggtagtagagtgttcatctttatagagcaagacgcttgagggtcctgtctgttaacagccattctcctggcctttttagtaacttcctgttttccttacacttctcttttcttaactatcatacaaaacaagaaaaacagataagcagggaggcatcagaagggtttctctggatagatcttcaaagtgacccatataaaccttccatttgactggtgccactcaacctggcttgataaacccaagggtgtggccactgctcatagactgccctgccctacccagttctggttgttaatgccacctccaggaatgatgtcatctatgtaacacttttgggaagaataagctgtcatttggttttgcatataaagaatacaaaaattaaagaaatcaatagaaaatgatggcttaaaaataatcaggaaaaaatgagtaacaatgacatttaatagctgtcctttataaaacagaagataaaatgaaataggtatttcttcaacaagctggaggcctgtaattgtgaccttctgtatccttcctttggttttcttctaagcccaggaatctttcattggctaaatcccagcatttttttttttcctcccttggccaacttttggccttgcttgggaacagctgccagtatttctctttgctgccagtcagtcaaaaatgtgctcacgttggaggcctggctccatcccacccagggtgtggaatgcattaactttttcacaaacagccttcgccaggctgcacacgaaagtccatctcagcaaagctcaccgcattactagctggcttggaggtgatgccaatgtcagttacagagactgtcaacatattttaggagtctatggcaaagtgatgaattttactatgtgtaccaaattaatggcaaaaaagaacacttccgagatcctaggaaaccaaaagtgttattatttaattgcttctccactcctcaaagcaaaacaagccaattcttttctagcctgcaatttggttcagaacccaaacaaacaagaaaataaaagtattaactgattagtgcccacaattttattctattttctttgtgcttttaagaacagccttctttcttttttccctttttttttttaactgaccaccatgcatcactccaatgcctgggtatgatccattttattaaaaaattcctgaatcaatttcctggcttacagcttatccaaccaagattccaggtgttctcaccataagaagggcctctttcaaaagctgtctgcttttataactgcacacccaccagaaatgtcatgaacaccccaacaatggagttgaaacctgaagacattgggtgacattccaaatttttgaatggaatgcgaatccattaagattattaggtaactttattgatatcctcagatttgtgccaaatgttaaagctgccaaagaaaagacagaacaaaaactgactcttggattctaactctgagtattttggtgtggaaactgtgttttcttgtaactcacttaaaaaacacaccgtgctttcactgtttaactgcaatctcagttttcaggaagcaagagaaatgagatacataatcaatgtttgccttctattcagctttcagcctaaatgatcctgcacttgtattggcaaatgaggacaggtattaacagcgaacaggaaacctattctaagaaggactggctcaagtgaagcaccactgcatcgtgagtgactcaaccatctactcaaagagtgattactctgcaaggatgaagccatgctaattggacaatggcttgctgccagttcgtgctggcgtgacctacaatacccttggctgacagccatgatgtctctttgtcacacctttttttttttttttccaagggtgtagggtgtaatctggatgggaagtagaaataattttgaaaaactctcacaagtgctatttaaattcttatcataaattaaaaagtttaattaagtaccttggtaaaggcccgggttctatgattaactacgacaaaataatagttatgatgactgatcaagtgaggaactttatagctctgaactttgtctttaaagctattattaattttaattgaaatagctaagagactccataatgggagaaagaaagaaacatgaaggatattttgttcatatacagaggagtttaaaaatgaatagatacgccggtaactattttaaaaaaattgatgcaaacaagtttactttcagaggccttgtcataaatctatttcaaaatgttgattattgtggtcatcctacatcagatagggataaatagacatagtgaaaagaaatcttaaaaacggctttgaaatcaggtcacttaaaatgatttttagatatgtcttaggtttttgtctactcaactcctactactatgccaaaagaggaacacatttctgcataagtttctttaaataggcttactggcctcaggatttaaaaaatgtaagaggtttggaaacagcttatgtgtctcagttttaaaattagctattgctgtggctattttcacactagatttccctccctctgtatcagcaccacagcctccagggctggagtcacaatagtattagctcccctttctgtggcgctgccttaccgcaactccatccgagactgaggaccacatttcagggctagcagtcacctctgcgttactataaataagttctgcctttaggcatttcaaaattatcagtatgattctaggacttgaaaacttctcatttgccagcaagtagttacctgaaatattttgacttcttatttatttgcttttttttcatctgctgccaagtcttactaacgcaacttggaaaattgcaccacagcttttaatgaggattctgaggtaacagccatttcatcagagaagactgttctttccttttaggggaataataacacctactgtttctatagcaccatccttccaagaagtttaacacatcacatttcatttatctgaacagcggccctgcaagtcaaactggtaactagcattgttactccttgtacactcatattgaaattgaggtcattaaatgtgaactaattttctcaaaatcttaacaccttctgacatggttaaagagccatgatccgcctatgttctaggtgatcagatagcccagaagtctctttccgctctttagctgtcatctcctgtgaatgcctgtaaggaaggccctttctgaaaagtcagggaaaagtcataaaagtgggagaactgagcttgtgcctcttctggagtcctgtggttctctcccttcctggccagtttgcctcccatctttatggcttttccctacctctcaatccaaacatccctccactcttcctgaccaacaggattttttctctcttcctccaacaggaagctagccaagttcaaggactgtaaacctgtgtgacataggctaggatctcagagatcatccagccccaatccatcattttcagattaggatgtgacttattgagtctggccatttggttagtagatcccatcctctgttgcatactgaaggcaattgaacttctgtctcctgtatcatcaagttttctctctcttttggaactttcccttcagcccaggtattaggacaggttaggctttgctgtgctaacagataaaacaccacatcttgagagattgtttggagcttctagcaggcagcacagctatgtatatacttgtgaatgaagaacggtcctcctctatcagggaaggtcgtcctcttcaaccaagcctgcagcttcaggagggacacacgtggagcagtgagggagggaaacgacacccactgagccagccagatcagcccaatcaacctggcgatgttggggtgacagatgttgcagccagattgccttcacatccagaaacaccaaatcttgagtgcttaattaacttaaaagtttatttctcatcatgtcagagtctgatttgagtcagatggattttgctggctctcttccaacagtgactcagggacctaggctacagcttcatcactctagagtcctttgacaccagctaagtggatgggacaaagcataaagagcttatacctacttttgactgccttggagcagagtcctcacctcacatttcatcagctagatctagtcatatggcctacctgattacaaatttagtcttcctgtgtgtctaggaaagaggaaaactgggtgtgggtgagcaatggtaatcttcaccacagagtacaaacatgttgggatttcttcctacttaaaataaaaaaccaaatgaaacctcttttgacaccgtttccctccagctactgatctacttctctgttccctttcactcaaaaagccttattctctctagaacacaatcaaattggtttttgtttctactgctcccccaaaagtgctcaacgaaatcacaaatggcctccaaattgccggatggtcagtttttggccttcatcttagcttacagtcagcatcatttgacctagttgatggctctctcctcctcgaaatgctttcttcacctggcttaccacgcactatgctttgttgcttttcctcccacctcaggcttgctccttcttggtctaccttgccggctcctcttcatctccctgacctgttaattcgagaaagctccaaggctcaatcctgggacttcttttcctttctatctccactcacttccttggtgatcgtatgtagtcctgttgcttttagtattcccaatattctggtattacaatttttatctctaggatagacttctcccatgagttctggccatgtaagtccaactgcatactagacatctttacttagatgtcaacaggcatctcaaacttaatatatacaaaatagaaggccgggcatggtggctcacgccttaatcccagcactttgggaggccgaagcaagtggatcacttgaggtcaggagttcgagaccagcctggccagcatggcaaaatcccgtctctactgaaaatacaaaaattagccaggcgtggtggtgcacacctgtaatcccagctacttgggaggctgaggcaggagaattgcttgaacctgggaggtggaggtggcagcgagctgagattgtgtcactggactccagcctgagcaacacagtgagactctgtctcaaaaattaaacaaaaaaataaacaaaactcccaattctacccgagtccccaatcctactcctctcagtcttcgcttcacccatctcagttaatgccaactccattcttccaatagttgaggccctaagcctggatgttatctgtgactcctctctttctctcccaccttgtatccaacatataagaaattcccatgagctctaccttcaaaatatcaccagaatctgacaccaaccaccatgtcactgctatcaccctggtgtaggccatcaggtcacacctgggttgctgtcttagcctcttgtgtcttttccctgcttctgccctggccctctttcaatttattttcacgtggcactcaaaatgacctgtgaaactctccagtggccagctcgttccaaaaaaagaccaatcgctcagtgaggtgcacagtctggaccatcacctctctgactcacctctccccaccctgccttggctcactctgctcctgggtggcaaacacgccctgcccaccacagcctccttgtgattcctcctgtctggctcaccctttccctagacatcagcacagccagctccctcacctgctccaggtctctcttcaaaagtcacccccttgaacaggcttttcttgatcactcttcttaaaattgtaatacttgtatcctaactcccttctctgttttattttcctcaatggcatctaacaaagtatatttaacactgattaatttcctctttttcctcctcctccccactggaatgtgagctaggttcgcctagcacctagaatgatgtctcctggttacatagcagggtcttgacaaatatttgttgaatgaataaataaatgagtgaggaaacagaagcccagagaggaagactagtttgctgaagacctcacatgcagtgataccaaggtgcagagtgtggttttcccagcccctcaaggctgatgatcctagtttaaaaaaatctgcccattactctttttcaggtaaagagtggtggtgtcttcttcagagttttgtttaggtgaatggggtgaggccaaagggcaggctctgtgctctgggctaagtgagtgttttgcccttctcatcctggtcatgccacttcccaaagacttcacccctgtttcccaccaaaactccaccttcccttgtcctcaccctcaggctcagaatgctgttgtcaccctgtgctgtggcgttaactactttctgtactattacatactgaaagggttgcccaaagataatcatgactgtcttattgcttccttaagactgaacctaaaccatcccagagacattaacagctttcatatcctctaaaaacttccagacaagaagattccataatttccttgttggcatctgtgcttggcagtactgctgcaggaatgttctttattgcagcctgtggttaagacttaacaacaaatgccttttctttagaatccttctgggtcagctttctttcctgtatagcactgaaaagtgagatttgccccaaaatgttgagtgagagagagaaagcaaaagatagtgagcacaagcgagcacaaacctgaaatctatttataccgaggaaaacataaggtctacctgcaggggccatactcacccccagcctgtagctgttccctgcatgaacccgtccccttctctagagggtacaaggacacaggaagcaagccagagaaaggtggtgagaccttggcagtaaccttttaacagccacttttcccctagcattctgtcaaggagccaggcagccacgtaagaatagtgttgatgtgcaaacccactgtgggctgagcatcttctaaggaagcacatcccctccctgtcctctgaacttgacacgccataagactgaacttcatagttgtgatgctacttccgtcatggctggcatccagcccgaaatggcctccatgactatagctaaggaggtgtcatactaatgagcagtggaagaacggccctgcaatgcttagcacatcaactactttctcttcatctcttagcaaaacatatacttactcattataaaattgaatgatctgctttattatgtaatgaaagtactaagtacagtggcttatctcctactatttgctgacacaattacctgggtgtgtttttcagtggggaacaaacactcaagtcctagaaatcctagggattgccatttgtttttttttaaaaacgcaagataattcaattattccttgatttctagaaggaggcctccctctatttttgtctgtctttcagtttagagactatgctgggctctgtgagtggctctaatgtgctggtaatggcgtggctcatcaggaattgggatttgggggtggaattgcacaactggacagtcgctggacggcagatctgggtttggcctaaggtggatggggagttggggggaggagtggcagtttgtgttcggaagtttcaggctcctaggaggaactctcaggcctggctgtgctggcccccttgaggagcacagcggttggctgccaagggagtgtagatgggtcaaatgtgactaagaggagggcagggccagaagttgattcaaatttggcgataggattatgatgaggtttaaagatttccaaggagctaatctaatggtttttcttatatcctatgaaccaaatgccgattagttccagaaagctactttctaaggtagtatttagaatgtctgcttatttaccacttaattcaaattttatgaaatcactcactgagctaagtgtgacaattaccattgagcctgcagggacatttcagtgtgcacacagcaagtcaggaaaacaatgcccagcacgtgggtccacaggcaggtgccctgagcagagggggagggctcttcaaaggaggcctcagaaacaatgacagagcctcaaaagaaaatgccactggggctggcttgcatgttccatcaacaagatacttagagctggattactgaaagtatgaatttgcgtttcataagaaaaaaaggatctagttctacctgaagatttcagatacgtgagcaaccagaatgtttcaatggtttcgaggatgtagatgatgcagggatgataatcattttacagggggaggaagaaagaaaatcaacacacagcaaattctcacttaaatgagaacacacagcaaattctcacttaaaaggccaaatagatttttgtgcgatgtctatacagtgtgcctcttatttaaaatgccttttccaatgccatggaaataagcaattatcagggatttgatctaaaaagaaactttaaggttatgtcatatacatttgtatcccagtttcctttacactttactgccttggtattgtatttttggtaaataattcaaggcaggaggatcccttgagctcaagagttccagtccaacctgggcaacagagcaagactccacctttaaaaagagacttacgtttgtcaaatgcctactagaggataagggctgtgctgagaatttttgtatttatcatctcacctagtcctcatggcaggacagctagttaagtatgtccccaacagcgcagttaaggaaaggccagctcaggatcccctggctacagtgcagctgccattcctcggccttcccgttacttggtacccagtccccactccttatcccagccccagtatgtcatttagctgatctgtccttttgcttctagtgttgggatctctctagctacctacttgctagtggtatgtggagtggtaatggagcattctattttgagtatgtaacaaggatacgaatgtgaaaacgctagtgcttatgcagtccttatttatttatttatttttttgagacacgttctcactctgtcacccaggctggagtgcactggtgtgatcatggctcacttgcagcctcgatctcctgggctcaagcaatcctccctcctcagcctcctgagtagctgagaccacaggtgtgtgccaccacctctagctaatttttaaatcttttgtagagatgggggtctccctatgttgcccaagacagtcttgaactcctgaactcaagtggtcttcccgctttggcctcctgaagtaccaggatgacaggtgtgagctgctgcacctggccccagtcctcatttttatcagctggttgccttcctgctcagcaggggtaatagcagatgttgcttaacaagggtctgggatttgaagaaacctccactacccatatcttgtttgtctatcaaatagacaaacacaaatagtgttttaaaattttaattattattattattttttttgagacagggtctcgccctgtcacccaggctggagtgcaatggcgtgatctcagctcactgcaacctccgcctcccaggttcaagccattctcctgcctcaacctcctgagtagctgggattataggcacacaccaccatgcctggctaatattttgtatttttggtagagatggggtttcaccatgttgggcaggctggcctcaaactcctgacctcataatctgctcgcctcggcctcccaagttattatttttttaaagatggggtcttgctatgttgcccaggcttgtctcgaactgctgggctcaagggatcctcctgtgtcagcctcctgagtagctggggctacaggtgcactctactgcacctggcttcttgttttttgttgaatttagatgccttttggtggagcaggtgcttgccccatcacttcctactgtcctatatacaacctacttcactcatttatattatttgccaggcccctgaaggcgtctggtttgtgacttctgtgatttaatactggttgtaaccatcagcatcatatctgggtgatggggtctttggtttctcctaagatcactgtgaagagctgcttagtcaaacaccacacaactctagggaatctatttgcaaaaactatggatgtgagttgtactcctgggagttacaaagtacaaagcttgtgtaactgttggtggtggcccaagagatgcacaccgcgctggtggtacacagggaatgattctgcccgaacacaaagtattatccttagtcccataggaatgacggaagtcaggatgatgaaccaagaggtagtgtatatatggttcaaaggatgaccatttaatggtttgccattgtgaagcccatcttttggggtcctacaacttaaaccatccaattaaatgtcatctctggacagaccaggtccagctactagtgttcccaaagtgccaaaataaccgtattcactgatgtgattaagaaacctgagtgggctgttttcaacaacggtgagaaaagcaagtttacacttcttagaatcttactgaattaatggtgaaaattactagttgcttttatttttcccccaagcaaagaaggtgctgtgaatgctttcgatcttttactctcaagggaaatctagtgatccttacaccatctgaaagacagaaatcatagcaatgattcagatcccacatctaggactgtgccaaacttaggctgaaccactcaaaacctgaagggtaagtgaactagaaactacaagtgactgagccacaggtgaggttcagttcccttcaagaaagatattcacattctgtgcctctgagactttaagtgtatcaaatagaaactgactatgccacagacctaacatgtgacttggacatcaactcctgagtggggacatggcacctagtacatcttctagctcctagtcagccagttttctgtaagtcaataaacattcattaacaatcacacaaaccaaattactgtacctcctcaggcaagctgaccaccaaatcattttttgtctgtccaaccagcgcctgccaaaaatattcactgcatgcggccagcacagcccggtgggcccggaactccttcctctccacgatcaaagtcacgtcacagagaatatcctttttccgctggtcattgaggcccaggaggatgttggtgcagtggactgtggactcatacacatacatgggggagtcaggcttctcatccacagacatgccgttcacaccctgaaagaaagaaagaaacaaagaaagaaagaaagaaaggctgagtcaccacagctgtaggatcagagagaggaggtgagaaagaacatcatggttcctgtgtcccactgccatgagcatggcaggaaggaggggaattaccaatcagcatatttgtgcttactctgtacaatgagctcaggaaacatatctgtaaagtcaagttccacagctgacttttatgcttcctacttaccgcattcttttaccccatggtaacaaagccagatcttttaatagaacatttaaaacatttaaaacacattggtattttaaaacttggtggttctgattttgttagtaggctgaaaaagaaatttcacatgtaaatagcctctatgcaaggactaacttagatttgtgtgaagaggaaatgaatcattttgaagtatttgtaatgttgtcttgatgaagtatatgtaagttcctaaggtgaaatttggctgagatgccaagtagagtaaacatcaaatcacaatacatatttaacaagtgaaccaaactgtctgcacactgaagactcagtagagtcagctattgcatctgccctctgccacttcaaggcaaagcacaattgccataatgcaatagttgctcagctcttagaaagatgtggaattgtgctgtcgttatcccagctgaattgatgtacatcccctttaaggaaacacaatatatcacaatagcagtcatgaaaaaagatgcattcaacagtcaagattacttttacaaaaggttctttgctttaaaaaatatccattgaaatatttctttttcttttttttgagagggagttttgttcttgtcgcccaggctgaagtgcaatggtgcgattctcagctcactgcaacctccacctcctgggttcaagtgattctcctgcctccgcttcccaagtagctgggattacaggcatgtgccaccgtgcctaactaatttttgtatttttagtacagacgggatttcaccatcttggccaggctggttttgaactcctgacctcaggtgatccacccgcctcggcctcccaaagtgctgggattacaggcgtgagccactgtgcctggccccgctgaggtattttaaaatacagtatctgtaattaatttatatagttacatagtttttctgtaatgtttgctagagtagtaagaattccagtagcgagtcctactttctttttggctttcttatttttttaaaacagctttaacatacaataaactgtacatatttatagtgagcaatttgatgttttgattgtgtatgtaactgtgaaaccatcatcacaataaagatagtaaacaaatccatcatcaccaaaagtctccttaaggcccttgtaataatttttcccttgtacctctctgtaccccaccgctacaacgactgatcagctttctgacattctatattagcttgcattttctagagtttcatataaatggaatcataaactacatattcttttatatctggcttcttctattcagcataattatttcaccattcatccatgttgctgcatatatcaagtttgttcctttattacttagcatcctattgtataaatatagcgtaactttttttttatccattcatctattagtggatatttgggttgtttccagtatttatttacaaataaagctgctgtgaacattcacatacaattctttggatggacatatgctttcacttctcttgggtaaatacctgtgagtagaatgtattatatggtatgtgtaagcataacttttaaagagtctgccactgttttctaaagtggctgtaacattttacatttccaccagcagtgtatgagttccagttccttcacatccttgccaacatttggtatggtcactctttctagttttggacattgtaataggtctatcatatttctttttgggtttaatttgctttctctaatgcctgaagttgttgagaatcttccatgtgtttatttgacctctgtatattttctttgaagaaatgtctatttagattctttgcccatttttaattgggttgttttcttatttttcagttttaagagttcttcatatattctgaataaaagtcctttatcagatacatgacttgtaaaaattttttcccagtctgtagcttgtcttttgattctcttaaaagtgtctttcaaggaacagaaagtctttatttgatgaagccaaaaaaccatcttggtgtcacatctaaaaaactaaaccaaggtcataaagattttctcttgttttctgctagaagtgttatttttttagcccttacatttaggtctatggcccattttgagttaatttttgtgtaggtaacaggtatggattgaggttctttttttccttttgcataggaatatccaatcattcccgcagcattgttaaaaatactcttttctctcctgaattacctttgtatttttactgaaaatcagttgtttttacatgtatgaatctatttatggactctgtcttttactatttttatgtttgtctacttttgttttttttggagacaaaccttgcttatttgtacttttactgaaaatcagttgtttttacatttatgaatctatttatggactctgtcttttactatttttatgtttgtctacttttgttttgttttgttttggagacagggtatcactttggagtgcagtggcatggccatagctcacagcagtagctggcactacaggtgtgcatcaccgtatctggctaatttaaaaatattttttgtattcctgtaatcccagcactttgggaggctgaggcaggcaggttacgaggtcaggagttcgagaccagcctggccaacacagcgaaactgcgtctttactaaaaatacaaaaattagctgggtgtggtggtacgtgcctgtaatcccagctacttgggaggcggagacaggagaatcgcttgaacccagaaggcggaggttgcagtggccgagatcacaccactgcactccagcctgggtgacacagcaagactctgtctcaaaaaaaaaaatatgtgtgtgtgtgtgtgtgtgtgtgtgtgtgtgtgtgtgtgtgtatgagtgatgaggtctcgccatattgcccaggctagtctcaaactcctggcgtcaagtgatcctcctacctcagcctcctaaagtgctgggattacagatgtgagccactgtacccagcctctatatctacttttatgttactatcatagtgtcttgatttgctctttttcaaagttagtttgatcctttgcatttccatatacattttataatcagcttgccaatttctacaaaatagtctgctggaattttcactgagattgtactgaatctactgatgaatttaggaagaactgccatcttaacaataatgaatcttctgacccatgaacacagtctctttatttagatcatcttgaatttttctcagcagccgggcatggtggcttacgcctgtaatcacaagactttgggaggctgaggcaggtggataacttgaggtaaggagtgtgagaccagcctggccaacatgctgaaaccccatctctactaaaaacgcaaaaattagccaggcatggtagcgtgtgcctgtaatcccagctacttgggaggctgaggcaggagattgtgtgaacccagcaggaagaggttgcagtgagctgagattgcgccactgcactctagcctgggcgacagagcaagactccacctcaaaaaaaaaaaaaagaaaatttttttctcagcaatattttaattgaaaattttttttggagacagtctcactctgtcacccagatggagtgcagtggtgcgatcttggctcactgcaacctccacctcctgggttcaagtgattctcctgcctcagcctccggagtagctggaattaaagaggcatgtgccaccgtgcttggtcaatttttgtatttttagtagagacgggttttgccaggttggccagactggtctcgaactcttggtctctcctcggcctcccaaagtgctgggattacaggtgtgaaccaccacactgggccctcagcaacgttttatggtagtatataggtcttttatacctcttttgtcagatttatacctaagtatgaatatttttgatgccattgtaaatggcagtcttttaatttcaatttctaatttttcactgctagtatatacatacaaataatttttgtattttgatcttgtatctggaaaccttgcttattagttctcatagcctgttttttcttggtagattccacggtattttctacatagaagattatgttgtctgtgaataaagatctcttactttttttccaatttggataattttaatgtctttttcttaccttactgcattgtctagaagctctagttcaatgctgaatagaggtgatgagactaaatatccttgctttcctgatgttaggaagaaagtattcaaccattcaccattttgtatgacgttagctatagatgcttcataggtgctccttttgagctgaggaagttttatttctttctctccctctctcctccccttccttccctcccctcccctccccttgttttccctttctttttctttttcttttttttttttttgagatggagtctcgctctgtcgcccaggctggagtgcagtggcgcgatctcggctcactgcaagctctgcctcctgggttcacgccattctcctgcctcagcctcccaagtagctgggactacaggtgcccgccaccatgccaggctaattttttttgtatttttagtagagacagggtttcaccatgttagccaggatggtcttgatctcctgactttgtgatccccccgccttggcctctgaaagtgctgggattataggtgtgagtcactgtgcccggcctctttttctatctttctttctttttcttcagtggcactcatggctcactgcaaccttgaattcctgggctcaagcaatctcctgcctctgcctcctgagtagctaggactacaggtgtgcaccaccatacctggctaattatttcttatttttttttgtagagatgaggccttgctatgttgcccaggctgctcttgaattcctggcctcaagcaatcctcgtaccttggtctctcaaagtgttgggattacaggtgtaagccactgtgcccagccctgtgtttgccttcttatacattgttggattcaatttgctaacattttgttaataatttttcatctatgttcaatacggagatttgtctgtagttttcttacatagtttttctggcctggttttagcatcagggtaatgatgatctcataaaatgagctgggaagtatttcttcttctttaattttctaaaagcttttttttttttttctttttgtagaattggttttatttcttccttaaatgtttggtagaatgtacctgtgaagacttctgagctgggatagtctttaactataaattcatttttttaaattgtcaaatttattggcataaaattgtgtgtgtgtgtgtgtgtgtatatatatatatatatatatatatatatttttttttttttttttttttttttagacagattcttgctctgttgccaggttggagtgcagtggtgcaatcttggctcactgcaaactccacctcctggattcacaagtgattctcctgcctcagcctcccgagtagctgggactacaggtgtgcgctaccatgcccagctaatttttgtatttttagtagagacgggtttcaccacgttggccaggatggtctcaatctcttgacctcatgatccacccgccttggcctcgcaaagtcttgggattacaggcgtcagctaccgcccctggcctttttattttttttattttttaaagagacagtgtctcactttgttgccctggctggagtgcagtggcgtgatcatagctaactgcaacctcaaactcctggggctcatgtgaccttcctgtctcaggctcctgagtaactaggactataggccgtgccaccatgttcagctattttttttttttttttgtaagagatggagtcttactatgatacccaggctggtcttcaactcttggtgtcaagtgattctcctgctttggcccccacaaagcactgggattacaggcgtgagccaccacacccagcccatatatagtttttaaaaatattccttctaatatgggttgaatctgtactgatgccacctctcatattactgatactgaaaatttgtgtcttctctttctgatcagtctggctagaggcttaaccattttactgacattctcaaataactagtttttggttagtttttttaaattattctattttctagtttgctgatctctattctcattgttatatcctttattttgcttactttgggtttaattgggtctttttttcttttccagtttcctaaggtggtagttgagcccactaatctgagatcttttttgtcttttctaacacaggctttaatgctataaatttcactctgttttagcagtatcttgcaaattttgaaatgtttaatttttactcaattcttaatgctttaaaatttcccttttgatttattccttaatgcacaaatgatttacacacgtgttttttggcttccaaatatttgggggagtttttagttatctttttgttaatcctctctgatttaattccattgtggtcacagaacaaacttcatatgactttaatccttttaaatttatggagacttgttttgggtcccagaatgtgacccaccttggtaaatactacataagcacttgaaatgtatattctgttgttggctggaatgtcctgtaaatatcaattaggttaagttgtatgatgagtgttgttcaagtcttctaatatcttttctgatcttttgtctataggttccgtcatgtattgagaaggagtactaaaactttccggctacaattgtaggcttgtctgtcagttattgtaattctattagtttctgcctcatgcagtttgaaatcctattagatgcatatatatttagggtttttattttttcttgtagtatttattcctttatcactatgaagtcaccttttaattcctggaaatattctttgctctgaaatctactttgtctcatattaacatggtcactccatcttttgtttggtgttagcacagtatatctttttctactcttattcttttaacctttttgtgtttttatatttaaaatgtgattcttgtaagtaacatataattgggtcttgctttttaaaaaaatctaatctgaaaacgtctgagttttaattctggtgtttaaaacatgtatgtttaatgtgacaattgatttggctaggtttagatctgccattttgctacttgttttctatttgttctttattctcttttccttcatcttctgactctctgtgttaactatttttttatgattcaatttcatttcaattattggcatgttgttttgttatttcattggttgttttaggatttataatatgcttctttaagttatcacaatctgccttccagtgatatcataatatgcttctttaagttatcacaatctaccttccagtgatatcataccatgtcgtgtaaagcacagtagtatgcttccatttctcccttcctggccattgtattatacattttacttgttacttgttaaaacccctgtactatattgtcattacttttgtttagtcaattaccttttaaaaagatataaataatgaggtaacattacttgcagtgcaggtatactagtgataaattatttcaacttttctctgtaaaagcctgctgccttcatttttgaaagttatctttgaagggtatagattccaggttgacaggtgttttttttttttcttttcagtactttgaaaattgtcattccactgtcttttcacctgcattgtttccagtgaaaaatctgtcatcctcatctttgttcctctgtatgtaatgtcttttcttctcctctgttgcctttaggactttttcttgatcacttgttttgagcaatttgattatgatgtgcctttgtgtagttttcctcatgtttcttgagcttcttggatacgtggatagttttaaccaaatttggaaaaattttggccatcattttttcaaatatttttgccacaatttttttgtcttctcccctcttctcccttggggagttacatataatattagaccatctgcatttgtcccgtcgctcacaaatgcccattttttttttcttttggtactttaaagaaatctcttacattttacattggatagtttcttttcttttcttttttttgaggtggagttcagtggtgtgactttggctcactgcaaccactgtctcctgggttcgagtgattctcctgcttcagcctcccaagtagcagggattacaggtgtgtgccaccatacccagctaatttttttgtatttttagtatagacagggtttcaccatgttggccaagctggtcttgaactcctgacctcaaataatctgcgcacctcggcctcccaaaatgctgggatcacaggcttgagtcatcatgcctagccacattggttattttctattgctaacccttcgagttcactaatctcttcttctgcaaggtctaatctgccatcaatcttttccagcataattttcatctcagacactgtggtccttatctctaaaagtcccctttggtcttttataaaaaatcttccatgtctctacttaagatgttcaatctttcttctaactttttgaacacttggaatatagttataataactactgcaatgtccttgtctgttaattctaacatcttctggttcagtttttattgttatttatcttcattgtgagttatatttccttgcttctttgcataactgaacatttttgattggatgccagacagtgtaaaatttaccttgttaaatgctggatatttttgtgttcccataaataatcttgagctttgttctaagacacagttgagttacctggaagcagtttgatcctttcaggttttgcttttgagatttgttagataggaaaagcagcatttagtctagggttcattactccctactactgattcaagacacttctgagtactctatctaatgacccctgatatatgtgttttctagtctggctggtaggaaatgatgttattcccagttctctgagttccctttgttttgggtggctgtctctccatccttgggtagttttcttacctgcatctgctgatcagtactctgcagaatattaaagggaaactctctgaagatctctggagttctctctctgcagctctctcttctctgctaccttgctttctgaactctattatcatctttccagactcttagtgctgtctcttcaactgaagagtcagccagctcttccttggttcttccttcctgtgccatggcctagaaactctcaaagcagtatgctgagttcagtttgttttcctttcctggggattactatcttttggttcctgatgtcccatgtcttaaaaatcattatttcatatattttatctgtttctatagttgttttaggagaaagggtaaatctagaacctattactccatcttggctgaaagtaaaagccataggtttattttttatgctacagctactccaaacactttataaacaataacttatcacaatgcaaaccacatagtataaactttgctctgctatatataatggtttgtaatacccaattacaaagatgcctctgtgaagaattattagttctttggtattccaataaaagataaaatatttgtgaggtttgttatctggaatcattttttaaatggaattagaatagcattctaaataacacaattcagttataatgaccctaagccacggggtaagatcgagttcacctggcttctgtcaatgactaggaaattgctgctaaattctttattatctagtaagaagacaaatattttctattctggcttcttattagtccttcattttcgtggaatgttttcaggattttcttatctcccatatagggtctcaattctgatttgttttctccattcttagttttcaaattattattctttctcctaccacactgagtctcctcaattagtctatagaaattattgagttaaaaatcataatagcttgcatgtataaggaaacactcaaaacttggtggagcatttaatgttctaggtcacggatggtgtgttcaattcataaaaagtaggagatttataagggacatctcatttttccagttcatttatgggtaatacatattaatgtgcctacaccaagatagaagcttgtgttgaaagaaacaaagccataaattctttaatgaaacatgaaatgaaagaaaataaaaagagaaatgaaagtgaagtgcagtggaaacaggagtggaccaggcatgtttggggcttttggtttagctccagcattgaccaactttgtggatctggacaaactgcctaactgtttaggggcctgcttccatgtttgtaaaatgaaaagcatgaactagaagaccaatagtgttcttccagatctacaattctatgagtctataaaagaaatatacctgattgatcacaaagagcgggatactgtcttttttaactgagagaagctagttttctttgaccttctaaagaccattttgtgccgttatattgttgttgatgttgcatggcttaacaaaactgcccctgcagagctggttacagggaatggggtggacaacaaatatacaaggaaaccacagccttctgggagagtagaaactaggacccaaacccctgctctttctgggctctaagatggttgaagttctcaagagtagactccatattctgctaacagggcaggtttagaaaaacaaagatacagcaacataagcatcccaagttgatgaaataggctgtgacagtcacataaacatgggcatctgctttttgggctaaacttacttgagagctttggaaaacactgaaaaagtattagttttgttcatcaaatggtataatctaaaatatatcactttcgtggagctgttgttagactaacctgactgaagattttcttgaatatattacattatttctggataataattctttatgccatgtcagtattactttcttccccttggcctttacctacccctccttgttggttcctcttcaaacataatggaacatacctttctgctttctttaaaaatcagtcagcccttctcaacctccaattatcatgggtgcattgctatgggttgaatgtttgtcccctatgaaaatcatgttgaaacttaatccccaatgtggcagcattaagacatagggccttcaagagatgattgggacatgaaggccctgccctcatggattaatgaattaatgggttattgaaggagtgcattagttatcatgagagtgggtttgttacaaaagtcactttggccctctctcatgagctccctcaccatgtgatgccctgtgccaccttgggattctgcagacagtcctcatcagcaagaaggccctcaccagatgcggcccctagacctcgaacttgccagcctctagaactgtaagaaataattttctttatacattactcagtcttaggtattcagttagagtatcagaaaacaggctaagacaggtgctcttctatgaactccctccaatttgtctgcttttgactggccaatgccaaactgaattctgcttctcctgtttccactaggttttcttttttcacttgccttgctaatattaaacaacattcccctccgccccccactcctccatgcagcaaatcctgaaatctgcagcaggacccatgggatctaagaatgaaatggtttatagtgagtaacagaacccagaatagcatggaggagtatgacagccagtctttaagcattagacaacgtgttaaagtatgtagacattagctgaaatcagattgtaaggaagctttccaaaggttctgatttgggttttggctggatctcattcttccttttgcaggccaaaaaacccagctgcacatgtacatacacatataccccaatcatctcatcatatggttcagcagtaaaagtaaatcactattattttatcatagtatattcatccccttaagaagctacacagaccacaactcttattactcgaaggtatagtattaatgaatacagacttactcattaactcactcattgactcttcattcattatcgggtcatattcagaaatgaaaatgtctaatagttctgcaggtaaaagtataaagcaaaaaagtaaaaaaaaaaaaaaaaaaccaacaaaaaaatcacagtgggatctgaaaagctgcaattcacaaaaaagtagaatgttaagattttcagacaacctgtcatgtctagagtgcttcagatgaaaagaaatgaatatgccttgcaggtaatgaaaaagaccaaattataaaccatttcacttgaaattcaaactacatttctcccagaaacagtgcattaagtaaatacttctgtgaatcaaacactaaattatttagtaattgctgagtaaattcctgctcttataaaacatgcttttaaaaaaagttatttactgtaaaactgtaagggttagttcttataaaagaaagttttcaagtctatagacattttagagtgcacagtgctataaaaattacttacttattacttttggattggaaacactttctaatgcatcaagactaaaacttcttactttaagtgaaaagcaatccaatttcagtattttctaatggaaaactgcagtgcttgtcacttaatgtccctaatgccttagatagctaaagtaagggccctgactgacatggagcagctaaaacgttttgtgttccttatttactcaaacactccatctgcctgcatcctagttagtgccaagggaactgaaatttaaggctgttgttaggaggaagcacttgcaattgtatcatcaaatccttaatagctctgaatggttctcgtaattcagtataaacttctattttccttgaccttctaggggaaagttcaatgttcaaaaactgacaatggtttttactgcactgctgaaaaatataccaaaaactttaaaaaggaacagttgtaacaagtcccaattttttttgctaatttttgttattattgctgcttgtttattctttcaaataggccaaaataaaaaataacccaaatttccaaaatatctggtaataaacttgtggcaactactagcacttttcctatatttaaatgtaatcgacatcggtcaggcgcggtggctcatgcctgtaatcccagcactttgagaggccgaggtgggcagattgcttgaggccaggagttggagaccagcctggtcaacatggtgaaaccctgtctctactaaaaatacaaaaattagctgggtatattagtgcatgcctgtaatcccagctactcaggaggctgaggcacaagaattgcttgaacccaggaggcaaaggttgcagtgagccaagatcgtgccactgcactccagcctgggcgacagagcaagactccgtttcaaaaatgaatgaacgaatgaacgaatttaaccaaaatggagagtcacagtctgatacggaaactgaggtggaagaaatattagaatgttggtagcagactgtatgtattggtccaaaggtaataaagaattaaagatatatagccactaacctagaaacaataagaaagtttgacaatatcaagtgcattgatggtcagatcaacttctttggaaaacagtttggcattatctagcaaagttgaagatatgcatagattatgaccgaataattccatgcctaggttataccctagagatactcctggatatctgtaacagaaactctgtataaagagtgttcacagaattgttcagaataactcccaactggaaacaacatcatgtctatccgtagcagaatgcagaaatacactgagatatatttatatattcatataacggaacaaagcaaattagagccacatgcagcaacgtggaggagttgcacaaacctaatgctgaatactgagctacagaaacaagacacaggataataacatacaatctggtttcatgtatgtcaaattcaaaaatggataaaaaacatctagggatatatactgttatggagtgatatggtttggatctgtgtccctgtccaaatctcatgttcaattgtaatccccgatgctggaggtggggcctggtgggaggtgactggatcataggggaggtttctcgtggtttaacaccatcccccttggagctgttgcctcaatagtgagttatcataagacgtagttgtttaaaaagtgtgtggcactttccccctcctctcttccctcctcctgctctggccacatgaagacgcctgctccagctttgccttccactgtgattgtaagtttcctgaggcctccccacaagcagataccaccatgcttcctgtacagcctgcagaaccatgaaccaattaaacctcttttctttataaattactcagtctcaggtatttctttatagcagtgtgagaactaacacatggagtaaatgtgtcctctcaaaattcgtatgtggaaatcctaatccccagtataatggtatttggaggtggggcctttgggagtgattgggttataagggtagagccctcacgaatgggattaatgtccttataagagaacccctcttactctctttctgccatgtgaggacacaagaagatggctgtctgcaaacctggaagacagcccttaccaagaactggacaatgctggcatcctgatcttagacttctaacttccggaactgtgagaaataaatgtttgttgtttgagccacccagcctatggtactttgttatggcagcctgaattaagacatatacaaaggtggcaaaactataaagaaaagactcagaatagaggctccatttagagcgaggcagtgttcaccagaaagggacaccgtggggtttcaggggtgctgttgcatgctctatttcttgacatgagtgacaggtaaacatattcccactttaagttatacatttgttttatgcacttttctacatctactatatatatatatatcccagctcccccaaattaaagactgtaggagaatgttaacaactcaagtattgagcacctcctttaggttctgtgacttaatcacaaaggtcctagggtgcgctttgggcttcaaatgaaaaaaaacacacccacaccttaaatcctacaacttatggtcaggaaggtccttaaaggcaatcaaatctaaccaattccaagttgtacgttttcagtaataatctacaaaaatgggccaaatacagggatgaggccttttgggagatggtaagaaatctgagcccaggcctttgctttgcagtaaaacttttttcagagatctcgtgttttgtcttctctcttgttaaaaccaaatcacttcatgcacttctatttccttatctatgcaaggaggaaataaactaggtgactttttagttctagtttctatggttctatgaaagtataggaactttaggaaaatcctgaaacatgagcttttctaactgtggttcctgagaagactttttaaggaagctagagatgctcaaaagaacacaactggctggaagggaaaaatgccatcacataacttttgagagagatgaagaagaggggaagacccatccaataacagtgtgaactttcccccttataaacagagtcaacccaaaggatgaatcaaaggtcaactttcacacattaatggaacacagtgcccatcagtactgagcaatagttcggcattctctttccatggccaaaacagtgctctggtgtgcaggtcagcgtctccctcaaaagccgtcttaggtatgtggctctggaattaagcggggtgtccatcctctcctcttgtctccacccagcgatgtcagatgagactaccccgtttagcgggccagagagaaggctacaactgggatttaacaatagcatggtgcataaactgtcatctcaaaaaggagatgaaatcagcgggtgaaagggagcccatgtcaggccatccaaggggcatgattactgttagtggtggttggtggtggtggggcagtgggtgtgtggaccagggagaaaatgtgcaatttagccatgggcagatttggatatgcagctttgtgatcatcgcactggtcttttttatatgttgatgcttgcttttgcttcttttgtgtaaccccccagttaagagtaaagccaaagcctccatctattcttctgggataggtcattttctactcttggcaagccttcttttctatattgtcacttccagtttgtctctggtattacttctttgtgtctatgttctccatttatattcacttctcatacattaatctctgcttcctattagcatgtgcttcatgcctattaggagttagaggacagagaaaagtcatttcttttctgcatttctctttatcagggcatctgtgtgaaatattctctcccagtgtccccttccctccccttgtagccagagaaatattaccctagagcttcacgctgctaatgtgagaagaaattgtgaacagtgattaggaggctaaatgagggtggtggaacctatttacttcattaaagttccttcagggaaaatacgaggatgggaaactgagagataagggttaatactaaaagaataacagatccatttgactcagagcaatcttcagtctgcctggattctatcagacacccttctccatggggaaatcattacagagaaatgacatgcaaagtgcgccataaagcatctgagtcaaaccagagggaggatgactcaacggatcattttacattttaatagaaggcactgcagatttgtacctagtgcacagttcaacacagggctcataactcctccccaaaacttcttcatcgggtgggaggggagttcccagaacctgacagaaattattctgtcttagaaaaaaaccaagtcaaaactcacaacagagaatcaagactaagaaaagacaacagatagtcaaatgccgaaaagaggggagactgcaagtctaatttcaactttagcatttctgtcaaacctaagacacagcctgaaaattgagctcagtaattagtggacttcagatgtcataaaggagtggggaagatggaaggaggaatggagggagagagaggaaagaggagaacgctatcaaagtgctataattaaataattgtgtttcttaaattagttttgcaagattttccaatgataattactgtcagaagtttgcccaccaggtcagtgacaatgctgggcttgagtttccatgtgaagtcaagaagcaatatattagtcatgccattgttcctagtatgtttcccaggccaggtattgcttatagatgctaatatgtataacctgccaaagttagattcatctgaccagggattatgatgttaagagactggattgtcaaacctaactccttcttggaatgggggtgggggttacctccagacacacttttgtctgcctatacataaagaatatctatagtttcacagctgttcatccgcctgatctctactgttgcctgccccagctcctaagagggcacgcggtttacaggtaggaaaggaaacagaagtgaatactgaggcttggcagaaatacagctttcacagaaaagattcttaataaaaggaaacttgctcctttcatgcatgggggtcttttggacaaaatgattctgttctgaaacatcatctctgcagggatgcaggctagaacgaatgaagtttagattgcaagttggttcacccggtaactaagaaaatcgaaattcaagaccaaaggcaggcagcatctaatggggtgaaagtcatctagcttgagggtcattcaggtagtgttttgagaaaggtttgatttccactggagcctaggcacacctgaaacccactcctgtttttccatttaaaaatgatgaaaaccatgaggctaagaccactggttggcagtctgttaagtcccatatcaagtaacaaaagcatctggaccacctgtcaccaagcaggaggtcaaatggaactggaatgttaacacgcaggtcaaatgcccttcagagaacacggggaaaaggcagtgaaaaggaatgggagaaaaagaatgtgcttggagctttccaagtccctgtcctgtccttggcagcttctcagaatgacgattattgtgaccaaaaggtagtgacacacatgctacatgacacttagtatactgtttaagatacagacggtcttatatgcctataccactgccactcacacacgatttcacctcacagaatatgcttcagataaagccaagtatattaaggaagagatttttttttaattcactcattataaaaagtcagaattgtactgccatgggggcagacaataccccctctccaaacggtaaggaatgggtgccacaagggctcattggccaggtggtaccggagagacacagtgtttcgcactttcttgactctaaaatgcacctattttccatttctccttccatccttagatagaggggctccatttgaatccctgctctcctgcttcctagctgcatggctttggctttggggccattgttagactgtgtaatccttggtctttctatgtacaaaatacttatgtgaggattaaacgagatgaagcaataaagtatttaggatggtccttgttttacagtaaacacaaataaaagctattcttatgaaaagaaagttaatttctttgcacattatatacacttgtaattctacatatgctgaaaatttcttatattgaggcaaatctggactgcatgaagaataatgtatatttttgtttgccagattctcttgcttaaacctggggaagggccaatttgcttaatttccatccaagacctgcaagagaatgatgggataggtgtgcattctggtacttgctggcaacttcggccatgacactatgtagacttccttctgcaacatcccttgatgactgtgaaggtcaaataaggcaacagatctgagacctccctgagaagtgcagagtactctgctcgcatcaggaattatcctcaccactatttgactaatcctacacataattatataaagaatgtctgctcttatgggcacttagccctgatatagttcactctcatgccaaaagaaggcatctggcagatgggggacttgtattgattctcatctgataacatttcctaaaagattccattccttcagatttgttaaaagtgcgtgctttggatactctatcctcccattacgggcttttcctattttctctctctgctaccttttgcatgtatgttctgcccaaatcagaatcctctttcatcatgaggggcaggatcctgcagtggtgacaggtcaggctctggggccagcctgcctgcatctgaaccatgaccacaatgctacctcagacaaaccacgtgagctctctgtaaagatttctcatctgtaatccagtggtcacaaggcgtaagcaacttaaaacacaaacgtgggaaacagaatgactcctggagaatagtaagcacccattagatactgcatacaaagatggtctacagaggcaaggtagtgcagtggttgtggatggaggctctggtgccagcctacctggctttgaattctgactctgtcattcactagctgcaaaaccttgcacaagacacttaacttttccgtgcctcagtttcctgatctgtactaaaagtacctgataaagggcacctatctcatagaactgtgaggattaaaatattttacgtgtttgtttgttcattaattcaccaatttaacatatagtaactggtccatcaaattagctcctcttttccaaccatgccaattttccccattcacgtttcatttccagtttgacaatggcttgccttttcttcacgtaagtatttcctgcttttggccctgcccacctaacacccagactctcccggcctgcttcctatctctggaaataacaatagttctctaactgcatagatttagggtaaccacagcaggttcagcgatctgcattttaaccccatgacagctgatttcaaacaaccctacaaactaagactccccgccctgccattccaagaacgaggggacttgggcaatttatttaagtccttagagtctccttatgtgtgaaatgaagataaagactgtctcccgagagactgttaggagatgtaaatgtgatggctcaatccctggcctcctcaggtctctgtgcagacatcacattctcagtgaggcctccctaaccaccctgctccgtttaaaccacaaccccagcctcccacctcactctccatcctccctccctgtttatgtttctttataacgttttcacatctcacacacactatattttactcatattttgttaatgacctatttttctattgagggcaggaatttttacctgttttgctcaccattgaagccgcagaacttcaaagtgctacactcaatacatacttaataagaaagtgactaaaaaagacttttcctaatcccaacaggtccatatgtcacttctgtttctgctgaggtctccttccagcctgtttcttcacacatatccctacgctctccagagctgcttgtcttttctgggcctcaaggtcgccttgcctatccatttatccacagaaaacttactccattctaagcaatgcgaccgttagagaaaactaatgatataacctccaagacacacagccaagataatgggatggtacaaaagcaaaagaaaggcttagattgacacagtgaaggaaaagctcccatttgcagagatgctgagtagaaggtcttgagtgtgctttatttctgaagctctctgtgctcaaatactcacaaatccagaaacacattgcccattggctctatacaatgtggatccttgcagagtagaattaggctgttctctcctggtaaaagcttgtgtgctcttgcttctaagagatggctctgatcccacccccttatgtccacggcctatctcaaactgccaaacagaggaccaattatgcccttcctttccgcagccctcaggaaaacagccagcacacaggaccctcaatggcaccctcaggatgatgctttcagaatgtgacagcgaccacagcccaggcctctgctgccctgggagtagacgtggctctggaaggcctgggtttgagagaagatggtaggaggaaggtttctgattttcgaatgaaaatcagaccagcagggttttttgaaaagatcaacaacattgatagaccgctagcaagactaatcaagaagaaaagagagaagaatcaaatagacgcaataaaaaatgacaaaggggatatcaccaccgatgccacagaaatacaaactaccatcagagaatacgataaacacctctacgcaaataaactagaaaatctagaagaaatggataaattccttgacacatacaccctcccaagactaaaccaggaacaagttgaatctctgaatagaccaataacaggttctgaaattgaggcaataattaatagcttaccaaccaaaaaaagtccaggaccagatggattcacagccgaattctaccagaggtacaaggaggggctggtaccattccttctgaaactattccaatcaatagaaaaagagggaatcctccctgactcattttatgaggccagcatcatcctgataccaaagcctggcagagacacaacaaaaaaagagaattttagaccaatatccttgatgaacattgatgcaaaaatcctcaagaaaatactggcaaaacaaatccagcagcacatcaaaaagcttatccaccatgatcaagtgggcttcatccctgggatgcaaggctggttcaacatacgcaaatcaataaacataatccaacatataaacagaaccaatgacaaaaaccacatgattatctcaatagatgcagaaaaggcctttgacaaaattcaacaaccttcatgctaaaaattctcaataaattaggtattgatgggacatatctcaaaataataagagctatctatgacaaacccacagccaatatcatactgaatgggcaaaaactggaagcattccctttgaaaattggcacaagacagggatgccctctctcaccactcctattcaacatagtgttggaagttctggccagggcaaccaggcaggagaaggaaataaagggtattcaattaggaaaagaggaagtcaaattgtccctctttgcagatgacatgattgtatatctagaaaaccccatcttctcagcccaaaatctccttaagctgataggcaacttcagcaaagtctcaggatacaaaatcaatgtgcaaaaatcatgagcattcttatacaccaataacagacaaacagagagccaaatcatgagtgaactcccattcacaattgcttcaaagagaataaaatacttaggaatccaacatacaagggatgtgaaggacctcttcaaggagaactacaagccactgctcaatgaaataaaagaggatataaacaaatggaagaacattccatgctcatgggtaggaagaatcaatatcatgaaaatggccatactgcccaaagtaatttatagattcagtgccatccccatcaagctaccaatgactttcttcacagaattggaaaaaactactttaaagttcatacggaaacaaaaaaagagcccgcattgccaagtcaatcctaagccaaaagaacaaagctggaggcatcatgctacctgacttcaaactatactacaaggctacagtaaccaaaacagcatggtactggtaccaagacagacatatagaccaatggaacagaacagagtcctcagaaataatgccgcatatctacaaccatctgatctttgacaaacctgacaaaaacaagcaatggggaaaggattccctatttaataaatggtgctgggaaaactggttagccatatgtagaaagctgaaactggatcccttccttacaccttatacaaaaattaattcaagatggattaaagacttaaatgttagacctaaaaccataaaaaccctaaaagaaaacctaggcaataccattcaggacataggcatgggcaagtacttcatgtctaaaacaccaaaagcaatggcaacaaaagccaaaattgacaaacgggatctaattaaactaaagagcttctgcacagcaaaagaaactaccatcagagtgaacaggcaacctacagaattggaggaaatttttgtaatctactcatctgacaaaaggctaatatccagaatctataatgaactccaacaaatttacaagaaaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacattggttagaatggccatcattaaaaagtcaggaaacaacaggtgctggagaggatgtggagaaacaggaacacttttacactgttggtgggactgtaaactagttcaatcattgtggaagtcagtgtggcgattcctcagggatccagaactagaaatactatttgacccagcaattccattactgggtatatacccgaaggattataaatcatgctgctattaagacacatgcacatgtatgtttattggggcactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctcagcaaactatcgcaaggacaaaaaaccaaacgctgcatgttctcactcataggtgcgaattgaacaatgagaacatatggacacaggaaggggaacatcacacactggggcctgttttggggaggagggaggggggaggaatagcattttgagatatacctaatgttaaatgacgtgttactggatgcagcacaccaacatggcacatgtatacatatgtaactaacctgcacgttgtgcacatgtaccctgaaacttaaataaaaaaaaaaaaaaaaaaagaaaatcagaccagcaggaaggccacagagcaacttttcctcacgcacaggaatgtgctttagttctactcacagtggtctgatgacaaagtcctctttaataacttataatttggaattgtaagacattggacccaacacaaccaatgtaaaaacaaaccactcatgatcttcctgggaaaatggaggtgcatttatataggaacagtcttctgtggatggttttctgagcagcttagcaaagaattgattaaataacagcatatgcgttgttaaattccctattacaatgctttcaaaattctttgaaagaaaaagatgctcacctgttaaaaaaaaacgtaagtttctaaaggagacacttgaaaaccagaaaggagcatcaccttcttaaaaaaaaatcaaaatggcacagcagaagttcacataaaatgcccgacaatgtttcttttcaatagaactcaagctgactaaaagacatgcttggattcagagcttttactggttacctaggttgcaaatgataccaaaagagacactaggaattcttagttagaatgccagtcaaggaaaagttcataatcctttcagattttaaatcctgtgtgtctgtgaggaggataaccatttagtattttagacaactggaaaagaagattagaccacactgtgtctataaagttgtgctacaccctgggttaccctcatcaaaggctgaaggaaatggctgttattctctttttgaaactgtagttatatggtgactgctggttatttagttagaatggaaaactgatacacagagaagcataccaaccgtatctaatgtattagcctgatattaacaactagcatctgattacttacaattgaccgtatttgaaatctattaaaatctcttaattattcttatatgcccatagtcactgctttctcttaaggcaacatgaaatgcttaatgattaatataacaatttcaaaagctttattgtacagactggactagactctgtagtcttcacagagtgatcattacttaatgaactcagcacactgtacattttccagccacctgaaactcccaagtattgtgtgagtttttggccaattaattatcaattacaacatcataaaacattagcacaaaaataggaataatgaaatttaattatacattattcttctgagttgctgaaaataatatacaagactgattctgattaataattcattcagcaataaagtatcaggaaagataattatgcagtgccacaattctcacactgatttctataattacagattacaacagtgttagcaatttaaaaggttagagagctgtggtaatttgctatgtcatcctcagctatattaatgtctctctttgagcaccaaagataactgaaaatataataatggaccaaatcagatggcttgcccatgctctcctcacctaaaacatctccaatctgagaacattagtaaagtccttgataattagcctcttatattatttaactagtcctactacacacatttggtttacagctaatcaaagaaagacaatatgtaggaatacatgccaaaatatgcaaacatagaaacataacctatagaaaagttacagggatacaatcacatttggtatgtgacatatctgaccatgaatacacatatatgtatacctgtataattaccccttagataattaaacaccaagtcaagggacacacataatgtaaatctctgtctctggcaacacagttgagtaaatagcacatgaaaaaatacaaagtttatctaactaccctctctgggttgttaacatattatgacacaccaaactactcttgcctttaagttctattacatcctgagaatgaaaatacactcagctgctagaaatactcactctgctctgcttgcattccatgggaaaaaacctagctagaaatttatggcctcttcccataaccagtatttaaatgagaattttcacctggggatgagcccaagtgaactaaacatacagttccacagatataaaaatcactttctcctctgctctttcttctcgctatttttagagaggagatttgtaagacatcttggctttactctcttgaatgccttaagtatctgactaacttcatgttcaactaatatggagaaacagatggaaaattcaccgggactaaaatcttaggcattatttaaatgagttccttgcagagtcttttgtgtgtcttgttgggaccgggggttcctcattctggagtatgccagggtttgaattcaagatttcattacagctggccccaacaagatgataaaggaagacagggtgaaaaaacagtttcatttcagtggtagaaagaacttgtagatcatctgattgaatatgctcttttaaaaattatagacgtttaggctcaaagatattaaacaatttactcaaggtcgcagaaccatttagtaacaataacagaagaaaaactcaagcatgtctgaatcccaggtttccactatattttattaaagaaaatacccaaggagaaggggcatgatgagcagcatatggagacaatttttgttctaaaattaagcccatttacttacatttcatttctacgaaggggttatgtgtaagattgggggtgggtagaggaagaaccattctaagagaacaccatagaactgtagctcttcatgtatttccttaagtgaaaataaaatgggtttcctttgagtcacaaaaataattctaaaacagggcattgcttctcatcagctttttttttctgggctacatgcaggcagttggcacaagatcatatggtaggacaccacactagatataaattcccttcaccttttttcacctacttccttttattcccagcagggcagtaaaacaggctccctgcatatccctgcaaatttgctcttggattcagaagtagacccctagcaggtgatattgttcccttgttaaagtagcagacattcaagcttgtaacaggggataaaaatggcaagtggactttggtcccacatttgcaaggtcctgtatcattttgtactttgaattttttctaacatattatgaacaatttcaaatttacagaaacatttaaagaattttacagtgaacacctacatacccatcacttagattccacgattaacattttattatgcttatttcattacacatccatccatctatatccatcagatttttttcaaagcatatcaaagtaaactgcagaaatcagcacactttcccctaaacatttcagcaggatattacttgctagagtttaagattagtttatagtttttttcttttgaggcaaaatttacatacaatgaaatgtacaaatcttaagtgtgtattcattgagttttgacaaatacatatacccatgtaaaccaaatcttatcaatctatagactataaccatcaccccagaaagatcccttatactccatcccagtcattcccctcctccaaaggcaatcagtgctccagtttgtctaacagactaattgtctgccctaaaacagttgaattttgaaactttaagtagctaagtgttctgtttttcttctttcagtcaacacaaactgagcacctaaaacgagacacacacttaaagccagtaacaacaaaataattattccattaaattaggaaaataccttccatggtggtgagaaccatgggattcattatacttcaagggcaatttagatgcacaaccaaaagggaagacacataccacaccctgcggctgttactcatttggaaacttgctgactcttcaatagtaaattaaaatccatacccatgcccagtgaaaaatggggctatgcaggatccttggattaagtgtgaaaaatgaggaggctttttaaaaaagcccatcttcaaaccaatatcatcgctttatgatgaagatgaactgttataacatgccaagcctgtaacctacaaagacacagccccgagttttacacaactataaaatcatgaaggaggctagtaaaggagccaaaaggctcttcatttattttctttaaacttaactacagtagtcagtgtggattaggccctcattttccagcagctgaattattgtcaaggtgctaacactcttggtggaaacagcattggattacctacctctttctgcaagagctcaacagcacgcttcacatatcagtcactaaaactgcattaaaaggctctcctacagcaactctgatactcttttaaaagttcattaacccctgttgtggattgaatcacaatattctccctccctccaaaagaaatgttgaagccctaacctcctgtagctcagaatgtggccttatttggaaataatatcattgcagatgtaattagttaagatggggtcatactggagtagggtaggcctctcatccaatatcatgggtgtccttttaaaatgaactccatatggagacagagacacagggagaacaacaccatgtgaagatggaggcagaggtgagagtgatgtggctacaagccaaggaatgccaaagatgaatggtcagcaccagaagctaggaagaaggaaggaagagttcttccctataggtttcagagggagcatgaccctgccaacatcctgattttggacttctaacctctagaactgtgaggcaatacatttctgttgtaaggcatccagtttgtggtactttgttatggaagccttaggaaactagaacaaccttaaagaagattttcccctttttggtaattgttttaaacaaaagtgtaatttacatgcagaaaagtataccaaccataagggcacaatcaatgattttctttcaagtagacgcattcatgtaaccaccacccaaatgaagactattatcagcaccccagaattctccttcatgccccatcccagttgttatttccaccaacagaactgctaattctaacttccttcaccttagttttctctttttgaactttaaagaaataatatataattttttgtgtgtctggcttcttgtgctcaacattatgtttgtgaggttcatccatgttgttgtgtataagagtggtttcttctaaagatggtttgaaaaatatcattaagtttttcttttgttttgctttggttggttcaaatttcctaaaatgaataaaatggtaaatactgaaattctccaaaaatctcccaatcccagcttcccagccatccagttccattttctagaggccacgagtgtctcttgtgtatccttccagagagaactgatgcctatttaagcaaagatatatatatttatagatagatctttgtccttttttttacacagaagtttacatatggcccgggcatggtggctcacacttgtaatcccagcactttgggaggctgaggtgggtggatcatgaggtcaggagttcaagaccagcctggccgacatggtgaaaccctgtctctctactaaaaatacaaaaaattagctgggtgtggtggtggacacttgtaatcccagctactcaggaggctgaggcaagagaatcacttgaacccaggagggagaggttgcagtgagctgagattgcaccactgcaccccagcctgggaaacaagagtgaaactccgtctccaaaaaaaaaaaaaaaagtttacatactaagccatgatctgcaccctgctttcacttaaaaatatagtttcttcattcttgttttatggtttcataatacttgactagaaggtcatagtacaatttatataaccaattctctattggcagctatccgggttgtagtcagtatgtgttattataaacaaggttgtaacgtgtaatcttgtaattttgtacacatatccatacattctcctaaatgtgaaattactggatcaaaggatataaactttgtagttttgatactgccaaattgtcctccattgggacagtaccaatttatactcctgccagcaatgtacaagagtacttttttttttgagatggagtctcactgtgtcgcccaggctggaatgcagaggcgcgatcttggctcagtgcaatgtccgcgtcccaggttcaagcgattctccagcctcagcctcctgagtagtcgggaccacaggtgcgtgctaccacggccggctaattttttgtattttcagtagagacggggtttcatcgtgttagccaggatggtctctatctcctgacctcgtgatctgctcgcctcggcctcccaaaatgctgggattacaggcataagccactgcgcctggccaagagtacttctttatccatagtcttgctaatagattatattaccaaacttaaaaacaaaacaaaacaaaaaacccctgcctgtttggcaagtaaaaaacagcgtttaattatagttttaatttgcattaatttttaataaatgacactgatatatttcatgtttatgaacagctatttatatttccacatctgtaaattgttaatagtcttactattcttttaatttttttcccctattgcattgttggtctttttctgccttggagaagctctttaaatattagggaaatcagttctatctctagatgagttgcaaaaatatttttccttctttgtcacttttttttttttttggccgtggtttatggtggtatttgctgctcagaaatttttgatttttgtgtcattgaattcattttatgactttccctttgtggtttctggatttttgtcatactttgaaaggccttcccaacttataaacaattttctcctgaatccttttagaacttttacggttaaatttttttcccaagtaagttttggaaccatttaggatttatcttggtgtaaatatgaaccaccaaactttctttttcccagaaggctatttaattgtcccagcaccatttattgaacatccttttttatcacactgatttgagatgcttccttaatgtaaactaaaatttcaaatgtatttgagattatttctggactctataaggtgccactgacttgcccattaatgccaattcaaatatatgagtacgtttgtagtatattttaatatctaaagagcaattttctctctttttattcttggctatttttgattttttttttttacatgaacttcagcatcagcttgtttggttacaaaatattctgttggtatttttactgcattcacattaaatttgtgatgttgaggttttctgtccaaggacatggattgtctttccatttattcacatctttgttttttctcttcatctcaggaggattttaaaacagtttcatttatttacaagaataaagatttacatcttaaggagttcttgagttcaattcctatatttatacacattacatatatatatatacacatgtgtatatattttatttgaacttttcttttttgctattgtaaataggatattaacttccattatatcttctaatcagctgttgatcacatatatgaagaatgtttagttttacataatccattagtacataatgggttgttattgttaccaccatcttccagctgattcacagaagaaagcatactatccaagtgtgcaatcatatcatctgcaaataacaaacattagtttaacctcgtccttttgactttttacacttctactttctttctcttgtactgcacaggctaagtacgttcagaacaatgttaaagaaataacaatgggcgcccttgtcttcattgtttctgacatggcttctggtgtttccctattactgggtatattcctttgggcatacacccagtaatgggactgctgggccaaatggtagctaatttgactctgcaatcccataaacactacatctactaaagcgtgatgctaattttataataaataatatatataataataattttatgttaaggaggtatccatcacttctgattttataaagtggtttttaatgaaaatagatgttgaattacatcaatgcctttgcagcatctatgaacatgatcaaataagtgttccttaaagatctattaatatgataaattatattaaaagatttttccaatatttatcactcctggaatgaacctcatttggttatggtacactgttctttcaaaatggtgctaggctctgtttgctaatattttatttagaattttacaattgtgttcttctatggtggttggtctgatggattatcctgctctttagaagtcagtgactaaattatattttcttagacaattatggatttttaaatttatctgtaaaaagttgagtaaaacaggctttatgattcctttgtaatcttttatttaccttatttttattatttcctctattttattaatcaagtcagctaaagtttccttgattgtgttgaggttttcaaacaacatgcttttgcatttattaattcttcaatttttcagtttttgaattcaggattttttgatatacttttatttccttcctgctatattttaagtttgttttattattcttttctaacgttttgagttagacacttaattcatttatttctatttttcttatttgccaaaataaatattttaggccacggcttctcttctgaccactgctttaagctgcagctcctggattctgctaaaaacacactgacacactgacacagatacttacctaaacattgcatataaataaactatgggaaactgatcatttaaaaagatgttagaaaagaccactaaaggaacccagcagtaagtctgttgtagggtgaagaataattctttttatttttatttttttgagacagggtcttgctctgtcacccaggctggagtgcagtggcgcaatcatgggtcactgcaacctccgccttttgggctcaagcagttctccctcctcagcttcccgaatagctgggactatgggtacgggacactgcactcagctagttttttgtattttttttttttggtagagacagggtttggccatgttgcccaggctggtattgactgaactcctgggctcatccactcacctcggcctcccaaagtgctggaattacaggcacgaccactgtgcccagccaagaataatccttttgctgccattcatggtgtattgaccaggtgcaccaggcacagtgtgggctactgtgagaataaacatgaaggggtctctgtctttccatcagtaaggaaaccacacatgagcacataaaaacacatactcacatatacaatatcacagaaacataaggacaagtcatacaaaccataaagagatacaaactttcacataaaataatttcccttcttctgctcaaaacatacatacctataatctttaataggcattcatttaatttatactgacctaagttgctcttccaacttaaaagcagttcacaataacaatatttgtttttgcatagaatatgggtcagaagagatgtagaaaggcttgttgggtagctcttgtaacagtctaggtgagtgatgatgatggcttggactagtgaggaagcataagagtggcaaccacggcctgatttggcatgaatttcaaaggtacagagaggtacagttgataggatttgctaatggactggatgtggggtgagagagaatgaaaagagttaagggtaactttgagaatttcagcttctgcaattacatgaatgagggtgtcatttactgtaagggaaaactccaggggaggatcatgtttgggggctggggttgaaataaattgttgcttcctggtagttcatctatccaagctcactgttatggtttgaatgtgtcccccaaaagttcatgtgttggcaacttaatccttgcgacagcagtgttgagaggtgggacctttaggaggtgattgggtcatgagggttctgtcttcattaatggattaatgagggagtgagtctgttataacaggagtgggtctttataaaagccattttggccatgtctcataacctccctcaccatgtgatgccagcctccagaactggaagaaaataccttacctttccttttcctcttccccctttcctttcctttcttcccttcctctctccctccctcccttcctccctcccttcctctctctcctccctcactccctttctttcttttcaaattactcagtttcagatattaacttacagcaacagaaaacaaactaagacactcatctcattcacctctcccataagttggttatattcaagtgtcactgacctttgtcctatcacagctccatgctgttgcatgttccgtttccacccaaagtgtcctgcctactcttctctgtctggcaaacacctgctcatccttcaagaataatctcaaatgtcagctcctttggttacctttctgactcctgcaggcacagttgggagattcatgctggagctttccagcctcccagccatctcagtctcacaaaattgcttatgtgtctgtctctgtcacctggttaagttccccaaggacagaagtcatgcttttttcttcttttttccctggagcacaatgcctgaaacaaagatggctactcaataagtgttttcattcattccatcaatattgatggagtgtctaccatgtataacacatgatgccatgtactgttctaggtacctgaggatatagcaatgaacaaagcaaagttgtgcttgtcatggagccttcattccattggagaaaagggcaatatacacacaaacgaatgaatctacaataatgtgctgtagaggaaaaaaataaggcagggcaagagcagtgaaggatgtgggcggtgaggtcctgttttaaatactgcagtcgtggaagatctcatttaggcagattctaaatgaagtgagggagtaaaccatgcagatatctgggaaaagagccttcctggcagaaataaacagctggttcaatggccctacagcaggagtaggcttgatgctctgatgactcaaaaggccagagtgcatggaggatagtggccagcgaaagctgcagaggtagtcaggaagtgaagggcatgcagttcgaggtaggagtttgggttttactctaagtgttatgagaagccagagtaggcaagtgataggatctgatttacactttaaaagattcctttggcttccatatggaaaatgggttgctgtagggtcagactggaagcaagaaagcatgttaggaggctcctgcagcagtcctggtaagcatgatgatggactgaactatggaaggagcagaaaagtggtgacaaagtgcctggatttgacaggtggagctgacgggatttgctagtggattggatgtggggtgagagaacggaaagagttaacgatggcaccaaggatttcagcttaagtgaccagatgaatgggggtgtcatttattgaaagaggaaaccccagaggaggatcaggtatgggggatgagggcagaacaagtgttggttttggatatgacaactttgaggagttgattagacagccctgtggaggtaagcaactgaacacagcctgattctagagagataaatttgggagccattagtatgcagatggtatttaaaagccacaagactggatgagatcaccagggagtaagcttatgtgggctgaatgaatgaataagcaagtttatgctcaggaaggaaactgttatcaggttgataacatctgactctacagagactggacaaatagataataaacacagggatgaaagggcacagaattaatttttttccatgtctagatggctaatccagacttttcccttacatgcgcagaaaagcctgcatcctaaattattgaggacaaagcagaccgcatgactctgtggagcagtttccactgcttggcttgtgtgcaaggtgtgtcagcctacttcaggcgtcttggtaactaagcacttttctgggtgagcatcttatcacagcatgttgtgcaggctggaacccatgagagtgagtccttcaggaaagaaacgacatcaacagatgtacacaacacgtttcaaattaataaaggtggggggaagatcacaaatacaacatctgtaacactgtacgtgcaacttgtcatctctattgaagaaacaggcaggtaagcttccacaactaagataaaataatctttgccgtaagtccgagataagttgcattgaatttggggtagttaagctgtatttctcaaaagtcaaaaccaagtcagtgggttcaccaaattcttttggttacttcaaatatcatattaccaataccaaaaacttctcaggcccacaggactctcatcccatgtaaaaacactaaaaggatggtgatgcaagaggtatcccactgtgaaaaattccttttgcatactttctaaaattaatatttctttccaagtacacagggttttgtctgccacttattttgctttttaatcatgaggcactaaaagttggcacatttttaaaggtgccagcttccatggacttttaaaatttccattcattcccatagtcttacaggcttctctcccctaaaaaccatgaggactctgttcatatctgctcccctgctccactatgatcaaagatattcctctgtatctctgtgtaatactcaaaacaggaaataaagaccccaaaatgaagcctcagtatctcatgtcttccccagtgtcccatccacgtctgaaagagtgaaagctctgttttagaatgactgctggctgccaatgagagctctggatacgttgacatggatgaacgaaaacacactcaaaaaagagcaaaattgtgtggaaacttggaaacatggaaagattcagtcatttaagcatctaagaaacatttagtatgtgtctaccacatgccagccactttgctaagtgctgggtcacaaacacaagcctctggagctcataatatagtggctaacgagacaaatgccatcaaggacagatgagactcttcccagcaatggcaatgcctaaactgaattctgaaggacaaaacagaaattatctaagggaaggcacagagggagaatcagttaatatttgtggatccctaactgcattctcccttgtaagcctggtactaggtatacaaagatgaatatggtacacctcctccccaaaagaagacaaaagacatagtagctattttgaaatttcaaaggagctagccagaagcagcatccgatttttctgggtgaacctgtgggtgatatcaatatggaaggtactaaggcaggagcacactggagagttgattccatgggctctttcagatgttttttccacagacctatagagacgcttttgtaaacaagttcaagtttacgagcattcaaaaatgaatgcatcagagctactagaatttggtgacttttttttttttaacactgtaattacaagaataaagggaaggatgaagctaaaccatattcttatgcccaagcaactcattaacagaggccaagcccaggccaattgcccatgtaatttctttctttctttctttctttttttgagacagagattcactactgtcacccaggctggagtgcaatggcatgatcttggctcactgcaacctctgcctccgggttcaagcgattctcctgcctcagcctcctgagtagctgggattacaggcatctgccattacgcaggctaatttttgtatttttaggggtttcaccatgttggccaggctggtctcgaactcctgacttcaggtgatctgcccgccttggcctcccaaagtgctgggattacaggcgtgagccactgtgcctgtcctgcccatgttatttctacaaacctttatcctcttggtgctttcaggaagttatcagggatggggggcagaggtggcaggggcctataatgtaactgttctgtgctgtacagccaggttcctttccggttgctggtgagaatccaatgtcagctagagttatactggcacgtccatggtcctggaaaggccttggaaaggctgaggcaggcaaatgcttctccacagatgccctaccccacctcgttcattctcttggatgtcagtgctcttctgctaacagaacctatacttcatgccccatttccccgaatcacttctttcctctactcatacagtatccttgatgaagctgagcaccttcgagtgtccgcagtttttgaaagccgtggctgtcttataataacccatcctgacgttcctaggagtatttatattctgagggtgagttaagttagtggataattgtggtaaagaaaggccttgtcagtgcctcctgtagagtcacaccatcaaaccctggggtatgctggggcctgagttctctccagcaaaccccaaaaccagaacttgggttggcactccactttattttccaagttatggatctcagggctggcaaacacaatcctagacaattgattctcaaaggtctcaaatcatctggtgtctaaagggctaatctaggggctcccctgaaagtctcttggtaaatctctccttaaagatttcaaataaaacctgaagcaaacagagcacctgtctagatgataagaggcctgattcatattccattctattgctgacttgtgacacctagaaattcagtcgtagcttttctgtggcatattctatgaagtgagggtataataaccgagattagtttcaggtctaggtctttctattttttttttatttatatatttagagacaggttctcactctgttgcacagactggtgtgcagtggtgtgatcatagctcactgcagccttgaattcctgggctcaaggaatcctcttgcctcagccacctgagttgctagaactacaggtgtgcataaccatgtgcagctaatttttgtgtttttcgtagagacagggtctcactatattgcccaggctggtcttgaactcctggcctcaagcaatcctcctgccttggtatcccttgggcctaagccttcatgctgccatggcatgtcatcagacatggtatttcacgcttgtttcaaccaggaaccagggcaaaggaaaggtctttggtgtcaatgcaatacaaaactttatgttaatttgccattgtggcagttcctaggaaagatcctaagaacttctgggcaaaaggctgaagaaatataatggtttcttgggaattgagggttgaggtaaacatttctaaaatgtgcaaaaaagttaattttgaaaatctgctgctcatttgttataacttcagagtttcaattttaattattttaaaaattccctctaacaagcacactttctgaatgactactgcctcatcatttggcagccaactcttgaaaccttggcactctgagcaataattatgagtatgtcttaatgtgtatccattgagttactgcttgcctgggaagaagctgaaggatgtaagttaaatttttggctctaacactcactagctctttagatttgtaacagctcttgttgaccttcagatactttttctgtaaaaaggggtaaacagaacccaacttgcagggttctagtgaggattgtgttaatgtaagcaaaatggggaactcaaaagttccttttgttgttatacagagaatccagagtaagcaaaaaatagctagttgcagctatgaggccatctgatgagaaatgatgaaaaaccaactccatatgcaccatctcaatctgatccaatcattccataaacttttattgagtgctcagatgccaagttattattttaagttttgtagacagttactatattgaacaggacagacaaagtccctacattcttaggtcttatattctagctgggaaaaacagacaataaatgtatgtaagtaaacaataaactactaagtagtgataagtgttataaaaacaaaatagggtgctatgataggaagtcactgggtgactacggatgacagacctctctgaggtcatgacatttaaactgagatctcaatgacgcgaagaagagagccacaggagggtctctggcaatgaatctctgtgtggtctgtggaacccctgggaatcccgagaccctttcagaatgccagtgaagtcaattttattttcatggtcatactaagatgctgtatgtctttttcacagtgttgacatgagcactgctggtgcaaacgtaatggtgggtaaaactgctggcatctcagcatgaaacaaagcagtggcaccaaactatcagttcttcactaccatatactcaccatagaacagggtgacagtttcacttataaagggacttgatcaagcagtaaaaattattatttgtactaaatctcaacacataacattttaacactctgtgtgacaaaatgagatgtgctcataaagtacttttgctgcaaaccaaagtaagattgtcatcccaaggaaaagcatttgtgggattcagcggcaagctgcacaagtaactgttttcagagaacaccatttttacttgaaagaatgactgacaaactaaggttactcagacttgggcatttgggagacattttcttgaaattgaacaaggtgagtgagctgtcacttcaaggaaaacaactgacagtatttgttgccactgataaaatctaagctttcaaataaaaacgtgatttttggaaaatgtgtatttcctactgtaagcttggcagcttccccaaatttgagaggcttttctgttaagaatgataataacattaataggtgattttttttgaacattaaaatagtgtcatcattttgaagatctgtgtaagctgataaagcaacatgttccaatcatacaaaatcatacttggtaaaagatttgatgtgcaaggcagagtaatgaattttaatataatggagtttgaaaagttcattgatatggctttagattccatattgcaactaacttttaagaagttaccacttgtcaaattttaacgtaatatcgaagaagaacacccacaatatttgaaaaacctattaactctatccttgtccaaatacacatctgtgaggctgaattttttcatataatgaaacaaaaatgacatatcacaagattgaacactaaaagagatattagaatctaaatgtcttctagtatgctggacattaaaggtattggggaaaatacaaaacaatgcaattcttttcacttttatcttgaaaaatatagttttttcataaagatatgttattcatgttaacatgtagtgagcttattactgtgattttaaaattaactaatagatactttaaatgttcagttttaatttctaataaggtaaatatagataaaacccaaataaacgaaagctctttggggttctcggtaatttttttttttttgagatggaatcttgctctgtcgcccagcctggagtgcaatggcgcgatctcggttcactgcaacctccatctcctgggttcaagcgattctctcctgcttcagcctcccaagtagttgggattacaggtgcctactaccatgcccagctaatttttgtagttttagtagagatggggtttcaccatgttggccaggctggtcttgaactcctgacctcaggtgatccatccacctcagcctcccaaagtgctgggattacaggcttttacaggctggtaatttttaagagtataaagggattctgaaaccaaaattttgagaacaattgacctgagcatattaaacaatacaattttagtttatttaggtcttgcataagttctgttagatttgttctgaggtacttaaatttttgttattatcattaataactttttaaacattacttttctgtgttactggtatataaggcaattaatttttattgatatatattgtatattgatcttatatccagtcactgtgctaaactttctcactggacttactcttttacatcagtcttactgttagtacaggactggcaaattatgatcctgtagactagatacagtctaccatgtttttaaaacaacaatttataggaacagagctctatccacccatttacgtattatctatagctgcttttgcactacagtggcagagttgagtagtagtgagagagactatggcccacaaagtcaaaaatatttactatatgcctttttacaaaaaaagtttaccaaaccctgtattatgaactccattcacagaaccaacttttggctctgttgataccctacatagtatttacaatttcaatttaattaattctgttctcatctttattcatccttcctttctcattcgtctttttttttaccttctcaaagttagcttcttaattttcactttttccttttctagtaacaaacctgcacgttcagcacatgtatcccagaacttaaaataaaaaataaaaataagaaaaacacttgagactataaattttcctccaagtacaacttttactgtatcccacaagttgatatatcatattttcattatcattcaattctaagtattttaaattttccattattacatctttgatcaatgaattattttaaaatgttaaaaaatttccacatataaggggaattttggggagtttatgttttagttaccgaattctaattaaattgtattatgatcagataatgtggtcattatactgattcttggaaatctgttgagacttgttttaggggcatagtatgagggcaagttttgtaattcttccatatgaagaacacatatattctatttgtttgatgcaagattctatgaatcaaactattcagttgtactgcttcaatgttatatttctttactaattatttgttatgtgcttgaccaagcaatatcttggagaaacatgaaatttctctatagttttattagtttttgttttacatgttttgatgcaatatagaaatgttatacctttccagtgaattaaaaccttatcaataggtagtgctctctctatcctgatttttttttgccttaaagtcttttatctatctatctatctatttatttttgagacagggtctttctctgttacccaggctggagttcagtggcatgatcttggctcactgcaacctccgtctcctgggttcaagcgattctcatgcctcagcctcccgagcagttgggattacaggtgcaggccagcatgcctggctaatttttcatatttttagtagagacagggtttcgccatgttggccaggctggtcttgaactcctggcctcaagtgatctgcctgcctcagtctcccaaagtgctggggttacaggcatgagccaccacacccagcccttaaagtctattttgactgatatcaacaaagctacatagctcctttttgattggtatttgctcgaatacgaattgttaaatgtgtatttctctaaacactgtatagctgaattggtattatattttttaaaaaatcttaatgtttactctattttttagccagaaagtttaggcaatttacatatattgtgattgctgatatatctgcatttgtttttataatattattttctatttgtcctactttcctatgctttatgtattttttctttcttttttgatttttaaaaatcaggcttagaagttatacactagttcttttcttttagcagttacccttgaaatccaaagttagtagtttaaccccttcagaacaacaaaaggaacttataatgcaaactctgattatctccttcctcatatatagggagttttacacagtattttaaaccagcaatatttgtttagatttgcctacatgtttaccaatttctttgcttacaatttctatttttcagaccttttgctatctcttttcttctttctgaagtatacgctttttttttcttttatttagagacagggttgtactttgtcatccaagctggagtacagtggtgtgatcaaggctcactgcagtcttcaactcctgtgctctagtgattctcccgcctcagcctcctgagtagctaggactacaggtatacaccacccatttggctaatttatttatttatttttgtagagctagggtctcactgtattgtgcagactggtcttgaactggcctcaagcaatcttcctggcttgacctcccaaaatgctgggattacaggtgtgtgtcaccatacccagcctgaagtatattctttcaagttccttcagtgtaagtctgctggtggtaaactcccttaggttttgtacgtctgaagaaaatacttcactctcattttgaaggttatttttgctgaaaacacaattttaagtcgaaaatcattttctctcagaactttgaaaatatttcatcatctcctggatttagtcattgctgttgagaagtctgctgtcagtctaagtattgttcctctgtggatgtggtctgttttccctatggctccttttaagagagctgtcttcagtgattcacagttttactacggtataaaaagttgtgaaggcctttttatttgtctgtttagatacactgcttcctatatctctggatcagtatttctcattgaaaaattctggaatgccggtggggaggagccaagatggccgaataggaacagctccggtctacagctcccagcgtgagcgatgcagaagatgggtgatttctgcatttccaactgaggtaccgggttcatctcactggggagtgccagatagtaggtgcaggacagtgggtgcagcgcaccgtgcacgagccaaagcagggggaggcatcgcctcactcgggaagtgcaaggggtcagggaattcccttttgtagtcaaagaaagcggtgacagacggcacctggaaaatcaggtcacttccaccctaatactgcgcttttcaaatgggcttaaaaaatggcacaccaggagattatatcccgcacgtggctcagagggtcctacgcccatggagtctcactcaccgctagcacagcagtctgagatcaaactgcaaggcggcagcgaggctgggggaggggcgcccaccactgccaagttagttgtttgattaggtaaacaaagcggcagggaagctcgaactgggtggagcccaccacagctcaaggaggcctgcctgcctctgtaggctccacctctgggggcagggcacagacaaacaaaaagacagcagtaacctctgcagacttaaatgtccctctctgacagctttgaagagagtagtggttctcccagcacacagcttgagatctgagaacgggcatactgcctccttaagtgggtccctgacccccgaggagcctaactgggaggcaccccccagtagaggcgggctgacacctcacacagccgggtactcctctgagacaaaacttccagaggaaccatcaggcagcagcatctgtggttcaccaatatctgctgttctgcagccaccgctgctgatacccaggcaaacaaggtctggagtggacctctagcaaactccaacagacctgcagctgagggtcctgtctgttagaaggaaaactaacaaacggaaaggacatccacaccaaaaacccatctgtaagtcaccatcattaaagaccaaaggtagataaaaccacaaagatgtgaaaaaaacagagcagaaaaactggaaactctaaaaatcagagtgcctctcctccttcaaaggaacacagctcctcaccagcaatggaacaaagctggatggagaatgactttgctgagttgagagaagaaggcttcagatgatcaaactactctgagctacaggaggagctttgaaccaatggcaaagaagttaaaagctttgaaaaaaaattagacgaacggataactagaataatcaatgcagagaagtccgtaaaggacccgatggagctgaaaaccaaggcacgagagctacatgtcgaatgcagaagcctcagtagccgattcgatcaactggaagaaagggtatcagtgatggaagacaaaatgaatgaaatgaagcaagaagagaagttcagagaaaaaagaataaaaagaaacgaacaaagccttcaagaaatatgggactatgtgaaaagaccaaatgtacatctgactggtatacctgaaagtgacggggagaatggaaccaagttggaaaacactctgcaggatattatccaggagaacttccccaatgtagcaaggcaggccaacattcagattcaggaaatacagagaacgccacaaagatactcctcgagaagagcaactccaagacacgtaattgtcaagattcaccaaagttgaaatgaaggaaaaaatgttaagggcagccagagagaaaggtcaggttacccacaaagggaagcccaacagactaacagctgatctctcggcagaaactctacaagccagaagagtggggaccaatattcaacattcttaaagaaagaattttcaacccagaatctcatatccagccaaactaagcttcataagtgaaggagaaataaaatactttacagacaagcaaatgctgagagattttgtcaccaccaggcctgccctaaaagagctcctgcaggaagcactaaacatggaaaggaacaactggtaccagccactgcaaaaacataccaaattgtaaagaccatcaaggctaggaagaaactgcatcaactaaccagcaaaagaaccagctaacatcataatgacaggatcaaattcacacataacaatattaactttaaatgtaaatgggctaaatgctccaattaaaagacacagactggcaaattggataaagagtcaagacctatcagtgtgctgtattcaggaaacccatctcacgtgcagagacacacataggctccaaataaagggatggaggaagatctaccaagcaaatggaaaacaaaaaaaggcaggggttgcaatcctagtctctgataaaacagactttaaacaaacaaagatcaaaagagacaaagaaggccattacataatggtaaagggatcaattcaacaagaagagctaactatcctaaatatatatgcacccaatacagcagcacccagattcataaagcaagtcctgagtgacctacaaagagacttagactcccacacaataataatgggagactttaacatcccactgtcaacatcagacagatcaacgagacagaaagttaacaaggatacccaggaattgaactcagctctgcaccaagcggacctaatagacatctacagaactctccaccccaaatcaacagaatatacattcttttcagcaccacaccacacctactccaaaattgaccacatagttggaagtaaagcactcctcagcaaatgtagaagaacagaaattataacaaactgtctctcagaccacagtgcaatcaaactagaaatcaggattaagaaactcactcaaaactgctcaactacatggaaactgaacaacctgctcctgaatgactactgggtaaataatgaaatgaaggcagaaataaagatgttctttgaaatcaacgaggacaaagacacaacataccagaatcgctgggacacattcaaagcagtgtgtagagggaaatttatagcactaaatgcccacaagagaaagcaggagagatctaaaattgacaccctaacgtcacaattaaaagaactagaaaagcaagagcaaacacattcaaaagctagcagaaggcaagaaataaccgagatcagagcagaactgaaggaaatagagacacaaaaaacccttcaaaaaatgaatgaatccaggagctggttttttgaaaagatcaacaacattgatagactgctagcaagactaatcaagaagaaaagagagaagaatcaaatagacgcaataaaaaatcataaaggggatatcaccaccaatcccacagaaatacaaactaccatcagagaatatgataaacacctctacgcaaataaactagaaaatctagaagaaacggataaattcctcgacacatacatcctcccaagactaaaccaggaacaagttgaatctctgaatagaccaataacaggagctgaaattgaggcaataatcaatagcttacgaaccaaaaaaagtccaggaaccaggtggattcacagccgaattctaccagaggtacaaagaggagctggtaccattccttctgaaactattccaatcaacagaaaaagagggaatcctccctaactcattttatgaggccagcatcatcctgacaccaaagcctggcagagacacaacaaaaaaagagaattttagaccaatatccttgatgaacattgatgcaaaaatcctcaagaaaatactggcaaactgaatccagcagcacatcaaaaagcttatccaccatgatcaagtgggcttcatccctgggatgcaaggctggttcaacatacacaaatcagtaaacgtaatccaacatataaacagaaccaaagacaaaaatcacgattatctcaatagatgcagaaaaggcctttgacaaaattcaacaatgcttcatgctaaaaactctcaataaattagggattgatgggacgtatctcaaaataataagagctatctatgacaaacccacagccaatatcatactgaatgggcaaaaactggaagcattccctttgaaaactggcacaagacagggatgcccgttctcaccactcctattcaacatagtgttggaagttctggccagggcaattaggcaggagaaggaaataaagggtattcaattaggaaaagaggaagtcaaattgtccctctttgcagatgacatgactgtatatctagaaaaccccactgtctcagcacaaaatctccttaagctgataagcaacttcagcaaagtctcaggatacaaaatcaatgtacaaaatccacaagcattcttatacaccaataacagacaaacagagagccaaatcatgagtgaactcccattcacaattgcttcaaagagaataaaatacctgggaatccaacttacaagggatatgaaggagctcttcaaggagaactacaaaccactgctcagtgaaataaaagaggatataaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttcaagttcatatggaaccaaaaaagagcccgcatcgccaagtcaatcctaagccaaaagaacaaagctggaggcatcacactagctgacttcaaactatactacaaggctacagtaaccaaaacagcatggtactggtaccaagacagacatatagatcaatggaacagaacagagtcctcagaaataatgccgcatatctacaactatctgatctttgacaaacctgacaaaaacaagaaatggggaaaggattccctatttaataaatggtgctgggaaaactggttagccatatgtagaaagctgaaactggatcccttccttacaccttatacaaaaattaattcaagatggattaaagacttaaatgttagacctaaaaccataaaaaccctagaagaaaacttaggcattaccattcaggacacaggcatgggcaaggacttcatgtctgaaacaccaaaagcaatggcaacaaaagacaaaattgacaaatgggatctaattaaactaaagagcttctgcacagcaaaagaaactaccatcagagtgaacaggcaacctacagaacgggagaaaagttttgcaagctactcatctgacaaagggctaatatccagaatctacaatgaactccaacaaatttacaagaaaaaaacaaacaaccccatcaacaagtgggcaaaggatatgaacagacacttctcaaaagaagacatttatgcagccaaaagacacacgaaaaaatgctcatcatcactggccatcagaggaatacaaatcaaaaccacaaggagataccatctcaaaccagttagaatggcgatcattaaaaagtcaggaaacaacaggtgctggagaggatgtggagaaataggaacacttttacactgttggtaggactgtaaactagttcaaccattgtggaagtcagtgtggtgattcctcagggatctaggactagaaataccatttgacccagccatcccattactgggtatatacccaaaggattataaatcatgctgctataaagacacatgcacacgtatgtttattgcagcactattcacaatagcaaagacttggtaccaacccaaatgtccaacaatgatagactggattaagaaaatgtggcacatatacaccatggaatactatgcagccataaaaaatgatgagttcatgtcctttgtagggacatggatcaagttggaaaccattattctcagcaaactatcacaaggacaaaaaaccaaacaccgcatgttctcactcataggtgggaatggaacaatgagaacacatggacacaggaaggggaacaacacacaccagggactgttgtggggtggggggaggggggagggatagcattaggagatatacctaatgctaaatgacgagttaatgggtgcagcacaccaacatggcacatgtatacgtatgtaacgaagctgcacgtcgtgcacatgtaccctaaaacttaaagtataataacagtaaaaaaaaaaacaaagaaaacaaacaaacaaaaaacacaaaagataaaactcttcacttaaaaaaaaagaaaaattctgagccacaatctctttaaacattgtctcatctccattctgcatatttttgttgcctttcacgctctaaataggctttagttaggcttgcttattctgccctccaaacttattaacctctcttccttatagttccatctctttgtctgtgctccattgcatgaaactattttagttttattttccagttcattaattagtccattacaaaaaagcttatccactaaattttttgataatttttttttattactgaaggttttctttagctctttttcagaagtgcctggtgattgtgagagaccattgttgttcaccattcaccatttttgtagtctatatttaagttaatttttctttatataaggtagtctagtttcttcttatctgatacttcaaacatctaaagcccttggtggggaaggagtaattaatatattaacgctagttttgctgattttcactcacggtggtttgtttccttgtttgataatcttttttgaaagctcaagatcccaatctgtgaaaaaaaactagaagcctaaattacatttgctttatctggaatttagtggtactaccaacctgggctattttatctcccttctagaatcccaggcttaaactgggagttgcagtacggtccccatttgcacccccacatgaccgtcacacacaaacacaagggatggccaattctgccttttctggcttgtttactgttgacatatatgcacttagctacttgtattttttttcttagatattttcattacttcctaggagttctaaaatgcaacagagatatcctttggagtacaaagtctgttatactggcagaagaagaggtcctctttaaaagtttttagaaagtaggagagtgacatctgattgttgcttttgaagagctttttctagattctctgtaagaatgaactgcagggaggcaggaatgaaagcagagccaggtaggaggctaatgtagtagttcaggtgagaaattgaagcaacatgtctgagagaagtagcagaggagacagaaagaggtgaaatgactcgatatctgattgggcataaaacaggaggagcttttgatagtttggatgtggaaggtgaggtacaggatccctggttgatggctggtggtgtcatttcatttattgagataagaataattgggagatggacagtttccagtgtttgtgtaggttagggcgtgggtagaaattaagagttctgttttgaatatgttaagtttgaaatgattatcaaacatccaagtggacatgtcaagtaccctgttgggtatctaagtctgatatttaggggagagagctgggctgaagatataaattggggagttgctgccataaaggtttgggagcagaggagataacaagtgagagtgcagagagaaaacatagggacagactgagcctcagggcacaccaattcagaaactaacagaggaggagacagcagtggtgattgagaaggaaaaaaaaatccacgagaggagctgtcatggaggctcagagaaaagtgggttccaggaagaagggagtgattgactgtgctggaagctattgagaagctgaggaagatgcggcaacaaggtggtcattggtagctttgatctgaacagttctggtgaagcagtggtgtcagagactttaatggagtgtgtcaaggataacaggagatgagtctagataatacctatagacaagaagttcgaagtgttttgtgtgaaagggagcagtaaagtggagtagaagctaaaggagaatgtgacacaagaagttttttcctggggcagtattaaagattttatatgccaatgggaaagatttagtacaaagggagaaactgatcatgcaggaaagaaagggaatattttcagggaaaatactcttcaaagattaagcacccacaagtctttaagaggtgacgtggaacatgtgtgtggcgtgagccatcatatgacctacaagacagaagggctaggacacctatattacataaggacttgggagctgagtaatctttatttgccaagttctcatgaggtctactccaccctagcttcaaatttacccatgtcacaacggctagtggtagaagctaaagaatatatctgataattatgatctgaaagttgtttgggtagttataaaagtaggtgattaactcaatatacagctaaagaggtcttagaggacttctagtttggtctcgtatccactttaggcaactgaatcctaaaggtcttagaatggacacctcactatcccttgggaattacttctaggatgctgtcacaatgccacgtatttagcacaaatagcaatttcctcttgttttgtgattaatggtcataggatacagctgaactgtaattttcttcacccaaagacctttatgtatttgaaattagaaattaactttactttttcttctctaagccaaacaacctctttctcttgattttcctttacagatcttatcttgtatcatttggctaatcttgcctctttcccttctctccaactgttttttttttttccctaaagtgtagtgaccagcaattgacaaactactcaaacaaagtctgaataatcctgagagcagtgtgggtatttcaacacgtctcctttagacagatgaaaggctgacctggctctgccaagacttgaacacattccagttcctgctgatctgagaagtctcttccacttgcgtttttcttcttttacctggcaatttgaataaaatgaaaatacaaccagatgtatagggaaaagagtttttagtgtacctattctttaaaatcagcttgagctttatgtaaaagtcaaaatgtgcacataccaattccttctaaaatgtaacaaatatctgaatataccaataaaatgttttgtctctcaactgcatattccacaaagtatttcttaaaatccaaaagcaagtattcagatgaggtaattaattaagtgaagtgttgggtttggaaagccttctactattttgaggctaatgatggttgagaaactcctatgggggtgtgtgtgtgacagagattctgcctgctaattacttcccaagaaaaatctaagcatccaacaatcattctaatttttcctaagaagcatgaaatatcacatcacattacattatgttatgccaagtaacaggatgttcttggggtaaacatgacaaaacaatacagctggaaaaaacaaattgaaaggccaaatgatgtgcatataattttgggtaggtagtgctataaaaagaaagaaaaaggtgcacactgataataagacttagaggtgacttacaggttttgatacccacaggtgattttaggaaggcagctttgttttaaccataagattaatgccataagctttggctcttttacttatatttgtttcactctgaacaagcattggagcccttttgaacttcaattttttcctctgtaaaatgggaatactactacccaccctacctctttcatatggctgttgtgagattctaatgcctggcatatttaggtgttttataaatgtctaattggataccgatagatatctgaactggatttaatattctgtatgtcacagattccagtctgtacattttttcatctaatgatatttcagaaataaggatatatcttatagttggtggcttatattttaattaactctttctttcttggtggtacataatatatttaaaccaatggcctcttagaaatatggcaaatgaaagagttgggaaatggcaaaagtgctatgcaaatatcagttatttattcataaaacgaaattttaccaaaagtctcccttatgcaaggcattcagaagaaaatgaaaatgaataagattgggtccttaatctccagaagagtgcaatgcacgaagtggatgactcaggataactcaaatgctaaacagaatgtgatatgtgccatttgagtagcattcacaacttggcaccttgtgaatgcagaagaggaaataactttcagtagggtcaaccaaggaagcagcatggagggggtggcacctggcctggccttgacagatgcgtagtatctcaacaggcacatatgggaaggggagataccctacgcagaaaggacaagtgaggcatggacataggatgcacagcaaatattctgaggaatatggtccagacaagaagcggtccagacaagaaggagcatggggaccatgatgggctgcttgctctaggatattagagatctgggctcaatttggtgaatgggttaggctcctgagcaaggagcagcctgatgaaagtggggcattaggagcctgtacagggggaccagttaagaagaggctggaagcaggggcatcctaaagcaggccttgtgcaggcttgaaaagtccagctaataagtgggtagtaggggtagacaggaaataacaaatggatggtagagccatagttaaacgctaaagatccttaatgagaatcctagagagaaagcccattccacaaatggatagaaaggatgcactgaattgatgtttgactgtgtgctccttgaggatgggaactgcatgctttgtacatcattgtatcccagcacctggtacatggtacttacacaataactatttaatatactcccttcctccaaaaattccatttatatttttaattcaattcagcaagcatgtacctatcacgtgcttgatgctggacactggggtcgggaagaatgggctgatgtggtggactgtttttcaaatggctgcaagaattccttccttacagagtcttgggtggtccctccaaagctgactcggggcttagccataggacttgcttttaccaaaggcataacagaaaacgtaaggtaagcagaaacttggagaaaaaaaaaaaagcctatacattgataaactaacgagttccagtctggacaggttgaatatgaaatccttgaggcatgtccagcaggcagtttggtgtaaagcagtaggtcctgctgccaccccaccccctgccgcccccactttttttttttttttttttttttttttttacccctgagggcatcatataaagaattccaggctagcctcctggaggatgagagaacatgtggaacagagatgagtcatcccaggggaggcctccccagaccaaccatcctagaatggggggtaacaacctttttcttaaaggaccagcaggaaatactttaggcctgtgggccatatgatcatctccattccaaatactcagctctgctgttgtagtgcagaagcagccatagacgatatgggagtggctgtgttccaataaaaccctatttataaaaacaggtggcaggcctgtgggctatggttcgcctacctctatcccagattattcagccccagtcgagccagtccaaactagaagaactgcccagccaactcacagaatcgtgagaaatagtaaatgcttgttgttttaagccactaaatttggaagtgttgttacacagctaatgctaactgatgaaaatggtataaaacacataaagcatacaccctgtttcaaggcacttaaaatccacctgtggaagcacgacacgtgtgggaaacatttaaataaccatagaaggcagtatgtgactaaatgtcaaaatgaatgatgcaggagaattagaattataaggatttataaaagggaaaaatcagtttggacacacaaaaaacttgggcagcatttcataaagaatgggtagaatatgacagttccctaaagattcctgtttccttttcactgcccttctttatgctgcctacttttatgtctatgtaccccagcagactgggagcctcctgagggaaggtcttattttctattttctaggttcccagagtccagtgcagtgcttggttcacagccaggctcagtatgtacttactgaagaaaccaataagtccacaggtggagaggagaaagagcatctatgtggaaaaaccaaacctcatgatcaaagaacactgcacaggaattcacgtggtgcattcaagagaggtgaccagtggctcagggagaagaatgagattggggtaagtagaagctatagctggccatgtgactctgggtcatggggtgggggtgatgaggcaaaatgaaggacactgactttcagggatttgaagctatatgttactggaatatgtgacctagctgacatttatgaagataagtttggtggcagacggtagggtggattccaggcaaggagaatagttaggacaatttactaatccaggaacgagggagcaactagcctgggagatggtgggaatatcaaggtgtcagctcctgataaacaccaaatagagctgatcatgtgcttcagcataaactacaaaagaaaagagagacatctcaggcattccttcatgccacctttactgagtacaaggtattattaagtcatgtgttctgagcccatgaagacactaagtagatctatgttacatttggaaccaagatacataaggtcaaggccaccactatactcatggagaagcacaagacaaccaggaattgtgagtgaggcaactgctagaatgggcagggcacaaggtttgcagtgacacacacagccttagagccgggctccattcttattagctgtgcgatgttggacagaccatgaacaccactgatgatggtattcatcttgcaggctggttgagaattatagaaaggatgggtgacgtgcatagcacagtccctgaatagagcaggcactcgtatgattcacaattacaataaaagcaacatgtaatagggaacacatgaatggtataatctgagtgctgtaatagggcagagaaagaaaaatcacttttggctgggacagtcactttggatttgagagtgagaatagcatgtggtctggtggcaaaaaatgaggacgattttgacaagtaggggaaggggaaggtcgttccaggaaaagaaaacgttctgtggaagggaacagagataaaagacggagcccctcttgtggagtgtggtggaatttagtttggctgttgcaaggtggaaggtgaggctgggaagcaggttagggtcagacagcagagtggcttgaatgccaggaaggggagctgggatgttacgcagtaagtagtgaggtgctgctgaaggatcctgagtgggccagtgacacgatcaaaccccaggtggcactgtgagtggtgtggaggcaggagacactcatgcaaggagggcaggaacaaggtgaggcatgccccttccagggattggccacagcaacggcaggagagggcatgtgagagaggatgcagaggacgagctggccacattgggaaacagtgaaggtcgggaaggagagggtggaggtgaagttcactatgaaatgagaacatagactgactggttgactcattggttcattcagttaagctgccattgagctttgtttgttatgtgctcaacacttctaaatggtggtaatcggctgtgcacaagacatggttgcttctccccaggccagggagtgtcaccaaacacacacgttctttctaaaagactatgcatgcagtgtggtcacagtgtatttatcattgtagctagtccccagagtataccacaggacttgacatatactagatgctcaatgtttattaaactcattcattcactcaacaaatatttattaagcacccattccatgttgggcatagttctaggcaatggggatatatcagtgaatataacaaatatttctgaggttccttgagatctctgtgcattcagtttacacccaaagcataaacaaaatcactgcacttattctaattatgttgtagaattgaagtcagcatttctttgtattttttcctccagagttaaaagatacttattgtgaaagtatcaaacatcccattatggaattaagttcagagcttttaaaaaattgtggtattgattttgagattgaaattaaacatgacatggtacagaatatattcactcaagcaaccatttaggaagacctaatttgtaagctcatctcaggcaccactgagtacagtagtgatgaatcagaaaatccctgtcctcaaaggtctttatattttacaataaaagtccttacatagttagcaccttggttttcaaagtgcttttgcatatgtctcttctcatgtgaatgtcaggacaatgcgggggtgtacacaaggcaagcatttctcttcctgtacctcccatggagacgctgaggcccagggctgctggtgagtcataagctgacccaagagtcaagagccatgctctttccagtagtcagtggctcccagagaaacaccatgctccataaaaggtggggagaaacaggttgttgttgttttttttttttgttttcttggaagggaagaaattcagttttctgacctaaaaattagaaatgactggagcggtaaagttattctgctaagtaaaaagcaacatagctgagtgggagaaaaaccagaagaaattcaacatgttctaagggatgcacctggagagtgtgtggcttctgttctgacttttatatggacaaggataattagcatcgttttcctgtaaactgtattcaaatttccacatgcagcaatgctcccctggattcgcgccgtaatcattacatcacacttacagcatgtaccagtttacaccccggcactaagtaaaatacaatttcctttcttcctttgattattttgccttccttccttctttgcttccctctgtctttctgcttttactgttactcccacatttactgaactagatctcataaggattcctgggcatccacagatgaatgagccacagttcctgatgcttgagtagcagactaggatgggaggaagcctgaagacgggatcctatcattcacttcagtatctgccccacagtccgctgctgggtctgagacaaggacttggttcctgaacactgagtggatggatggaaggatggatgagatgcctgtatccggatggcagtgttccaatttctgactcagtaaaacagttgaaatttatcctccccttcccgttgctttttctgtttcagcaaccccctttcaatgagagaggatgtgaacaagagaatcaaattggcattctgaagctctttatttaaaggcacgtatttagcaatttgctatgtctgagttaatatatgggttaagttccctgtgaatgacactctcctaactttagcaacgtcataaagacaatcagttgctgtgtgtctggcaagttaatgactacaagcccaagggatgcaagaatgggaaaatgttaacgtagaaaaaaagactttaagcaaattcagaggaaaatggaaaaggactcaccactccctccccaaaatgctacacataacatcttgttttgaacaaggaagttatggagaatattattctaaactttgtattcattagaacaatcctttacagaatgcagacaagaaggcgattagggaaattagtaggagataaagaagaaaagagttttaggaaaagatggaagcagaggaggaaggaagaagaaaaagcagagaagaagactccatgctaaggtgacagggaagcaggagaggaatgtgagcatgaggtcaggtctgggggcaggtaaaagagaaccttcggagaacttgactggcagaggtgggtgagaaaggacactcctctcctgtcttcctcagctccagagggtggaatgaggctgacaacacgatcattgtggcagttactctgctgggggcttttatatataacattttatttaatcatccagttcaaagccacctgcaaggaaggaaattatgtccattgtactggtgacaaaactgagtttagaggttgttggtcaaggagcaggggttctggacaagcacccacctacggacagcacactgccatccacaaaggactccttcatcttccttaaacctcaggcaattctgtgaagtgaacaatatcatttccattttgcatggcaagaaatgcaggctttgagggagccactcgcacagctagcaagagaccaggaagcacatggactgggacttgatccagtgctccttctgtttcactaaacagcctccttgaggaagtagctggttcccttcttttcaccccatcctcagctttatcctgtagcctgtggccagatgagtgctgagtaccaggccaagcagacacagcatggcggttggggttgatgtcccacggtcctcctgactgtaattctgcatggagtgaggactctgattctttaaaatcttagggctatctggttcgtgctcccacacagtgcagcagtcttgtctacagcagcccccaaacatagcctaaaaagacaatgactctcattccagtagcagaggttcactgttactaaatgaagccacaggttccactgtgggctagctgtatctggaagaaaattcttgttttgagcccaaatctctttctctataatttcttttagttctgcttttgctagaataacaaatgtctttcagatatctaaatgcagcttttgtgtctccccttgtttttctcttctccaggctaacctttctctgttccttcaaccactggttacaagacagtctctgacaccctctccattcctcatgctgtgttcataaagcactcaagtttgtttgttttccttttctttcctttgttttttgtttgtttttttggggggaagtcagagtcttgctctgtcacccatgctgcagtgcaatgacatgatcatagctcactgcagcctccaactcctggtctcaagcaatcccaccgtcttggctgcccaaagcattggaattacaggcaagagccaccacgtccagtttatgttccttttcaaatgtactggtataatactcctaatgtgatctaagtactgcagagtctaatgaaatcatgactcttccttctgtgggcatgagacctcttttgtcacagttaggataatgttaactttttcagcagccactttgtggaggagaaagctaagtcaccaagctcttgcagtacagcataataagttctgcgaaggaggcagccagtgggctatggcatcacagaggagggacagcaaattttgccagaaaggaacaaagaagccttcttggagatgacacttgaagaacaactcaaagtgagagtaaaccaggtggagagagtggaaggtctttccaggcagatggaaaagattttacaaagatgagctggtgtgagagaacatggcagtacagccttttcttccccattgcttctcttttcaattcctttcttcagcctttctctgacttagcttcactttcggatgttcttttcagttaaggcttgggaagacccttgcataacacaggggttggggcgccgatccccgacgcagtcgaaaatctacatatcacttctgactcttccaaaacttaatagccggctgttggctgaaagcctcactgataacataaatagtccattaacacatattttgtatgttatatgtattatatacctgcaataaagtgagctggaaaaaacaaaatgttattaagaaaatcataagagaaaatacatttcctaagtgagagtggatcatcataaagggcttcatcctcacggtattcacattgagcagactgaggaggaggaagaagagggattggtcttgctgtctcaggggtggcagaggcagaaggggtggaggaggtggaagggaggcagaagaggcaggtacactcagtgtaacttctatcgagaaaaaaatccacgtatatgtggacccacgcacttcaaacctgtgttgtttaagggttaattgtactatgttctcctgttttaagaagtatctgttgcatggagttgaaagttcttcaacttgtttactgtattaagtgagcatcaaatagccaaagcactggcaatgttactataataagtagttttggaggttgtgcctctacttgagtgaactgtttgattaggttagaaaagcaaatggtaccctaagtatcaaaaggcagccaaaggtcactcagggccacaggctggaccacagtgctccagggtctttgccccattatgagctgatctgtttttcccttcaatgcctccagccagcagtgttgaaatgagatattttaggatttccaaactatttctaaggctgttagtcacaaactcttatcaaggcagttttctcaggttggttagcagacaggctcagagcctcacctttgcaggtcaaagctcgagaaaccctccacatgataattcacgcatctgttatttttttacctgtcccttctctgcctttagcttctcagtcatccaaccccgcctctgtgaaaagtgcacaatgactcaaggcttttcttaggcctctgacaggtgaacaaagaaaaacacctttcacaaatccattctatcaagggatagaagaagagagaacagagccttcagtaaagaaccctaaacatcccaccagaaagtcccaaacaaccctgaaaagtgagaataaaactaccaaaagctgacagagggtaacaagcattatttccaacccacacttgtccttctaaaaaaaaccaacccgctactgaaaaaacccctgaaatgtatgaaatctaacatcgttaacatatttcctgtcctcacatagcttataaaaatgtttctgagcttttccctggctcatttacaacgatgagaaggagcaaaaaggaaatgcaacagatggtactgagggaggaggtactaccatcctcgctcacagtcatccatcttcgcagtaagttatccccgcttgggcgaggtttcaaacgtttttcagatgtaccaatggcgtattcttgctcgagaacaatgaagatgaggctcctttaaaaagcttcaggttagaaggcatgtttactactgtctatttttgttgtttctaaaagagatcacctcagctttccctctgaacctccccaaactgactctgcgagaatctaatctggtactgatttagagctgacaggtggtacatgcataattaaagatgacctaacacagaatgctctcattcctggcatattatcagacacttaaggaaagcaattatcagtaggcaatcttttctgtcaacagagatcgagatgaaacatttcttcaattaagagaattctgcaaggatgctgtacatatccatctgcaaatacttgaaaacctttagaggttaatactaagtcagctcaatgaaacacctttggccagttaacacatgctctcctctcctcccacttttcctgggaggtcacatttcaaacatcaaaatcggaacaattttaaggtgctgccagacaccctgacatgagcggacaaggaaatctctgcatttttctgccttgctgaggtctgaaaatataacaagttttccttaaaggttcaaagcaaaaaaggatagggttcacattaaagcaaattcaattaaaatttcccttcagagcaggattattccctctccatgctccacccatgtcagaagtatttagagaattattatcaagccttaaaacttcgtcttgaatctaagtgatttaaaggatttttttctttcattttgaagaaatcaatattactcaaagaaaaaagggacttgacaaaaacggaggaatttcccatttcaggtgaaggagggaagaggtgccgcatttcctgatagaatactgtgctttttataaattatagtgcatgcactttgtataaatgaatgcatttaagctttccttagaacagaaattgctttaatgttatagtgagacaagtgattttcttttcttttttaaaagggtagtttataagttaatggttttttgaagcccatgtaaaaactgccttccacaagacagagaacttcacaatgtttgtggtgcatattttgccacatttcacaagaggtcttattgtttaaattcttatagccttatgtcatatgtgaacaaatgactttattgttcatttgaacatgtctttataggatctctggtggtagagctagtgttgttgtttgcatttttcccctcaacaagccagaacaaaagtctcttttactgaagcgctgggaactcagggacgatggcagtgtggcagcagttgtcagttggaaacaccataatgataatgtaagtgaagtgctcacattaaggggttgacttctgacaagtcaaggtctacagaaaagtttccgctacagcagacattatggtaatgcaaaaacagaagtacttaatagaataattaagaatcatccagtacactattactgcagtagggctcaattcctttcgagatatgctttccttggaagagactccattcagaatattaggggaaaaatatcagtagcctttggggagaacataatcagatgggaggtggaagcgatggcgggatcattaatgggagattcagtaggactcaaagctcaagttcattatattccttagaactaagaatagcttctgaatgagtactcacaattctccacagacctatttctcctaaggagctccccctttctccctttccaattttaatctaagaaaaagaatagaatacagacagacatgggtaggtaagcaggaacaaaggaacctctacagaatggaagagaatctaagctagttccgttttagatgttgttaaatccctttgaccaggattcaatttagaacaactcaaaagatacagtttgacagcatgctgcatcaagaggacaggagaaagaaagaagtcacaggtgtaatgttgtggcaaacaacaaaatgttatttcccagtgcatgtcatggacgaaaagaacatataagatataaggcacatactaccattaaagtaaacagaatacaaaaaggaaagattttagtgagtttatgtagggagagaccctcatttctcacacaactcagagtccctgacttttgtaggacttcagtgaataaagcaaagtctgtaagcacagcctttctatgctgaggatgatatatggcacaaaaacattttacatgatgccttttacacttagatattattttagaatcataaactaaaagcgtttttaaggtggaggtacccggcataaaatagatgtatcttctttttaaccaaggcttctcctgtccacactcaaacctggctttccaagtgtgttggctttactattttatgattggatgaataaaataagactgttaactatggctacaaaataaattacgataccctgaccccaacagagtattattttggaaagaaaaaaagtcaaatccaagatattattatcgtaactgcaatctacttgtgaccctgtttcagaaaacctgccatttggaagccttatggagacatttttcagaatcttatgtattctctctgttaactgatcagagatacttctcaggtttctttcaccaaggacaaaatatgacatatacttaagaaaggatggatattgtttcaggatctctatccattcaggagaagacacttgctttttagttaaaaaatgactgtgactaattccagagcacctggtattggctttttcaagaatgagcatttgaagtcaaactggaaaatggtgactggcacatctgcaatgatctagatgatggtaagagacgatccagagatggtaagagacagataaacccaaaaaggctggcctcactttgctgcagagggataaaagaaaatagaagaagcgaaaaaaatgatttttctctacaagtcccactctaggaatcacctttgttaactttgagttctttcacaaaatgaaatgttatgtgacaatacaatctgtttcccttagggatggaaggtgatgaggggagaccagtgataggtgagatttaaagacacgtaaaggaagggtggaaaagaaatgcattatgttaccgagcgaatgaggattaaatcttcataatgcatgtcagattctcacaaaaagaaaataaaacaagggcaagcttttactgaacacctaatatcacccagctgtgaataaaagaaaaagaatctcactctgaccaattcatacaaattgactaatacttattcccttatggtccatggtaacccatactccaagcacacatgatgttctttcacatgtacacatttgtaactttctgtaaactaattagcgaaggagaatacaaaataggcaggtataatggaaactagtgaattccatccctgaagctagttgtactgtaatatcttctgcatggtgccaacagccccctttccctttgcttgttccgacacaatgccttcaggtctgtctaagtaatgtaatttactagagtggaattccctcggtaccctgtgcagtacttggtgacagtatcatttatactccaccgtgtcgtggcctgacactgatccatccgccttcatccctcattcagaggagagcatgcaatttcaccttcctccgtgcccttctctggtgtgcacgtacacattcactccactcagccctaattacaaacctgggttaaaatactctcattagatttatatttcacactccaaatgtcaatcttgttgaaaattcccgttttccggaggattcatccattagcaataaactttaaagcattctgtgactgagtgcattaaaccagcaatgcggacatgcacttaaaatacatcattagagaaaatctccattgcaaatactttacactattcaaccaaaggaataatgagccccgcctggccagtaccctcaaactgcacatgaaggataagttaaaactggcagttttgcaggaaggagcacacagtgtatccacaggatgcatttcagaatctgtcattccttatgaaagcgtgggagggaatcacagccagagtctaatttatcaccttctctcacctattatttttacagaaacttcggtctatggcaaagggcaagagggacggcgaagataatggggaatatatgagtgtgtacagggaacagaagctgtatctgcaatgccaggaactttgaaagtcacctagaatgatttgctcggcctgaaaagcattcttccatttcgttaacagagaaaagtggagaaagcagcattgtctggagacactggagaagcgggtatcattttaatacaagacagatttccctggcagagttgacctgagaaatgtctttattccagactgatggttcctaacacaaaaaccaaaaatctgatgagaatactaatatataaattataagtcacaagttgtatctgggacagggatggtaggacagactaagaaaaggaaaatttgaagaggattgaaaaacaacccagcaaaatacaacaattaagaaaactaagccaccactgttttatatctgtcctgtattttaattccttagcttataggtttaattcatcacttcttgtcaggtctcaggtgaggcaaagttaagatacagtcataacttctctttaactttgataaatgaagaaacagcattctaggaaagtcctggaggaggttaaagggagactgatttgaagtctcagcatctaatcctgaaggctaacaaaaaagttatgtccacaattatgactttgtactgtgaaatacacaatacactttataatgcaaaactttggtgggtggaaaaggactctagaaggacaggtatacattgtattaaacagaaaataacttgcaaagcataaaaaataaaaataaaagcaacagcaattgttttctacctgtcagcatctggtcaatctgtcagattgttcagtaaccagaattataacagatgcaatattttctgtggggaattacaccaccatggaagctattgctcctgaagttttgcccatttccacctgaaatatttttttagccttacttgattacaacattagcactctctttcataacgtacaccagcaggtactacaattaacatgcacagatgttagaactgaacatccatgtttaaataaaaaacagggagaaggtaaaaattactgaatatgctcaacacagcactaatcttaaaaggaaagagaggcttacattgtgctaacttaacagcaaaataaaaaaaacaacaatcccccagttggcattagtaacctaagaagaagcaaaccactctataaatgcctgtattcttctgaaacactgaaccagaggctgatcttttgtccatttaattccaaaatttgtactccaagaatagaggagaactcccaaatgctctcaaattctccaacacattttatgatgcaactgcacaaatgacgataacaccaacatcattttgtggagtgctggctttgtgctttatgtacgtcatctcactgaatccccacaaccaccctctcattcaggcaggcagtactacttctgttcccattttcaaataaagacacccaggcctaggagaggttaacagatcaaggtcaacaagtagctaagctaagatttgatccggagtctttttttcctcctaaagctctcaactcattgtaaccactgtgccacactgtctgccacagttggggatgccaaagaaaaatgtgatttgcagtcttcatttttcagaatcttctggaactgccctcttgactcatccattttacaaagctcatcagactgaaaggctcagaacacttgcagacattctcattctttggaaatgccacaaccactcagtcagtggaatgggacagcaccatcaatgggattgcgaaggcacaaatttccctgtgaatgctggcgccgcctctctttggtgtttcttctagccacaaacggacacgttatcacttactgtggttgcattcgactcagcagccagatgcaggggagtttttacttggttaactgtccctccaacatctgtgtctacagaagatactacagggcaggcgtgtgctcatccttgtcccttctccctcctccaaccaaacacacaaaaagttttccaatctctagggcaacaccattaagatatcctttccttgctgtgctatgagtttacaagaaataactttctaacaataagccaagaagatggatgttgtaaaactgcatttcaaataaggcaattcctttttaaaaaagattcaagggtttcacgcttctttcttccttccatcaacacaatttgtttatgtatgagttggatctttcttccttcggaagagaaaagtgctgataaactatcatgtgtagacacacaacgcaaaaacttggttgccttttgctatttaaacagagacaaattatttcccaatataccacttaccagacagatgcaaagatgtgggcaaaccagtcatcagaattaacagagtgattttgcttgcactacatattctgatttgtatgactcttatttttagccatgcacaaagggcaataaatggaaaatcttattctaaccgctactttttctgggccacccacactgccccacctaccacacaacttcaaaatgtaaaaaaacccagaccagggtttgtcctaacaagggatgcaaagtggctaaaatgtgtgacattttttccagttagtgtttgtactttcattttttttttttttctgtctcaggactttcagggaaaacaatgttgacttaccaatgggcattttcaaagactctaagttggtatgtcagtcagtgtacagacaacgtgatccgcaaggcacgggcaccaccctgccgtgaaccacatctcagccaatcttccgcaaagaaatgtacccaaaaacttttctgtaaattcaggaaggtgatccacaccttccacattttgttttgaaacaatgatggtattttaaaagttcttcaaattaacaaaagtgatatcagaaatataaacatttctaaaacagagcgggctgtgaggagtgattttgccaaacttaagtcagtagcacttgacttatatctgcttttagtctgcggtggcaccacgcttaccaaggcacagtatccccttgctatccctttccttctgtgcattttttctttctgtatgccttaaccacacttctccacctgataacctgaagcttatcaagcattaattcacacatggttatcactgtggattgaagcatctgatatttagagataaccatcttgacggcaaataataaaaacaaaattgatgaagaggatatttgccaggggcacagagaagatagagatgagagtctatttttgattactatctttccagacttttaataaaaagttattacagtcccaggataccaattaaaatgcttgttcctctgagccctctgcaaaccacaacagcaaacatatgcaggtaacaattaatatttaaaagtctagttcaacaaaatcatcagaatcattaggaaacaaaaggcgtcaaccctgagaaaggcatctttacctgtgtgcctgctcattatccagaaactagaggaaatgttctttcatcgtctggtagttagcacatgccctgcagagctaacaccgtcttcatgcgcggtactcgagcagctctgatgagatgtctcagaaaatcttttttgggtgatagtccactatcgccagaacttctgacttgtgttgtaaaaacacaggcaattaagtattacacaaagtgggtcatacgccactgagacaaccacaccgcccccaaatcagactccaaatgactgtgctgtgacaaggtaggaggggtctgaacgcagcgaaagcaaaacttttatgtggtgaggagcattttagttttcactggtttaggttagagaaagttaatctcaatgtcaactacaaagccaacaaacttttagtgtgttcttgaatttatatgacaaatgctggctgttcatctaatgggaaattcagatccaatgtcataaacagtctgagggacagtctcaggcttaaatgacatgcccatcactaaacaagtgagcactgtgactcagtgaaggaaggcggccaaatcgaaactaaagataaagaaccaaattctcattatccacattagcatctccttctccaaaggaggatcaaagtactgtataccacttccccacacccgtaaccaaccagggcattcaacacaatcgcagatgctacccaaacacccttcaattgctgtaggaaaaaggtcaaatgtagttacctgaattgagcacattcattcatctgtcactgaagagccacagaaatattaatccaatatacactgagttcctattacatacaaggacacagaggacatgaagggatgctctcaaagtcactgctttcaaggaacttaagaatcctttacacgggatgataaaacctagatataaccaatgtcaaagacagactttttcttttttttttaaacaaacaaaatcccttctagcagctagctgcttactaaatacttcctattctacggacataaagtttgtggattacaattctacatttctcagatgaatcttctaacaattccttaaattttaccttggttttctttcagtgctcaaagcccttcctaaccttggccaagtgttaggattcatcctaacctgaaggcctagtactctccaaagggaagcacagagataccagcacaactcaaggagctataaaatcacaccacagcaatcggaagagatgcatctttaaagggggataaaggatgcaaagttaaaggaaaactctgttcacagcacaagaaggcatatatttgaatgaaattttgttaccaaaattataaaatcagaatttgattggagttcatattgtttggattgtgaatgcggaatgggaagatctggctaactcaacctttcccatttctgccaaattgccttatagtacagtgattactaatttctaaataatcagaacacaatcagttgacctaacaccaaagccatcttgtacataactgaatcttcctttatgattccagaggcccactaggatcttacagggccactcactatcattttgactgacagaaggtagaaatgaaaatactggttgacaggaatttccacctgataaagatactagtgagtccacacagctatctgttcttataagagctgattaatataattagaaggaagaaaaaaaaagtaacaaggagatcactgtcctataagatgacacttaaaggcatcattcctaagtgccaccagcttgtaggatgtaatcagtctagagcactgcttgtaaatttggaattagttaattagtttcttgaaaaaagtctggaaaaatacataaaagtatgagttaacaggtaggttatatttgggcagccagattataggtaatttatctctacctttattcaattttctgctattttataaattatgtagaatacatgtatcactttgataataaggaaaacaaagctacttctgttcagataaaaggaaacaattattttctgattgtggttctgtctagaaatcaagaacacttcatcaataagtttctgacactttctgtcaagaaatcaaggacccagcatactaatctgaactgaactgatgacaagtaaggcacagaatacaggaaaaacatgctagaaataacagattatagcttctaattaagcaccgcaaggactctaaaaatcttgctatcctgcaaagctttgtaaatactgttctggggcagaagagcagaagtgcttttcctcctcatgacgcacagtctgtgcaacttccagctgccacaaggctgcaggcacacactcttacaagatctagctaatgggacatccttggaaaaacatgctgcaatgccctgggttaaatctgggctcacagagaggcatcatttcactagtgacaggtgcatccaaaaaagagcacacaaaccatttcttaaaaatcaacagattggaaactattagaataaattgataaacaatttgtactacaactgatgtcactgggcaggcagctttataataaaacatagattatttggagactcacgactcagagaattatcttttgaaatttttgatttatatattaatgtttacaaccatgctggtaacatcactcctctctgtaccattagcagagaatgaaaattaattttgatgatctcttgagcagaacataatctgaatctgaaatggaatattacaaataatcatatcataggttctttttattttttaaaaagaaacagaattggcttcaaaagtatgccgttggttcccaatgactataggagctaaatacataggttcataaaatgatttcatatattagttttaaaaccagtaatatcacaacttttagagtgcttaacataaacagaacattcaacatttaacctctggcactggaaaggtggtaaaagccaaaacttgcagtttctcgagaaggataaaaatgaatggtatattgttctgtcctcagtcaaaatttttagattattattaaagcatggaaataggtatactaaaacctcagttaattagactatttgaggacaagaatattttttattattttgattttctggttaattgacaactacaaaatgctttttgttgaagtttttccaaagcagtttcttttcctctttataaaacatctaaccattctcaatgattcagcaggtcaatgtcatcagctacaagtatcctccagggtttacaccccacctttactcaaaaccaaagctatcttgttttcttcatcgctgaaaaagggaagtgtggtgtgtgcggtagggtggggtgtgtgggagggaaggggagggggtggggaagtatgaaggttagctaattcagggttctggctagttgggttccaggtagcaaaaccgtcagtaaacacaaattcaatgtctggaaccaggcacatctgattcctgcgaatgatgagacaaggacacaaggagatcccactagggtctgtctttgttggtcttctctactttatgtcattttgtctcggtgactgctggtttgatgctcttctctgtggaaaatgtgtcagtgtgtctatctaaaaattctggtctatgaactcatggggggggaatttattttgattagattccatatccatgccctttcaactcaagcttagggtggatgtcaaagatgaataagcccttactttcctctcccttagacttgctgacctgaattttctcctctacaaaaatctttaattccagtttttttttttttttggtatctcagcggctccccatagcaactgactcagaaacctcttttcctttgccctgttttccaatacctaagtgaaaatcatgaagagtttctttctaagcaggtttggaaagtctggcgtgagaatgagtggactaatttatatatattgtactttaacaaattcattttacctcttttcagttacaccttttccttaagcaaaattatatataatggttctgctatagggcctctgtaacagactatatatatactggtatcttaaggagatagtaggataatttaggatagcagtttgtgaactttttgaaaccatggatccttatagatgactcttcaggaattctaacccctggtcagccctaggggtagagggtaaaggtagtgaagacgacctgaataaagtatggctactgggccccataaaactgttgattgttcttcaaagccaaatttctagaaatgtagaataaaacacaaaagccaaaaaaagtagggtacaatggactaacctagtgagttccatcctgtgtgttcctcacaggactaccggccactcactaacctgtctgtgacttacgggtacaataatacccataagtacagagatttggtgatgggggataaatcttgcttcacttggagaatgtaaaacaggcatcataataatcataggccctacagcgggagaactatctgctgtggatttcctctcacagctttcattttctactgcgctggaatctacgggaagtctgcattccctggttcctgcctccatgtccacctccgctgattaagacctttcagaagccacagtgaggcacacagctctgggactctctctgtgctctgtgcatggactggtttacaaacacccatctggaggaactggagcagccccactgctggagcatgggtggctcacgctttccttcgccccagtgaagcaggtcttctagatgtgtaaatggcattttagtagagaccacagttgtttaaggcaaattcccttgatggcttctgacaactgtgtctttactctgataggaaactcattcctgggactgaagtatataccattcagtggatcccttacctttgttggcttctaaaggctgcccaaagggtaacaggaatgagggaggtgtgagagacataatgatctgttcttcctgcaccctcacaaactgcagcatccctatcaagcactagctagtgattctgcacagcactcttaggaggaaagctttaaaaaattatgtaaaatatatacaacataaaatttaccattttacccattttaagtgtgcatttcggtggcattaaatacattcacattgttgtgcaactgtcatcatcattcatctccggaactctccaatcttcccaaactgatacttaatatccattgaacaacaactttcaatttttccatcctcccatcccctggcaaccaccattctactttctgactctgtaaatctgacagttctaggtatctcatataaatgagatatttaatatttgcctttttgtgtctggattatttcacttagcatcttcagggttcctccatgtcgttagcatgtgtcagaatttcatctttttaaaggctgaataatattccattgtatgtattaatatacaccacattttgtttatccattcacctgtagatggacacctgggttgcatccacctctggctactgtgaataatgctgctatgaacatggttgtacacacatctatctgctcaattccctactttcactttttttggtatatacccagaagtggaattgctggatcacttggtaatcctgtttaattttttttgaggaactgtcgtactgtttagtatttaattttttaaatatatgcactttatcataaagagcagttttaggttcacagtaaaactgaccagaaagtacagaagtttcccacatgccccctgtcgccctctgccccacaagattcagttttataggcaccctactcactcggtgactgaacgctcgtccaaagacatggggagtgatccaggcaggtcctgccagatccagcaggagcctgaagccatgattcacctaaggagtcatgacaacttctttccttcctgacctgtagacaggaaactgactgacagcaaaggtcatcccacaggaacactggatgtgtaaacgtggagatctgcggagtggcagagcaggagagggcgctaaggggcatttgatccaacctccttctttcactttatggtgaagatgtctcataaactgataaccttccttccaggaatgcagtgcagaataaactagtgcttgttggagatggtatatttttgagggtggagtaataataattacatcactcacaactctatcagccctaatcccagccctgttaccctttgggcagcccccagaaggcacctctgggttaattccattatagatcacttttaacacttactggtttttgtcttatttttctgatattgggggttttattttaaacattttaacatatacctactgtacatttaagtctatctccaggatttttgactctattaatgttgaggcaatacatatgttctttctttgcttggcaattgctttattaacagtgattattctcaactccagagagttataataagagaactgtaaatcctaagtgctactctgaatgataacatctaccatatccaagtaaaatgttataaatcacagtgcttatccacagatttaaaatgcccagaaatttctcaaatgtttcctggacagtatcactcatactatttttacactcacatcgactcaatgaaacaaaagaaaaaatgctgtttcaaattcctacagtcaaagctcagaaatatacaatgcatatatctattcacaggtacacatgtacatttgtatgtatgcttacatgtgtccaaatgtacatttgtttagtcaaactcttctacttttttctattaacgtggaataaattgttcttgtcctcagcagttaggcaacgggcctgttcgaaagctaacaccacaacatgatgattcacaaagtttttcagtcttgagaacttagaatctcacaaaacctggacttgctggcttgagttactcattggaggtgtgcttcccttcccatgtgtgtgttttttttttatttttaacttttgtgggtatacagtaggtgtgtatatttgtggagtacatgagatgttttgatacaggcatgcaatatgaaatgagcacgtcatggagaatggggtatccaccccctcaagcatttatcctttgagttacaaacaatccaattacacattttactataaaatgtaagttattattgactatagtcactctactgtactatcaaatagtgggccatattcattctttctatttttttttttttgtacctattaactatcccacctccatgccctgcccccaacccccactacccttcctggcctatggtagctatccctcctactctctatgtccaggagttcaagtgttttgacttttagatcccatgagtaagtgagaacatgtgatgtttgcctttctgtcccacatgtgttttgtaaatcaaatcacatttaagtgtgtgaggggagggataatgctatgatgactcactctgaaagggaacaatgtatttcccaactcaggggaaaaaagattttctcttttgagtgtgtctaaaagcatgatgagcacacctgcaaaaggactgtagctgttgttttagcctaataacagcactattagtcacacttgttgaaaaccaggggcaaagaatggctggtactagcagctctggggtaaagctggcacagaataatggcatcaactgggctggacttccaaatgtgaaggtgctaagtgaaccttaaaactcttttctgagacataagtcagtgtattaagcaaagcattaaatttcttaatttaatgctatttattactcaagtatatacagttttctacctttttcattatttcaagcacatgagttaaagcagtgattctcaaattggggtccctggaccagctgcatcagcctcacttggaaacttcttagaaaagcaaattcctagcctgtaccaaatctactgaatcagaaatctgagcttgaggcccagcaagctgtacttcaacaagccctccaggtgattctgattcaagctgaaatttaagagccactgagttaaggaaccaccaatatacagattccaacctttgctcaatgataactctccagctcctttgttaaaaaaaaaaagtaattcatgtgtgcttgggctatttgttactatcacctaagaaaatatttatcattgtttaattaaggaaaataaaccctggtcaaaacttacatgtaatttttccaggtcctgtgctgccttcgagtcttaggatgcagggaactgggcgaagggagagatgagaaggctctggcaatccattcagacatggaccccaaagttttgtggggcaaccttgtgacaggtcagtgagtgtccacctaattgggaaggaaaagttgtccattagcagatgaaagtatgcatgtgaatgtttccccctctctcctgctatctcgccatactccgttctgcttgttatgatctcacacaactgtctgtgtctctggctgtcggcctcttgaccaatcctcatgaacagaataagacaccatagcccgtggtagaaacgcctgggctctgcctactagaagccctattccttgaggtatctcctttaggtgagcagccctcacgaggggctctcctgaatccaaatgcagcctaggagataggtccatgtccagtaagttatcaccttctatatttcatctcacgttttctgtcagcaaatcagaacaccttggtttaaaagacacatgtggccattgtaaatagaagagatttgggaagcaaatgatttaagaattctgaccgaaatgagatgattccctgatgcctcaaatgtgtttcgttttaaaattaatatttattttttcagataacttaatacatgcttattgtagaacatttgaaacatacagaaaaataaagaaaaaaataaagatcaatggtaaccttgacaccgataaatcactaatgatgttttgttgtatgggtctgaaactccttcaccgaaactcttggggccagatatatttcagaattcagaatttttggattttagagatgcagctaccatttattacattagtatcttgtgagagtatggagcagcaccctataatattaaatattaaacattaaatatttgtgcacaaaaatagatgcatattcttattaagtgggggtaaaatagagcctcacatttgttcaggccaggttttcctaccaaagaagttactaaaaatagaacaaaacaaaaccccttttgatttctgaaaacttttagatttagaattagagataagggattgtgggccagtattcttttcagatacatgcacatactcaaagtattgcttctactttttcattcaattctgaaataaaatgtgagttatatgaatatgagtatttccccaagttattaaaaattattcaaaacatgcttttgaatgttcatgtgtattataccccatagaaatacatcttatgtatttatttccctcatttttggagttgcagattgtttttttctttgttattgtaaataacactttaggggatatttctgaatatcagattgtcttgaatttctgaacattttcttacgcaggttcccagaaaaggaattattgcatgaaagggcataaactttgagagtcttgattttctagaaagattgcaccaatttatattttttttcagcagcatgaatgcctggttaattatgaaccttatcacagacagagaaaaatacacttgctcctcacgcaacttaacaaaattctaatcaatgatgatcaaatgtaagatattttatttttgttttccttacacagaagatagtgaacagcttgctgtttttgacatagcaagagagaaatggagttaattttagtttaccatcaaatgaccctcattaggccagactgagttagatgtggacagtgggggagctgtgacttgtccatggggtctccacatggaaaagcatgtgagagaattcagaaataattcccataatatcgtgagaagaaaaaccactgattatttgtgggttgataattcatcttctagagtagtgaggccttgtattttccttccttctggggttttcctatttcttggacattttgctcttcctcaggatggcatcaaaaagcagaaaaagatgcaaagacaaaatcaaatcagaatagctaataataatggctaacccttatgcatgattacagtgtgtccactccaatgccaggtccttgtatgtattatctcatttaacgccaagtgcattggtaacaaaactggtggctggcaagtttgaaagtatgtgcccactcattggtcctccttattccccaataagtttgtaggaatttgggcttcagaattccaaagatgtattcaagcctagtgtctcattactatgttgactcattgcctagctatatatcacaagcttgatctttccactctttggtcagtaccatctatagcatctaaacgaagcagagaaagtctaagaaaattctagacaatagtaaaccctttgaaagtcctatattgacacggggaaggctatagctctttgagcacaatagagaagtgtgaggtaagagtgttatataacacaaaacaggttatacatggagaaagacatgaagacacagataaaatacacacttgaaaaaagaaacatacaaacacattcttcccaaatgtggctacgaattaggaatgctaaagcaggtcttacagccccaggttcttttagatttatagctttttctaataatctctctttctctttcccctttatgtatatttaaccttacaggataactggtatagagaatgccacaattttcatatgctaataaaagcaaactgaagtgacgtttgtttgttatattaaatgaaataacctcactctttcacttatgtataaactcaaatttctgcacccactaatactataagatggttatggtttgaggagtggggggtgcaaaaaatttcaatcctattttgggagtgatttaaattgatctttcccaacaatcttatctaaaaataaggattgtttctatcaaaatgatcaaaagaccaaagagaagtggaccatttccttcactgtggctttacttcataatttaagcatcattttcctgataattaggtgtcaacgcagatagaatagcttataaatgatttttctttgccacattcaggtatatgcctaagtttctaagcagaccagagctacagggagtgaaaaataaaatggtaatagaagaaataaaccctcaaagagtatactttgttttttccaaagggcctaactgcttcaggggaaatacaaaaaacaaaccaccattaataacgcaaacgattaccagacactccttggatactcaaactgtacaactatcattgcaaagctaattacaaatttggattctctcattttaaaaatatacttcgaagcaacccacttctgtttcaatgctgaaccaaagtctgtgcaattggcacactgtcaaagtaaaaaaaaaaaatatatatatatatatatatatatacacacacacacattgcatcacttgcacttgaacaaagttattactttcaatgtcactaaatcctgaactgcaaaacaccgcaagctaaaagcaagtaatgccacatggtatattatcttacatttacaaaagagtttatagttttccaagccacagagatacagactttcccactcacagtagctttgttatgctgggcaccccactcactgcctcggagcctactacctctcacaggttcttgtggggatcacatgagaatgtatacagaattttttttgcagattataagacatacataaaatattaggtatcttttttttaaactaaacaactttgtgaggcataaagatattaatcgccatttcatagtttggaaaagaacacaagaagatgtaacaaaaaaagtactaagttagaagatctgagttttatttctaaattggctacgaactagctgcctgactctctgggacttgatttcttcagtaaaacaagggggttggatgaaatgactgtaaggtcttttggaagccaatggatctgtgatgtaggacgtggccatggtagtgatgggagtgccttaggaagtaatccctcctggaggccaaggaaccatgaggccaaaggtagcatccatcaatctgaggcctgcagtgctggcgcagagtccttgagcagcccccaactcccagagatgagacagacattaactaactcattttgctggactgaggggaggttggtggaatcctaaaggaatggccagggtgtcttgggcattggaaagaaataccgaagaaacttaggacagcaggtctttattaactggtacaggtattttataactttaacaactggtatagccaagtaagtatataccagctgtcagtcttgctaacagttttactgttgtttgtctatcagtctcaaagagacggccaccactgagggccaaccaccttgcttggctaagttcctacagcatggggggagatgtgtaagagggctctttttggtattatgagtgcacatcagggtcacatgggaatttgactttaaaaagacactaacttaggcctctactaatgctattctactaacactgtttaacacaactttctgtaatgatggaaatattcaatatctctgctgtccaatatggcagccacatgaggatactgagcacttgaaaagtacctagtgagagtgaggaactgaatttttaactttagtcaatttaaatcaactgaaatttaaatagccacatattgttagtggttagctgattggacagtgcagccctaggtggcttcacatattagttttcttggacctatttcagactccagaagcccacaggacaatacccaatatagtccttcaataggtattcactgcccttctcctaggtgctgggccatgtttaggtgtctcagaacaatggtgaataagagtaccatggacacttcctgccttgtggcattttgcggctagattgatttccgaagacctcacaaaatcttgaagtagctcaccagactgctcttaggaaaaggtgggtgaggagatatggtaatgctacactaagcatgaaagcactgctttttcatttcttcgtatttactgttagagaagttgggggaaagtttaaaaagaggtatctgaatggttactattcattctcttacaagtaaagtaacatatcccagatatgggaaattatctgtaggtaactacctcttgcataatcttaaccttacttaaaaagaaaagtccgaggaaccgcattctgaagctaagaaaagtaaatggtattcaattacagcaacagccgtagaaaaagtacaagtgggtctccagctgcaaatggtgggcaagggagtgttcttaccaattagttgtgaaatgatcaggttttctagaaggtactttttgtataagtaaggctgattgaattctttatcccaactcaactcttagctaggattttcttagtggctttaatgggatttgatgaggaaagccccatttgcctgtccccaggaaactacaggtgaaaatatttctatttacattacaaatctaataccaagaacataatttctaagaaacacaaaagtggtttaatgatctgatttccagtgttgctctcaatgtcctcctgttgtcaattctctcctatcctaatcacctcttcctaccttattgggatctggagtgacagaaaaaacacaaaacatgatattcaggtttgaactgaatccaggtttgcctaaacttcaaggacgggacactgcatgttgggatacagaatttttaagctaattctctccattgtattaatattatcactggaggtaaaaaatttaccaaataaaacaatctgattttgctcagcatcccaaggggatcatgttcagcatctcaatgggaatgacaccagtcagccaatctttcgagcttcaccatgccacttctggttcccctgccctaagtcagacttttgatttttagggctaataagtgactcttccacaactatacacacacacacacacacttttttcccctctggattgagtagaaagacaatttaatacaatggttagaaaacaaaataagacttcaaaacttagttctaaaaatacaaattgcatttagataccattatcttctttttaaaaaggtcaaatctcaaacgttcagctggttccaggctatataaaaatattactgaaaatctgatgacagctttggtaacaaacatcttgagagtggccctgaaatccttatttatattcagaaacactaagtggagtagtcgcacgccattttatggctgaaggggttcaaaaggaaagaggtcaattgatgttaattgttaattttttggaaattcagagatgaagttttttttttttttaaactcttatctttcaaacagaatttaaacagacacttgtataaggcagaacccctttgaaccacagatcttgtggcttttgtgttttattctactggcatggaaaggtgatgaaagaaagtgggcttttttgctgcaacagagaaagaagtggggagggagatgcagttatttcagacaggatggcgaacattaattgagattaaacagctctgaaagtttccacttcaacatttcaggttctgggactctagctgaagaaccaaagctagaaaattcacttatttgacattcaaggtgtttaagttcccaaatacaacaaagaggttatcagattttcacttctatcataaaaggatggtgcaggcagaactacttgccactaacaagccagaaaaataaaaagtgtgatagaaatgtgttgaaagtacataatttgaaataattcttggatttctgcagactttatacataaaaattggaatactagcctgtattgatacatcatcaccatcaccatcatcatcatcatcatctccaccaccaccaccactgccgccttcatcatctccatttactgaaaatatctatttgctaggaactgtgctagaaattttacaggaattattagcctctctggtacatgagagaaccctgactcagagaggcaacgtgttttgcttaaggtcatactgctggagacaggacaacatgcaatctgaatccaagctggcctgtcaaggctacctcctttcctgtacaacactgccttcctctacaatgtggggagactacatccttcttctgcgaaggaaacatgaccactttcccatgtgccaccagtaaaacatgaaagtaaactgacaaggctgcaggtcccacagcaatttaactatttgtatgaagagttttagtgctaaaatggttatagttcatgaagcataatttcttacttgttatatatttcagtgtcgtttctgtcccttgactatgcaaagcccttgcctggccttgccacctgcttctctctctgcctagaattccctcccacaacccttagccatgctggttacttctccttcactaggtctagttcaaatatgtcacttgcagagacactgtccttaatgtgctctgtcctctcccaaacagctaggcattgccctgcttgtttccatcaagggataaccaaaatccacatgtttatttactgtataattacctatcttctctcttggtccatgtaagacccacagcagcagggacctagcttctcttgctaaccattgatacctgacacttggaatagtgcctggcacaaacttgaatgaatggctacaccaatacatgaatgaagatcagtgtttgcagagtacagtgacaggtacacatagaggaaccagaggagagacattgccctggggatctgcctttgccagccctcgagtcctaggccagagttcatctgctctcagcttgaaccctgcctggagactgagcatacacctgcacttggcccttggccctcttctcctgctgcacctcctgacatagcctcttcttccccaacagaggctcttcctcacacgatgagctcagcttctctccctggatctaatctctacattcccaccaccatccacctcgtataaaaatcaatcgtgcttacttctcctgtggtcacatacccttcagataatctggggccacggccttgggttccatcacacccataaccatgtggcactgtcagggctgactcctggcttgttgcatgcatccctagtccagcctgacatccagcaccaggctctttcccagccttctgtcctgagccacctcacttctttctcctgtctgccctctcttcccaggtccaagctcatggatgactcttggcaggctggggaagagaaagaatgtggaacagaggagagagaaagtcagaagcagcaaaagctgctgtgtgtccacatgggaagcccgtggactacatctgtccacgagaattttcatagtgttctatagattttttttaaaaatagtgagtttaaactatggatcagcagagctgaaagggaccttggagatcactgagtcccactgtctcactgtactgttgaaaaaccaacatgtgagtaatggaccgaggaggaagaaggcagcatttgtggagggcttaacatctgctttgggatatagggtcccaggtcccatagccagtgagtggcagagtggggaccatgcaatgcttaaatgagcacttctaccccatacacactttgccctacgacttacatattcataccacgtgtgggaaagggtgtggcatttaccacataaagatacttggaattcttgcctcaaagggtaagtgggttttccttctgtattagccgatatactttttaaaaattatggtaaaatatccaaaacgtacaatttaccactttaatcatttttaagtatacggttcagtggcaccaagtacatttgtttcgttgtacagccttcaccactatccatccaatacatttttaaagtgagtattttctaaaactatacatccaaaacaagagtgaaggaaacaaaaaagaagtagaaagaaaagacaggtagaaaataaacttttgggcatgcatttcagctgacaaaaacctttcatacgaattagcttctctgtgacatattcattattttcctagtaatgaaacgggaactgtgagacaccatgtgaaaaggcggcttttattgtttctctaggttctatactagctgtatccgcttacaaaaatgttatacaacccagtacatcacagccttccacgcctcctccataaaaggacaagtaaaatagtatttcttggaaagacaggcatttaccaatgcactgcatctagatggagctgtctccatcattctagtctgtttctaaacagggttttaaagtcttggcacagaacacaaagaatgtcccttagctattcagcatttagttcagctccacaatatatttagcaagatttctttgccccccccgcaacccccacccttcccttcttggtttaatgacctcaaatgtaccaacatcctgtcttacctaatcccctaacaagttctatcaaatgccaggacagaatcagacagcactgcaggctgtgagatcattcactaagaattcatttttattccaaaaattaggagtgccagaccatttaacacaatctatcacacagccagaaaattagcctagcgctttaagagaaacatttaaataacttttaaatatcttcttcctgacatagattctttaaaaacctgaagactctctccccagaaccagacgcatagacacaaaacatttccacatgatagcaagagctcaaggaccctttgaagacgatgtaggccccctaagaatccataaacctcaggttaaaatctcttgtaaaagaactccagtacttctctttgtctacaagcccctgtactggatcctgatccatggagcatccagggtaacttcttctggggccacttttgtctctggatgagaaacgacttgtttcagcttccggaacacccctacgtggcttctggtccaactgactgtcaacacggctaggcctctccccaattcagctggctactctgggaacgttcatttctcttactggtccatgacatgctggctctaccccagtgttaggttttgcttttcaattggcaatcttggatcctgtggtcccttctgtcttcctgtcactttccttgtggtccttgtggaacttttgttttaaaaattaaacctgttttttttttctttatcataaaagcaacggcctcccgtttgcacttaattcctttgttttttctccaaaagcatacttcagccttcatacctttgttcttgggaagactttgcccacctctctaagtggcaggtcgtgccactctctgttcagttcgggacagggtttctcctccaggagaagtgtggggcagtgaattaggaataagcctaaagtcagagagacccaggtctagtcccaacatagctgactttggccaagcaatttgaacaaaggctcagtttcctgatgtgaacaaacaaggaagattaaagccaacatatgcttttgttttattttttttagacagggtcttgctctgtcacccaggctggagtacagtggcgtgatcatagctcactgcatcctcgaactcttgggctcaagcgatcctccggcctcagcctcctgagtagctgggactacaggtgtgtgcccttaaaactggctatgttttttgtttttgttttttaaggaagactaagagagctgatatgttcacagcttctgaaacacagaaggtatctagtaaatggtgatgatcatttcattcccttctaactcttcacatatgggattcagcatacattctatattttagaagcaactcctgctgctttctattaggtggccaggaccacttacgtttggaggcttaggcattttttaacaggtttattgagatataatcagcatatcatacaattcacacctttaaaatatacaattcaatgttttttagtatattcacagagttgtgcgaccatcaccactatctaatatcagaacatttccatcatccaaaaaagaaaacctacacccatagtagttactcttcatttcctttccccttcaacccttggcaaccaccaatctactttctgtctctgtggattttcctattctacacattttgtataaatggaatcatctattatgaggccttttgtgtctagcttctttcactttaccatattttcagggttcacacttgatgtagcaaatgtcaatatttcatccctttttatggctgcataataatcaattatattcatctaccacatcctgtttatccatttatatcagttgatggatatttggattgtttccacattttagctattatgaataatgctgccaagaacatttttgtatggttagacatatttggacatgttttcaatttacttggatatatacctggaagtgaaatcgctaggtaggatggttaattttatgtgttaatttggctaagtcaccataccaagacttgtggtcaaacatgtttgggtgtcgttacaaaggtgttttttagatgagattaacatttacatcagtagtctttgaataaagcagattactcttcatgaggtgggcctcatccaatcagttgaaggccttaagaaaaaaggctgacctctcccaggaagaaggaatactgacagcagactccctttggactctaactgcaacatcgatgcttctctgggtctacagcctgctggcctaccctgcaaattttgaacttgctagtctcctcaatcatgtaagccaattctttaaaataaatctgtccctttcctctctctctctacacacacacacacagacacacacacacacacacacacacagacacacacacacacacacacaccctctattggttctattctctgcagaaccctaactaatatactgggacaaatggtaactctgtatttaacattttgaggaactgttttccaaaatggctgtagcaggacaatcccaccagcaatgtataagggttccaatttctccacatcctcaccaacacttattactgtcttttagactttaaccatcctagtgggggtaaagtggtaactcactataattttgatttgcatttccctaatgaccaatgatgctgaacatcttttcattcacttactggccatttgtatatctttttctgagaaatgcatattttagttgtccattacttgtctgggttgtcttttgagcattgagctgtaagaattctttatatattctggatacacatcctttgtcagatacatgatttgtaagtattttctcccatctgtggaccatcttttcactttcttaatggtttcctttaagcatgaagtttttaattttatgaagtcccatttatctaatttttcttttgtcttttgtacttgtggtgttatatctaagaatccactgcctaacgcaaggtcacaaaaatgtatccctatattttcttctaagagttttagaatttttgcttgcatttatttttgtgatccattttgagttaatttttgtatatggtgtaaggtataagtccaagttcattcttctgtgtgtgaatatcctgttgtcctggcactatatgttgaaaagactgttctttcctcatcaaattgttctggaacccttgttgaaaactttgagcatacgtgtactgtattcaagactacactatcttataggatgttttgaaaaaaggaagtgtgagtcctccaattttgttcctcttttgcaagattgttttagctattctgggtcccttgcatttccatatgaattttaaaatcagcctgtcaatttctgcaaaaatgctgcaattttgatagggattgtgttgactatataggtttggatagttttgccatcttaacaagtcttctgatctatgaacattggatgtctttccatttatttatgtttccttaatttctttctatagtattctgtaattttcagtgttcaagtcttgcacttcttttcttaaatttattcctgaatatttaattatttttgatgctatgtaaatggaattgtttttgtaatttcatttttcttgctagggtacagaaattgatttttgtagactgaactttcatcctgcaaaactgatgatcttattattcattctaataggttttttcgtgtgtggtttattttttcttctaatgaattgcagtcaagtatttttaagtattctgaatcacaggaatatcctggcacaaaaacccatgacttaaaacttcactataaatataaggagctcatactattatttgtccccttcctgtggcattgggtaatgatcctgcttttgggttatggtcttggtggcattcctactgctgctgacagcccatataatgatttgaaaagttcctgggactccaggatacatggtgagacacgaatctattttccatagaagtggtattataaaaagaggtcaggtttccagcctatccctaaagtctgtttaaaggggtatcattcattgaggatgccacagggtctggcctcgccattctcaaagggaatctaaagggtttgtttcaatgaaaaaccacattctaaaggagttttgaatgaacctttcaaaaagtgccctcctgggctgggcgtggtgactcatgcctgtaatcccagcactttgggaggccaaggctggtggatcacttgaggtcaggagttcaagaccagcctggccaacatggtgaaaccctgtctctactaaaaatacaaacaattagctgggcatgatggcgggtgcctgtaatcccagctactcgggaggacgaggcaggagaatcacttgaaccgaggaggcagaggttacagtgagccgagattgcgccattgcactctggcctgggcaacaagagcgaaactccatttcaaataataataataataataataataataataataataataataataataaaaataaaaggaccttccattcagttaggacttcttatgggcttttatgtagacacctctgctaacctacttcttctttccaactcagggctgactcctaatatacaatactttgaggggcagtggtagttaccttgcacaaaaactgctaaatttgacacaatacatatatatatatatatatatatattttttttttttttttttttttaccagactatattttgcttcaggttcaaaaactgatttctagccagcattcagagacctactttgcatcttgatccatgagtcactgatttgagcatgcatttgcccagaatacccaggcatgtgaaaggatcaaaatatcacactttgattgatttagaaagttattttctaccaccatgcagtctgagagtttctatgctgcatctgactaattggggaggtgtgggagcagagagagccaggagctgctgtgtggaagaccttgtccctcctcccaggcaccaagatcccagggagtagcaaccctgctctccatggcgaagtgtgtccgtgtgatgctcatctcagcattatctggttatcggagtcatcttttgaagagatcctggtatttcggtttgacaaaaatcgagaaacaatttagaaagaaaatcggatttgtgtgtaaatgaagaatattcctgaaaagaaactctgttacgaaactgaaatctggagaccgcggtggtgctaagttgagtcatcagttccctttacgccctaataattgacggcactttgatcacgatgactgctctgggtgatgcttttttgtttgctttttaaagtacttccttgtgtaaacaggttgtctcactatcatcttgaaaacatgtttacgtttgggggatcatggggaacatctgttagaaacagatttcatgcttttctgtcaacttagggaagtctgaatcctatttcttggtaatatacaaaagctcttggagagttaaatgaagttctactggaaaaaggactgactggatattttgattgttcttcatatatgtatttacaaatttgtcctgaaaacatccatttgaaatagaaacaggcatgaattattgttcactttttgtagatgcagacaatgaagtgtagagaagtgaagtggcctggtcagtgaccgacaaagtggcaaagagggggccaaatgcatcacagggacatactgacccttaatcagcaccaaataaaatccgcaggtatcaagggtcccctgatattatttccaaaaagatgttacaatccttcacaattttattgagatcactgattctggagaaggcaaatattagggctgagtgatgtatcccccaaaagagcagtttctttgtccaggtctcaagttagagatctaggtgtgtgtggagaggtggggtgttcagagggaacaggaacaaagcttgaaggagaggctgaaccaacaagaggacttcaggcaaaatactttactgaaacctcaacagtgaggctgctcctgctgtgcccagaagcgaggtgctcctcttggagggtgtgccaactcgctctggcccttggagttgaggcaggagcggtttctgtgtgaagagaaagaactgctgtcatgaaaaaatgggagatgctgcagattttatttaaatgcccacagacagcacagcccctagacccaggcaaggaaggactctgttctccttcagttaggccagggaggcattgttccccatcttgccttatgatctctcccttaaactcttccagaatttcccacccaaatggttccaagtgagctcccagggtcagtgtatgccctttccctcggtccttcctccctttggtgggctacaccacctgaagggtgagagaatggccaagggcagctatttacagagatatgcatgtatcttggacatgtgggctggggtgtccatgtgcatgtttcaagacccctgtaggatgggggactgggggagtgggaggagaaggagcaggaaagaaggaagcaggtaggtgtatgctggtttcccccatactaccatgttcccatttggaactctaaggagaccgataattctaaatttaaatctggccttccgaaaggtcattacatcaaggcagaaggacagaatgtattttatacaaccagtttgttagcctgattcataaattttaatatttaagcatacagcatatgagcttcaattgtgcctttgtctggagccctacaaatattacagccagacctgtccagagccatgtggatcagggctgggaaggcttcagattgcagatgtgcagttatgcattacacaagccccatgttgcattcactgaccctctggatgataaagtggaggtggctgcaaggcatttccagaatatcaaggtgctcacacaacaaaggtttccttcacttgttttgggaacactgtgctgaagacagcttagccaaatatttctctgtttggctgcagccaaatacatcagggtcttgctacaggccaactaagcaaaccataatttttacaaaaaataattacctaacactttcatctcttgtggtttctttattccatacatactttgtaatgtgtttatcagcagctagttgaacaacttggtgtaccagtgggagacaaaccagcagtagttatacacggcaagtaaggaccaaaacataggcaggaaaataaaaataccaatgaacattaggctgaactgtaagacataattaagtagctgtatatcaaatgcataaatatgattcttttttaaaggcccacacatattacacccactttcaggagtttcccaaagtaatttaaaactatttgatgttgcttcctgtttttcagtacttttatctgtttatgggggtggcaattctactgctaaccaaatgaacaagaagaaaagtgaaggatggggccattttcctggttttagtcaccaaaatctgctttaaaagactgaatttttagaccttaaattttaaaatttggggttctaagcttcaaagtaattatttaagacttatcccacattacaactacagattgcaccaacagttttcttagagttagtgagcctcttgcatcaactttgtttcctgttctctccaaagctcctttctaaagcaactgagcttcagaagagggaagaaggaaacagggcagaggggtttgctgacctcagtctgcattcaatacatttttctttttctctttgagacaaggactgctaagaaagggccttttcatattttaaagctgaagtttcaaaaaagctagaacaattcaaagatatttattccataaaattatcctcaggtaccaaaagtagctctggaaaagtggccacctctttttatttggccttcatagctcattattttaatcaagtagatggttaatgaaaagcaaacttacactttccatgaagtaaataaagtaatgtgctgaataatgacatttcagttgataatagactgcatatataatggtggtcccatagattctaacatcatatttttactgtaccttttctatgtttagatacacaaatacctcccactgtattacaactgcttatagtattttgtagagtaatatgctgtacaggtttgtggcctaggagcagtagactataccatacagcctagctgtgcagtaggctataccatctaggtttgcattaggtacactctatgatgtttgcacaatgatgagactgcctaatgacgtacttctcagaatgcatcctatcgttaagcaatgaatgactgtgctattatgaggtgacaggcattttggggatcagctagttcaatgtgtcatcaaagtcttgaccaccaagtgggtggcgctgattaaatacctctaatgagaagaaaggtactgccaagtcaattttggaaaattattatgtaccacatcactgcatacatcattacacagttctctctcaggccaatctgcctccttgtagcctaaaaacactggtttgccctacagggcaaccagaggaaggataacacctacatacatggtagggagtaagtggtggctccgcctcctctctttcctcaagtcttctcgctggatagttgtttctagttccttcaaatgttatttgacatggtttcaggttctctatcactgtcttgggccactgtcctttaaaaatatttaagttctaaatttaaaaatcatcatttcaatttaaaatcacattataggccgggtgtggtggctcactcccataatcccagcactttgggaggccgaggcgggtggatcacgaggtcaagagatcaagaccatcctggccaacatcatgaaaccccgtctctactaaaaatacaaaaattagctgggtgtggtggcgtgcgcctgtagtcccagctacttgggggactgaggcaggagaattgcttgaatccaggaagcggaggttgcagtgagctgagatcgtgccactacattccagcctggagacagagcaagactctgtctcaaaaaaaaacaaaaaaacaaaacaaaacaaaaaaaacaccccatgttatagccaacaatacatttgccaatatatctatcaaatgtgatctcaaataaagcacaattttattactgaagagtacatagaactatctttcaccttcttagtcctacaatgcagaccatgatttcattaatgctttgggcagctacatcacatctctggctaggattgagcttacagaaatgaaacccccaaggagtcttcacatattgctattgtgttttatttcccacattctctatttgtgatttttttttttttttttttagtgggggtgtgggatacaactgcaggtcttggcacttattcctattactaaatgtcaactcacttgggtctcgtcccttgttttcttcttctttcttctgtctattcactcggtggcaaaggagcacatgaaagagaactgtgctcaagggaatttctttttatcatggaactgtacaaggcttacaaagcagtgggcagtcagggtgaaaactaactcagtaaacaataccctttaggaattggctcagtgtgtatgctgtgtcaaatcctgcttggtaaattccaagaggaaactctgaataaatatttaccatatctatttatttctcctactgagaactatataagacaagaggatgttaaatgatgaaacagatttcaggatttttgctctccgctgagtcttgcccatggggcgtgaggactgatacaagtcccagtctcataatgaaaccagacacagttcacttccttttgtttcttaaaccaccccctcacctgggagatgtcttgaaatgacacagacttagttatgtatcactaacctgagatctcaagggaatgattggtattaattatcattagtaataataatatttaatataccctcctgggaaggtggacagcatgtgcttgggatggaatacagccctgactaagcttacctgctcaagctgtcaatccctattgtctcaaaaggcgaaaagagacattttaactccagagccatctcctcttccaattgacataataaggagaggtcaagaagaatctagttagagattagtggacgctgcattacacttccatggcttcctactgaaagtgaactaccaaagaaatcacaaagcactttctgtctaattcttcccttcttccttcccagcttgggaaacagcctgagatcagcctgagatcagacagaggatgctacctcacaagctggttatcaggtgggctctttgcttactgcagcccagaggaagagaaccaaatggttggggcagtggagaatgtctatcattgctctagacttaagatagtgaaaaccaaccaacaacccaaatacagaatctacgcccttcttgtcttacatcctctggaactttcttcaattttagctattccccagttaacctttttattgaggacagagggatgacctgccccattcttgggctttctgtttgctctttcccctcctcaggaatcaatcactattcttgagctctggatcccatcccctctctctcacttagagaatctgtttctgaatttaccttcactgtccctgggacatcaatttctctctcctggaccatttccactggcatatcttaaatcccttcttgatgccatcgcttcctccagaaccaatccctttctctgcccctgttctgaaggaagaccctcaaaatagttgtctttacttgctgccattatttcctcatttctctttctttccttaacctgttgtagatttttttttgtcactccagagaaactgcttttatgaaggttagtgatgatctccgtcttgccaagtccatgctcaactctctattctcatcttacaagacttctcaccatcacttgactcagtcgtcaacttcctccatgaaaccacttcttcttgtggcttcaggggcaccacactgtcctggcttctcatcagcttcacctgtggctccctcctctgcagagtcctcctctgctcctcctcctctgctccccatctaaatgctggcgttatcttggagctccatccacggactttctctttcctctaactatactcactcccaggcctgtggtttttgtcacctatatgctgaagtctctcaaatttattatatgttgcccctgacctcttcctgaatttccatatccaatttcctactcagcacctgaacttgtatattcaacatgcatctcaagtataacatggccaaaaaaacaattattgtttccatcctccctccaaacctgcttctttccagtctttttcatcacagctgcttgggacaaatatctgaagatgaatcaaagagaatatatagacttccatctgccctgcctccataatacatcttgaaatgaaccactttcattagctcagtgtttagacatgttggtctgaggactcctttacaaccttaaaaattaataaaatctccaaagagttcttgattatgtgggttatagctattgatatgtgccatattagaaattaaaacaaaactttaaaaaaatagaattcattgtatttgaaatacaataaaacattgtatattaacacaaatcacatattttatgaaaattaatacattttacaaaacataagtgagagaattaacacttttacatttttgcaaatctctctagtatctggcttaacagaggactgctggattctcatatctggtactaccttcaatatgttgctctatggtgttttgatggaaggacatgaagaaaatctagctcacacagatacatagttggaaatgggtgaagtattttcatcatcttttgataactgtggatattctctgattctacaccagaaatcaacaagtggtagcttttaaatgtggagtctgaaatgtggtacctgaaaatctgtcaataaactttttttactttgttaatattaaaatctattggtctatcttgcgctttgaatggatttttcacctgtgcataattttataacattacccatttggtcatttggaaatacttgttcactaagttcggagatctttgagatcttttgaatgtttcacatttcatgatccaataccaaattctccacattcattaatatcaccatcaatctcgtcagaaaaagtccttaatgtattgggaagttatcaagctctacagtagcagctatgtgttttccaaaatcctaatttttgtctcaagctcaaattttgtcattggcaacaaatactgtcagttgtttttcttgaagtatcagggcacttcattcatttttgataaaagatctgtcaaacaaatacccaaattggagtaactagagtttgtctgttagttgttcttttaagtcatattggcattccatgaaaaaagcagccagttcagcttgcgactcaaacaactgcacacgggtttttcctggagataaccagtacactctggtatacggtagaagggcttatgtgtccttcccattttgtcacacagaatattaaaaagacatcactcaagagttgagatttaataaaaacagtaattgttactgcttcatacaggatattctgaagtgaaattggcattctgttctattgtaagcatgtgctggtgaagaactagcagtttggtaccactatcttgtttcgtgctgaggtgccagcagttttccccaccattacatttcactagcagtgcacgtcaatactgcgaaaaagacagacagcatcttggtattactgtgaaaatagttttaaccttgcattccctgataagatcttgcgggcccccaggaacccacagaccacactttgagaactgtggcactagcttgccatcttctgtccaggccaccaccatctctctcccgggcttgcaaaaaagcctccttgatggtctctatgcttttacttttgcctctgtagaagcccttctccacagagcagccagataatcttttaaaaatgtatgtcagatcacatcgctctcctgcttaaaactcccacttcagatgtcccattgctcatagaatagcatctgaggtgcaggcccaagcctgcaaggccctggctgcccctattttctcattcatgcctgtactccttttctttccccttctccagtcacttgacctgtggatctctttaaacctatcctgtgtgctccagcctggaaggctcctcccccaggttttagcaggtagggttctcctcatttaggtctcatctcctgtgttaggcattactcaacctgcccatacacatcttcctatacactgccctcctctggattacatagctccatttattaccctgattgctctcatcgttctctgaaatgatattgttcactaatttgacagctggtttgttgtctgtatttctaaaacagaaagtgagtttccacaagggtaggaatcttgaatcttgtgctatgccatatccttaccatctaagacaatacttggaacacatcaggtgattaattagtatttgctgaatggatgcttctgtgagtgacaatgggtggtaggataccatgcaggaaagctctctgcatactgcaaaatatacacatgtaaggtaagggaaatgatgtgttacaacttgtaattctccgtcactagtacatactttgccatgtcaaatttaagtcatagataacattatcaggctattagtgttaccttcttgactatttttctgcagatcaaacaagataagagtccaagatctctttgtctctccccaaactggtctccctgttgttaatccttttcttctccaggccatcttctgcaatgtatgtcatttatttatttatttttttgagagaatcatatagtggctcctgcaagattgtacacaaaaagatcatccccaagacacataattgtcagattttccaaggttgaaatgaaagaaagaatgttaaaggcaactagagagaaagggcaggtcaactacaaagggatccccatcaggctaacagtgaacctctaaggctgaaaccctataagccagaagagattcacggcctatattcaacattcttacagaaaaaagtcttcaaccaagaatttcataactagccaaactaagcttcctaagtgaaggagaaattagatccttttcagataaacaaaggttgaggaacttcattatcaccagacctgccttacaagagatcttgaaaggtgcacaaaatatagaaaggaaagactgctatcagctaatacaaaaacacacttaaacacacagaccagtgttacttgcaaagcaaccacacaaacaagacaacaaaataatcagctaacagcacaatgacataaccaaattcatacatacaatactaaccttgaatgtaaacgagctaaatgccccacttaaaaggcacagagtggcaagctggatagaaaagcaagacccaatggtatgtggtcttcaagagacccatctcacacttaatgacactcataggctcaaaataaaaggatggagaaaaatctaccaagcaaatggaaaacagaaaaaaagcaggggttacaatcctaatttcagacaaagctgatttcaaaccaacaaagatcaaaaaagacaaggaagggcattacataatggtaaaatgttcaattcaacaagaacatcctaatatcctaaatataaatgcactcaacacaggagcactcagatttataaagcaagttcttagagacctacaaagagatacagattcccacacaatagttgtgggagacttcaacactccactgacagtattagacagatcattgaggtgaaaaattaacaaagatattcaggacctaaacttagcactggaccaaacagatctgataaacctttacaaacatctccaccccgaaacaacagaatatacattcttctcatctccacaaggcacatactctaaaatagaccacataattggacataaaacaatcctcaacaaatgttaaataaccacatactctcagaccacagcacaataaaaatagaagtcaacacaatgaaaactgctcaaaaccatacaatcacatggaaatgaaacaacatgttcctgaatgacttttgggtaaataatgaaatgaaggcagaaatcaagaagtttattgaaaataatgagaacaaagatataccagaatctctgggacacagctaaggcagtgttaagagggaaattcatagcactaaatgttcacatcaaaaagttagaaagaacaaccccaaagctagcaggagatgagaaataacaaaaatcagagctgaactgaagaatattgagacatgaaaattcaaaatatcaatgaatccaggattttttttttaaattaatcaaatggataggccatcagctagactaagaataaaagaaagaagatccaaataaacgcaattagaaatgatgaagagaatgttactactgaccacacagaaataaaacaaccatcagaaacgattacaaacacgtctacacacacaaactagaaaacctagacaagatggataaattcctggacacatacaccctcctaagactgagtcaggaagaaattgattccctgaacagaccaacagtgagctctgaaattgaatcagcaataaatagcttagcaaccgaaaaagcgcaagacctgatggattcacagctgaatcccaccagatgtacaaagtagagctggtaccattcctacagaaattattccaaaaaattaggagaggaaatgtctccccaactcactctatgagtccagcatcatcttgataccaaaacctggcagagatacactaaaaaagaaaacgtcaggccaatatccttgatgaatatccatgcaaaaatcctcaacaaaatacttgcaaaccaaatccagcagcacatcaaaaaatgaatccaccataaccaagtaggcttcatccctcggatgcagggttggttcaacatacaaaaatcaatacatgtgattcatcccataaacaaaactaaagacaaaaaccacatgattatctcagtagatgcagaacaggcttttgataaaattcaacatctcttcatgttaaaaactctgaataaactaggtagtgaaggaacatacctcaaaagaataagagccatctatgataaacccacagccaacatattactgaatgggcaaatgctggaagcatttcccttgaaaactggcacaagacaagggtgccctctctcaccactttattcaacatagcactggaattcctagccagctcaatcaggcaagagaaagaaataaagcgtatccaaataggaagagaggaagtcaaacgatctctgtttgcaaacaacatgattctacacctagaaaaccctatagtctcggcccaaaagctccttcagctcataaacaacttcaacgaagttgcaggatacaaaatcaaggtacaaaaatcactagcattcctatacaccaacaataaccaaactgagggccaaatcagaaaggcaatcccattcataattgctacacacacacacaccaaaaatacccaggaatacagctaatcagtgaggtgaaagatctctacaataagaattacaaaacactactcaaagaaattagagaagacacaaacaaatggaaaaacatcccatgcgcgtggataggaataatcaatatcattaaaatggctatactgcccgaagcaatttacagattcagtgctattcctatcaagctaccaatgatattcttcacagaactagaaaaaattattttaaaatttatgtggaacgaaaaaagagcccaaatagccaatgcaatcctaaacaaaaagaacaaagcctgaggaatcacgttacctgacttcaaactacaatataaggctatagtgaccaaaacagcatggtactggtacaaaaacaaacacataaaccaatggaacagaatagagagctcagaaataaggccacacatctatgaccatctgatctttgacaaagctgacaaaaacaagcaacgggaaaaagactctattcaataaatggtgctgggataactggctagctatatgcagaagattgaagctggaccccttttttacaccacgtacaaaaatcaattcaagatggattaaacacttaaatgtaaaactccaaactataaaaaccctggaagacaacctgggcaataccatcctggacataggaacgggcaaagatttcatgaaaaagacaccaagagcaattgcaacaaaagcaaatattgacaaattggatctaattaaacttaagagcttctgcacagcaaaataaattatcaatagagtaaacagataacttacagaatggaagacaatatttgcaaactacccatccaaccaaggtctaatatccagtatctgtaaggaacttaaacaaatttacaagagaaaaataaacaaccctgttcaaaagggggcaaaggacacgaacaaacacttctcaaaagacatacatgcagtcaacaagcatgtgaaaaaaaggtcaatatcactgattatagaaatgcaaatcaaaaccacaagagaccatctcacaccagtcagaatggttgttattaaaaagtcaataacattctggcaaagttgcagagaaaagggaacccttacacactgttggtggtattgtaaatgagttcaaccattgtggaaagctgtatggcaattcctcaaagagcaaaaagcagaattaccatttgatccagcaatcccattaataggattatagagcattctcccataaagacacacgcatgcaaatgttcactgcagcactgttcacaatagcaaagacatggaatcaacctaaatgcccgtcaatgacagactggataaagaaaatgtggtacatatacatcatggaatattatgcagccataaaaaagaacaagatcatgtctttggcaggaacatggatggagctggaggctatcacccttagcaaacttatgcaggaacagaaaaccaaatatggcatgttctcacttataagtgggagctacgtgataagaacttatgaacacaaagaaggaaacaatgaacactggggtctacttgaggaaggagggtgggagagaaagtagcataactgggtgatgcaataatatgtacaacaaatccctgtgacacatgtttatctatataacaaaccttcacatttacccccaaacctaaaataaaaattaaaaaaagagaatcatacagtggtgttattcttgctacttaaaaaaaggtgatgtgatggcagtgatggtcaataccatatggggaagaccaggtccacactttgtctacaatcaactgctaccacataagtcttcttggttaagtaatttgcgcctacagtgacagaataggtccctggatacacttctatgtagaggtgttctcactaggctgggatgcctctggagcacgctttgatatttgatagatgcctccaggaccaagggatgtcttttttctgtcttttctctgaccattccctatgtccaagtacatgtgcagcttcaacttccctctgtgaaaatgatagacatgggttgctccttctttctctggcacagatgaataatatttcccacactaacttgaagtactgtctatgaattcagccattgttcagaagaaagcactaagggttgggtgtttctcgtctctctggccaacttctcaaggtgcatgcgcccagcactctcaataatctttcaacatggaaatctgatcatgtcacttcccttcatcccactgatcttgggatgaagctcaaatatggcttccaaggctgtttatgagtaggacgctgctccctctacagcttcatctttcaccactcctcctaccctgctctctgctccagccatcttgaatttcaattcttttctcatctgggattgacaggctcattccttcttccctcttccctctctctggctaacgcaacctttaggtgtaagattagagagcacttctcctcagaacctttctgactcttcctgtctcatttacttctttactgttagcttgacttttttttttttttgtaattctatagcatcctatacttctgcaatcacagcatttgtcattcctatgatgaatgctcatttatagcctcctccactcaactgtaagctccttaagggcaagaactctgctcccctgtgcatcactgagccctagcacctagactgctacctaagacacaacaggtgctcaaaaataattatggaattatgaacaaaggaactaatccatgaatcccatcaaagacaaaacaggtaattctagagagtgtatatgtggttagcttttcctttttctttaatgtctttgcttcttcctagttcctgtgcttgattttcagcattcttgtttagcttttacttatgttttggatcaatatacatttctccattattttgtgtttttcgtaccaagcgagaataaactttaccttacctaagtttaggcccttttcctctaaagtctttttcaccttctctgctttcactattttctacttcatcccatattaacaagcatctaacttataaagtattctgcagtgtttattgactataatatttttcatttatgactcattatagtttcatttatgtggctatgttaaagacacttaagtctaatagagaatgtaagggtccttaaagttgaagttccaaaagcaattaaaatttaagataataagctttaaagcaaagccgtctcctatggacatccttcaggaatgtcatactaaccaagaaatctgaaggggaaccatctattattcatactaagggaacagggacaatggcttcacacagctgacttctctttgctactgactagctttttctgctctgtggataatacaaacaggatgaaaggatcttgatactccacaagtaaatatcctttttaagcagatggcttgcaagttaggaaaaaaagttgctctccagtgattaaaacagctctctggaagcccactttattgcatctaagtacattgctagtctcactgggagagtttattcctttcaaagatccagcctctcagctggtaagagttttgataaataattttgttctatctatatgtacctcttgttaatacaggcatatcaatgatcagtactcatgagctagaattgacttgttcatgttcatattgtctcagtaattcaagagacatgcatttgatgaatgaaaatgccttagtcatggaaagaccaagatgcgctcttaagaaaagttgaccatattaagccaacagggtcattgtaagtatctgatgtcaaagtggaataaacaaaggaacatctgttatttgcagttatccaagaaggtggcagcacagtacagtacagtacagtcattaaggcgtgggagctggggtctaaccagacctgggtttggttctaagctctgccattcactacctatatctagaaaatgttcctgacctcctttaaacccaataccataaaatggagataatagtacttaccaagtaagatttttatgatgattaaaggagacaatacatataaagtaaaatttgagcccagtctcaactatctatcaaatgttcagaatattttacctaaattaaatatatgttatcatccaccttcctttgcacaaacatgtgacatgatatcatataaaatgaagactttatttatatgcaagtctttaggtggcacttgcaagcttccatgtgcctatgacatttgggaacttctatctgcatgttgtaggaactgttcatatttatacctctcatgcccatgtggctacattttaaaatgattcagtcatgattcttccagggtctcctgtgggcccagctctgtctttacctaattatgttagtttcaatcgacaactataatacgaagacttaatgaggaacacaaatgagagtaattcacatataccaaaaatcaacttaaacacacactaatataatgttgagaaatgcattatttaaaataccctgtacattatagagaaatgcttatcttcaatcttccacttgctttgtggtgtcagtttactgagctattaatttaaacttaaaagcctgaaatttgaatatacagaatagctgaacagctgcagaaacaaacttataaaaatatatactgttacccagcacataaaaaagcaattatttattgaaaaaaatcagaatttaatattacccagtaactgcaaaagttgttgaaaggatataattaacatttactgaagattcttagggggtaaaaatattttaaataaaacaaatatttagaagttcttagttactagtaaaaacaatctctttaaacataacgttcatccaccttgaaaaaaaatctgctgactgggacatttctagataattttgaagctcaaaaacgccaaatctatcaaaatcagagagttgctcttggtttgtgttgtcacaatctgtgacgagacaatgggtcttgctcaggtcaggggaccattaaggacccaggaaagccagcaaaggactaggagattttgatgtactagaaagacacaggatcaagagtcagaagacctggctctcaccccaactttagctcttgctagcagtgtgactggtctcattcattcattcatctattcatgccagctgctggggacatcaatgaacaagacagacatatcacatatcacatatcacaaagcttattcattaaggcctcaccagcaccctaaaaatggggagaggaccgtagagttgagaagaagtttaaatcaaacatcataggaagaggtccatgatggtcaccactctcatgggatgaaatgtctttggcttcgtttctttattcatagaacatgagtacaacacctgctttctctatttcagcaggtaccaaactctgtgggcatttaacaatgtgttaaacaaatttgaaataaaaaaccctactttattaaaataaaccattaggaaaatcaaataagtacaaggttatcagagcaaagcttgcctagttcacaaacatcttcatggatatgtttaatggcccttcagaggaagccaaatatttgcataaccataagcctccttcaaatatcttgagacttgtcatgatcttaatttgccaaagtgggtccctatctatgtttggcagaaccgttcaaatcatctgaaagctacctgctttttgaacgggtttttactgatgaatttttgggaggagttcagaacctatccaatagaaagtcttttaaccaatgggccctaatcaactggatggatcaatcagcattctccatcccctgtataaaatatactgaccaatactgtggtcaaacgaatactgaatgttctctctcgaactctggagcacatcagctctctctgcataaactgttaatgtcagctatacttgctttgtaattacagaaattaaatattatgttggcccataaaatatgagtgtgaaaatagttatttgtatgaaaatttagtaaaattaaagaaatgaaagtaagtcactagaggaaatctgccattgaattagatatgattgagacaactgtgaaagattggggaaataataaaaatttaaaatgactttgcagtcagactgtgttgcaagtgtcttaaaaaattcctcacttaaagagactgaaaatggaaatcatgcaataatgtgcatgaaagattacatgaagttccaatcagcagacccaaactcgaagaaaaggcctcgagcccacatcaaaagattggcaaataactgttcatttgcaactttaggttaaatacatgatttaggctatgtagtatctttttaaaaaatgattcactgtttaattgatttttcaactaatgagaaaacacccagtcaggttagctaagagggctctgactctgtaaccagcctggaaccctgggaagctctaggtagatagggttccttcttgttgttttttctgatttttaaaattttctaacttttcttaacggttattatttgcttatttaaataaaaactattttaataaaaagatatatatctaaatttcagctatcttggagcaaaaagcctttgcattttattaattaattaattaatttattttgagacgagtcttactctgttgtgcccaggctggagtgcagtggcacaatcttggctcactgcaacctccaccttccgggctcaagcaattctcctgcctcagcctcccgagtagctgggatcttacaggcgtccaccaccatacccagctaattttttgtatttttagtagagatggggtttcaccatgttggtcaggctggtctcgaactcctgacctcaggtaattcgcccacctcggcctcccaaagtgctgggattacatgtgtgagccaccgtgcccggccacctttgcatattttaaacaaagaaaaaaagaggccaaatatttttactcatgtgttgcttaaatgtttagtgattctgccttttgccccccatttctggtgtgaggctacctatctattggtaagactgttttaactgcagttcaatgaatatgacccttccaagtaagaaaggctgaacctttccagctgtaaaggttgattctggggcagcagaaccctaccatgtgtgacaaggtttccttttactaatctggttctcctcctgtatattttgggaaatgacacacgtccaggcaaagcacaccatgggccaaatgcacatcctctctgcccttaaggggccatgactcaaagcacttcactggggatgcccaggggttgtgcatgaccagacatcggcaaagtatttttgagaaacctcctcctcaactaaaaatacccactgtgagaaatctgtagcgtgaagcaaggatcgagtcagtacaacacaaaaaaagagacaggcttgtggcagtctcagaatcaaacccagttcgccctcccttaccagaacaacaagaacaatcaaaaaaaaggtttacaggaaaggacttcttgaaggcagtaagatgggatacatggccacactcattttagtcttgtcttttctctttctccttgagggctgggatggggaaagtggccccaaatctgctcaaagtccaactgaacacaatcaataatagacttactatgacattttaaaaaaatttctactgagacattagttttattcctcagtaaacacctccctgatttctgcatcccaggagagcctgggcaaagaagagcacaggcaagaagtgtgaatgtgttcagagaaagtgttggcgaggcctggctctcccagcccctctgatggctgagaaaactgcttgacaagagggagacccaccaggacagaagcctgagcttcacagggcagacacattgctagtgtagctactgactgcccatggcaatggttctatttttttcatgggagaccttcctatagttacacataaaaaagagacataaaaccggagaacttaacggcagagaaaagtaaaatggtaaatctagaatgttttgcttaacttcaaaactgttgttgaatagtttagaaggagtagggggttgaattgaggtccccaacaatacaggtgtcctaacttctagaacctggaaatgaaactttatgttggaaaaggaccttcgcagatgtaattaagttgagaatctcgagatgaaatcatcctggattacctgagtaggccctaaatccaaggggaggtgtccttagaagacacagaagagaagacagaggagaaggccaagagaagagaagaagacagaagtggaggcagagattggagtcatttagccatgagctgaggaacacctggagcctccccagaagctgggacaggcaagggatgattctgccctgaagcctttggaggaagtgtggccctgaaacaccttgattttggacttcaggccaccagaactgtgagagaataaacattgttttaaattgtccagtttgtgataatttgttaagcagacctaggacactaacactgaaggctaggacagcttataagaagaccggtgggggccgggcgcggtggctcacgcctgtaatcccagcactttgggaggccgaggcgggcggatcacgaggtcaggagatcgagaccatcccagctaaaacggtgaaaccccgtctctactaaaaatacataaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaagaccggtgggaaaacataaagaaatttctattagaaatagaaatcttatgtgagaacaccaaaatcgcctcctgatgccccaaagcacaatgattctgaggggagcaggagggagggtgcgactctcctccgaatgcaggcctgggccccaaagctgatgaagaaacccgatggctgcatggggccagacctagtgtgagtcagagtcgccaggggaacttttgtcaaaaactgatatctccacttaagggtggctgagtcagaatttctagaggtcaggttggagaatccatgtttttcaaagtctcccatgtgattctaatgatcttccatccttaaaaatgatgggcccaggtggtctgctccctcccgctttcagtgtttgagaagcagatctgcagctgcagccaacttttaaaaaaacgtgtccaacaggctatttattatttaaaacccagctttattgtttatgtaaagcttgatacagatgcattatgaagtattaaacaatacagaaaagcacaaagacaaaagtaaatatccagattcaccatctcaggaaactttccacgtgtatttccaagtgtttattcacacagagatgtctgtgtacactttaacctgctactcagagtgtggtccacagaccagcagcattgacaacactaaggaaattgttaacaattcagaatttcgggccctgacacagcaggatgtactaaaactgcaaatatgttatatcccttgttttgtaacttgctttttccacactgtaatgtattgtaacctctgtccttggtaataaatacaaaccttatgatctttcttaatatatgtacggtattcttttatgtaccagaatttacttaatgagctctcatttgatgatcatttctagtttcccatttttcccaccattgtaaacaatgctcacctaaaaatccttgagaaagtatctttctgttttgtcattattatttttgggtaaatccctagaagtcaaccagtgtgcaattttacgcacactgatcattctgatacctaatgccagaacaccagcaagaatgcccagtgaccttgcacacgaatgcttgttccctcacactcttgccaacactggaatttttctaataattttaacctttgtctatctgatacttaaaaatgacacttcattgatttttttccttgcatttttccaaaagcaataaaaaagcttctcatacatttatcggccatctgtatttctcattttgtgaactgtccaaagttattttggttgtttaaaataacagttataaaagaatctgtggaattacagagtttagaaatatggtttagtcacaatgaaaagacacggagaagaaaaaaaaggaagagagaagaaaatgtgccataaaaaaagataatcaaaagattagtttgtgtgtttatttatagacaccagttacagcaatccagtgattaggcaaattaatgcagctgtgtatgatcacagctctgggatcagcccctacatccttttcaaatgatgccacctgtcatttaagtattttgcatttgcctttcatgttacatatatttcatgatgatttccattttaaaaaccttcttggttaaccctttgaaggttctcatgatatggattatcctctgccgtcaggaatggggtgagctaaccaccctcccaggtaggcaagagaaacagcacgtttgcctctgaaaaagaccaatcctctccaaacgttcacatcttaggaaagagaacagttgcatccttttcactgggtgtaaaactgcttctctgctcagaaccaatggaaaaaaatgggggacgggtcagatgctgtgtactggttgacttcagtggcatgtgcagaccatgcccattccaccgggcacatgcatccctcacacccccagggtgacctcaggcctgctttgtcacacaggcacccaccttgggctccatacccagcacacgcaacttctctactgaacaagtggcaggggtcttctcacagggcccctggaactctttcaacccataagacaacgccaaatgggtgaaaacccacctcatccacccctgccaccctctagttgctgctttatttgtgaattgagacaaatcagtcatcctcatttgctgaccattctctgcatacagtacagcaagagcactatgccaggtggccaggagggccggctgcagggaaacagaggaaagcgtggagagagaaagtctctaggctccactttgcgatctgtgggatatgaacaggtggaataaggtctttaataaacatattttaggatgttagaacaagcaggtcccattacaaaacctgaaggaaggaatttgaggacaaaaggagaagcatgactttatagaacaggttctatgtaaacacacaaagcacatataccttaaggattgtgcatgctaaaacgtatttcagtagctgctagaatgggaacaatagattattaacatgtttgaaagggatagggactcgggaacacatctcaaaaatgtgggtcagagtcaaggaagcttgctgctacagtgtcaacaatgctctcagtgctactggcagatacggcacgggcagaagagaaagctttgggtctgccacagttacaaagagttgtagacttcaatatttagttacgggatgaagaggggagaaggaacaaagacctttaaataaaaagaaacaaaagagtgaacatgaacatagagctacatgaagtgtcaaccctagtgaagtgattatgttttaactgtgtaaataaagttcaattaaatattcaacataacagcaataaaatgtaaaacactgagaagcatctctctctagtcagtgtttggcagatgtgttgtgtttttgcatcttgctctttatggtggtatctctaacaaatttaagggcaaaagtgatgtagaccatacattctagaaccaattctaaaacagcaagaagtggccagatgcccagtggcttaatcagattcttaattctacacactacatttatcctccagtctcactgaaaatctaacagccgagtggtcaaaagaaaagataaaactgcaaaatgggagtgccacaaatttctgctcctcctactccagccaacttaacttgacagggaggaggcagcctctgtttccttcctccctttaaaggggggatggcaagctgttgacaactcctactgtacaaaagagttgttcacactgcaaaagtgtttactgctcacaagtgacgctcaaaattaattcacagcagcaacaccagcagaaagctttgacagactgtcttatgtgttgacacagttatacgttgttgcataaaaaaaagtaacacacttaccctcttttccagcccatacacactgaagttgctccaaagagagactgtgaaatgcgtctgagattgtaaatgccaccctccaggtaaggatttcccgctccgctccggggttgatggctgcaggcatgagaagacgtggaccccctttttgaggtgaagcaaggctgcgagcctctcccccggcctctgttacaactggccttgctggtggtttttccttcaaaggcatttccctctagggcaagcctcaggcaccagggtgggaagtggggtagagctgtttattataccgccttggcagaaaaggagacgccaggataacagctttctgagacacaaataattcatcttcctcttcctttaaaaaacaataaccctgcacttaaaatggctttgggaggctgggaagatgtgactttcttgctcagaaatgatttacattaaaaaatcagaaagaatgtagtgtgatttaattatctcaagttacctgagatgtttagagttaaaaaagaagccaggtgggacagctagtatttggcctcatgtggaagatgttgtacagactctttggctcagctcggcgatctgctgtggtgtgaggctcttgcgtttgaacagttcctgctgagcagcgtcctctctgagaagtcacgggacttgaaaaatgaagaccgttgacactttaaaggtgcttctggcaattggaagtagccacatgtgtaaaaactacgcagtgcaaggactttctttagatggtgatatgtaagtatctattgaaagtaaggtttgcatggagctaaccccaaggaaaactgtggaccaggattcacagccttcccatgcacttttcccttatgcccccccatctccatttccccagccatggtccacaggtgcccaaagagctcttctggctttgccccttaccccatcctggcctatgcttctccttccctcttattcctcctcagcaccaaactctcctttcttttggtcttgggaaggaagtggaggaaagaatccatatcaagatgcaaatgactgacaatttaaggtattcatcctactaggctttggggattttttttccctcagttttaatttgtttggtggtaagagtctataggccaggcgccgtggctcatgcctgtaatcccagcactttgggaggccgaggcgggtggatcacgaggtaaagagatccagaccattctggccaacatggtgaaaccctgtttctactaaaaatataaaaattagctgggtgtgatggcgggcgcctgtagtcccagctactcaggaggctgaggcaggagaattgcttgaacctggggggcggaggttgcagtgagccaagatcgtgccactgcactccagcctggtggcagggcgagactctgtctcaacaacaacaacaaaaaattttacactgttggtgggactgtaaactagttcaaccattgtggaagtcagtgtggtgattgctcagggatctagaactagaaataccatttgacccagcaatcccattactgggtatatacccaaagtattataaaccatgctgctataaagacacatgcacacatatgtttattgcagtactactcacaatagcaaagactttgaaccaacccaaatgtccaacaatggtagactggattaagaaaatgtggcacatatacaccatggaatactatgcagccataaaaaatgatgagttcatgtcctttgtggggacatgaatgaagctggaaaccatcattctcagcaaactatcgcaagggcaaaaaaccaaacaccgcatgttctcactcataggtgggaattgaacaatgagaacacttggacacaggaaggggaacatcacacactggggcctgttgtggggtggggatgggggaagggtgaagggatagcattaggagatatacctaatgctaaatgacgagttaatgggtgcagcacaccaatatggcacatgtatacatatgtaacaaacctgcacgttgcgcacatgtaccctaaaacttaaagtataataacaaaaaatctataaagggttctggatatcaaatagttttagaaccactgtcccagactactggagccctaaaaacttcattaagtggtttcctacttctctgtcacatatttctttttcttctaaaaaaacggggtacatgtgcagaatgtgcaggtttgttacacaggtgtacacgtgccatggcggtttgctgcacctactgacatgtcctctaagttccctcccctcacctcccaacaggccatggtgtgtgttgttcccctctctgtgtccatgtggtttctttctttttttttattattatactttaagttctagggtacatgtgcagaatgtgtggccattttcacaatactgattcttcctatccatgaggatggaatgtttttccatttgtttgtgtcctctcttacttcctggagcagtggtttgtagttatccttgaagaggtccttcacatcccttgttagctgtattcctaggtattttattctctttgtagcaattgtgaatgggagttcattcatgatttggctctctgcttgcctactgttggtgtaaaggaatgcttgtgatttttgcacattgattttgtatcctgagactttgctgaagttgcttatcagttcaagaagttttttttttgttgttgttgtttgttttttgagacagagtctcgttctgtcacccagtctggaatgcagtggcgcgatctcagctcactgcaacctccacctccagggttcaagcaattcccctgcctcagcctcccgagtagctgggattacaggtgctcaccactgtgcctggctaatttttatattttttagtagagacggggtttcaccatgttggtcaggctggtctcaaacccctgacctcatgtgatctgcctgctttgccctctccaagtgttgggattacaggagtaagccacggtgcctggccagcttttgggatttgttagagtacaccgttgactggtggaattcctgctggtgtgatgagatgcagtgagaagtcgtaagacatcctccaagatagaggaggtctccttgatcagtataggcccatgcccaggatacaggtgacctaggatacaggtgttaatgcagccaccagctaggatgcactggtcctacctgattagggtgatgctgacacaggagctaacaccgaaggagcattttctcttttgcctggcactgtaacatatgtaccacatgcttttacaaatgtggttatcattcagtagagtatgaccctgagcgtgagtacttttagcattctcatttaccaaggtggaaattgaggcttgaagaggttagataacttgcttatggttatcatgctaacagaatagcagaactggaattgaaagccagctgtctggagctcatggacttctatctacctccagtggtttcatcccaataggaaccatcaattgtgaacagctggtacaggccagcaccccctgcttcaccatgggacaatactaagacagctagaggccatactgcagatgcagaggctttgcttacgcgaaggtggtgaagttagaagagcatgaaatctgaaggcaaacaatctggttaaaatcctggccctgtttgttgctttgctttaagacctgcggttaatctgtgaactttagttttttccatctataaaattcatctgatactacctgctttacagagttgtttgtgagaactgaataaggtaatacacatgcaaaatgttttgggaagcataaactcttagatgttattagtgttaatatggtcttttagtgggaagagtcactcctgagagcggaagattgactttcacatcagtatcacctaccccacctgacaaatccaggagtgggctctctggaggaccactggggaaaagggagtagaagcatgtaccagttatcagaggcatttactagtaatagtgaagtttgaccctaaaaaacaacacaagatgaattctgtgacatgtggatgagaaacatgaactttcaatgaattcagaaattccacactcacagcctgcttcaagtcctgtgtcagctgctgaatcagagtaggaggcatcattttcttgttggtgattacacttatgcctttgtacactgccggctggcttcaaaagaaagggtcacctttgtgtagttgactcctcattttgtaataattccaaaatgcagtagcttctcccaaagtagttcaaagacaccaacctgctgagaaccaggggaggccatcaggataccaaacttcctgcttctaatggcccaaatctcagcgaaagcctctgaatagataggcaagctccagaaggacagactgtggtcattaacgtaaccctttattatggcgaatctcaattctttttctacacatgagctcacccttcaaataccacatttatgtccatttttgggcgggctgaactaaagtttaaagcattatgtcattgtaaacaaacaatcacatgtagcgtgactctgtggaaaatacagcatttcaattttgtggtattggttccaccataagaaagggaacccaaatgatgaggtcagtgggccagctgccacggcaaagagaatgccaagctgagcaagctgctttcactcacaactaaaaaattaagctcaccattgttatgccagccaatgaaagtgattgcattcctaaattaagtggaaacagagcttcagagactgctcctccttagtattacatgttcatgccaggaggtcaagaggctgttacttttgctgatgatggacataaccacatccaggcttatcccatttagaagccactgctggctaataaaaagtaaatgaaaacacacactactgtgaatcaggtagcagtaaaaatggatacaacaatgtggtagatgttaagagaggaagctatctaagtcctagagactcatccaaagagtgtaaaccacgctcttctgccaagtggctacgacttctacttgcaagcaatgtagcattacgtaagtcaacctgacttggtcttcgtctattttttcctaaggcagaacattatccttccagcatgcaacagggctggtcataccccctaaacagctttgatcaaatctgggttatataccaagcatcagaaccagcctgggttacataccagccacccctcccaccttcctatgtctaccaatcatacttccaggctcctagacttggagcctcagggtcttctctgattttatctttctggttcctctgttgtcctggccccaccaatattcatattcagttttcaccaacatctcacagattactcctttgatatgtgcccagagtccatctctgtctctttactcttacagtcatcatttttgtgcaggttcctcctcccacccctaccgtggctacaccattacaagaacctctcactggtcttccatctctggtttgtgccccagcaacctgtcagggacaccaccattaagccactgtaatggttttcctgggcttacaaaagggcagtccacaactcagcttgtattcatggcccccaacaacttggtgccagcctgtctttccaatcctatttcccctttctgcctggctgaaccacttcttgagccctgcactgtacccactccctgtatttgcatatcatcttttcccacccaaagtgcccacttctgtccagttacgctccaagacccagttaaaccacatctcctccaggaagacagctctggtcattcctgagaacgtgcagcccagatctggatcactcacttggtgataagtagagtacttccttttgatctcttttatagcacttactgctttgatggctattcaaatgcaaattagttaatttcttgtctcttcaactagatttatcatagctcccagaagattatattttctacttttttatattttctctgcccacctcatcctttgtccttctcctcctccttcaaaacccatgtagcaatcataatattaaataaggacttatttttatctgtgtcctaaggagaaaccaggaaggaaattgaagtgaaatgcaagagtaaactcagcagagatgtaactggcccctctgggtggaagacacagcagaattgaataaacccagaattgagtacatctgctgccagcacatcttcaatgctgccaaatgccctcacctacgttaaatcaggtaatcttaaactcaggctttgagatataattcagtatgtaaggaagggagaagaagaaagaaaataattcctctttagaaaagcattttctttttattttattttatttatttatttatttattttttattgtactttaagttttagggtacatgtgcacaacgtgcaggtttgttacatatgtatacatgtgccatgttggtgtgctgcactgattaagtcgtcatttaacattaggtatatctcctaatgctatccctccaccctccccacaccccacaacaggccccagtgtgtgatgttccccttcctgtgtccaagtgttctcattgttcaattcccacctatgagtgagaacatgcggtgtttggttttttgcccttgcgatagtttgctgagaatgatggtttccagcttcattcatgtccctacaaaggacatgaactcatcattttttatggctgcatagtattccatggtgtatatgtgccacgttttcttaattcagtctatcactgttggacatttgggttggttcaaagtctttgctattgtgaatagtgctgcaataaacatgtgtgcatgtgtctttatagcagcatgatttataatcctttgggtatatacccagtaatgggatggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcattagaaatgcatttttgcccaaacacttcaaacacatgacttcgcttttaatccattttaatttagaaatatttctgtaatacagtatagaaatattttgatgatgtacatcagtgccctgtttgtagtatcaacctaggcatgaagagtgatgaaggctgacattttacaagaggatggatgagaagagtccttcctggtcggatggggttagtgaggcaggagtagcctggagcacctggtagagctggaatcatgggatgtatagttcaggtggtcaggggcctatgggcaagtttcactgggatggtaataattatgcagcagaaacaggcagtgcatagaataatctgaatggtgaccatctccagaatggcagcctccagagtgaggcttttcacagtgcccagtcttcttgaccaaaagtcagggtatttgctagaggagctggtatttatgtctaaatggagagctgtatggtctggttgaattgaagccttgtgcaaataactggcatgtgctttggtcagggcaggtagcctctgtgggagagggtctgacagggctggggcaattccttcccatcaacttaggagggtcatgcctccctgtctctggggccttgagtctttaacagttattgagatctacatggcagatacaggcagagcagatggcaggaaacatgggatgaacagatccagccttagcagtggccctgagatttatactcctggaataattttcagttgcctccttgagtaatttttctcctgccccaatggagtgatgaccgtgcaacagtatcacctccctggcagcatgctaaagccattttcttccgaatggagaatgaaactgaggcagccttgtcctccttcttcaaagtagttttcacatcctacaaacattttctgtacttgttgctaccattgtcctccctcctgacacagccaactaaaaccttatctctagcttcatcataacatgttccctccttgttacctacaccttgccatctatcgctcacattttgagaatctgcaccaagactttagattatgatgcttctgcaccagtaaccctcggctacacttctcgcctaagttttactgaatgcttgacattgatcagaattctgttcacaaacaacctttaaagtaaagcattaggctgggcacagtagctcgcacctgtaatcccggcactttgggaagctgaggtggatggatcgcttgagaccagcctaggcaacagggcaaaaccctgtctctaccccaaaacacaaaaaattagccaggcatggtggtacacgcctgtggtctcagatactcgagagctgagtaggaggactgctggagcccaggaggttgaggctacagtgagctgtgatcatgccactgcactccagcctgggcaacagagcaagactccgtctaataagagcagaccctactatgatcaagattactaggagccttgtattctctttgcattagccctcctcccacttatttcctcactcaccagacattcactgggcacacatcatatgctgactcaggtctcatggctggcggaatgtggatgatacactgagcctctatcatcgtctctgaccctttccactgccgccaggtctgtggccacctccactgctgtttctcaactctgccacggccagctcatcatccctacttcttatcttggctgcttcttgttttctactgctctgcctctttccttctttctcttttgtcacttcacccaagcttcctgaatttctccaaggccagttacccttcctcagacatcacctagccaccagggttctccttcctgtgatcagtcagtcccacgagcacaatcctgtgctgtgactctgcgctgttttgttgttgctcactgctacggctgagtttctttatctccagagatacctacataattgactttcttcttctttttataaacttcagggtcagttctattatggataaataggactattaacactggtggctgctttgtgaatgtaacattatggaaagagcctggttttggagtcagagagatctgatttcaaatccttgccaactgcagcagtagctgcggaatctctgacaaatcatttaagttcttctcagcctcagctgccacactggcaaaatgggactgataattattacctcatatgtttattttgataaggattcaatatataaaatgccttacacatagaaggcaccctagaaacacccctcccctggcccactatttaccttctccttataaatgtgatgcagaaaatggctatagtgaactgttaggaaggagaggggatatcaccggcaaaattaagcaaagctaataataatgaacagattaactacaaatgctacttaatattaccagggctggtgtatcataaaattgcacagattaagatgaaaaaaaggcaaaaattaattccacaggagcagcaaaaagcagtggtcaccaaatgtgaacataacagccaggccctacaataatgagcactaaaccatgctatttttcttttctttctttttttttttttaaatcctacaaagaaataggatacaaggaaattagcatgtgagaaagacttggacttatgtgaagaagctaacagatgtgcaaaaatctagaccagattcccatttcaaaaaggaacttgtagagtcactggacccatcctgacagtgaggcagtcctggtagcatgtcatgtcatcctgtgacactagcactgtgcacatacataaaaaaaaatgtctgttccagtgaagccaggaagagaacagacggcaaagcctgacacagacagaaagagggacaggcttgtcttgactccatctgccatttttaaacccaagacacaataacacctaaggaatactcacactaacatttcattcaacaatccctccactgcatgtcacatgaaataagttagacaagagcagttctgcctaaagtatatgctatctgagaggcatactagttctttgcaaatacctaaacagaactttcagatgtttctgctggagtgagaaaaaacatgtgcatttgagtgtaatgtgatggttttcaactgcttaaagaggccataaatctattagcttgaacttcaaagaaacaaattctgagaacatcaaaaattagggtggggcaaggagaattggatctaactagtttctccgttctttcccagaaaaacaatgagaaccaaaccaggctccagtctctttcttctcccaatttttactacttgccacacttttgaaaacatcttctacatacttctagctctggacaaacacattcttattcaagtttgtggttaactccatgagctcatttttctatgatttgttggacatttttatgtggcttttacggagaacagtttaaagtgaattatctttgagaagcctgtgggattctataattctctggtgctctccccaaccaggatgatttattccaagacaattctaaaccaagaaggaggactcgatgcccagacttctaataagattcggctgctgtcttgcaaagccaggcagtgtgggacagctggatgaagtgagtgggactaggcttagattgactctgtgtgatcagagcaagtgatttcacctctttgggactctgggtttgcaacaataaaacataagaagtggtgacagcgatgacttcgcagattctcccagccctaatactctatgagatcatgactattctaatcataaaacacacacacacacacacacacacacacacacacacagtctctctctctctccctctctgatatgttttctcataaccaaaggctcattctagatttaatcaaagatacaaatgggagaaacatggacacgaactggacagtgagagtccatttaaaccagcagggaggctgggcacggtggctcacgcctgtaatcccagcactttgggaggtcgaggcgggtggatcacccaaggtcaggagttcgagaccagtctggccaacatggtgaagccccgtctctactaaaaatacaaaaattagccatgcgtggtggcgtgtgcctgtagtctcacctacttggtaggctgaggcagaagaatcgcctgtgggaggcagaggctgtagtcagctgagatggtgccattgcactccagcctgggtgacagagtgagatccatctcaaaaaaataaataaaaaataaaataaaccagcagggggatacagacaaatctaatagtgggtagaaaaaggatccatgtaagtcttctccttaaaaaaaaaatcattgaaaaaaatcactataatagcttggagatgacaagccaatatgaattactgaggcgaattcattaaatccaccgaaggacacatcctaggagatagaacatattaaactgagaagacatcttccaggcccacctctccagctctaccgatttcttgccactaaataataactcccaacagctctatcaggaatggaaacaaacacaatgagctggggcatagtaaactcaataccaagaccccactttaatgtctgtatgtatgtattaattcacgtaccacatggttttgtaacaagaaagcggaatgggaaggagactggggtgaagttaaacctgcgggcctcaagtaggacacatcagaatgggagccaggttcatctttttgaaggattgtcctttccgcctcatcatcttcccgtacacatgcactttagcaagaagaataaacaggatatgcctacttgacttccttgtttgctctcagggtgacttcactaaaaaaaaaggcatcaaaggcctttatgaatccatcaccagatttttaaaaagtctgtttacagtgattctatatgcccatggctaaaatctggaatttttctctttttatcctttctccacccttttcttctttctctacgtcttctagtcatcctctgccatgttcctcatgattatgttttataatatttaatgttccatgtaaaaagtggtgtgccttgagctgtttgctggaagagccagacagacctaacacgtgatcataatttagtaagaaaagtgagggagaaggtggggaaaggtcccctgcaggctgtgtgcatgcacagtgactggctccctgaagacactcaagctgactacgtggagctgtcttcgcttatagaccagctgctgcctcatcacctctaggttgccacgccccacttactttctgatagagcagagttcatttgttagttctttatgcaataatctccctcccttttttttctggggaggaggggtaggggttggggatattcaacaaaccaacagtccttcaacagtatttgtgaatgaacacggtaagcgtgattgtgtaacagtgttcggatgtgtccttatcttccatttgaacactaccagttgtacttccacacaggtgggggtggaggtcctctaattcaactaagaaatcccttttagctaatgagactagagaagtaaaatgtaggaaagggaacaggaagataagtggccataaaatctacaagatcattgtttcagacggttaagccagactccagctaatagacaccctccccaaatcagggcttaaataacatggaagtttatttttctcatgtaaaataagtcaggggcaagcagtccaggatgatacggagcttcctcattcatcaggacccaagctcctgccagttttccttcctaccagttctaggatacagtcctcctcctcttccaagtctaaaatgatgctggtgctccagccatcacactcatgttccaaggaaccccatggaaaagggctgaagaagggtgcagtccatccctttaagacttcctagaactctgacgcacacttcttacatctcattggccataacttagtcgcatggccagtgaggctgggaaacacaattttggttagcagctcaactatacaagggattctgctaattggtagacaaagagaagaaagctacttggtgtcaaactagcagtgtctcccataatgaaggctttgcaagcttccttatcttctgaggctgtataatgggaagattagcaacatatgcaacaaatgggaataaaaagaacacaattacagtaaactatagtaatagtattccattgaattgaaggaaaatgatagatttttccacctcaaaagacacagggatactttctaatgatttaatgtcattcacaggaaaagggtaatataccacatggtactacagaaacactttggctgagcccaggtggtagcaaatattttcaatcaataggtttggacagtgaaatagacatgaaatcctctaacttgtatttaatactaattcagacatatgaggtggaggaagaagggagataaaacaaacatattctacagcaataaaatgatcatgctaaagagttactttgaattaattaagacactgtcacaagggaatgataattgaataattccctaagatacaatgaaagtattcctggttggtgcgacctggcaacttatattaaatactttaaaattctgcaagttcctgactcagcaattctatttctagaaatttaacttaagaaaaatagccatagatacacttagagacttatctatgcagatattcatcaaggttacttatcatagtaaggaaatgaaaaaaccttcaatatctaacaagaaaggactggctaaatagatgctagtccacaaattctagtgcagccattacaaatgataaggatgataaggttaagaaacttaaggcatggaaaatagtcataattttataaaatgtacaaagtaggttataaaataaaatgtattgcgtgatacatttttttttccaactgctcccccacccagggatggagtcttgctctgtcctccaggctggagtgcaggggcgtgatctcggctcactgcaacctccacctcctgggttcaggcgattctcctgcctcagcctcctgagtagctgggattacaggcgcatgccaccatatccagctaatttttgtattttcagtagagacggggtttcaccatgttgaccgggctagtcacgaactcctgacctcaagtgatccgcctgcctcggcatcccaaagtgctgggattacaggtgtaagccaccataccccgccccgatcccgtttttttttttttttttaaaccaatgaatctatattaccatatatacctgaatataaggtagcctcaataaatgatctcccattttaccaatgagaatacaaaataacaaaacaaaacaacaataacaaagacaaacagctttgctaacttgagtatataaactctgaggaatgtgataaaataatcatcttcttatgatacctaatttatttagttgtatatacatacttcaaattagattttacacatgataataggttgatttgtaagtgttttctgaaatcatattttattaaaaattctattcaggctgtgtgcagtggctcacgcctgtaatcccagcactttgggaggccaaggagggcagaccacttaaggccaggagttcgagaccaacctggccaacatggcaaaaccctgtctctattaaaaatacaaaaactagctgggtgtggtggcttatgcctataatcccagctatttggtggctgaggtacgagaatcacttgaacccatgaggtcgaggttataagtgagctgagattgcaccactgcacttcatcctgggtgacagaactagactctgtctcaaaaaaaatttttttttaattcaaatgtttcacattcatcttcaatgtcttcatcattgttagaacgtctttcgagtcatctaacacctctcattgtctgagatagaatctttgacttagtatgtgatgctgtcactggatatttgatcctgagtgggaaacatccatttccatcatattaagaaagctggtgttatcatttgggctgtatgtgatctctgccattgcatcacttattgtgttgttcttaaaagtgctctatataaaaaagacttgctcagcatggcatccaatcctaggctatggggtcacatctttagctataatggccaagtttctgttgaatttcaacacttatttttacagcaattctatcaagtgacctctataagcacccaaaactcaagctgattgaggtgatttcaggataatttcaggactatttgcccaaacagtactttgttattcaaaataaaataatagaggagtgtccataatctgagacttacagggagttgattataagatgatgcccactttaaggataatgtttggccaaacaaaacccccttcttgccttatattcagacatatttcatgtatacacaatgaaaaaaagattatagacataaaatctctataaagtctacagtggttactgctgggtaggaagatcattataaaagatttaaattttcttctgtttgcttctattttctaaagtttcaatgagtaagagtgactgtgataattagggaaatagtattaagaataataaaaaaaaggaagagacattatacaaataatacattggacatgattagaggcaggctaagctagccttgggtgtgatttaaggtattccagctaaaaagaattccctattggcatgaaatttgtcactcttctgggtgacagccagttgcaagttagttaaaatgtagatgtgtttcttagaaggctaactcatttatccactatcctccattcactgcagattcctttatcaaattcgtttccagcctcagacagggtctggagggaacgagacagtgacagggataggtctgctttatgtgaagagagatgatcagaaaggtcaggcaccagacacccctttccttctactccccataaagtcttggcagctagagagctggggaataggactgagatggtacaatgaaggaaaaattaatagtaacatcgatgacaatatgaaggtagtgtggcttgcagttaagaatgcagtctctagaacctgcctgcctgcttggttcaaattcacctctgcccattatcggttgtgcaacgctgggcaagttacttcccttctctgtgccttggtttcctcatctgtggaataaggaaaacagtttccactccacaaggttacctgaaccacacctccccaccctggtaggagcagtatgaaaaaggccaaagccttcaaacctttcatactctgaccccagtttgcctttctgaaagcatctcttcaacacttccttctgaggtaccctgaggccattccatgaacccctgtgcacctccacatcctccacttttgctggcattctatctatctagaatgtgcttctcctctttggcaatgttttcctcatccttcatgaaacagctgaaacgtcagctccttgaataagccctgactgagggctgcccccattggttggtcaacaaatactaatattaagagcctactatgtgtcaggcactgtctcaggcactttaaatacagcagtgaatgaaactcctgccccgaccctgctcaacactcataatcatgaactcttcagcatccctgtggagatctgctatgacattactatatatgttatagaactctttcccctgttagaaggaaagtctttggagaaaggggcctgatcttacctgtctttatgtttctagtgtccagcacagaacttgtcacaccaagcacttaataagtattcgttggatgaatgtcatcctgaaaaattttcatgctagaaaatgctcacctacaactactttgatggcaactctaaataggaatatagagatgattcatctagagatattttttcctttatttaaaaaactgattccaatggcttgccttttgggaaaaccacatctgttaattgtgtacaacacaaagaaaagtctatttatttagctctggatccctagaactttatacagtgctgtgtcatcagtaggcactcaataaatgttttttgaaggattgggaaggacagagggaaggagggagggaaaaacagagggaaggagggagggagggaggaaggagagaaggagaaaagtttgggagccaagagaagagctggaagagacagagcattatccctgaggccagtaaggcactggcagagctgccatgggtctggccccagaggaggaaagcaggggttgagccaaaaaagggagatcctggctgggcctgcccgcatctgaggcaggtttcactcctcaggttcgggaaagcaccttcaggaacaccactgtttcagaatgacagtcctgagatatttaaacaatgactgggtgagtaagccccactgaagagagtaataaaaccaatttcttacaaatattctagaagcaaacataaataaattcgtaatccttcctgacacactccatttggggagttaggcttcctattcacctacaatgcaggtgagtaaacacaagtttttcaaaagaaacagaaacatgcttatgttgaaagatcccagagagcgatcatccgtgattgtaaaacacttctcttccattaaccaacttctcttccatttatttgtctggattttaccaaggagacaaataaagatgggagcagcaacatccttgtagacgaaatcactaataaaaaaggatatagttcccagagatcgtgacctttctgtaccactctctcaaacactccctcccaccccccaaataaaccacatataaactgagattatggtggtgattgcagatgcagtttcagggtaagaagagactaaatcagacactgtatgtgggagagacaagcgcatactgcctgacacatagtgggtcctctttaaatgtttaaagtagaaaaaagcaacaaaggaaagaatagctcatctaatctgtacttggaatttctcaaattactcataagagcacttaaaaaaatccagaaagacagaaagtatgcaacccctgtcaaaatagtattaagtgctgaaacacagacaaagataggtaattaactgctactagcttagatgaaaatgtctgcaatcttgttcaagtgcttgggtaatataaagcatttggagataaacttaggaagatgtgggggttgcaagtgaatagaaaaagtgtttacaaaactagtacatagtcagctttttagaaactagttcacacacatataaacttttcagtgaagagtttaaaataggatcaaagctctcccagaatgatggaaaaatgcttgacaaggcttcttgaagctccctcgagggtctctttctgcagatatatcctttaaaattgtgtgaagtgacattctcccaaatatgactggtgtgccaggtctttaaatcaaatcattcatattataatatgtgaacgcattaagtctccctctgacgaatttggacatcttgacccactccactacaaagagtaggatatcatcttccgaaagtacatgattggatttgcacagagaggtaaaacacatgggtttaagtaagagaagacagtgtagaaggcagctggggagaaaccggtagaggaagacaatgtccttgtgtgtctggcagtgtcattttgtgactttttctctttgacttccaaccacactttatattttcaactgtgtaaccaataacacattaaacttcaataagagtttgaagctagaatttttgctttaaaatttttacattaaattctatgtatagacttatgtgcatgtgcacagaaagagaattctgaagatgtgaaagatgaataatttatttttaagattaaatttaggggtagtgaggtttggggttaaatctaagctagaatcaatagtctttcatcaccacgtgtgaccaaagatgacccgcagaagtgatgttacctgactctgttgaactctatgacataatgtactgaccaaggtcatgactctgattcctatggcttgccttttggacaaaccacatctgttaattgagcacaacacaaagcaaagtatatttatttagcactctctctcttgcgtgcgtgtgctctgtgtattcatccttgttttccagtggtgtctgtcctcaaggaccaaagttgattattctatacgattctgaggcacagattctgtcactggcatatatgaaagttttctaaaatgaaatataaaatcagaagtgtctgaaatggctgtaactactccatgacccataactgatggtcaactcttccaagaccttgttctaaaccagatgatcacacatacttaaatagatgactggtctcaacacacacacaaaatagaaaattgaaaaattagtaggtgaattgtttcaatgtgaataatcaaatacattaatacttctaggtaaactctttttgatctctttgttgtttcttaagcactcagatattaggattaagatttactaaaagataggataatgttaaattaacaattgtcctgtaaggaaactctgggagtaaactataagaaataacttctaaaactaactttacaagtggtttgtgaatgacgattaaaactattcatttcagatattagagccaatgacagtgaagaaataaaaaatcttgcagtagcctccaggagacgtaggataagtcaaagtgaacatatcatagctcgatcctactctttcatttctactgctacttaaataaaaaagaaaaaaatttttcccgaaagggtagaatatggcagaaacagtaagtaccaaacccagcaaaaagaggaagttggtttcttacatagaaatgggtaacttgctatatgcaatatttaaaaaaaagccactgcaagaaggggcagtaataaaaataaattattttccttattgcaaagtatctgagggtaggaaattgacccaaactgccagagaatgaggaagcacccttttcaccctgtcctcagaatgttatttcataatttatcccttcctcagatggcctttttctgccacgtccctgctctctgctcttcagctgtcctctctccaaactcctcaattaaattatctcacgtttttctctgatctgctgttcgcagcttgtcacatcactataccataagccttcccacatgctgccgtaacagtacacttggagagccgttccgcggcagccactcgctggtatcctggatcccgggtgcacgagggtaccctacaacagtagtttcattgtctagaaggagcaaggccaacccacctagtcttcttctaaggagcatatgggttcacatccctaaaaattaggaaatgtgctatgatcaacctgtttaagcaacaacccatgtgccagatagtcaattagaaaaaaaaattgtgcttgtcttcttcctgttgtataaaagaacaggcagttttctcctgagcaccgtaattgaaaaaataaagttatctggttatcacaagtgcacagcttttcatcttgtttttgtttctgcaaataaataatttgggtctgtaagacatctttcacaaaatgatgtttcaaaaaatttttacagaatactctatctagaatggcatgaattacccaaaacagtaatacaaagaacctacatgccaaattaaaacattaaatcaaaaggccaataacagaggaaatagaaaatcttgttgcaaaatgagatgagattacagaaagacacacagatgaaatcctctagtttgatgagacagaggtacagagaggctcttcccaaacagtccaactttaaaggaacacctcattgacttaaaggtggcaatttacaggaggcagaggagctaatggctgacaaatagtgaagcatcgtgcactagccaggaagattttccattcaaggagtttaaaaacataggagacttggagccacatccacccaagtgaggaaaaatgttatttttttctctcccgtacccaagtaggacttactgatctaatcagaaaccaggtggtcaaagcctcagatgcccagaggggaggaaatgaacaggtccatcctttcagctgggaaatatgacaatattgtaccaaacacattaaaaatatgcatgcctttcgatctggtaattccatttcaaggatatctgaaaagatagatacacagaagatgctatttgctgcacttttcataatgctctgccttgtttccaacagtggaaaaactagacaacggtggaaaaatgtccagtaataagccatgaagcattcatacatggattctagacagatacttgaaatgatgctctagaggaatattcaagtgacatggtaaaaattgaagagattacaacatttaaaaggatgtgaccaaaaagtgggaatgtaatggttaagtgtctgttttacacacacacacacacgcatacacgcacacctacagtcaggactgtaagacacattcaggaatggtaaaattataagtgttttgattctttccttacttgcctttttttgaaaacatcttttataaaaacatgttgttttttgataaagagaaaaatcagtaataggttttgaaaaaggaacacaatcaggtggtggtctcgtgtacagggacctatgaaacaccagggctggaagggccttgtggctccctgagctgcttctctcatttgagagacgaagaaccaaatgcttccagagtgggaaggttctgacctcagaaaagctaggcaaggcatcccagcaggcagaacaagagagggacacaggctgctaagggttgccccagcagggctgagtaagtaggtggagtggaagtgatgcggatgtatgatttgagagtgtgagttcaacagaggtgtgagtccaaggtgatgctgggcttgggaacaagaacaaataagaacgtaagaaaattaggacaacagagatatgataaggggcaagtaacctacatttttttccagcgcttctatgtaaaaggctcatgtttactcatgtaatgctcaaaagaactcagaaaataccagtactcccaactcactgttaaggacactgaagttaaaataactagcattggtctcagggctagcaagtaacagagctatcatttgctctcaggataaattccaaagtccatcttcttcctaccgtgctacacattgtctcctctgtttgatctcctgagagaaatatctcgattcatacaggttacttatcagctgaggcatctggagtttctattgcatcaaacatctcagttggtgagtcaataacatgggggatgcccattgtaaaatccagcataaacgaaacattcaaaaggatatattcatggaactggaaaggccagctccccctgtgcatgatggagagaagggaagagtggtattacaaaaatccaattgctggatatataggcagatgaaaatcttttcatcctgctctaaaggtatcaagaaatgtggggtcctttccttctaaaacacagcctgcatctttcactgggttccaattagtctgtccttgaactgccagaagtccttagcattaacagtgagctgctgctatcctggctatcatttagggaggagcataagagcaggcactgcaatatcacctctctttggtctgggaaatgggcagcagacagtccagatgccattaaatgggaggtcttaatcacctattagctacttgcagaaaccaagacatgattactctccttcaagcccccagtacttttctcactgcagggttaatgaaaacattaggtctcctcctcttccctttcttattgttctgatcatctccgaggggtttgattagcaccagagccttctctgtagttatccctgtctacagtgataagcaaccaagcccacccctgcagcgtctctcatgcccgtgccagtgtttataatcacatgcactactctagtttggacttttattggacaattgctgtaccctcccaactggtctccttgtttcaattacccttctacatcatcagcaagaccaaataataattattttacaatggataaaccctcctcaatggagcctcagagtctactgagttaaaggtagttttaattcttccatgcagttttcaaagttgcttgcaatatagtctcaattttactttctagtcttattcacatctactatctaacacttatcaattactacggccacttcattacttcaaatgtcctgagaagcagacactaacatgggattcgatgtgctagagatttcttggggtagggtgcaggaggaggcaagaaaagccttcagatcgagatgcaggtctggcccctgggaaggagaggaggaaggaaggaggataggctgtgaagtgtcttggagtgcagcatagttccgagaagggtttagccatgtcaatggggagtgcttgagcccaagcttctcagtggaggaccccttgtgttgctggaatgggcatgccttacttagcacccccaccatgcatggtcaatggctgggagtagcccttgggaagcatagccttggtgccaaaacagtggtgggttcagaggggcagcagttgggatgtcagtcagtcagtcagtcagcggtgttgcctaaagcaagagagctgagcggtgcattttcatggccaccacagtcactgtataattcaccattaaactgggacacttttaagagtagaagagggacctatcaataattacacgaggcagacaggtagaaccagggtccatctaggcaaactagaatttattgtcactctatggcaacagatgcatcaaagggcctactcagtgttgactagcatagatctttccactttttggcattctatcagtttggaacagttttataacccacaccatggctacagaaatcctatgcgttttaaaactgacaaatgtcatcttctgaatgttgtcttttcctccttggaatcatttcgtgtgtccctttcctgaaatactgaccctttcctgctatatattttatttttttgagacagagtcttgctctgttgcccaggctggaatacagtggtacaatcacaccttactgtagcctcgacctcccaggctcaactgaccctcctgcctcagtctcctgagtagcttgtactgcaggcatataccactatggctggctaattaaaaactaaattttttttgtagacacagggtctcactacattgcccaggctggtcttgaactcctgggatcaaacgatgttcccaccttggtctcccaaagtgctgggattacagatatgagccaccacatctagcctctgctatatattttaattaattttatattatctgctcctgccataagacagtaagatctgtaagggtaggaactatgtgattttcagtttttctctggttgactaccacatcttgcagacacagtggacaccaacagaaggcatactcctaaatctgtagtgtcccaactccaacttccttatggcttttcagttttaaacaaatacttgagtcatcttgtatttcttaagtgcaaattttccctatgtctttatagttcagacagagaattcaactatcagccaatcttggtgaatgaattcttttacgatttgttaattactttgtccttttttctgctaaaagcctacattgaattacttcaactttgcctcaaaagaggactaacaaattgctgaatataatttgcactttaaacaataaagctattaatggcattttagcaagaacacccattattttctctgcagcaataaatcagcatttcatctgttataaattgcttggtcagcttcaaatggctttagaataaatctctttctcctttctgcctctgctgtccatgacaaagaaaggaggcagaaggtaaccctgtgttctgcattcccgggcatataattttcatgctgcacgactctataatttatttctagcgataagcatcttgtagtgctacactggctgcatgctcacacatgttcaaatgcacacagaaagacacaggtaactcttcagcagtaatgctgaaataaagaggcttccaggtgaagggctcagtgactgtgtatggtaaaattttgatgccaactgcatattttagtaatagggcagctgtaaatataaacacaaatgttctaataatcagactatttttcagccccacctccaaaatatgggtaaattccacaggatgattagataaggcacagggttatcttgttaatattaggctattgtacattcacatttctgagaaatatacttaataagttttactttttaaaaatcattttcattgaaagtcttgaatgtagcatagcatcacaaagtaggtgcctaataaatatttaagtgaatgagttaacagaagaatgcctttcatttagtctgcttaatgcttaagtcacgttatttagtgttattcattcatcacaactaaatactaatatgtcatctatatttactacaagctagtccctcttctctagtttataatttgctgatacttgggggttatgtttactgtcagttatagcgctaacatttcaaacataaggaggactttgtgaatattactatggataatggtgattagctgcttttggcatcctaggcagagtgagagaaaacagacttaagctacagcatgagggattcaagttagataagaaagaaagcgttctcgtatcaaatctaattaagcaccagagtagatgaatgaagggagctatgaaacattctttcttggaagtttttaaaaataagacgaaatctcatcagtacatatatcattaagtatgctcctccatgaagataaggaggaattggttctaatattctgtgaaaggcaagtatatttattaaggttatatctaaaaatataattttcagagtatggccatttcatgtaaagtactggtatcaattcatagtcaagatcatgaatcacacgcccaagtggtgacttatagttctttcatttactaggtgactctgggcaagtcactgtatatctaagatccagattcttttcctaaataagagtaatcctgcttctaaatactactcctcaaaataaattaaatcagaccttgttgggtaagttatattctgaataaataagcagtagaaaatctgattccttcaatttcaagtcatttcaatactatattctcagttaatgtcctgaaacaaataatctatatataaataagagtttttctttttatcacactagtaacaattagaaaagaaacactaacagataaattttagattgtggcaattaagtgaatagcaatctgatagctataggatttaccttcaaaatccaggcacattcatgtatttataccaatctctctccatgctaatattcttacagaggaattttattaaaacatggctgaatctatcatttcagtattcccaggcacaaggcagtgaggaaataaaacactccttctatgttatggaacctagagaaaataattctttcctaaccagtggggtacattttcctccttgaggttcgtaagacaaattttgaaaaaatcatggtgcagactatgtaatttacgcttaaagtattgtaactgcttttgtgttaggattcatattatgagaaaattcacatatattacccttttacggcttggttatagatctattttgattatggtcattggagcctaaaacatccacaccctaaaaagaacatatcattccaatctctatctcttttaaaatagggactttgggctatagcatgtttttctcaatagcccaactccctactcagagatactactataaaagctgtattttggctgggagtgagggaggaaacaaccctagctatttgcagagtagaattgcaggttccattggcaaaaaagtgccagaagtagaggaaatgcaggttacaaagcatacagaggaagagtgacagatgagatgaacaaaattgattcatggagagaatcagatcaggacaaagggtaaaaaagtctcaagagcccaatcacgtcaaaaagatcaatttttaggagaagtgtagtcaatagtgtcttaaaacaaaattagaagtggaagcaattttgaaggtcatttgaagagtaatctactccttttatagatgagaaactgagacctagaaggagtaggtgactttctcaaggccactctatactaggaggtgacagacatgtgctgcacaattcagaataatgagtggtaggttcagaacccaaaaagttcataatgagccagggtagcccccttcctctttaagggaccctctctctaagcgccccagccttgctcccaaggagcactgcaccttctgaatctggtgagtgatggggaacaacaggccaggaagggaggaagtatatctgccaatgctcaaaacgtgttcattctgatggccctagttctagcctgccttttgaatagcactgcgttagtcagtactggacaggaagcacaagtgttactttggcagggtcctgtccgtagaaagagacccactgagagcctcttgtgtacagccacagacaatgggataacccacatgctggcccctcccagtcagctaccaaggcagactgcggaaaaggggacaaactggcaggaagaacttgaagcaggctcaaccataagtcaggttgcacagcagacatgaggagaaggggcactgcaaagggagagctagggatcataaatccaatgctatttgaggcggagtgtctgcgatctgtaatttatatggatataataagctccatgcctaagacaccgcagccccaaacaaccaccaccaaaacacaaagcacatgtttaaaggggtgaattacccaaaacatcaggtttctccacatggctagactaagaaggctgcaaaatctatcactgttatgggctggaaagccaaccaggagagccttcttaggacttctaaagggaaacattctggatgaacctcttggtcttgtaagaagggaggctagttatgtttaactataaacacatggcagtaggtgtcagcgatatgttccattcgaagactatataataaacatcatttttggaaaaggaaactaaactaagaatagataacctgagaatgccatgcaagggctagagcaacttcccatccttttgcaagcatttagcaatcaggtttcgcctttagctgaactcctttcatttcatgcaatatttaatttatacagagatgattcatttgcaatagtaaatcatcacaacattctgtaaaaacaacaacaataacaaaagactagaaatataggaggcctacaacaagcacctaatttaaaactgcagcctcttcctatccccaaattggccctcctctttcctgctctgtttttaaatttttttcctagcaattaccaccttctaacttactataatttgcttgtttattgcttattttctgttttcctccaatagaatagaagctctaagagggcagcaatttgtgtctgttttgttcacagacacatcccatgcattgagaacaatgcctggcacaagcaggtgtgcaaaaatgctggccgactaaaaaaagtcatggatgggttgtcaatattgcataaagtcctattctcagatgacaattgaggtggcctcatcactaactacaagagattttttttccccaatggaaatcaccaaagttttaaaaaagattggaattccaaggttagtgagggagttccgctatctgatgaagcagtgactcacctgaaaagttccaggggacctaatcccaatgtgcatggggcccaacctcctgaccagccttgcatatctgaaggtggggagggaaactgaggtaggtatcgagtggtgtaaaaaaaacgcttcacaagagtttttctttatagccttacaattttaatacttttgtatagcacttcccaggcataagcaacacttccactgcatcttactctactttcataacaacccctgtaggcagtaagaattatattctgaatcttggagagtgtgctacttgcccagggtggttggccaaagtgggactgttcctattttggtttaagaatgcaagtttttgggttacaaattcagtcctttttctacatggcatggccaaaaataacattctcaaagatgggttacttagctgccccactctcatggtttacttcaggggagcattgtacaaaaatgggtgattgtctagttttcattgccaatatgctgggaaataaagaaaataatgagagaacaccaaagtttctactaccaaacaagtaggcatttcaggtggtctttacttagggccttgcatttcttaggctaagttgtgttatattgagctgaggtggaggactatgaaaaagaaaggcagcagatttcacagggaccattcaaagccctgcaggaacaacaacaacaaaaatgctatgaaacaacacggagtaactcttgcataaaaatggagaaaagtagggtctaaaatacatgcaccaaaacccaaaaaagacatggaatacatgacccaggcggccctgaaaatctcatcctcacacaaagaagaactgtgcagcatccagagagaagaagggatggtagctggggagatgagacctttggagaattaactaccaaaggggatgaatcagctcacgtctgacaacacctacagattctgtcaaacctgccgcactcttcaagagcttcaaggctcacaaacaggaaattgctgggtatgacttaacctgactctcaacctccttagagaagagcttgccccaaaaaggtatgaacaaagtgcagagccaaagggcaagaggtgaagaagaatacgagctcacattccaggtgtggggcatttagtggaaggaaacacttttcgaaacatatgagttatttgggatttagcattgggctcaatgccaatcaacatattcacttggtagaccaacacttcacagaaatgagaaaagagaaaacaattacaaaggaactctaagggcacaaaaatttgtgaagaagtgagattgggttgttaatttattcattcactcatgatattctgcatcagattattttcagaagcaaaaaactttgaattgacctaaacagtaagtaaatttattattttacacgacagagttgcctggaagtaaagccaacccaggactggtttagcccacagctcactgatatcctcgagggcctgggttctttccatctttcggtcctattttgtaggttccagggaaacccataccgctgtgcatgagccaagctgatgaccagatcttgtatatctaacaacaaattcacccactggatcaggaactggggctgggaccagctgcccgagcagatggccgcttagaggagaggaaatactccaaccaaatcagggttgcaccagctagaaaggggctaatggccattgagtgagcccctggagatatccacgatggtcatttgaaaggtattcattgagcacctactatatgtccactcctgtactgatcactagaaacacagagaccaggaactgcctgcacatagacaataatgaggaaggcagacattaatgaaataattatacaaataaagataaaattgcaactgtattaagtgcgatgttggaaaggtatgtggtgtcatgagagcgttaactgagggggaggtgatgcctctctgatgaagggatatggagctgctggggaaggggcatggagaaacatttcagacaaagggagcacaagcagtggccaagtagaaggatggggtatggcacattcaaaaactgtccccagatggaagacagtgagggtgagcttggagtaagacggagctaaagaggtaggcaggagccagtccatatgagttgtatacaacagaagataagattaacaaacatctttttaaattttaaaaatattagaccatttgttcacataaagttttacacaaacaaaagctctaaaatgccttggtgcacaatgtagtgtgactatcaaatggccattccccttccttgcaaaatgcatacttctagccatttcacttacactatctcatcgagaagaaaggcaggtgtgggaggcaaggcacaggtagacccaggagcggggttgaaagatgaagccacacagtcataactgattgggacaggaagaaaataattaaagaggccaagctaggaaagggacatcaggaagagcgtggctttgagacagggttgaacaggatcaggggcctgggcaggggcttcatgatgtgtagtaagtaacgagagacgggtggttgagctgggggatgggaaaagacccaggagcacagggcagagtccagaatttacttccctctcctattctagggaggtaacgatatggagatggcagaactcagtctccctctgtgtcttcttttggtggggggggggcacttactcacatagcaagaggttacacaaaactattcaagggaaagtgccacaaagtcctctctcagcaaatgaaaatatgcttcagaaataaacaacactgccactccctcatggggctgaaaaatatcatctcttaatttgatttcttagcactaataaactacatcataatctctcaatagctgagtataaatggtcgaattaaccatcttctgcccttcaaatacttaatttccatggtgactaattatgcatttcttttaccacatggatgggcaagtaactaaatgggctctatcttctaaagcagacatttaacgtgtgacaaagtcctctcagataaacttgtctcttttgaaatgagataactaattactgggtaagacagcagaatcgtttccctactgggaaatcaactacgtggtctagtagaatgaaaggcacggaccatggcaaatcaggtctgcaaaaacagtaaacaaaacaagccaacagaacaattaacacatgtggaaaaagccaaatacagtatccactgcacagctgatttgattttaagacaactgaatatgtgtttcagaaagaaagggaaaagagtgaaaatatatggaagtataagaaaagaaacaaaacatcctaaaagtaaaataaggcaactaaaggcaaaggaaaacttttatatacgcagacctcatagactacacaaatccctttgtctgcattctctagagaattaagaaatggtcactatacatatattttattgctcaggaaggaagtccacatctcttccagaattctaactattaaatacacaaagcattgagccatgcagataattctcttttcaaaatagggacataacctattttctctagatcagatgtagctggctaactgagagcccatagctattgtggtaaccaggagaaaaggaaatggatgattaaagtaaatctaattcaataagctagtgacattgtactgtacaaaactggggatgggaaagaggcggatacaggccaaaggaggaatagtgcttattttgttccttttgaattttatcaaattgtgtatatatttgtgacttttaccctaaggagcataaaaaactgacaataaaagattatctgaatggaacattggtttttggtaagtgtcaagcacaaaaggaatcataatttttttcaacgagctttcaaagtatgtatgctcttgacatctgctgataagctgcagtttcctcctaaaaacttaaagcttctctaaattcaacataagcttgctttcagtatctgcaaaatatatgtggataaaattgaagttttcaaaagggagttaccatagaaacacacaactccctaaaagagcagtccatcatctcttaaggggaaccgtcatcacagacatgtattcagtatctctctgtgcacgtgaggccttagacaatacacaaaggacagtcagcacttgcacactggacaaatacagaaattagataagccaagtccttactctaagtaagcaaggcggggatgaggccctttgtgtatgtgcatgtgtgggctgtaggggacaggaatcatgtgagctggatcctgtgatgcagctaaaatgcagccatcataacatttatttaaaacacaattctataacaatctggccagtgcacacagttatcactatggactgttttctgtgaattcttttaaaatgaggatctaagtactagaagcagcacgtacaaaaatagttttatttttactagcagagtagactcaagctaaaaataaactaaatgggaattttgtactgcagacttttcaaaaacagtgtctgtatacctaagacaaacaccacctcttaattagaaatttctgtaaagcattccaaaaaggccacactattttcagtcagactatatggttcttcagacttggtttctcttgagacaaaagaaccccatggagacgacatctaagttggagtcttcacttaaaccacttatggtctttatgaaaggatttttgggccaggcacggtggctcatgcctgtaatcccagcactttgggaggccgaggccggtggatcacgaggtcaggagataaagaccatcctggccaacatggtgaaaccccatctttactaaaatacaaaaattagctgggcgtggtggcgtgcgcttgtagtaccagctactctggaggctgaggcagaggaattgcttgaacccgggaggcggagcttgcagtgagccgagatcgggccactgcactccagcctggcgacagagcgagactccgtctcaaaaaaaaaaaaaaaaaaggatttttgcccttaaagaagccaaatcattacacagcccttttacaatgggacagatctaactggaaggaaaaaaaagatatacttttaggcactgtgccccaaaaaactcagcaattaaagtttgggattaaaaaaagttaaagctatctaaactgaggtttgtatagaaatgtgattatttttgcaggtgtattatctgtgattggtactaatgatttgcaaatcatattaatgaccataataatgatattttttctaatgaaacacagcactttacaaacattaagtatttaatccctgttaggtaaattacagctactcttaaccacatcttacaaatggtaatactgatatcactattcatgatttgccccaaatcacagatgactaacatcagaatttattttaaataaatataaacaataaagtacacatgtgcttatttgcatgtgtgagtatacaaagcatcatgattaggcatagttaagcaactgattagaaagtcattcaaggtctcacttaaaaaccaatcaagttaaatctaggtaatacaggcctagtaccatcagttggcattattctggggaaaaaaaatatcagaatgcttagcaactcagaatgcttaacatcctacctttccactgcaacctgtaacagacaacggccagtggcccacaatgccagtgccaaccacagacaggatggatggctctggaaccattagaaggcaccattcaaatagacaatggtaccaaccagcgtctcgatggtggttataggtctgaaaatgtgtactaaaagaagcggaacctctggccgatgaatttatttggatttcatggctattagtactctgacttccacataacctttgagattcagactgagcaggagttcctcagagaagcttctctgagccctgagccggacccaacaatgctgctccagagaatgtcttcagactccaccccagagcttcttcacgatttttggacactggctttcttgaaagcttcccaataggatcaaacttcttaagggcaggagccatactgtcttgtgcctggacaatgtttataaattgatggagctttataaatgttgaataagtcaatgagcataggactaaatttatttaaattactagtgctctcatctatcagaaaatttgttctttcggtgaatatataattaaaatggtgtgggttaaaagaaagttcctgattatcacaaaaaattcagagaccagggccaggtgtggtggcttatgcctgtaatcctagcgctttgggaggccaaggcaggaggactgcttgagctcaggagttcaagaccagtctgggcaacatagtgagaccttgctgctacaaaaaattttttaaaaattagctgggcgtggtggcacacacctgtggtcccagctacttgggagtctgaggtgggaggatcacttgagctcaggaggttggggctgccgtgagctgtgatcatgccactacattccagtctggtcacgagagcaagaaccctgtttcaaaaaataaaaaataaaataaaaacaaaaaattcagacaccagagatttgtctactaatatgcattttaattttctaaggacaagcaagcaaagaatgatcatgattttctgaatttaaaatccaggggtgaaggaactacccagacatctctgatgctgcccattcttttatcttgaaggaacactgctctgggcatgacagatgaggattaagtaattacgctacacactctggcgtgtgtctccgaaatctgcaaacacatctagtgctctgaaagcggacttgtagttggttttttaaagatgataaagagaactttgctactcaaataaaaataactgatatggccttcaaattttcctaagttcccgaaaagcttatttttcctaagtgtacccatctcagataaaggcagaaatcacccctctctcaatacagtcaacttctctaaagatgatgcatacaaacacaccagactttggcagaattctctagcggagatttaaaagaaaatatctcgtggcagtagagagtcacatgaagacttccaacagctcagacattctccttctacacaaaaggggaaaggccctctctgtagcaattgtttgataaacagaccacagtggcgtttttttacttctcctctgatataagtgaaaataagtccttggtactatgtatggaaggcaggtaaaaacaatgaagtgataagtatttacaacacagatttaatttatctacaccaaaattttaaagattttctgctttaagtagagttatcctgcttaacatcctgccccactaatttttatttgaatttggaaaaaagtcaaatgtggacccctaagagtacattcatcttttcagaagcagctaagccctgatttttcaaaaagcattaatctagactattttataaaattataaaattgatttaaaaatattttaaatcaagactaaaggtagatgatatcttcattgtaaaaagaaaaagatactatacattcccatcctgtgaaattacagccaaattttatccattcaggatactttgggaatgaggcgttctatacagcttagtttcccagagagctgaagggctccaaaattttcttaaaatagaaatatttctaaaatgtaccatatatctgtgcttccacgatcacagtctaagacacataatatactttttccttaataacttataattgaagacaccagctcatgtgtacaaattgaatgtagatcaaaatgtgctaggtaatttggtcacagataagaatttatgtactgtgatgcccacaagagaaagcaggaaagatctaaaattgacaccctaacatcacaattaaaagaactagagaagcaagagcaatcacattcaaaagctagcagaaggcaagaaataactaagatcagagcagaactgaaggaaacagagacacaaaaaaccttcaaaaaatcaatgaatccaggagctggttttttgaaaagatcaacaacattgatagactgctagcaagactaataaagaagaaaagagagaagaatcaaatagatgcaataaaaaatgataaaggggatatcaccactgatcccacagaaatacaaactaccatcagaaaatactacaaacatctctacgcaaaaaacttgaaaatctagaagaaatggataaattcctcgacacagacaccctcccaagactaaaccaggaacaagttgaatctctgaatagaccaataacaggttctgaaattgaggcaataattaatagcttaccaaccaaaaaaagtccaggaccagatggattcacagctgaattctaccagaggtacaaggaggagctggtaccattccttctgaaactattccaatcaatagaaaaagagggaatcctccctaactcattttatgaggccagcatcatcctgataccaaagcctggcagagtcacaaccaaaaaagagaattttagaccaatatccttgatgaacattgatgcaaaaatcctcaataaaatactggcaaaacaaatccagcagcacatcaaaaagcttatccaccatgatcaagtgggcttcatccctgggatgcaaggctggttcaacatacgcaaatcaataaacataatccagcatataaacagagccaaagacaaaaaccacatgattatctcaatagatgcagaaaaggcctttgacaaaattcaacaacgcttcatgctaaaaactctcaataaattaggtattgatgggatgtatctcaaaataataagagctatttatgacaaacccacagccaacatcatactgaatgggcaaaaactggaagcattccctttgagaacagtcacaagacagggatgccctgtctcaccactcttattcaacatagtgttggaagttctggccagggcaattaggcaggagaaggaaataaagggtattcaattaggaaaagaggaagtcaaattgtccctctttgcagatgacatgattgtatatctagaaaaccccatcatctcagcacaaaatctccttaagctgataagcaacttcagcaaagtctcaggatataaaatcaatgtacaaaaatcacaagcattcttatacaccaataacagacaaacagccaaatcatgagggaactcccatttacaattgcttcaaagagaataaaatactcaggaatccaacatacaagggatgtgaaggacctcttcaagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttcaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaagacagacatatagaccaatggaacagaacagagccctcagaaataatgccgcgtatctacaaccatctgatctttgacaagcctgagaaaaacaagaaatagggaaaggattccctatttaataaatggtgctgggaaaactggctagccatttgtagaaagctgaaagtggatcccttccttacaccttatacaaaaattaattcaagatggattaaagacttaaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaagttttgaaatctactcgtctgacaaagggctaatatccagaatctacaaagaactccaaaaaatttacaagaaaaaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggctgtggagaaatagaaacacttttacactgttcgtgggactataaactagttcaaccattgcagaagtcagtgtggcgattcctcagggatccagaactagaaataccatttgacccagcaatcccattactgggtatatacccaaaggattataaatcatgctgctataaagacacatgcacacgtatgtttattgcggcactattcacaatagcaaagatttggaaccaacccaaatgtccaacaacgatagactggattaagaaaatgtggcacatatacaccatggaatactatgcagccataaaaaatgatgagttcatgtcctttgtagggacatggatggaagctggaaaccatcattctcagcaaactattgcaaggacaaaaaaccaaacaccacatgttctcactcataggtgggaactgaacaatgagaacacatggacacaggaaggggaacatcacacaccagggcctgtcgtggggtggggggaggggggaggaatagtattaggaaatatacctaatgctaaatgacgagttactgggtgcagcgcaccaacatggcacatgtatacatatgtaactaacctgcacgttgtgcacatgtaccctaaaacttaaagtataataataataataataaatttatgtgctgtggaccatggaacaggaaggagtctgtttgaccctcacagtattctgaaatttgtcctctcaaaaaattcctgatgtcaactcctatttgtatcatttgcctcttcctcacagaggtagagtgaagctatgtggtagagcatggctttgcaaggagtaaaatgttttaaaaaactagttagtgaaccaaggctggagaagtttccttgcaaatggttttcctattccctaggtgggtgtcattttggatgttgctatcagctacctccttttttctttttctttttttttgagatggagtctcgctcttgttgcccaggctggagtgcaatggcatgatctcagctcactgcaacctttgcctcctgggttcaagcaattctcctgcttcagcctctcaaatagctggggattacaggcacctgccaccatgcccaggtaattttttatatttttagtagagacagggttttaccatgttgtccaggctggtctcaaacacctgacctcaagtgatccaaaatgccttggcttcccaaaatgctggggttataggcatgagccactgcgcctggcctgctatcagctacctctgacttcagctggagcttcatctgtaagggctcccaggcgctcctggaaagtacacatttccccagctttcattcactttattcaatgattgagaaagagaaacatgcttggccagttcacaaatctgaatttagatgtttgggagttctccaatgtttcacttctttttgctgaggtaggcttgtaaacttggttaaaagaaactggtgtaacctctttgaaaagacaattgggctctctctccctgtattttacacatggatgtaaaagtcattaaaaagtacatattctttgacctagaaaatcactttctaggaatctagcctaaggaatcactggctatataaacaaagaggatgtgcaaagaggctgaccacaccgctgattataaaagtaaagtaggcctggtgcagtgctgcacgcctgtaatctcagtactttgggaggccaaggtgggagaatcacttgagcccaggagtttgagaccagcctgggcaacatagtgagaccccatctctacaaaaatagaaaaattagtcaggtgtggtggtgcctatagtcccagctacatggaagcctgaggccagaggactgcttgagcccaggaggcagaggatgcagggagtcatgatcatgccactgtactccagcctgtgcaacagggcataaaagtgaagtttaactaaacctctaacattaaaggattggttaaaaaacatggaaattcaaacaatggaaaactattctgccattaaaattttaaaataatgatccacatattattgacatgcaaagatttccacaatatattgttaacccaaagaaaacaataggtttcaaaaatatgtgtggttgtatataggggaaggtccgaaaggatctgtattagaggttcccaaatgattctggtagcccttagagtctcagtaatttttcacaatgcctccaggcccaaacaaatacctaatagagctgtctgttaagtagttagatccaaacaacataataactatttatgtcagaatgatttagcagctgaaaaaaaaacacacataaatgaaaactactatttccttctcaagtaactttgttataacttgtttatagaatgtatacacctgttgggcactgcataactttaaatcttggaatcgctggacaccactaccttatttcctgttccacgctggttttcatgtgatacactttttatcactaaacactcagcaatcactgaaaactcggttttgtaaagatatgatgtcatcaaaaggaatgtagtgtgatctaatgctgaaactgtgaactatctccagctaatagttggcagagtgttgtacgatgtttcccttaatgatggaaagtatctgtgccaaccctagagctgcacccagaatttgctgtggtgccccagagcatcttggcacacagtttggagctgcaggtatataacaagatgttaacagttgctttctctcaggttactggtgattaaaaaaaaaaaaaagattttctgaactttttcccaataaacatctgttattttttacaattagaaaaaccactaaagtgatttatgtatttttcagagttctttatctttacaagaagatggagagtctccccaattttttactgtgaagaaaagtctaagcataaacaacagtaaaaatggagtcttggatgatgccttaatgatgaaaaactccctcatgaataacgttctgcaataactcctcctattctgaccccctccctgatacttgcacaggttggatcaatgaagtcactggtgtcaggacactaacccagacattcaccccacttcctgcgggtagccactacaattgtttaataatagactctctgtccctcagctgatgtgcttgtaatagagcatggtcatgcccttgtgggaactgagctataaatggtgctttgctcttggtctgcagagctttagtctctggattaacggtgctccttttaaaacagtgcctgctgctttgcaccctggtgtacactgctgccgtctttaaaggtctccactgctctctttgttcccttctggttacttttgccctgtttgtcagtttttgcactaaagaaatgaatgggcttttataccttcaccaattgggactttcagaaccagcctagtgagttaagtctaacagatatttagccccctttgatagtcagttgttgctggatattttgtttgtttttgcctttgtgggaattggtgggcagaaaaaaacattttccagtttcatgctatttttaaaacctgaggattttttacaagttttggcatcgtatagttgaagttctattgtgatcaatatttctattcatttactttcttactaaacaagtgtccaaggaattataaaacactttttttttctaatttagaaacttctacaaatgtatacatcaattgcaacttaacctttacaagtttaggaataatgctgtagtagaatatttaaaggaactttctgcataaacttcagttaatataggtcttacttttaaaatatcttctttaaaaaataaataatattgcttactattgggataaaattattttaaaaagaataatgagaacagctcccaattctcctttacctgccccagggttccctcagcacttatcaccttttcaacatactatacactttacctatttatcttgttaactgtccatctcctccaaccagaatgtaagctcagtaggagcaagaatttttgtctgctttaatcactgatacatcttgtctccagcacctaaaatgtaggggctcaacaagtatttgttgaaaagtcagtaaatgagtgactgattcttaaagacctttttgtaactccattttagaagaccaaagaaaaaaagacaaaatcttgaacattaatatttatacaaaccaaatactactttttgtaggtaaaatatgattctattgtgatgtaaagttacctttttgactgtagtgaaatccatgaatggcaaggatctaactaatttactattgctcctcttccaggaaatgtttcaactttcaaataaagaggacttctgattgtcaagcatggcaaattcatgtggaatgcctaaaaatgctgagtactaaaaatatttttaaagatatggctaagcagcaagaaagtaacagcaattgttaaaagttgaaaatgacaaggaaattagaacctagagaagtaagtaggtaagtcctgcataagtcaatccctgatggggatattaagagacaaagggacagcctaatgtccacacaggaaggtcaaagccaatacccttgaaagatgaaatcctcagtgggtaaattaaaaaaaaaaaaaatcttcccagaaatagaagacagaataagtcttggtgatgggagaggagaaaaaagaagaaaatttcctcaaaaaatacaaagcccaggctgggtgcagtggctcacgcctgtaatcccagcactttgggaggccgagacaggaggatcacttgaggtcagaagtttgagaccagcctggccaacatgatgaaaccccgtctctactaaaaatacaaaaaaattagccaggtgtggtagtgtgcacccgtagtctcagctagttgggaggccaagctaggagaatcgcttgaacccaggaggtggaggttgcagcgagctgaaatctcaccactgcactccagcctgggtgacaaagtgagactcttgtctcaagaagaaaaaaaaaaacaaaaccccacaaaaaaacaaaaacaaagcccagaaattacatatccatgtgccctttccaaatccaaatagggtaaaaagtcctgagttggaaatgactacaaacacatagcagaagcaaatacaaagcctctctagaataatgaatattaaatctaagtttcaagagattttcataagaattccaagtaattaagttcacaatcaaaaatcacaaaacaaagaatcaagctgtcatgaacatgaatgagaaaaaacaaaactgcagaatgaaatcatcaaaggctttagctattgaatgtattgaacacagatataaaatagatgtgtttaacatttttaaaaaagtaaacaggatcttaaaatatgaacaaggaagatttcaaaaatgactaggcagatttaagaaacagccaaaaataacttctagaaatgaaaatataataattatatttagagactcacatgagtaagtccaataccaaaatagatgcagctgaagtaggaatgagtgatttggtaaacagatataaagaaattgtacataaacttatacaaaaatgaaaaatataatcttacgtttaagaaattatatggccgggcacagtggctcacgcctgtaattccagcactttgggaggccaaggcaggtggatcacgaggtcagtagttcgagaccagcctgaccaaaatgggcaaaccccacctctactaaaaatacaaaaattagctgggcgtggtggcatgcgcctgtaatcccagctactcggaaggctggggcaggagaattgcttgaacctgggaagcaaaggttgcagtgagccgagatcatgccattgcactacagcccgggtgacagagcaagactccatctcaaaaaaaaaaaaaaaaaagacattatacataacatacagaaggaaaatataaaagaaatatttagagatgtaaagggcagaatgtgaaggaaaaaacagacaatgtgggaaaggcagcattcaaaataatttttttttctgagatttttcagaactagtaatcatcaaattcagaaagccaaatgcatcccaaggatgttaaataaaagaaatgcccacccagacaaagcctggtaaaactgtagaagaccatcataaaaaaagctctgggggaaatctggggaaaatgtctttaaaacactgaaagaaaataatactgaatatgtaagtgtatacctagcaaaactacctttcataaataaagcatgaatagaaggtattttcaatcaaacaaaaaataagaaagtttacttccaaaaacattcattaaaggtacttctaaaggacatgcttcagaaaacagcgatgatctgagaagaagaaatggtgagaaaagaaaatagtaaatacatgactatgtttaaatagagtataaaaaacagctgctactgtatacaaattgtaataatgtgtaatataaaaaataatataaaactataaaccaaataaccatggcatgttaggctgaaaaagaatgatccaaattaaagaactctaaggttactgaactgtttgagaaaagaatgaatactgtttagtgtaacactttattaagttacataggatgccaacatctctagggtaagcgtggaaaaaagagaatggtgtgtacaactgttaaattagtagaagaaaaaccatggaactatatttaaaaaaaaaaacaaaagcaaaatccaaatgaaggcaataaagaaaaaataaggctcaggaaaagcaggacaaatagcaaaaaataatatggtcaaaatgaatataaatgcattagtgcaatcaataattagtgtaatctgctaaacaacatacatcaactgaatattttacttaaaagacaatgactgattgaattaaaaaatagacaacatatgtccacacagacttgcatgtgaatgttcatagcaactttatccacaatagttgaaaaaactggaaatgacccaaatatccatcaacttgtgaatagctaaaaaacaaacaaacgaaaaacctgtggtatatccatacagtgaaattatactgaaaaaatataaaggaatgaaactctgatatgtgtaacagcataaatgaatctcaaaggcattatactaagtgaaagaagccaaacacaaaagtctacttactgtatgatttcatttgtatgactttctggaaaagacaaaataacatagtgataaaaaatagatcagtagtttcctaatgccagacgtgagggaaggaaactgatagcaaaaaagcatgaggaactttctggtgtgacggaaatatctatagctttattgtggtagtggttacatgactatacacacctgccaaaattcatcaaactgtacacttaaaatatgtgagtttgatcatatgaaaattataccttaataaagctagtaaaaagacaaattccaattatgtgatttacaaagcacaaatctaaagccttttgtgtctttgaataaaggaggctgggggaagaactgcgtaggcaaataataacccagaaatctggtgtagctaaattaaacccatacacagttaattttaggcaaagagataaaaagggccatcacatattaatagaaatatttaattccctgggaagatataatatgttcctaataatgtatcttcaaaaatatataaacccaaaaataaaagaacctcaaggagaaactaaccataagacagtctcatttatgaacataaatgcaaaaatcctgaacaaaatattagtaattcaaatctaataatttccaaagaaaaataatgtgtctaaatttgggttattccataattcaaggttgcttcaatatcaatcagtgttattcactagatgaaagaagaaaatatatgattatctcaaagaatatagaaaaagcattcaataaaatacaacattcatcattcatgattaaaacaaagaatagaaagaaacttcctgaactggataaaggatatcacaaagcaaccctataacaaataccatactttataatataaatgaaaagttaaagttttatctatcactattttaatttaacattggagattcttgccagttcagtaagacaagaaaaaagaattaacattttatgggttggaaagggaaaaaaaactatcattacttgtaaatgatataaagaatctacaaattacttttattaataaggaagccaataaggtttccatatacatgataaaatgtaggaccctttgacagtggcatggctaaataaactacagtaaaataaacacaataaaatattctatagcaatgaaaatgaatgaactaaagttacacaggtcaacctggataaaactcagaacattgtgttttgtggggagcaagtcacaaaataatcagtatgattctattacataaaagctaaaatgagatagtatattgctttgggatatatatatggtaaaattatatgtggtacatatgtagtaaaactaaaaaaaaaaaagcaaacaaacaagacagtaagtaactcaaaatccaggaaagtagttggggagaggagaaaacaataggagagaggtacataagggtttcagtagcaatgataatgttcttcagatgagtagcagaaatgtggatgttttctttatttaatcctttaaagtgtatctacatgttatatattcccttccacatgtatgatatacttcataatctaaagaagtaaatgaacctgagtgaactttgttagaaatgcattttaaagtcaatgttacttcaagttggaaaacacaggcatttaggaagttctttttctatatctaagttttgaaattaatatttattattttttcttattccttattctaggaaagttgagagttctcatttatacaatggttttcctattacactgaaatcataagaaactctcttggtaggttttaaaggtaaattatacaaccattttgttttcacaactgcctgtataagacagaagaaaaacaacaaatgaacaattaactggtaaggaaagaatattaactaataagaaatgtcaaaaaggcttgacttctcatattaaaaacaactttttggtggaaaaaacctaatcccttcttttgaaagagaatttttcaaaattctcagtgttggggcggtggggggtgagtggctgggggttgggaaatcagatctcagatcaataaacaggcaaacaggttgactaagaatagaaggtatcattatgtattttacatattttgtattttctgcatattagatgttttgacatcttaaaactacctttctggctagagagagactgtctctttcaaggctagccgattctcagagataacaaagagcccggctggtagcatgcctttgacaagaaaattcaccaatctagagacacccctcctctatctggccctcagaggcaatatttctctgcctttactataccacagccaggtaccaagcaagcagggaccacccagaaagcttggagcctaaccaaactacttcaactagcaattctaaactgttaaccctgccctgccttgcctttcccttggaaactccaataaaggctgtggctggcccaagctctcccctggctcctgccttctgcctcctgactaacacgggtgttttcccttgtggccctgcgtagcatgtggtgacacgcctctatgggacctgtgaatgtaacaaatttcttccttccaagccctgttctcatttccccttcagtggctgtactgattttatcacatatccaacatgtacattcttaaaacacatagcaaagcaggagtttcagatgttaaccaaggtctccaggaatgacaattctggagctcagggcgagcagagattagtgaaggagggagcaaatttacaggaaacaagaatatgcaaatactgagagtttgagagttcagtggtcgaaaaacaggagatagctgtggaaagtgcacactgggaaggggcagctctgaggcacctcacggcacctggacaacctcaaccagcttaaggtgcctaacagaggaatttataagcttcttgctggtatgggaacaaatccccaagtgaggtgcctgctagatagatctgcaggttgaagtagatcagggaaacgacacaccggaggagagggatgtaggggcagaaaagaggggcccatccaaaaaatgtgtgtgtatccccacctacccttacctccttccactttttctacaagcgtcagaactgctcaacatcatcacttccaaatcagttttggtgacagagtccaattgcccaaaccagatgcaatgccctcattatgtcttaccagccctcctgctcctgcctcctccagttcatgcttcacgtagccacagagtaatctttatagaacacaaatatcaccatattacttcccagcttaaaaacctttcaggattgacccatatccacccagagtagcctccaagccacttagattgtcctcctttctgccgtccttctggcttctctggctggagactttagaccacagcactgtaaactgattccaactccatgttaatatgttaatttaatatgttaatattaaaatattatttcatgggtccaggtattagcacattatgtactcttttctccttctgaaaggaagaatctttgcctgccttaacactattattcatcttcaaaaatctgtgcaacacttcattctgaagcctcctcaaacaactgcagtctgctcgctttatggaccaccttgctgctctcattacattcaatgcacactattttattcacatgtatgtctgtcttcccaactacactgcagactacttgagggcagggatggtatcttattttttctttgtatttccagtgggtagcacagcacctgacccataaaaaaactatcatctattgagcacctaccgtacagcagatcccatactaagcttttcaaatgttatgacgtgagttcccacaacaactcaatgaactatttataattacctcttttacaaacgaggaaactgagatttaggaggttaacatccccaggaccttccagttagtaagtggtagaattctgattaggacttgggtctctgacaccattgcctacgttagctccttgggcctctggtgaaacgtaatgcacgaaatgtggatcggatcgtatgaaatctcccccaacttacaccctgggttgaaggctgtgaagcttatgcagaatgctagaggaggcattaggacatggggtttctggttctgccactgattaacctcaactctgggctgtcgcaggctttctctgggcttcactttcctcatgggggaaatgccatccttaacagatcccatgtcatatcctcactcttaaggacctctaaagctgataagaaggtactgtgaatcataaacctaggtactctttctagatattggccttgaaacatctcttccttcactgaaaaactgcttctgaaaaaggatgccagaagccacttttggtcaagaaaatgtccacttttgttctcagcacagagcaggtacccggactttccctgttcccaagtgctgtagaccaaaatagcagggaaccaggatgaagtcagccagaaacacgctttctataactgctcttcacagaagagaaaatcaacaagctagtgtttaaataatgtgcagggtgtgataccaaccgaacctccgccctccttcctggggaaatgcaaagtttgctgtggccttttcacaaacctcggagagaatgaaatgtcagctctaacactgaatttcccagcttcattccacttccctcaccacctcactattacctaagatgacattctgtatattagtatactacatcttaaacatcatccctcactcagacatcagattacaaacaaacagctgaatcctacagctgttcccactagaaacaaaaagattcttaacatatttgaagggaaaaaatctgtttgttcccagatgtctcctgagcccatttctggggcgtgtctactagtaatagtgcgtaaacgctaactgtactcctcgctcctatttacacacactattagttttcagtaaccactccttcccaactcccaaaaaagacagctaagaaaacaatgttcacttggaggaagagaaactaaatttctttttgctgttcctctcaatcaaacccttgcaggaaccaaagtattcactgtggtttaaacacttgtcactcaaaaaaaaagtacccagaaatgccatgagacttcctataatttcacttttatttaaggagctgtgctgcatcaatacttgctttgggcacaaaatgcagaggagcttgatggcattttgagaatggcacagatgcaaagtatttaaaaaatacataccacccagtgtgttcctgggagacatggctggactcaacatgttactatcagcagtgttagcctggttccgcaggggaccacatatgcacatgtaggtactgagcctgtgctctgggatacatgctgtgctaaatggtttacattttttatgactcgttaaaatatacttaggaggaaggtatgttctcccctttttacagatgaggaaactgagcactacatgaactgccccgaatcacattgccagtaagtttgcaaaagtggcatttgaacagtcagtcagactccgaatatgtgaaggagttctttaagggaaccaaggaaacaatgtgcattacaacccttgggagacactctagtgtgtatttctataaattaaaaaaaaaatgggaagaaattgatcactaatgaaatgtatccatctgtcataatgaagattttaatgacgaaacaagtaacctaaaactaaaattaagacattacaaatatcaaagaaacaaagatacaacccctaaaaggggctggggtgctaatatttagaaaaataaatgtgtttcaactactgccccctcctggtggcataaccaaaggtacctttctttttcttaacttgatggatttggaaggttttcttctaactgatctaccaaaacaaaaaatgtaggtaaagaaagactgtatggagcttattgaggataaggcttagttctggactggagtgaaggtctttctaactgagtaactataagaaactatgaagcatcttgtgcctccatcttctcatcagaaaaatgggaataatatccactctatctacctcaaaggttattgtgggcatcaaagaaataatgcatgtgaatgttattttcaatgaatctaaaatctaaggtattatgattaattaaagccatttatagtatcatctattaaatttaaaattacatttactctttaatcctgcaatcccactcctgggaaccaatgccatagaactaatagcactgtatctaagaacaaatacaaagatgtttatgatttcagtgtggacaatggccaaaaaaactgagaccaaagtaaatatccatgagtagggcaattgtagaataaaaaattctaatagttaccccactggaatattatgcacccattaaaaagaatgttctagagctttatcaattgaatgaagagatttcaacacagttttctgagaagagcaaaacataaaaaaagaatgtttaacagggaattctaaaagtcttagtgcattttaaactttaataatttcagaagtataaatgctatacactttcaagaaacaatatatgaaaaataaaaatttaactttttaaaatattgatgttacttattaaaatcaatataaaaactattatgcacaaaaaaactaagagtaaaatttattattcaaaattccaaagttaaataagtataaaagaaatataaatagctaaatgtttaaatgtttctaagtttatagcaattatacctctaaaattatgaacttaaaattgcactaatacttaaaaatgttatttcaatagctttaggcatactagtgtttttggttacatgaataaactgtatagtggtaaatcctgggattttagtgtacctgtcacccaagtagtgtacactgtacccaacaggtagcttttcatgcctcaaccacctctcaacctcctcctcttgagtctccaatgtccattacaccactctgtatgcctttgtgtacccatagcttagcacctgcttataagtgagaacatggtatttagctttcaattcctgaattactgcacttagaataatggcctccagttccatccaagttgctgcaaagacattatttcattctttttcatggctgagtagtattccatactgtgtgaatggaatgtgtggtgtggaatacacaccagtccaatggaatggaatgcattctatttacacaccatggaatactactcagccataaaacagaatgaaatggaattatgtgtattacacacacacacacacacacacacacacacattcctcacatgttttatccactcatcatctgatgggcacttaggttgaacccgtatctttgcaattgtgaattgtgctgcaataaacatacacctgcaggtgtcctttttatatagtgacttcttctttgggtagatacccagtagtgggattgctgggttgaatagtagatctacttttagttctttgagaaatctccatattgttttccacagagggtgtaccaatttacattcccaccagtagtgtgtaagtgttcccttttcactatatgtacatcaatatctattgtttttttactttttcattatagccattctggctggggtaaggtggtatgttgttgtggttttaatgcattaacactttgagaacactctataacatgtttttgttttttaaaaacaaaataacagtcccctcactcccactgtgtggtgtgtgtgtgtgtgtgtgtgtgtaattgtacatttacataaacaggggaaaaatggaaggctatatgtgcagttaaaatgggagaagggaaaagaggaggagagtgatccagacaaaagaggaaaagttgttgttttttttttaaaaatggggaaccaaaaagtgtatatgctattatcacatttatgtacctatataaaatcatttgtattgtacagctatataatattacatgtttaaattttattattttagagacagagttttactctgttacctgaactacagtgcagtgaactacaattgcactggcacaatcacagctcactgcagcctcgatcacctgggctcaagcaatcctctaacctcagcctcttgagtagctgggaccagctacggcaccaccatgcctggctactgattgatggattcattgattgtagacacagtctcactttgttgctcaggcttattattattattttgttttttaagaaaggaaagaaacttgccccaagtcccatactaagctaatggcagaagaaccagaacttgtacctaggtctctctgactctgcagtctgagccctgaaggattacactgtgatttaggatggttatggattcacaggcaggactcactagccctgcaattggcctctccagcatggagttcctgaccattattcgtcaatctcaggagctgctttcaaaacaaccaatcgtcctttgaacctctcacttctggggtggagcatgatagcatggtagatgctgcagacatgaggcttttggttgatgctgatagcaaccctctgttgcacagatacataattttaatcaccactgctaagtaactcttattgatttgttcttctcagaatcaaagacacttttctctctctctctctcaagtaaattaaaaatggaaacatattgtcaatccctgaacacgtggtgtgcttttttccttcaggcccatcacatactgttccttctatctggaatgtccttcatctttttcctctgctgggaaaacccttccatattcttgaagttgcagctcaaatatcacgttctccgtcaaggatttcctacctcatccaggcagaactgcttcaccctttgcatgccctcaagaatcaggacaggcttctcttagcagtgctcactgaggctttgattatgggcttagggactgatcttccactggagacctcatgagtatggtctcactctcaccttgttccagtggccagcatggtgcttggcacattatagccttcaattaaatattggttccatgaaactgtgagattgagaacgtattaattcacaaggtaaataagtcataggtccaatactgaggcaaatgaacatgcaatcttccatgcacaaggccaagaatcccttgcttttaaataatatgaaccaaatcactaccaggaaagaggctacacctcacacagcggatcttcactctcgcctttccccaactcagcaacagcaggacaagctatgaaaagttcttttgtaagtttatgggaataataattcttttaataatttcaatttttattttagattcagggggcgcatgtgcaggtttgttacctgggtatagcaattatacctttgatattttgaacttaaaactgcactaatattttgagaacacaccacataatgttttcatttttataaaacaaagggaaaatcctctcactccctctcaaatgctggcattcagtgtgaaatcatagctggaatgtgacagatgtgtattgtgtgtgtgcacggaaggcctctttactaattcagaccaacctttacctcctcagtgtgagattatctactgaaataataatgactgatatttatatacaacttagaatgtatttgctttcagagacattacctggtttgttgtatgaagcagaaagcaaatcaatcaaccagatttatcattatgtttacactgattttgcagtagatagtaaccgagtttatgccttgaccaaatgtccatatataacatacagtcagtaaaactgttgactggctgtaggttcctgctgtgagaagtgtgatctgtgaaattctaacatgcctaataacatttattcccttatgatctagcatagatttaagccaggcaaaaagttttaacaaaaactgattatgcttgtcaataaccgtgaatagtatcccaattaagacaatggtcatttatttgttcctactgccaccagtgaaagcaggaaaagcatttggcaaatctatttctgtcaccctcagatttcaggaagagaagttcaaacagatgaagctgatgttactggaataactcattctactctaccattcttcctgatctactccccaggctctgtgagctgctggtaatcaaggatgtttgactgggttctgttagctgtcaaggtttactaagctgagttagttaatgagtgatggctggatttcattccaggacttcatatcagccatgaagcaattaggcatgtacttcatgatctcccactggaatttcaaaggtgccttagtctaccaaggaactaaattcagtgtggtctgaaaggaaacaataaacaacatttaaccatgagaggtagcaaaggacgtcttttctcagtgtctatgttagacaggtgaggaatgttgccaatttattttttgtccatataacctctatagctatttcttctcttgtctgtcgttctgaaattataaagggttcttatgagttgtttatgtgaaaccaagtaccctgacccacaggcaaggtattcctggaactgctgaaatagcaagccagataatgatatcatttaaaaaagtgccaggcaagaaagctctgattaactactgaaacatgctcagtggagatatttgtagctagaataaacgccattttaacatctcctctttatctagggtcctccttcctcatgctattattgtgaatatttcctcttcagattcctgcatacaaggaagactgatgaaagagagtaaaaatcacttttggagaaaaaaaggtaagagctggcagaggtaaaagaaagattctgaacctcatcaacagttgttgcaatctcactcacctctctggctaaccttcctccctccaccccttcactgctgctttcctgccactcacccagactggactttctactctgatgctccacaagaaacagaagtggtaagaagacaagcaggctcccgggggaagtggaggaccatatgaagtttcatgaaagaaatggcttcagggatgatgaggcaactcttcctaatacaaggggtaagccctagcccaggggcacacccatcctctaggaggccagggatggtctctgtcactcctgggaagtccctgcagactctacctgctttccaagtgcttcaggaaacatcaccttaaggttgaaggaggacaaactcaagcagttgcctatggtatggctaagggggtggcaaacagagggctggtgatttttacaagtaacctctcacaatacttgcgccattacttctcttttcatttgtgtccatgaatagaaactctcagaggatagtatgttagctccatggcctgtggcactgtagagtgagttctttagagactgaaggagttaagagtacctgtttagctaccagaagctgaatgtcagccggtatgaatggtatgtagctgggcaattttccaaaacccatgcgtggctgcgtatcaggaagactgctataaacaaatgtgcatgtatgcatagagcctgataagtcaatggggggagacagacacggaacagccaaccagcctgaggaaatatgcagagccgggtgagcttccactttaggtgaacaatagctctgtctcggaaacaggtctggatgggctggtgaacagttggaatgatcctttgactttttacacattaaatgtctgtttcaggggaccgaaagctggattctcaattttccaattatcctaatattataaaatcactaaaatggtgttttaaaaaaattcttaatatgtaaaacatgcaaagatacattaggtgaaaaaagcacagggcaaaactgcatttatagaacccaattatgtaaaatatatagatacatttaagatgatacattaaaaatgtcactaaaatataacacgatctttttgtggttgtgggattatacatgatttttgttttttctttctactttactttccaatttttctaaaattaacatatattattttcatagttaagaaataaggttacttaaattaagaagaaaattacctgtggatgaaacgacatctgatgatgggttatgagggttggggaaggccagaaaggcataaaatagaaccaaccacgtttataaaatgttaaattcaactggtcttcacgtctacacacattagtatcttctgtcttacactgtaaactcccagagagcaaaggctgtgtctaattctgtgcaatgtctggctcaattaaaaatgtagacagaatataatttttatgatgattacgcaaatgtagttggttctttttcactctggcagccagtttagtgttactgatgcttggacagtgacacagaataagaacatacattgttttccccctttaaaatcatagtgtattaataggctacttttaaaaaatttttttgcagcatatacactcatagaagagaccgatcctctaccatatttaaagtagaaagtaaaacagtactgtaattttctctgttttagcccatttccatgttatataatgaatgtaattccaaggatgagcttacagtttgatttccatattaattcaattactggactcgccactgactcagacctggaattaatataaaatacagggagacacacacaaaaaatgttccacttaagaaaccaaaacagccctaagtcaaaccactcttacaacactagagtaatatccaatgaagcggcttccatttacagtgttttccagaccccacaaagttcttttcagagttcttatattccctaaaatataaccaaggttactgtaacttttgaagtcactctcaagatgtacctatcaataaacagtagctttttgtttttttagtacggtggctgtaagaagttacaaatgactgtcagtgtggtttcaggtggtattcttattagaaatttaaaacacggtgttatcaaatttggcctaagtctgttcctttcaaggttatcgtaaaatatgcaggaaatgtgaaatcccaagtgcttattaaattaaactggagaagtcactttttgagagctcggtcctcatgcccctcccctgcccccgtgacaatggtagcatttaccaagtgctctcagcaggtgctgagtgttaagtgcttcacttgcatgatgtaacataatactcaaaagagctctggaaggtaagcatttctatcagtattttacagatgataggtttaggaaaaggttagggaccttgaccaaggtctcacaacgcctctgtgtcagagctggaatttgaacccaggtctgataactctcagagtgcaaactcttaaccactaaggacttgttcacttcagagggctaattaagtgtgaaatcaaaagcaatgaataatcgcaattatgccacttttaatttgagtctgttgcatatacataattggtcttcctctatattaagaaggatgccctataaaaaattagaaattctgccaacaaaaacctcctgagggaaactaagaacatctactaaataaataaatcaagtgtcttattgagaacacggcaatactgagaggcttgggtgtggccacctgacagatctggaggaaacctagaggcaaaatgtaccgaatattctattgcacaacagaatctatctgtggaaagcaccccctaaacggaagtatctgtcaaagtaaaaataaatcagggtaacagcatctaaaaaatatattgtgagtgagatgcatacttctctcatttactatggtacacgaatatacttagtttaattgtcttgtttaaaaaagaaacaaacaacttttcagcccaatctataaaactctgacaaggactaacatcaccgtgcagtcatgaagcagggcgagccagctgaggcttttggtagggtcttctctgcaatctgcttctactatgtgatgggtcaccaggagcgcaggctcactgaggactctgctttgcatgatgaagaaatcatctggatctgttcacagagacgggtcattccactcaaactcataaaagccaggctgacagattaactgaaatgcttatcaaccaatctgagaaccagaatttcccagaagagcagaggattaggatcagattattctgttttttaaaaaattaaaacatttcctgagcacctactatgggtcaggatctgtcgtaggcacttttacattagtggtttcatttaactctcacaaccgatctttggtgtgagtactttttaagtacattttagatagaggctgtggcctggagaggcagaggaactctgctgaggtcatgcagttagaggagcagcaaagctcccagaagagcacaagtgccccagtgctgaggctacgggtctcactatgcggaaaatcacaaagttcagaaggtgctggcaagggagcccagtggtcataggttgctgtcatcaagcctaaagacttaaaatgcactggtgacatatggctgccagttgggctgtcataatcaggaacatccctaaaactttcaggctccccaactccttttggtgactgtcatacagaccagcagccagctgtttgcttttgatataaatgtgttctaatttctaaaatgtaaagtttaattatctacatttattttattttatttttcctgatagaatgtcagtagacacaccatgaatttgtatagaatgtcagtagacacaccatgaatttgtttaagtgtgggttaacttatgggaattttatacatagctaacttcagtcatttttctgttgatctgtgatagtttcagtttcaaatgatattttctgccactgttccttgaaattcaaattttgagggtgctcattatttggtacccgggcactgatttattcatatctattaaaatacatatataaaaacaaaaataaaacacgaagaaaaaaagaaaaaaaatacatatacaagtatacacggtacaaaattgtgtgccatactgtgtactcattcatgaccaaaagacactgatcatttgtaagcttattctagtaaactgaataaaataatatagctaatattttatacttactttttctgctcctactgaaaaactggacatcttaatagttacttcatactaccaatctagtaataaggtctggtggccccaaaatgaaaaaaaaaaaaaaaaaaagcgaaaggggactgagtatttacgttttttagcattggattaaaaaaaaataaaaaacaacatcagtttccaaaggctagctctgaacattttgcctcctcttgaccttaaattgtgggctcaccctggagaataaatcttaatagtgaattatacatagcaactttgaagacaaataatattagtgcagcctacccgtaattactctctttttacaaagtttcctaagaaaacagagccaaaatgcttaaaatttaaacagaaacagagagagtaaatggctgtgaaacatacacatatagaaatttatattgtatatttacatttggtctaaaagcaacttcttaaaattcaccaacagaaaaaaacaaatacattttttggagagaagcaacaatgtaggtaaagatcacagattgtttaaaaggcatatctaaacatctaagagacagtctttgtttaaattgaactaggatttcctggagagtagtaaaatgttgtttcagtatagtgaatgtgcaagttaacacttcaagagtgggcttccggccgggcgcggtggctcacgcctgtaatcccagcactttgggaggccgaggcgggtggatcatgaggtcaggagatcgagaccatcctggctaacaaggtgaaaccccgtatctactaaaaatacaaaaaattagccgggcgcggtggcgggcgcccgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagagtgggcttcctttggcttcaaactaaacagctggacaggggatgctacttaattctttttcttccctaccagaaggaggaggtgctcaagtatttttctttattctttcatctgtttatctgctgagcaatagggatcttgcttcaggttggttaatctgctgagccatgacacatatgagaaggttctctggcaggacagtatgctctccaaacagagactatggcagtgaaagaaccaaagatatatcatctcccctctgaagcctctgcttctttggggtaggaattggtctattaactctgagcattttttttttaaagatggagtcttgcactgtcacctgggctggagtgcaacggcatgatctcggctcactgcaacctctgtcacaggggttcatgtggttctcttgcctcagcctcccgagtagctgggattacaggtgcacaccaccacactcgtctaactttttgtatttttagtacagacagggtttcactatgttggccaaactggtcttgaactcctgaccttgtgatccgccctcctgggcctcccaaagtggtgggattataggcgtgagccaccgcaagcagccaactctgagcatttttaggcactaacattccaagcgtctgagattccaaataggaaagtgctattttaaatgactctttaagctaccattacagataactgtaagaaatattcaggcctgaaaaaatgttcattcatcaccaaaatgtgaatcacttctaattgatttactatttctgctcttctgctaataacagaattttgtcactatccacaaacattccagaacacttatcttacagaacagaaaagcagttgtctatagtaaaaacactccaagtttcccttacatgtcacactgtagaaaggaaacaaaacccatttattttctcaactatcttgcctgtgatagtctgtgtacgataaaatttatagaaaactaaaatgctagagtccctacagacttcaaagataatctggcccactgatttctttgtaagctgaagccccttggcgaatctgatgggagctatgaaccattctccctccagaaaaatgtatatgcataccaaatattgtattcacttcccagcattttagagacaacccctgaagccaacctaggctaagaccccagaccaacgactctgatctaattccactgctttgtttcacatatggagacaccaagttccaaacaggggatgtggcttggccataattgctcggcagaaactatgagaaagtaaactggatgaaactgaaaatgatgcagatagcaactctgaaccatcacaaatcaggcctatcattttgctaggaaaggagaaaaggtgaagtgtttcaagaggagagctttctttcattttaggtttctggttgagcttctcactggttttcttcatcttgccttcgggccaggcccatccgtgacttaaggctaccttttcttgtgtttgcttctgtaaatcagtaagacctgcataacctggccacattcagaaaggagggcaagtgtgagagtgtgaagtagaaaccagttttaaggaactgtaagagttctaaagaactctaatttggtcacataatggatatttaagaagtattctgaatcaaacactgctcacatatttaaggaagtggcagtctactaaactgtcaccgagtaaaagtcctagagacttgctttaatgattagatggaacaaattttcaactactgcattcatccgcacatttgcaaatggctcattcttttaagaactaaaacattcattctgggattttgtatttgtgtttagttcattgcaaatttactcaatatatttcgaattcaattcaacaaatacgcttaggacattccaatgtgacggaatggaaacgtgcatggattttggagtcactaagatccaaattcaaatattggatctgctttatctagacacgtgattattgggctcattacttaagggtctctgcgtttccccatctgtaaagtgggaataataccaactactgtgcaaattgggtttgaaaattagcaataatatagtctattgtaaagaggctaatgcagtatctggcaaacagggattccataaaatggtaatacttaaaataatgattatttatcaaatatctacaaaggacaaacttcatcctagacccttctctaaaatctgaattcataatatcaaaatgaatgaggatttaattcattcttaaaatgactcgaatacttgctaagattttgacatattaaaaactataaccattataaatgaaaaggccactgttcaaatgactagctttgctacagtacaactgtcagttttttgaccaaaaggaaatttataataccattggtgggttttaagtctttaggtaaaaactgtgttttaaagtaacagaacaataagacagcaatatagtggtttcttaatgactaaaatcttacattacatattatggttcagtattaatgtgctttcacactacctactgagttttcagactgcaactacttatccttttcaaattgctatcactctctttttcatgggagatttcttacaaattccttggagaatccaaaaatttacagtggaaattttttctcgattcctttttttttttttaaagaataaacctattcaacaggtaaatctaaataatttttagcagttctaaatgtagagaattcataacttcttattgtaattgaaaaggaacatacaaagcaattagtcacttacaaaacccacgttcaaccttcaaaataatgactaacttgataggagaggcaagacttctttaattaaatactaaagtctagccatttgagataagcaaagcaggttatacaaccgtcttctgcactcacaatatccttttctccctcttggaaatatatcatttttcagcaatagtagaacatgtaacaaaaaaagttactgtactgtagaaaatcactctaaccacaagctaagtttttggctaagagttaaacttcattcatttggatttcactagtttcacaagaagaaaaagtgattaaccctagtgtaagtaaaattcccttgagaatatattagattcttaagaaaacaaaacagtaagcaaccttaggcactcacttacatataaatccttagggtgttaactgaaaagcattcctagccatgctagaataggattctcaaacttgaacactgattacctttttgagagctctctggacaggtgtgctcagaagcactggaagatacaggagagtttgatacacattctgagaaagatggggtggctcctgtgtgtgcatgtggccatctagcacaatcactattcagcacgggactacatttcccaggccacttcacctccaggtgcagccacgtgactagtgctcaacaaaggaatatgagaaaagatggtgctttacttcaaggcgactgtgattaagaagtgaggtgcagacaattgcaagatggtgttacaggatgaattatgtcccctcaaaattcacatggtgaagtcctaacccccagtacctcagaaagtgaccttatttgaaaataggaccattacagatgtaattagttaaaatgaggtcatactggaagagagtgtgcccctaatccaatatgactggtgtccttataaaaagggaaaatttggatacacacaggaaaagagggaagatgatgtgaagagactcgggaaaaggtgaccttctacaagccaaggagcaaggcctggaagagatccttgcctcacagtccgcagaagaaaccaaccctgctgacaccttgatcttcgactcctagtctgcagaactgtgtgaccacacatttctgttgtttaagccacccagtctgtggtactctgttacagcagcctgagcagacaaaatagatggtgaggccagaagacggaaggcacctgagttcaggattcctgaatcacctctcaataaaagcacttcactgatcagaaatacttccactgggctgagagctgagcaagaaaggaaactagttgtgtcaaaccattcaattttgagggcttatctgttataccagctgtcattacctactataggacctaattaatttaagtggcaagtaattttaaattattttacatgaaaacaaacatggacctatcacatatcacagggaacaatccatgtaaaattttaggattaaaaacacttcaaagaaaatttgaatttacaggaagatattttggggtaaattctctcaaatcctccatagggtataaatttactctcttctgccaatagaagtagaatttcctcaagaatattaaacaagtcacaatgtcaaagttgctggaacttcaactacgccacataatccacttaattttttttttttgaaattaagtggagcatttctatcaagtagcccaagtatgtaaaattttacttgggtactaaagatgagaacactgtgaaatgagttatcagccttttccaaagttctcaatatttttataatcaatctgaaaagaagtcactaggtacagaataccttctgtttgaatatggacaaaaaatgtaccctcttttatgacagggtaactgatacagaataaatactggataccattttccatttttgattttttttttctgacatgaagaaaaaatgaaatgataactatcttcggtaagacttagagttatagttcaaaatacctcaaaagccgagctggcagctggcttctcatgtttatagaaaagctaggatgattcagcctgagctcagagctcaatttagatcatagcatctggattcaaaacacatgtgagatgtggcagccgattttcaggtcatgactgatccaagacagagattgcagaccactcaccagcattattccaaatggagaaagtgcctgagagaaacagaagtctcaaaggtatttggaagcccactccaaactgttagggaacaggtaacatcagcattttctgcatccagcagctttaagcaggtgccgcagaagccaagggcctgaggatgacactgaacagctttgtcatgacattcagccttgccatggtcagaaaacatccctcacccatgacttctttcctgaactggctattgttcagattaaactatgggaatctggtaataaattggaaaacctctgacagcacacacttcctgctaagatctgtgtttaactttgctttgtttcgaagagaaaaactgtagtaaagaaaaaggaaaaataaatgtaaatgccctttttcttgatgagaagaaatcatagtcacagtaattctaatataaactacacaatgaaatctaaaagaagaggggaaaatccccagctcagtttcaatctctattggaattcaccttgtgccttccttgattttccttggatatgacatgtccagatgtgggtgattctgcagctatggattttatgtgcaataaaaaaatgcttctcctgctgcttttcctcacctcccccctcccccatctcttttcctctctctcctccttgtctctttgttgtgaatgtcagggctgtcagtgtcacagtctgacatgattagcgtttctgacattacaccaagaagcagacagagagcaaggagagcgagcagaggggaaggcagttatgagtagccatttaaagaagtccaaggaaaaaacaagcacaaccacctttctctgaggttccttgattacagggcagtttataaatcaccttggatttttctcatttatcctattagtctgttttcctgttcctctggagatccctaaggtgtggatctagtctgtgagatcaaagccagcggctctaataacagataagacagaattcgtgattcagcggattctaaggttgtgaagtgtaacaatcagcgcactttgggaagatagcgccagtccatttcgagtattgattcgctgcactttgtcactctaatgatgttatctcattaaaagagataaatgccccactgttcttctaagagcatctgcttcttactcttctctctttttcaacagcatggctctcagcagcagcacattaaaatcaaattgaaatccaatgcaaggcttggctacagagcagctaaggtatctttttaattgctttttcctactctcaacccccttccagctcctccactacagtccttcaaagaaacaagcaacataaagagaaagagatgtagaaagtaatcataatagaaagcatttgctgagtgtctgttacatagggactccactgtgtcaacatttaacttattcctaccttgttagataggtagaacaatcctcagtttgcaaataaagaaacggagttttgactttaggtaacttgcccaagatcatgaaggtagcgagagaatgagccacaatttgaacaagggtccattcaatgcaagtactttttttttttttaatctccatttcattcatggaacaaataagaaaatatgattgcaacttgattagaataggtgaaaaaatgtaaaagaaggtagcaattattcttcagcctgctaatagccaagaacacaatgccataggttttgtttcaacagatttcttattaaataaaaaaggtagcaatttttcataatgaatgttttatacattattcctttgtgtatcaggcctctaaagtacacattattaaagtctattaaagtctgtatttagcagcattactaatgtgcctttggggaaattattacaatgaaacagcatcagtctttcacaaaatttcaattgtttaatattccttttcttatcttcaatacacgtgtctatttttagctataatcagacctcatcccaaatgccgtaatcccagcctagagctgtcacagcaaattgtttatgggttggatttaagaaataacaagaaacacagacattgttaatttcacccaacactttttttttcatgattggttgcagttttcctacagttctcattaacaggtgctccttgatcactatgacacgcgatgatactttatctctctggttagggttggttatcttaattaattgcttatatttatatttaactgaaactagcctcaagatgccactttattaaagtttgagagtggtaagaaattacaaaactattccattaaaaaaaatagaaaagaaaaccaaataaaccagaagaacatataaactatgattagtcaaatcaaatctctgcatttaaaagtaaacatcatttactagatgtctactggactagaaatatgtgtcttctgaacagtaactgaggagtttctgcaaattattctgcaaattgtaaataggcatctctacctttttattacattaattttatcacacagtatgaagtttttttaaaaacaaagccaatgatgtacatatattcaaaagcacaagattctctgaaaatatagaaaatactgctaggcttattttacgaagacaaaggacaataggaagctgggaagaataccagcaaacagctatacgttataaggcctctgtatcacaaaaatgaagggaaaataaagccaatctaaagtattacgtacttaaattaataaactggattggaagcaatcattccattataaatttcctttcatacatagcaatcccactgagatgatacctttgtaaaatcaggcaaaaatcaattgttaatattctagagatggacaaaccacagattaagtacctaaataatcatgtttccaatcaccaattaactaagtagaattctcttaattgtatctattaaggcctactaattgacagaaaaagggcagagttgaggacttggagaaagaagacagaagcattcctctgcctgattcataaaggtcagaatcccctggccgttgttgtaggaacccagccatcaccagtcacaaagaaaaaggcagcagcacactttgagtatccaaagggcctctttactgaggctgcatggctgttgtgggcttagtccaacatgatgatgtaggacaagaacctaccagttcaatcaacatgcaattaaaactcctgatgaaggacggcccagggcagtccattggtttggggcaggggacgcagagaagcaaagcctgttttaattaagaaaatactaggcactcctctttaaatcctcaaaaaatgaggatgaacaagattccaaaaccaacaatcacaatgtgtgtgaaagtaccagcaacaagaatgaagtgggactgaatatgtgctttcctacaaatgaaacctgtttgatggtgtaaggaaaatggatgagctgtggtcaagaataggccgaggcagacatctagtccagcatgactcagcgagtttggagtgcaggcacacagctctgcctgttatgtaaccatgccatgtgaggtgcattaagtaaccactcatgtgtgctcatgcttgactcggagccactattgtctgtaaaaggtataattaccctgctaatgctgtatgtaacggcttgcacctgtggctcatcctcaggcttgtacccatggcttgcttgtgcccatggcttgcttgcacccacagctcccgtgtgtccagagaataaagccatgttgaaatgcccccatgattccttgactggtctttcagctgcctgccactcatccaccgactctcctccgacctcagttagaacccgacagatggtcagtagctgcagccatatttcaaagaagttatcatgattcacagctaggcctctcagacttgaaattatattacagtcatgtcaaaacagatcctttcttctctggggcctatagggtcttaacacaaagtccagcttttctattccgaagacttaatttacctcctacctcttcagactctccttcatcttttctgacattatcagatgttaagtcaggccacatgaccctttcactcaagacaaggcattgccatatccatatgacacggtagtgggtgcacagagtctcagggctagagctcactttgaggtgctccaacacaatcattcatcagatgctcaaactctctgtacaaaaaggttcagattttcagcataagccctggaacatgaagactgtgatatggtttggctgtgtccccacccaaatttcaaactgtagctcccataattcccacatatcataggagggacctggtaggaggtaattgttaactgaatcatgggggtgggtctttcccatgctgttcttgtgacggtgaataagtctcatgagatctgatggttttataaaggggagttcccctgcacatgctctctcttgcctgctgccatgcaagatgtgactttgacttcactcctcctcaccttccatcatgattgtgaggcctccgatgtaactgtgagtccattaaacctctttttctttataaattacccagtctcaggtatgtcttttattagcagtgtgagaacaagctaatgcagactgcttcttggagaagtagacaccagccagtgcttcaccacacactgctctgagatttggtggtgagccatgcacacaaagagagaacaacggaaatgtgtttctggttagacagaaaggaggagaagagatgggactgacgtagaagcattaccatagttccatagtcaagatgactgtgtacaaagagaagtctacgtaacttaggaagcaatcctctggaatgtatatgtttcatacatatttacacacacacgcacacattatatgcatgcacgcattttaaagacaaatgagcgttaacatattcagttaattattttaaatttatcttatctctctttcatgccaaatcgaccctctactcaattacatggtaagttgtattttaaatttgcacttccatacctctcagaagggagttatagtgctattttcttccggaaacttcacagaatttcccagtacaaggcaggtggagacagagtctggaggtctaacttgccctttaacatttccatgcacctcacattcgacaggactcaatgtacacgtaacagaggggctacagtggcctggtgccagcaatgtttctttttggcttcacaaactctataaaaatgaagttttttgaagagctaagggaaattattccttaaaaatgtagaaagtgagaatagaagtgctacaatgtccaagggcactcactgaccaggactgagggtccagattcttgttagaggaaagcctgccacatataagacataggcacagtctaactcagtcgttttcaaactcatctcacggcccttttacaggctcacaaatgatcgcagaccctaaagagcttttgtttatgtgagttgtttctatcagtgtttaccatactggaggttaaacccaagaaagttttgcaacatgaagacacaggcacacatcccagaagtgatgtcattgcatgtcacagtctctttaaacaccgttgtgtatagtcaagagagaaagggtgaaacaggtaaattgtatcttagtattattataaaaatggcttttatcttgcaggcagacagcctgaaagggtctaagggtgcccctcccaagggtccctaaaccatagtttgggaaccactggtctagttcaaacttgtacacatcggcagtgtctttgaacacgtaaatgaagaaatggcacagtaccgagtaagaggatgtactgttaatttttaaaaattgaggcactgaatcaaatgatggcatctttttctagagcatttctctactcactactgcccccaaaccattagtaaattaaaatgatccttcctggtaatatgccaagcagaatgaccctaggtccaaatctctgttttgaccactctctgttttctatctgctcactaaatatcttcatccatttgcacctcaaatgcaaaacagctaaaatagtacttattttttaaatgtttggttactaatctggttgttaatgaaatacacaaatattgtagaaaagctgaaaataccaaaaagtattttttaaaaaagaaagaaaggtgtcctatgtttccaccctctgggaaggccatggtcaacattctgggcaatagccttccggtctttttatcatgtatattttaaaaatgcaatgaagttcatattttaaagataattagtatattttatttaaaaatatttttagtatgaaagaaatgcacattgcttaagaaaatctagaacatacaagcaaaataaagataatgctcataatatgttgatgtgtataagcaatctttattctgtgtgcatactgtacctttttttaaaaaatgaaatgattagactgcacatgctgttatataacttgtcttcttcgcaatttatttagaacatctttttatgtcactcagtattcctcaatccctccttggcatttttattatatggctgtactatggttattcaaaaattactattttaagaatattgtgatgaacattttagctaaacttctgaacacatccatggcggttctctttgagttaatgttctagaaatggaaattctgggacaaaaggtatgtcaattttttaggcgttgatacaccttatttaagtccccttaagaaaggtgttctttcattaactgtgtatgacagagcctgatgttccctactcccaacttcactgggtaaatgttacaaatcttcatcaattgtataggtgaaaaatactatctcatcattttaatttgcatttctttgattgctgttgaggttgaacatttttcttctattttgttgatcatatttctttctttgttggtcttacctttctgttcttggcccattttctattagtgtaattatctttatgttataaatctatattaatttgtaagaactcttaataactctttctcatacatgggtaaatactgccccagcttgtcttttatctttcagaatagttcagaatgtcttttgattgaaagaagttctgaggtgttacatagctaagtacattctcttccttgataatttctgacactagaaattaataaggccttctttattctaagatcatttaatttttagttgtattttcttccatgtcacaagtttagaccttgcaatagctcttcaaagtctgccacaaggaggacctggccaatgccttcagaaaaatgactgttgaggcttattaaatatagattggacatttggtgaaacaaaccattgagggtgtcctggaaaggagagagatcttttatgtttattattcaccaattccttacacaacctccagtagctctgttaacttgctctttaagaagtttaaaatgaaaaaagtgttcatattaggtttatgttaaaatattaaaccagtgggcgtgatgactcttcttacctttgccagaacagcagctgtcttagatagaaaatacctttgctacgttcataatgtatttcttgcaagcacagtgcatggcatatagtatgcacttgacaaatatgtgttggagctgatgttttaccaactagagctctgtatatgccaggtttggggtgagagaggcagggataataaagtctggacttcacagcttcatatgaaggaggtgcaatgaaagaaaaactccaaatgaaggtagaaactaaatttcagttttactttttagttgactgtagagatactgatctgcgtgtaaacgtgaaactgcctcagacctgggacagtaggatgtggtgctgaatactggaaaatattcagagaaaaaaaaattctgctgggcagatcattaagcaaaacagtggcatccacccactaaaagagacaaggggcactactctacttcatttggatgctttggcatttgtccaaagcaataaaaatcagatccagcttgatctgaacataacaaggaagaaacagttctcaagaagatcctttttcatgatgggggaagagagagggtcattttgtataataatggaaaaatcaattatttttcaatcagatggagtgtcctcataaatttaaagcacagaacagcatgtgacatgccttcataaaaaacaatgaccatgagggagaagagtaaaggatcataatcccaaagttgctactaagaaggaaagatctttcaagagaagaacaacacttttcttgctagtgtgttttctgtgaatgtacacagtggtcagtatgcactgaacgtacaccatcctgcacaatttgcctctacagaatcctgttcaattggcttcccatttggctatggcttttaagtgacacactgaaatcctttctctatagcatgataatgcagcagtaacacagataaaccagaaatgttggtttttcttactggcaaatatactatatgtaatatatatttacacatattagcaagaaaataaccaagaaagtagtagaaatacttttgacagaatttaaaagttaaattttggccaggtgaggtggttcacacctgtaatcccagcattttgggaggttgagatgggaggattgcttgagtccaggggttccagaccagcctgggtaacatggcgaaaccccatctctacaaaaaatacaaaaattagccaggtatggtggcacacacctgtagtcccagctactcaggaggctgaggtgggaggattgcttgagtccaggaggttgagcactccagcctgggtgacagagcaagaccctctctctctctctccaaaaaaaaaaaaaaaaaaaaaaaaagagttaaattctaattatgaagtttttgatcaacataaagattggaaagtcagctcttgcaaaaagctgcgaagaatgtatgaacactggaaagatggtcaagtctgcatgagggtttgggagaatgcacaccctgggaaaatatgtgccccacaatttctttaacatgtaagaatttacaatggttgtcagaatttacaaccattaatgcctgtttacaatatttaaaaggtgaataaataaatatgaggctgtctactctgtgtaaacccatgagtttgttatcatattccacgtacactaacatattccctgtagactggcctcagggatgacagcagattcttgatgggccttatgcgcaggaatgccctctgcttctctttttagctggcactgatacaccaacatgcgagctatccaaagtcccaaagtacacccctttctggtgtttcctcagaccctggcacagataggagttcaagaatgtgaggaatgaaggccctacctgatggacagcaactcatgaggtatcagggtagtcctgttaaattagtgcggccaactgctaatccttttgtggcacgggatttgggggattctgtgttttctagagggatggtctctaatggattcaaaagagagctgtcaatgtctaactgcaatcagcatcgccctggcacttcaaaggaataacaaggaccctagaacgccagggccaccctccatccgaacacctccctaactgaagtgccccgtcagtgagctgggatttaggaagaaaggagagcattacagtgtgtgtctgaggaagaggagagtgcacaattcgaatgtctccaactttctaggaacaaatccacttagaacgtcagtcacacccacaacaatatttctagcactccaactaacaccataattgaggaggagattctctggttttattcatgctgagaagagctgtttcctccccagagagtgacctattctttgtcttatgccaagaaagccataagaaaaatgctgacctatgaaggtgacacatcatgcttaatcactactttcaattaaaacaatataaaataaagaacgtactgagccactcaggcagaacataatatcccaagcaacagacacacctactgagacttgacatttccgaggagtctggttcccagctgtgtgtggagagtgaatccatgacattagatgttgggttgccctggagaaacttagggcggagctgtcacagcaaactgcatttgctgataacagatttcccgagttgccttagcttttcaatacaccaaactccaaatactaggagccaaaaaaggtttgcagccatggatctcccctcatccccacctccagtcatgaccctggggcagaacacctgcctactttccagtattctagcagctaacttctcaaaggaggcttaacgccaagtgtttaagctggggtggggttgaagcgggaaaactcagcactggtttctttctctttggctcagctcagccaaacaaaaactcctcaaaaacaattgcttgtttttttgctggtctcttcagataggataaagcggccagagtctcccataaaacttgcatctagggaaagagggtaagtgcacagagggcttttccagctttctcccacccctgaagctgcccagggcccttcgtgcccatgagaaggctgagtaaatgaccatgagaaaagtcaccactggaagagggtcctttagtagaagaatttcaacagggaaatgggctttctaaagtctagagattccatatgctcttttcacaaccaaaccatcgaacagggctgtccaactctaccacaatccatacaacaggcccacaataacacacctgtttttgtaggctccggaaacaactctcccctgttttaaatccttcagtggctcataggatctggcccttgcctccttctctgggcttatatttgaccaccttccacttgtgcagcagtttccaaccaaggggtaattctgtccccgtatgggacattgggcaataatctggggacatttttggttgtcacaattagagtgaagggaaggggatgctacaaaaaatcctaaaattcagaagacagtctctcactgcaaagaattacctggtccaaataccaagtgtcaaggctgagaatccctgctccagccataccaaactctttgctgttctctgagcacaccaggctttctcatatgcttttgtgcctaaacacattcctttacctggaatgccttgccccaccttccctgtccaggaaattaccatttcccatctaggatcctactcaaatgtcacctcctctacactgtctttcccagattccccagagttggatgttcctttttctgtgcctccaaagcttctggtacacaccttgctagaacatactcactatgttgacccaagatagtctgcacacgctaaaggcatctcaagttgtattcttcgtttattcccatagggcccatctggtaataaatcaccactcaccaatttaatcagggaataaatcaaaatggaaaagatgcaccttacactctcttggaactatgtctaagggataacagtgtccccaacattaaaaacaacagcagtaaatatgtatcaagtgcttgtaatgtggacaggtaccatattaagcactggtatacgcagtaactcatttcatccttgcaataatcctatcaggtaggtatcattattatcagcattttacagatggggaaattggggaaccaagaagtcaggccacttgtctagggtcactgacactagcatcccaaaaaagtgatatttagtcccaggaaatctagccccagagtctcaatattccaatattcatgccaaggcagttacactaaaacccagtatttcagccactcagaggcccctggcaagtataaatgacacctccagaggactacgcagccagagtagccaccagcacctgtgaccctgcttgtgggggatcacacgactctccaactctgaaatgcttctggcaggagaagcaacctcttcacatcatggaaagacatatgtactccagaaaatcatggtaccgtaaaggaaatacaagtgctgattcctcaaagtacctcttaccttgttcatgctgcagggatgggagcaagggatcagacatgtcacagtgcgaggaagttcttgaagattctcctcattcctggagccctcactttctgaagcagacagctgcactgtgaatataaacaaagaagaaatccatcagctggtgcccaggaaggcatagagcactgccatgtccagtggcacttgctgtcatgatggcaatgatccaagtctgcactgtccaacatggtagccactagtcagatgtggctattattgagcacttgaaaagcagctagtgcaaacgggggctgccaggactcaacagctagaactttcacagatttcctagaaaggcagtgtaccataagggaattcaggaggtcagtcttccatgggccaaatgaactaaacagtccaattccccccaaacagtccaattccccccaccatgttttcattcatgctatttattctttacatggcgttttttgattcatatgaattacattttagagtaaaagggtcattgtacagtttcagggttcttctttgtcttttttgtttttgtttttgtttttttggcatagagtctcattctgttgcccaggtttgagtgcagtggcatgaccacggctcactgcagcctcaaccttctcggctacagtgatcctcccacctcagcctcccaagcagctggggctacaggcgtgcaccactatgtccagctaatttttgtattttttgaagagatagggttttgccatgttgcccaagctggtctcaaactcctaagctcaagtgatcctcctgccttagccttccaacatgctgggattatgagccaccatacctggccagtttcaaggttaatttgtcaaatattaggggaaaatattttaaaaatgacttcaattacttaaatggacttgtagccttttcctctgaaaggtgtttacaggtggaactgagaggagagcaaaatattgtaaggttcctgatactcaatttgtgtgttatttttttaagttgcatctaggagggatttatatatctgcaccttcccataatacatggaatcggaggtttaactggaactgcagtgcttttaaaaatgaaaaatatactatttttaattataatatattaagactatagaaaatgttcaacaggaaaagaaaaaggtacttataaccccacaagcccaccataaccatctttagttcttagtaatcagcctttgtctacactggagaataacatgtctgctaactaagtccaggacatggagaattccaaagctgtattccccatattaacatctttcactgctaagaaaatgattttgcaatttacattttcaaagataaactcctactccatgcacattactattctatgaacataatattactacgttccttttataaatcagatgatagagagaggaaattgcaaatcactccttggctatttgaaatacagattccaaaaaaaataccacatgcggattaaagacttaaatgtaagatctaaaaccataaaaaccctagaagaaaacctaggcaataccattcaggacataggcatgggcaaggacttcaggactaaaataccaaaagcaatggcaacaaaagccaaaattgacaaatgggatctaattaaactaaagagcttctgcacagcaaaagaaactatcagcagagtgaacaggcaacctacagatgggagaaagtttttgcaatctacccatctgacaaagggctaatacccagaatctacaaagaacttaaacaaatttacaagaaaaaaaacaaccccatcaaaaagtgggcaaaggatatagacagacacttctcaaaagaagacattaatgcagccaacaaacttatgaaaaaatgctcatcatcactggtcattagagaaatgcaaatcaaaaccacaatgagataccacctcacaccagttagaatggtgatcattaaaaagtcaggaaacaacagatgctggagaggatgtggagaaacaggaacacttctacactgttggtgggagtgtaaattagttcaaccattgtggaagacagcgtggtgattcctcaaggatctagaactagaaataccatttgactcagcaatcccattactgggtatatacccaaaggattataaatcattctaccataaaaacacatgcagatatatgtttattgcagcactgttcacaatagcaaagtcttagaaccaacccaaatgcccatcaatgatagactggataaataaaatgtggcacatatataccatggaatgctatgcagccataaaaaaggatgagttcatgtcctttgcagggatatggaggaaactggaaaccatcattctcagcaaagtaacacaagaagggaaaactaaacaccgcatgttcttactcataagtgggagttgaacaatgagaacatatggacacagggaggggaacatcatacaccagggcctgtcggggggtggggggctgggggagggatagcattaggagaaataccttacgtaaatgatgagttgatgggtgcagcaaaccaacgtggcacatgtatacctatgtaataaacctgaatgttgtgcacatgtatcccagaacttaaagtataataaaaaagaaaataccacattcagtcatagcaatagcatattttaacaataatgtacaacacagatcttggaattccaactttgtagtacgaatacatccaaacatctccacatgtacatgatgcctgggtaatcatggcttcaaagtcaagaaaattcaatatctaattgtaattgatcttaaagtgactgaaaaaaataatgcatgtaacttttactctttcaatttccagaagcatgtgctaataaatttcttagttttaaagtagaactttatacatgctgtttccttttcaatgtatgtatccatccatgtaaaaactacagcctagcacttaactggaaagcttgcccaaatgcctagcagagatgcctcatgtcacaattcaatttctatgtacacattggtatcaacacaggaaatgtgggcacaagaagataataacagacaaggattcttgaacatcatttccctgaggaaccccacccagctccaatcatgccacaatccccgtactctcagaacttggataaatagcttgcactaaactgattacggatcccttcctgcccccgccccaactgttcttatgtcattttcatgtatgttgttttacaaccgaaacaggctaaaaaccctttgagggaaacatcagacacacagaacgttttaaaataaatattacgatagttttttctttgctgtcactcacagggcctaggatgatacagactcttaagtgtggggtcttaaaaacaatgttaataattgttgcagctgcctttggagttcttttaaaaaggaaaacctcttaatgccagggttgtaaatcttttaaaaaatattaagaatgtcatacaactgtatagtaccccaaactgtacaatgcacttttatatattaatactctcatttaatactaataccaatctgggtggtagttttcctaatttggaaaccagacacagagaggtaaaagaatttttcctggttcttgctataataagcaatagaccctggactagaagtgacttcatttcaagacgctatggaaataaagcatgtgaaagaccagaaataaaaaataaacacaacacacaccccaaaacaacacacacacacacacacacacacacacacacacacacgcacatgcacacaccaagaccaccatttaacagaaaacgcctcagagaacagatgacaattttagaaactgggtcagttcacttctggacagcaaccaaaaagactggccttgttctatcaagtactttccatctcctttgaaatcgagggaacctggttgttttgcagccaattcagtttatgaagaagcttagcaaaatctacagcttaaaaaaggagactgcatcttaaatataaagcattagggaaaaagatacctgagttaccatggtggaatcaagaatgttttcttttttagtttattattcaatgtttctttttattgttttaagaagttggattcctctagtactgaacaaaaggaaaactacagacgtctttaaagggtgccttgagaaagttaatcccataagcccgtgtgacttccactcagctgatcctaacagttggttcaatggtcaatcttagacttctaaaaggttaatgaaacataatttgtctttccaggtggatagaagcatgggtaagaagaaaggtggtccagaattacagaatcccagcactttgtgaggctgagacgggtggaccacttgaagtcaggagtaccagcctggccaacatggaaaaacctcatctctactaaaaatacaaaaattagctgggcatggtggggcaggcctgtaatcccagctactcaggaggctgaggcaggagaatagcctgaaccaggaggcagaggcactgtagcctgggtgacagagggagactccatctcaaaaaaaaaaaaaaaaaaaaaaaggcagagacaaagtaagtctaagaagaagagagaaatgacaagaaaagatgaaagatataaagaatggagaaaaacaaagggcggcaagcaaacaaagacactcagagataggtttggtaacatggccaagtgcccctcaccagccaggtcctcgctatggaagagacccagagatttgggctcctggtgacaattccacatcctatggcttctctgagggttatactctgatgtcttgggtgtcagcaaatgggagttggagaaaacaccaggcgtacctgattcaccactatttatttaccatcaacctccatctaccatggagagaagcctattttacctggatcactgttaatgtggtatagaggtatgctgagaataacataagccacctttaatcctatgctctttaaagagaagcttaaaagtgtcaagggctgtgtgtgtgtgtgtgtgtgtgtgtgtgtgtgtgtgtgtgtgtgctctcctgacccttgaaaatgcaactaatactgccaaatactgaatggaatatggtgagttgggcttttctccccactccaactcccacccccttctatgatgtccattctagaagccttcagtaatatatgtcaaagctgggtagctcaggcactcctgtgggagatagataggccaacaagagcaagcaggtcactcttcgcagtgttaaaggtctcactagcttttagacataacgtaccatgaggccagtctgtgggatggactcttgttcctacccttcccaccaccacgcccagcagcttaggcagagggctggggcatgagggcctatgccaggcccaagagcttttggagaaggagtaagtgaagtaatacaaggtgaaccggctctgaagtctagaaaaaaatgctcttgcatctaggacttagaaacttgggaaatcagatggacaggtgagagcaatatcccaaatttcctctactctattttaaggggtggagtaattcacatggctttgaagttaagtctggacaatcttcaactggagactttcaactgaaaaaatataaggtcattttattacagaaagctaatccctcccttctaccatagggggcatggtgctgggattgaaggatccaaaggcaaagaaactagactcctgcccccttcccccaatgcatacacaccttctttccaagtggctggctcattccctgcttcctaaagaagaggcaagaggaacagagtggagcttgccaaggagattcctgcaggtccctctccatcctcaaagttacagcagatgtgtggctgtggttctccatgacttcagtgtcctcgccaccccacatggaggcagcaaacacactataacatggttctgccccaagagaccagacgtttgccattctgctttgctcccctgtgcgctgccttcacagcataccatggaaaacagacattctaagccagaacaacaagagcatcttcccatcaagcatcaacaacagccttcctccccaaggataggttaggtaatttgaaaatgaatgttctgaaattttaactaatatatgagttatggttcaataggaaatggtaataaagaggaggaaacaagaggattataaattataaaagagagacacattgttggtaacacacgcacacaaatagtctgagagccagatggggagaaacagaggccaggaagggccaagagtgacaagtggtagagggtccatcactttcatacacccacttctggcacacaggctagggggttcttgcacttggtcaaatgataagtcaggatatctaatctttagattcagggctatcactgtaaaatgtaaatcgcagtctccagtgatttaggactatctcaatttaaaggcacaacacagaggagcccccaagaggttacttggcctggcccacttcccttgcctaagtgactatttaaaccaggggtcacaaattcagatgactgcaagggtcaagaaagaatgagatgagtgaaaggtcaggtctgggaagacagtgaggaatggggcatccggggagtctgctactcagctctagccccagcaaagcaggaacaagccccatgtgccaagagcttctgatactcaagaaacggagttgagagactgtgtaaaataatttgctgttttaatgttggaaactcatgctaatactttggaaattttgtaggagttgggtctggttggctagtttgcctcttctactgcacaccttccatgtcagtcaggggattctttgttcctgtaaacctccgggagagaaaactctctacctgcctcttggcccctctgggttgtactgctagggcttcactgcccacagaaagccagggagaagagtaggcaaagagagataggggccaagtcagtctgaatatcaactccacctctcggaatgtgatttttggcaagttactggctctctctcagtctctgttcctttatccctaaagctgggggaaattctttatatctctggagattcttttgaggattgttttgagcatttcacaagaagagatcttgtctattttgtactagtacccaaatacccagcacctatcccgctgccttacatacatacagtaggcactcaatatatgccaaatttaattataatgtttgggaagatctcctgtaagtctggcaccagttgaacctatttcctttcattctctcctcttctgatgctttaatgtcaatattcatatctacttctcgcttggtcagaatattttgaaattaaactttatagaagtccaaattaagaataaatactgaagttttttcttaagaagcatggcacacttttaggtcagcaaggcactatttgggtactactggtgacagctttttgcgcactttagaagaaaaaaaactaaacaaaagagatttcattgtcctattaataaattaaggaatcatgcattaagtttagcattctcaactcatgtttgccaatagtgcacgtcactgcaaagggagtacacagtggctattccaggcaactcttgatccatttgttcactttggattgagaaggctgaattatattcatctagaacaaatgtttactaaccatgtcttatttacctgggtttctttgattttatgctgaaagaatcccagacccctccaaataatttcaacttccctctcccttggcggggcggggggagggggttgctgtacaattcaggcaaacatatttcctatgatttggtgagaaactgaaataacagacagcctgatgggttacttcagagtgatccactgcaatgggagcactgttaaagaagcgttaagggggccagctatctctccaataaaaagtttctaattaaggaactaaaatattctcaagaagatcttggggacaagctataagtaggatgttaccttaattggggctagtgcttacaactgaaactgcttagcaagccagaatgggttatatgccttgttcctcttgagaagaaactttcattaatctgcagaagaaaactctagttggcctgaaggttcactgttaacctctgcttttctggggcttagattctgttccttttttttttttttttttttttttttctgagacagggtctcactctgtcgcccaggctggagtggagtggtgccatcttggctcactgaagcctcaacctcccaggctcaagtgattctcccacctcagcttcccaagtagctgggactacaggtgtgcaccacccatgcccagataattttttgtagagacagggttttgctatgttgcataggctggtttcaaactcctgggctcaagtgatcctcctgtgttggcctcccaaattgctgggattacaggcatgagccactgtatctggccatattctgtacttattatcagcatctccttagtgcagcttattctttttgagggagtaccatgtcccaggttgttaagcctctccacagggatctagtgtttgcctccactatggcctgagggcgttcaatgctctcaaaccagtttctgccaaaacagttgaagttataccatgcaggtagtagtgtaactatgaaccccagagctattcaaacagtgtaaccctgggtttccatccccctggtctgtgccccaacacacagacttaaagccccaaacagactggggaaaatcttcttgcccccctttcacaagcaattcctgtgtgagtatagacaccatagcccctagagcctagagcctacagctgggtctgaaacactctaaggccagtggcatcaatgtcttctggcacctaagaatttccctgtcctgctttaaagctcgtatgtacttgaaaatatttaaccaatataataccttaggactttttggggtgggtggtcagaagtaggccaggcttaggactttttggggtgggtggtcagaagtaggccaggctgcatgagctcagtataccattctgccagaattgggttccctaaatgcaattctgccatatttaggttccatatgtagccaattctagctgtcatttaggctacaactagaattatgttctttgtagcctaagctaattgctgtgactctttcactaactcatcctcattacagagtgccattgggggtagaaagtgcttacgggtagcccaggccttgagaaacctacccttagccagaagcagcaggtccaggcagttaccccaaggaaacaggtcaccttccttcccaaggctgcattttccacacccaagtctgccctcagttctgtggaaaggaatctgccttccattaacttttccataatttagaactggatgactgcacactgatgttttagtagaatgagagaagcaaagacagcaagaaatgcaacaagggcacaaccaccttaacacatcagggaggtctgcagggagtcactgcgttctccgacagcaagcagccaagagaacagccacagaaagcagttccagcagctgaccctggggtcctctctgatctcattacagcagttgacactagtcctcacaaaacaaacagaggaaatttatgcttgccttagctgtggaaagctccacattccttattaacgagagtttcagcttctgagaccacagccgctggaatggggaggaggtcagctgtgctcccaagaaagaactgtggctgctgccttgccctctttctggggctggatatacaggcagcgagcctggggcctaggctgtctgctcaggtgactgaggggaagttccctttctgctaatgtcgacttccctcggctcagacggtggggtcatttcctcttaaacagcactgggaaactcactgtaagggagtcctgaggggatccacctgctaaggtcgcaattccaagagagaggttgttctgcataaccatactcaaaagtactcttgcctgcaccttcaaaaactttacttaacttggaattccaacttaaaacattatttcatatcctttaattcaatcttagaagtaactgagcagccagctcatgacgtaaagcgtgagcttctaaaccagagtaagaaatgtggagcagaagttctgaaccagagtggttttgtctcccaggggacatctggcaatgctgtagacatttttggttgtcatgacccgggggagggtgctactggcatctagtgggtgagaccaatgatgctactgaagatcctaccacgtacaggacacaccccataataaagtattactggtccaaaatgtcaatagtgctgagattgggaaatcctgacggggagggaacattcaaggatatgggtagacttaaaatcatgccaactcataatcacattataataatgtggcaccatgcaacttggggtccccaaaatgtaaacaattaacaaccataaaaatttaccagttctctccttgagcgaagtaaaagctgtaacttacacagagtaagaccatcagagttgcctggaagaagtggaacagcttcagtgttggactatgttatcatcaatatcatcagtgccttgtttactccaggtcaaggtgtgatctgagtgtctactatcaaaattcagtggtagctattaacagaaggagtttatacgtgaagttctatggtcactaaaaccgtctaaataacctaagaatatctagctctggaaaaaactgcaaaatgtttcaacttttaaaataccaacaaaatatgaggaacaatgttgatgttgacctacattctatctagggtggctaaaagaaatagctgcacaatagggttctaaataaatgcagaattgaagaaatgcatcataacaaagataatcagggtgactattttgaaatgctccccatttctgtttttctttctgttttcaaatattccctctcatccacgcggcatattttcattacatttgttgtaagaatgtacatttagataatctactcactattcttttatgcattcttttactccagccaaaaagggaaaaagtccctatccaaacaaagctaatgcatgtaagcaaatttgaaggaaaaaaagaatttcatgaatgagcgggagacaattttttaatggaatgttttaaaggcttgtggtataaacagtaaacaaaattgattcactaacattaatactgtttgccatgatgtgagagttggtctttttttttaatgccccagaagctaaaggaaaataaatactgtggtagggaaaaataataccttacttggcattttgaagtcattgctcaatccttcttgagcaagaaaaccatagtaatgactttgttttacctaccgcaattatggtacacctcgcagcaatccttcacaatattttcctccctctgttcaagtcctgctaaataatctctggaaaccattaactaagagtacggttccaattttcctgttctccctcctctgctgcctcagtgtcatgttggcgtcaggacaaagcaaacttgtatgacatcacagagcaaactcattttctgtaaaccagccccttggtagtttaccgctactggaacccaacgctgtcaacagtgtggtctttgtttggtgggtgttgctctaaaaatttttttaaagtttcccaacaccttcttcttttaaacagaggcaagctgctggaggcgccgtcctcgcctggcccgccccactctgtaaactagacattaccttatacacaaatgactctaggcattcctcagtctagctgcctcactgcaaaattcctatgctcctcagcagcagggcagcgcacattcccctggcttcccctctttcctcttcccccaccctcctctttttcttttctttcttttttttttttttaatttccactgcctcactgtgtttttgtgtaaatgatctcacatgactcaacaaatccatctgcctgaagcaggccaagtctggagccctcccaggagggaggagaagaattgctttgtggaaaggacctggagctctgccctttctctggctcgaattacccgcctgtcaggcctgacggatttggctaaaaataaaaggaaacgggccgtgaaaagcagatgaatgggctcagcagttccttagataacacaggcctgctgttgcccaaagctccccaaacagaaacttcaaatgcagggcctctgagtcagtgatgtggcttccaggtgaacgaggcctgtcaaatccactggagttgggggacatggcctgggctgtgaatttcggtttcctttccgtgtgtgtgtgtgtgtgtgtgtgtgtgtgtgtgtgtgacacagagagtgagagtgcacgcaagagagattgagagagtgagagaaccagtctagtattaaaaggttctcagaaaacagtagacttcagtggagtgaaggcttgtaaaaaaaagaaaaaaaattgttgtttccactacaaaattatccttctccccacctccaacaccagacattttcagcctccctatgatgtcacttctctgtttagagccagcaaagagctaaaagtctttcttgtaagtgtatgcccagcgcctgcagtgggtattaagcacttaggttggcaatgtaatgacacactgtaacaatctgtaatatgaggcagtcagcaaagccctggctctgaaagctatttctcccgaccattaaccatatgtttggctcctcagatagccaagcgggtgttccagcttaccatctggtttctatccacacaagcaactgcaaagcacaggctatgtccctctggagctgtgtgtttctttttctctctcttttccgctcttctcttcccctttcctcctcccagctcctttggttccttctgctaaagaattctctgccattcatcacgtacaaagaaaactttacctgacatggcagcggcagagccattaagaatgcacagctgtattgtaaacacgccagagggccatttaccatccgcggaatctgtacaagtcgggctctaccccttcctcatctactgagtgctgacacttgatccagcatgttaaaaacaggtacattcttgagagatccaggggttgctgtggtgcccttcatactcacttcatattctgggagtggggctttaaaacacatacacacacacacacacacacacacacacacgctcccgaagtttgcctctgcattcaatctgcctgacgtcagtctcacacaggatgacataccaccactgcaaataaccaacttaactacaggttttgattcttttttctgcactaagggtttgatcccaagtgtgtatttttctgagtttttttttttccgcctaaacagcccacattgaaagagatgacacttcagaagaataagaacatgcagccgcttgtaacaaattgacaacctgcaaaacttatgcttatttacatctgcactttttaatagtacacagcaatgaaatggaacctactatcagaatttatagaattttttcacaatgtttccaaagtatttaccccagagtttctccgctacaggatttaaggtcctttataactctatacatttttaaatgtatgaaggaagatgtatttgatatatagaaattaggtcacttttcttcctgtccccctaagaataaggtctgcattagcagcccattttaccgaattaggaaattaaagttaattctttcccacacactgaaaaaaataagggctggtttctaacatatcaagaacaaaagaaagaatatcattaaaaagtgactaaccagaatgtcagattttatcaatgtggcagagctacagaggatttgtcaggggaggactgtttattcaggctaacaagggtgccaggaaggccactacctatgtaaacttcttaaacccacagcccttgtcagtcctcatttccatgatctgaaataggtgttgtgttagctatttctatcaataagggacattaaaattctgctgcatgtaggtttttagagagtgacagaaaaggaaatttttaatttcagaagccttaggaaaattgtccacagatgatggcgtctattaaatgctgtttgaggtctcaaaaccataatacaaactttaaattgcattagcttgactgccaagaaaaacaataacagcatagttaataaaaagaaagaaaaattagcaatttaaaacttcagtattttcatagttaactacctggttttctaagcactgcagaatcattttattacaggtatttgtgcttttcataaatactggtgcctgggcccctttcctccagctcaattatacaaggatccctgagtggggaggtatttttgaaaagcttcccaattttgtgcaactaaagttgagaagtgttgccttatgtgaactaacatgatagtagaaaccatctcatcaaaataaaaatgaaacctttggtatagaaatgtaaatgaaatttaggaatagaacagtagctttccaaacttgttctgaagtgaaatcttcaatcaaacaaaatcttatatgaaatccctataagcaagataggtaaaaagcagtaatttatactgtccttttatacttttagtctgtacaatattcatggattttttaagttcaaagttataattttttaatcataagccacccagtgagaaaaaggaggccattttattgaacacaaaacctgaaattgaggttaaggctgaaaggtccagtcctatacacctcagcatctaattttttccatggccaatggttaagatgatcaaggtctgatgtatataaaaatagcagtgtgtatagcaggatgaaaattagttcataagttaatgtaataaacatccattaagtgcttactacacacgaggtactgccctgtggtcatcagagaaataagttgcagcctttcccttgaggagtctacttaagacgacacctaatggcagaacagcaagacaaatgcaataatggaggtgctgagagacactatatgggaaggagtggctaattctgcttgaggaaatagggcgtgacatcaccagcaagggacaattaagtcaggtcctaaaagtgtgagcaggatttttgacacctaaaaaaggagggacatttcagaaagaagaaactgaatgtgaaaaaaattaaaacccgtaagtataaacagggttggtgagtctgggggttatgagaaattctgcaagggacaggaagggctgggagatgaggccaaagaggtaactgagtccaggttataagaaactctaaatgtcatgatatagcttagaccagtgctggccaacagaaacacaaggtgaactaaacctgtaatttaaaactttttaataaccacattaaacaaataaaaagagagaaatttacttaatattatagaaaaaagtattattttaacatgctatcaatataaaaagtattaatgtgctattttacaaattttgttcatactgagtctttgaaacagggtgtggattctacacttacggcacatctcaatttggacaagccacattttaagagctcaacagccacctgtggctagtgactattatatttggaaagcacaggtttagcccttattttgcaggcagtgcagaccaaaggatatgcttggttttatttcatgagacaatggcaacaatgtgaagaagcagaaacattgggtctgggagaaggcttctgaggtggcttccacagtccatgcaagggacacagagaagaacaaggctcagagcaagtaggatggcatggaagagtcagagtcagaagatacttgtaaaaggaattcagaaaactttagaagactgtatgtgagggatcaagtgaaggactcacagaaccattacatttttttcatgctgaaatttgtgcttagaatgaaagctcactgattgtgtatttaatatgaagtttcattgttccttttgagcttgcttccttctgcagtagaatgcagtgtcacttatgtaggatatagtaaattcctcttcaaagaaccaatatggtacgttcagcatgttcagctctcctgttctttgttctccattttaaagtttaaaacttcctcgttctttatgtctccttgcccctagtttcagtaaacaaccccctcttagcctctatcatctgctcttagtcatccttagtcacctgctctgtccttagtcaactgctctgtccttagtcatccttagtcacctgcactgtccttagtcatcctctgtcacctgctctcaaacagtccttcctgccgaaactactcaacccgccactctggcgcgcacccctgctctctttaaaacagccaatcggaattagcttagactgtgtggtccaaccctagccaataggggaaagacacagcagtagggactagctgcgttaaggataagacccacttccccttccttgtccagtgtgctctcgccattgctccatccatgagacgcacccttctatagaagcaaattgccttgctgagaaaacttttgcctgggtgctattttcacttggtggcaccgagcatttacttccaacacttaataaacatgtgctgagtacccaccacatgttaggcaacgctgggcactggggaagcaaagctacgacataattcttactttcaaagagctcaaatacagtgtaggagacaaaacaaattacaacagagcattaagtaaattaataaacagatatgcaaagaggcctacaaaatgttccataatgtataacttagaactgtttcatataatgtattcaatggcacttgtgagatggagtggggctttcagatagtaaggcttctatcagctgacttttttgagacagggcctcactgcagttgcccaggctggagtgcagtggcgtgatctcagctcactgcagcctcgacctcctgggctcaggtgattctctcacctcagcctcccaagtagctgggactacaggtgcacaccactacacccagctaattttttttttgtttttttaagtagagatagggttttgccatgttgcccaggatggtcttgaaaacatggactcaagcaatccacctgccctgagctcccaaaatgctgggattacaggtatgagccaccaggctcagcctcaattgatttttaaaagtgatccagaatatgatttacttctgtgtctgtatttggttgcactcactgtattaagagaatcctgatactcctaaatacagataacactatctgaatctctgctctcaaaactcaaattttcagacaaatctctcgctatttgctactcttactacttactatctgaaactgagaaacgaagctgacatgaacataacaagttcaaattcctttgcactggaatttacaatgggaaattttggcacctgaattctggaaatgagcagatttgaattgtaaggcacagttgtattggaaattataacagttctttagcatttcatttgataatctcataatatgcctcaaaactaatctaaaagcttggagaaaatgcagcagtcaagattttatttcaaattttaatcactaatgataatttgacaactatttaaggtaaaagagtatccaaaatgtagagtgggtagacatgatcctctaacagaatgtacatcactaagtgatgtgtgtggtgttcacttattgtacaactagccattaatccacacagaagcctccatcccacagaggctctgaaacgctgcctggcatgtcatcaagtgtgctgaatatgtgtgacaagaggaatttgcctgttcaatttatgatcaggctggaatatgaaaaatactgggatggaagttcctaatcaatgattcatttatttataagaagttcaaatatgtaagccaaaatagtggaaaacactatttcaaggttgacttggcagtccaattcaatgtgctggtggtcctaatgtgttaaaatttggtaggtagcacatttgtgtgcattttcttttattatagttataaaacatagtttaaaatatattaaaatgaaatgcaaattagatgtttgcagagcctctgaagtatctccagggaacttctgcagaccagagtttgaagatcactggcttagggactttgaggttaaaatgtaaatggaagaacaacaatttggtgcacctgctattttaaggctcatcaagtcattcccaaacttcagcccagggcagaaaccattcctcattatcctaagagcagtgaagctgagaaacaaaactgcagaaagtgttttcagattctctggtgagttagaatttaaaaggctgggaccaaaatttgaaatacattattcatatctcaatgttgttcatccattaattcattcaacaatttactgagcacctgccacgaggcactgttctagaggcttgaaatacatcataacaacaacaacaacaacaacaacaacaacaaacaaggttgggcatgctggctcacacctgtaatcccagcactttctgaggccgaggcgggtgggtcacttgagcccaggagttcaagaccagcttgggcaacatggcaaaactctctactaaaatacaaaaaattagctgggcatggtggtgcatgcctgtagtcccagctactcgggaggctgatgggggagaatcacccaagcccaggcccgggagttcgaggctgcagtgagctgtgatcatgccactgcactccagtctggataattggagtgataccctgttttttaaaaaaatacagacaaaattccctatctttgtgaaatttagagttagtggggagagacagacgataatcacaaataagaaacttgttgtaaggtaacaggtgacaggtgcactgaaaaaaattgggagtcaggcaaacaccacatgttcacacttatacgtgggagctgaacaatgagaacgcatggacacagggaagggaacaacgcatactggagcctgttagaggggggtggggagggagagcatcaggataaatagctaatgcatttgggacttaatacctaggtgataggttgataggtgcagcaaaccaccatgccacacatttacctatgtaacaaacctgcacatcctgcacgtgtatcctggaacttaaataaataaaaattggagtcaggaattagaactgtggtggaggagaaaggctgcaattttacataggatagtcagggtgtgccttactgagagaaagaaaaagaggatcagagatctggaggggagaggtaaaccaagaggccatcagttcaagcagtggttctccaagcggggtcctaaggccaccagcattaccctgaaacttgtcactagctcagaaatgctagagaggcacccagtggtctgtttttgcagactctccaggtgattctgatgtgctgtaaagtttgagaaccactgccctacagaaaaggccctaaaataggagtgggtctaggatgttctacagaaaaaggggtgaaaccaggcatctggaggtgagagccaggaggacggacggtggtggccacagcatgaatagctttatgatcacagcaaggctttggctcagaaaaatgtggagctatgaaggacttttcttcaggagccacacagcctacatttcaaaatgttcatgttggctgtttggttgagtggaagcactgcatgacttgcctcaagaggagactccctgactgctcaactccattttgggcagtggtatgctgctaaatgtttaaaaacagactctgagggtgaggagcaccaatttgtagtgtttgatttccatggtgtaaactctcccaccatggctgatttcaagctgccagtatgactcactgaacatggagttgtgaagagatgtgcataaacgactcacaatactgactctagtcccaacgtcactgttaccactgagaacatttaaaaataagggagaattctgtaaatctgattggaaatgtgaatgctattttataagtctatataaatgcaatgtcttctattggtctattactgtcaatcaaacacagagcccaagtccttagaattttttttttttaagaggcagggtctcactctgtcatccaggctggagggcaatggtgcaatcacagctcattgcagcctcaaactcctgaaaagttaatacaacaataatatattaacttcatttagagaaaacaccattagtattaaatttcagcttcctttattcaaaaacatttgttattgaatttctcttctcttactacaattaacatcttgcactctcaaaaagtatgcattgactaggatttgccatgcatagtatgtgagattgctgctccaaaggctcacataaatccaagacaggccatcaaggaatgtgcgtgaactgcaagaataaaagtttgaatctatctgaagatgaaatgaagtttgaataaggccttcatccatttgatttgccattaagaaacttttcttagcctaatggaatatccctacttctgtcaatgagatttcagtttgtgaataacattttcaaagtgcagcatcttctgtctacaaaaagacattctatgaactcttaatacacataaagtgtttgcaactaccaggagtctgctccacgcattctcccgtctgcatgatccctcgggcggtataccacccacactcagaccccgggcagccagatcagcaaatgtgcacaagcctgcactcctgtcaaacaatggggtctttcaggccttacaatcttgtgaagaaacaggctaaaacgtcatgggaaaaattaggaaatatcagaggaaaacagctcacaaaatgaggggtggaaccacttgctcacatgttctaatttctgaacaaagagaaacaacagtgacagccccctgcctgctctgacccctccatttcaaaagagaggcatcctaacccctttttcttttcttggagattacagcagcaagatgtagacagacagaattagaaattcttaaacctaaagaagcagagttaatttcaaaagctttatcctcaagagaagcataactaacccatcttaccagccttgtttggtgatctgaaatatcaacaaaattacagactagaaatcaactagacttcaacaaccacataaaggaaaacagaaactcctgatatatccctttaaaaaaaaaaaagctcttccaaagtattcttggtattaaatctcatgcaatagctagctctatccacctcagcaatccttcctcattaactgctacacccagtttatacttttcataccagcctagctagctggcctagtggcctgcaacactccatttgccatccccagcctttatcaagaattgttccacttgtaaattacctgtctctttttatccacaaaataacatctctgtttaaaaatctatttaagacttactgcaaaaatgatttctagattaatccagtacatttgcaaacttgccaacaaatttacacttctgctttaatatacttttataatccatctatattttccagttgattacattaatctgactttactaaaatctctgaggataaagtctgagtcaattcttctttacataatctccaactttccaccatatcactatctatctgtaagacgctatcagccgttaaacactacaggcacatcagctgctgtctcccaatagtgaggctgatggtcagccattttgggaaaagaaccataggtggattattactataatgcattatgtggaagaggtgtttattttgctcctggaagaaaaaaagcaacatgtattaaaatcataaaaatgtttttaggttgggcgtggtggctcacgcctgtaatcccagcactttttgggaggtcaaggcaggcggattgcttgagaccaggagttcaagaccagcctgggcagcacagtgaaaagaaactttgtctctactaaaattacaaaaattagccaggcttggtggcacaccaagctattctggaggctgaggcaggagaattgcttgaacccaggaggtggagggggcagtgagccgagatggcaccactgcactccagcctgggtgacagcaagacactgtctcaagaaaaaacagttttaaaaggtaaaacaacataaaaagaaatattctatagtggaaataagagagtcaaatgaggctgagaactttacaaagggatcttacagacatgtcgccaatatcactgcatgagcctaagtataagaacaacctttggggagaaaccatcatttgacagtgaggtacaattccaagtcaggtagtgaaatgggtggaattaaactcaaattaatcctgccagctgaaacgcaagagacactgtcagagagttaaaaagtgagttctatccatgaggtgattccacagtcttctcaagtcaacacatctgtgaactcacagaccaagttcttaaaccactgttcaaactctgctacacatcagaatcacctggagagctttacaaactcccattgccgaggtcacatcccatactaataaaatcagaggctgggcggtggctcacgcctgtaatcctagcactttgggaggccgaggcaggcggatgacctgaggtcgggagttcaagaccagcctggccaacatggtgaaaccccgtctatactaaaaatacaaaaaattagccgggtgcagtggccagcgcctgtaatcccagctactctggaggctgaggccagagaattgcttgaacttgggaggcggaggttgcggcgagcagagatcatgccactgcactccaacctgggctacacagcgagactttgtctcaaaaaaaaaaagaaaaaaaaaatgtctggggtggaagccaggccatctgtagctcttaaagatccccaggagattctaatgtgcatcagagttttagaaccactgtcctagactctgtcagtacaagattttgctcaatgaggaaaaagcacgataacttacatttaagttggtgacaggtaaaagcaaaggttacctctgaaacttttaagtaggaaatcactgctttggctgcaacaagaagtttgtgctctgattctcataattggtgtagcatacagtctttaaacagccctaaatgaacttgcggctttgcgatttagactaggagagagaaactaggcatggtggtagatatgagcccagataacaactgaattgttgcccattgtgccgtcgagatatttggcttgagagcctacagcctggatgcaagtcctaggtcagtcatctgctggctgtagagctacaggcaactctccaacaacataaccctggtattccatctgaggcagtggttcccagccctggctgcatattagcaaacctgggtctgggacgcaatccccgacattctgactgatccagaatggggccccaagatccttatatttctaaagttccccaggtgtggttatgtcatatgagtgaggagaaccacaggcagagaggttttgagaaaggatgctgaggccatactacgtgggttcaaatccctgctccactagttactagctatggctcagtttccttatttgtaaaaacggagataactgataacacctcctttgttgtgaggcttgactgactgaatccatttattgatctcagtggattattgtacggatttggcataacacctggtacatagcaaatgttcaattttaatcacatgcatcatacctatacatgtgtacatgtgaatatgtcctaaggattaaacagtttgatgcatataaagggcttagcactgtctccatatagaaaatactcagtaaatataagctgagctgatgctgacagtactggtcgtaggacaacttattgcaactgactgtcttctgtctggaatttcatcctttcctcactgcatggcagcctttgcttcagaaaaccacaactttaaaaggtatggggataagaataaatcattttttctctttcttttaattattaagaggtcccactaacaatgaacggtacttctactgcaaagttatgatgggaatgtgggcttaatggcaaagaaaagcgatgtggagacctggctctgcccccacatgatgataaatagcagaacttgacagccagaggaaactcagccccctcatttcctaggggaacccagagttgaaatgtgttttgctcaagatcacagtgtgagtggcagaactgggatcagacttaggaacagagctctttagtttccaggttgcttccattgatcatccctggtgagaagcatgcctgagaggtgcattatcatgtggaagatgctgtccttgtggtcaaggccaatgtgggggatgaggaatgtggtaccctgtttcccaattgcttccttcctctctctgccgaattcccttccctggtccaaattccacaccctgcaggccatttccagctgaaagggaggacacagagcactagaaagcagctgtggtttgtttgtggccaaactgttttcttaggggtgttcagttccaattttataacagaagacaattatgaaaagggtttaatttcccaaattttcattacatacaactgtttagagataggcatatataaatggatatgtgcatactttttatctatcaaggacaggaaatcctgtctttcagttgctaagtctcagactattccatctgagtatttttgctgacaaatgtgaccttgtctaggttctgcgggaatttaaaaattccctcaatgtcatttctacttgaccttagcaacatgaccaaactgcaaattcaaatgccattgagtaaaggtacaacattcacatcctgttaccaaagcgttctccaactccaatccagtgaccctgggccagagcctaatccaaaagattacaaagcaactttctgatgagttgtcatggcaacccctagatgttagatatttcatgtcatccctgggctgcaaattctcatttttagtctactcatatcctactatttcatgtataacaaccaaccaaaatgcaatttgaaatgtcagctgccaaacataataagagatgccacttgctattatagccaataataaaagatttctagttgcttgtttcagagatacagcaaatcactgtgtattctaagtccactgggctggtcctcaaagtgaggctatttagctagacttccttagtttttatttaattagtcaatatttaagagagccttggagataaaaagaattctagtgaaacctaggcattattattttccaaacaggaggaaatgtactgatcttcagactttcaatagacatgatatatttggtctgagagagagagacagagagagagagagagagagagagagagaagcccaaccgttatctaaaccttttaaggacacaattatacaagagtgccttgcaaggttttcaactctttataactggaagagaggaaaacacttattactgaaatccagataatcaaaacactttgttttaatcagcagtttctacccttttcacattctatatcaattcacaaggagtgaccttcatcttaggtataatggggtcaaaacctacctctgcaggtgtttctcccttacctgccttaatctgtggcccaggttaagcacacctgcaggcaggctcaacccaagatagccaggagttctattatgagtagactgatgtagaaagatctctcttgaaattccctttagctgacaaagcattgaaatcacctctgcaaatagctggaattgtgtatttatttttcttttctctgtttaaaatttagcagaaatgttaataagaaaagaaatgtccagtagatgaacaacaggcccagaaggaaagagaaatgaagaccaagataatacacaaaccagattatcaatcttgaaataatccagaagtagacatatgatagatcatactatgtgagtttttctaatcctaaacacaaagggaatataaagaggtgtgcagtagggctgcatgtcaaccactttaaactaatgctagccaatacctgtgtagagctgcaaactatttttctgctagaattttaagagaacttttaagttttgaaaattgattcccatgacacttctctttccgtcttcataatagctgccaaaaagttcaaaaccacatttatggcctgtctctaagaagtccttaaatggtctttcttgacatcttttattaattcctagcctcattttctcacttttttgttgtctgctttagtggggagtatctctgaggccaaattaaaactttttacaataatacaggtgtattattcaacagatagccttcattaagcctcaaatatttatgggggcttctcttccagaccatccctctttgatccatgaggcaggagatatcatgtttcaacaagaatttgtttcagttcacagagaagctgaagcaacatcaatttctcatacttgtttcaatcacatttggaattgataagctaaaatagagaagagtgctatgctaggaagctgggatcatgaggaggtgagaagccaccttttttttatttgggagcttgcactcatgactttggccagaccccagaagacacataagttccctgtggtaaagtatttattggactatcacccaatcctttcttctacatgagaatatcactttggcagatgtacaccaaagccttctctgggtataagtcttcagcctgccttggatggatcttgtctgcttccgtctgcctgtgcacacaggctgccagccccactccaccctccagtaaaacctacttgactatgtatagtgctggcttagaatgacacagatttaggttcaagttttgcatcctttaatggctatatgaccctggacaaggtatcaaactctatgagtctcaggtacctcgcctgacaattgggaataataaagagtcccttttggggtttatgtgaggattacattaatgctcatagggtcctcgacaaaatgcctggcacaccaaagtcaatgctcaataaatatcagcgattggtattacaattatgttattataattctttgaggaactgctggtggccagtgtaaatcctatggtctttatctctcctgaccccatccacaggctcatgtgacaattttcccaggatcatttcaattttctgcgatcagagagaatgccagccacggccctatggaccagggacaagatagcacacctgagcagaaagaaagaggaccactagccttgggatagaattatccctcacttcaccctcactgtcggcatgttcagagactaagtgcttatagaaccagactcagggttttcctgttagtctgaagagtgcttcatctcttctaggctttcactggcagagccacaggatgagaacactctcggccccttatcaccacccacatcagcaacactgaggccagcatcagggtcttctgggctgtgcggattggggagccgatgatgtagttaagtttcctggaaatacaggcagcaatttcctgtggcttcctctgtttttgatgtagagatgagcacaggtaaaaactaaacacatcaaggatcagcgcttcagtcggtggtgcaagtgcggaaaaatactgtcatttcctcacaaacagattcagaagtgcaaagtataagccactttccagagagcatgctccccagcaaggacctgtacagtagggctgtgagttgacagtgaatagatgggcattcccatgaacttacttgcttacccaagtgatcaagaaccagaatttccatgaaggtcaatgttttgtataaaccttagcctgaaaaagctctggtctgctcacagagcttcagtcaagccttctccagaatttgcagccaggtcagaaaaaaaggtcactttcagaagtggaaagcagtacaaattttagttaaaattttagatgaactaaactgtttatacaactatcctaaaagatagtttagaattaaataaaacaatgtgcactacatttgggaaacagccaggttcaaagaaggtggtcacagtgtattcttagaaccagaatggaataaagaaaatgatacatgttatggttatgatagcataacctgctgatgaaagaacagcagcagcaggatgtacagtttgcaaagggtccactcaaatcagagtgaacccagatggtgctagaggcagcctagggccaaatcccacctttggcactcactagctgggtgaccttgggcaagtcatttaaacttccatttcttcatgtgattttgtttctccatcattggctccccttcctttgtgaaaagttgcccctccccataccaactggggcacccatcatcatagtcagcaacctgacctaaagatagctcaggtataagacatggtaaaatcttttttgctttagtccgttgcttgtaaccaaaaaaccaagaccttttttcggctgcaagcaaaagagatttaacacctaatttgcagaagttgctaggagcattaaacgaagtcacacaaagcaaacacaagaaatgctggttgcattcatagaaaggaagattagtgtgtggttaaaagcaaaggtattgagtccatctgcatgggttcaaattccagcaccccttagaacagagataaatcacttaacatctttgctctcggtttcccagtctgtaaaaacagagctaataatagtaattacatcacagggttgtgaagattatgtcaaagtagataaagcatttagaacagtgcccaacacagtaaacattcaagaattagccattattattacaaaggtagaactgttttgattactgttaaggatgttgtaaaagtcagtgatctatagagaaatgcccttcaactaaaaaagccagggattgtggcacaagcctgtagttcccagctacctgggaggtggaggcaaagaggatcctttcagccaaggagtttgagcctgggcgatatagtgagaccctgtctctaaaaaatttttttaaatttaaaaacatttttaaataggaaaagaaaataatccttcttctgggtaatccagcttgatggacaatcccttagagacaattagaaaggatgcatttactcagaatttagtaagttctaatattgggcctcctgaatgaacttactgaccagcaggatgtggcctgagcaaatgacccatgtcagttgtgctgcctggccttcctcttttcattgtcaagaatacatgagcatatcaattatgaattaatctctcataaatttaactataagtcaattcttgcaagtcacatctctcaaaaagaactaataaaactgattttggtcctgtggctattcaccagggctatgcccttatgggggccacccagcaaccaaccagcctcactcttgctgaaatctgttaattgcagctcaagcctgttttactaactaaatgcagtgtctccttcaccactgcttcctgtgtgatatcactaactcattccttcattcatttattcaatcatataagaaacatttattgagcaccacctaggtgccaggtgctgggctcagtatttgttaagcaaaagcaagcaataaacagtgctcaaaatgctttttagagtttagtgaggaaggcacgtcaactaacgattagaaacagtatgctaggccagagacaaacctgagccatgagggacctcaggcctgcatggtgggacccagaaagagttcacacaattagcacaaagcacttgggaagcgaacagtttacccagggcacagaaagagtagactggaaagatacataggtctgagacattctgggatttagacaccttgcaaaggaagagaagtcttcggaagattttaagcaaagtcatgccatgatgtttagttttgcctttagaaagaacatttggttggcagtatggaagatgaaccaaggggctggccatatgtgcaaagcaggaggcaggtaaagagtttcctgtgtttgtccagaagagaaatggtaaagcctgaacacagggcaatagatgagggagcaaaaaagagagtctctgggatttcaggatatgaaaccacctgattccatgaagctatcttactttagctcactgtatagaaaactgtgcctgtcactgttcagctacttcttgaaagaactgagactacaaattaaaattgaaaactacatgcacttatactatgtccatgattccactgtgaaattgtacaaacccattctccaggactcaggaaggccaatgttcttattttttttttgagagagtctctctctgtcgcccaggctggagtgcagtggcgcaatctcagctcactgcaacctccacctcccaggttcaagcgattctcctgcctcagcctcccaagtagctgggactacaggcgcctgccaccacgcccggctaatttttcgtatttttagtagagatggggtttcactgtgttagccaggatggtctcgatctcctgacctcacgatccatccacctcggcctcccaaagtgctgggattacaggcgtgagccactgcgcccagcccagtgctcttgttttagaaatctgggagagcttgaaagtacagaggaagggcccttaagttaaatagtcatccctcctcaacaaacaattaaatgttattatgaccaaccatatctaacaggttcagagacatcctagcctgtctgtcaactttgtaggctaaatgaaagttccaggttgtcagacccagtgtagttttatttcctcagtatctatttcctgccactttactttacaaaatgtttccctttgaatgtaaccagagaattccatgaaccctgccataatgttaatactcacggtgaatgcacacttatatcactagaatatctgaccacatctgtttgttttgtgacatgacaggccttgagactggtgaaaaatttaccaaaccaatagtttactttctcttaaatgtaaaatgcaatggaatctcttctgtacctctggaaacactgtagtcagcttttctgaatgaacctgctgggaaatgtcaagatctctaaataaataagttgtgactttcattgtatttgcagcacacaacctctgacaaggaagaaaggccacaaggggatgttgatcaaatccaggtcagaactccatcaaggtggacagacactcaacgccctggtagataacaaagacaacggtggacgagcaataaagaaatctaacaaggtctcaaaggaacagcaaatgaatttcaattttaaaaggacatgggtcattctagaaatcaatgtgtgtgcaatccaacagttccatatataaataccagaaaatatttatgaagcaagattaatctcgttttagaaattattactaacctggctttattactggtttaaactaaatttataaaacaataggcttgtcccttagccaaatacattcatgtctaagaatgaagtcatactctatacgaagctaaagagaattttataatagtctcataaccccattagggggaaaaatgtatctgttctctcttatcgatcgatcgatcatctatctatgttgggaaagcaaatttaatgaactccctgaaactcttagagaaaaattatgggaagacacacactggctagacatatttcgatagtggttaccatagaaacaagtcattagatttcatttttggagttgtggcttttgataaaatattaaatttcttagagtatttgcatatacagatagcgcaactgctgatgtgcaattgaattatatgctgtaaaaaatatttacactacttctacttttagattactaatatctacaaagaaaaaaactcactcctaataagaatgaatttaaaaactcttcctctaccttgccattgtttcctactgggaaaaagctaaagtgagggtggtgaaggcataaaacaggctgggacacaagacagggatctaaggaaaccagcttggtcttgcttgagagaaactcctgatggctttccaaccacagctgctaatattctgcaggccacctaactgaacagcaactctggtaatttgtttttaatcagactaattcttcaatctcattttcctgtgacaagatggctgtttctcacggtgtaagaaatgatgatgtgcttccttcttgggggagtgagttgtgatactgccttgtgtggagctcatctagtgtctcctttcatttatatttcataacctccctgctgtgagcccaagaacctgaagagcacacctcacttcctattttgaaaattaagaaaaagtatacattttaacacagagtcaaaattgcaaagttaaacgaccactaactcaaatactgattttaaggcaggagcagcagcaggttagctgctgcactgaattttactgactgaaagccactagggtgtttgccaatcaatgctaaaatgatacttgaattaaaatcaatacacaaccccatatgtatgtggtgtgccaggaacagcctaagagttgctcgacctaggatctaagatgtccacgagccacaaacctggtaatctttgaaattagggttggcggatttagttttctgtcagctgggaatgtcctggcattaaaccaaggacctcaatccccttaaaacaatgaattcagcaacaatcttgacttcccagacataagaagtaaatcacattaacagctgagaagaggctatgaactttctgtttgaaggtcaactagaaaacaagcgaaagatcagctgaaaatgtcatgggtgaacctgagccaggtgctggctctaaaattacagcaaggtccccatgaaacattaaaagaacatagccaccctgtaaggtgttataggaggattctcttttcactttaaaaattatttatgtatgcatgtacatgctttaataatctctggcaatatgcacatatttatgtatatagccatacatgactaagatataaatctcgtctatatgactaagagatggaccttatctttatatgactaagagattatgttatctctgaagggatcaaaggtcacgtttgtttttctgttttccccaagctcagcactgacatgcatgatctccatagtaagggggggggaatacacacacacacacacacacacacacacacacacacacacacacacgctgactattcacatacagaaatatatatttgctattaaaaaaattaaaaccacatacaagaattagccaaacagtaggaaaaacgaacacatgaatcaaccccagaaccaccactattttagacttgccaagtaaaataaagatctaaaaattcatcttatagaaaaagaaatctgagaactacttctatattgttacagaaaatacaaaaacagatatattttattatttgaattaagcattaaaaaaattcatcttacaagtaacaggtatatcctaatctttaaaagttctatttgtactagtcatctactaggtcaaaaaaagtttaatacaaaacatttggaagtaaatgaaaaaatactgcatttttccaatactatcttttttaatgaaatatcaaaaagtttaacacatgttaatccttttgaaaacctattttgcctcctaagaaatgcaaaataacttataaagtaattctaacatcagtgaagaatgctactatgtttcaagtaaactgtctcaaaaattttaacttaaatatgaattttaatataatttatgtgaaaatgaaaaatacttgaaaatactttgctttggtctaggattaaattcatgatgtatttcattaaatatcctgctattgtctgctttacgatattaagaaaacaagcataacgaaaaataatggttatctcctcagccccactataatgggaattcttcctcataagaactacaaagcaaataagaggagatgtacttcaaaatcttaaatattcatcacaaaataagaaggcaaatggactttaaaaatgatgacccacgtaaaatcaacatttaatcctcaacatgtagactgtctgctttgtggctttcttagagtgaaccttagctttaccctcctagggaccaaattcctatctcttgcattacaaacatctgcaggccacaagacagcaaccaaaggttaatactgcctccagccaaacattattaagaagctaaatctgctaacttccattaaatataatactaaatataatattatttccaaagccaacagatattacttttgaaccctatcacttgtcaatatgaggctagaaattaagagttgactaaaagtatagaaaaaattagccaggcgtggtggcgtgcgcctgtagtctccagctacttgggaggctgaggcaggagaatcgcttgaacttgggaggcagaggttgcagtgagccgagatcgccccactgcactccagcctgggtgacagagcgagactccaactcaaaaaaaaaaaaaaaagagttgactaaaattatagttatatggtttccagataatatataataatatatatgtataataataatgtgataatgtatcacttaatagattgaaaatgatgagatgatacttctcaatggcagacactagcctgtagggtggtggtattcaccacagctaaaatcaaccgctcacttaaatagcacctggactgggaccaaatcctccaaatggctccccctcccacctactcaacagggggcaggctgggacagagagtcacgtgtgttcacattagcctgatagaggatcagaatggagtcagactgcaagggtaggaatttcctctcttccagtgctctcatttcctcatctacaaaatgggaactgctgtaaggattaaaaaatacatagaaataaaacatttagcacaatggccacaagcccacattttcaccctgtctgttgtcaaaagcaaggtaggagacaactaatgctagggtaggtggaaaagagggacagggtgtggctagggagagggacacctgccagtcacatggtgggcatctctgctcacaatctgaaatgtatgccacaggaagttgccaaactgcttatttttttaactgcccgttactaaaggttgatgagataacacataagataaatgaaaaaaaaattaaaaaacaactagagaaataaggtggggaatattatatgaaagacattatacaaggcttttgttttgttttgtcttggagtattgtttttttatttctaagctacaatctatcctgattttctttttttttttttattagtagactattttttagagcagttttaggtttatagaaaaactaagccaaaagttccctcttccccgtttcccctgttattaaccatcttgcacaagtatggtacatctgttataattaatgagccaatgatgatataggattaactagtcataacagtcaatatagtttacataagagttcactctttatgttacacagttgtatgggttttgacacacctatctatccaccattacaatatcatacagaatagtgtcacagcccttaaaatccactgtgctccacctgttcatcctgtcccctcttccctgaactagcaaccactgatctttttactgtctctatggttttgacttttgccttttctatagtttaaatcgtacagtatgtagcctttccagactggcttctttcacttagcaatatgcatttaaggttcctttgtgtctttctgtggcttcattgctcatttctttttagtgctgaataatattccattatctggatgtaccacagtttatcaattcatctaatgaaggatcccttagttgcttccagtttttgacagttataaataaagctgctatcaagattcgcatgcaggttgttctgcagacataaattttcaactcatttgggtaaacatctagatgcgtagttgctgaattgtacgttaagcctatcttgagctttataagaagctgccaaactttcaaagcagttgtaccaatctatcattttcaatatctaaaaatccatctaccaaagtgtaacttaatatctacacaatgtgaccagtgcattatttatgatctacctaagtgaaggacagttaactttcaggttctaactaaacttgaaagataatgtgatcaaaaaattcaggagttgttgactttgggctgttgactttgggcaaattatctgatttctttttttttttgaggcggagtttagctcttgttgcccagactggagtgcaatggcgtgatcttggctcactgcaacctccgcctcccgagttcaagcgattctcctgtctcagcctcccgagtcgcttggattacagggatacaccaccatgcccggctaatttttttttttttttttttttttttttagtagagacaaggtttctccatgttggtcaggctggtcttgaactcccaacttcaggtgctccgcccgcctcagcctcccaaaatgctgggattacaggcgtgagccaatgtgcccggcccaaattatctgatttccacagcctcaaaaaaatgtattaataactagtcgcaaggatcgtctttaaaaatcctttacagtcattaaaggttatgcaattcttaagaaggtgactatgatctttgtgatgccaataactccattttacttttaagcaaatttgttttagtatcattttcaatgaaacctcaacaaactgtagttcagactttggagaaaatgcttaataatcatgacagtgaagaccacttgggactgttaggctggtttttgttgctgttgctgtttttgttattgttttgcctttagatcacaaaagttttgtcctggtggcagaaggaaacatcagttttccattggaacattctctgactagcattatggtctttacataacgttcattccttatttccacaccctccctaatattacagagtaattactgaatctctttttcctatgaattttaaagtttgacaccactggccaaaaattctatgaatttggcaaaaatgatgatggatccaaaaaagctagcatccttttctcagcatttaaatagtttttttcctcatgaacaggtctactacctgaacagttccccatctcaccccaccatccctgtgggaagaaaaccattagaaggcatctacctttatgtagtaaaatttcattgattggaatagctcaattgaggagcaataaacctcagtcataggacattcattttttattttttatttttgggagacagagtctcgctctgttgcccaggctggagtgcagtggcatgatctcagctcactgcaacctccatctcctgggttcaaatgattctcatgcctcagcctcctgagtagctgggataacaggcatgtgccaccacacccggctaatttttgcaattttagtagggacagggtttcaccatgttggccaggctgatcttgaactcctgacctcaagcaatccgcctgcctgggcctcccaaagtgctgggattacaggcatgagccactgcacccggttatttataggacatttaaaaagaaatactgtcttcccaatttcatgtaatacagtaatagctaacatttactaaatacttactatgtaccagatggtattcaagggcttcgcatacatgttttcaattagccatcaaaataaccccttgaggtaattactattactgcttccattttacagattcaaacactgaagctcagtgaagtcaagcagaaactctgctgtgatctctccagaatctggtctagaatccttggataatggctgggcccaacattctcatggacagacactgctgcctacttggatggattagtatcagctgcttctggggtctccatttgggtatattgctcacctgacagcaaccaccccctccccccttcacacgcgcacacatgcgcacacacgcacacaaatactcgtgtacatgtgctctgtgctgtgcctcacacttgctgcctgtgctatggggaccactggctggtatcatatctgacacatcccatgtttacctactgcacttgactcctccctaaaagctgcttctattgccccctctgagccatcatcaccctcatgggcctttctagctccaagtgatcttccttaagctgctgaaattaaccaaacaagaaccgtgaaggattaacaatacctaatataaattatgctttaaaaataggctttagccaggtgtggtggctcacgcctgtaatcccagcactttgggaggccaaggtgggcagatcacctgaggtcaggagttcgagaccagcttggccaacatggtgaaaccctgtctctactaaaaacacacaaaaaattagccgggtgtggtggcaggtgcctgtaatcccagctacttgggaggctgaagtgggagaatatcgcttgaacctgggaggcagaggttacagtcagctgagatcatgccactgcaatcctgcctgggtgacagagtgagattctgtcttaaaaaaaaaaaaaggctttagtactttttaagtaaactgatgaaaattatttaagcattgcaaactcttccttaaaatacaattcatttttaaaagtaagtggacatttcaaccaggctcagtggctcacacttgtaatcacagtacttttggaggccaaggcaggaggatcacttgaggccaggagttcaagaccagtcagggcaacatagagagactctgtttctaacaagaaaatttaaaaaaattatccaggtgttgtggtgcgtgcctgtagtcccagctactccagaggctgaggtagccagtgaactgtgacggtggcactgcactccggcctggttgacagaacgagatcccatctctgaagaattttttaaatttaaaaacaaaagagtaagcagacatttctaaactggctaaaagcaatttcttaagtaggtaaacatagcctttatatgttcatttacatcattcagtagtttagttagctctgttcctgctaagatgaacttcaagaactagctatgaggtgatcagaaataatctgaatttgaaacaagagaagtctgaatttgaaacaagagaagtctgaatttaaagatttttcatatttggattaaaatatttgtaacagggtggaaacagaaaaaattggacaaaaatctatgaaaacttgctctccaggaattttctccaaaggtctcctggcccagaccctcattccatgacaggaggctggcagtgccagaggaatgcagcacaaaggggtggaaaggatgtcagcaagagaagctatcaagggaggaggagtgggacgtggcagaagttaagttggactgataacgtggcaagctgggtctgagtgactactgctggaacacaatgaacagtgggtccttcactcaacccagattggtgagagccaggagccactaagtcaaaattaacctaaatgcacataaactctaggattccaattttattctgtttttctgtgcctctactacactcccttgacctttaaataatcttcacaaaacagttataaagcagagttgattactgtacttttataagtataatgtgtaaaatggagacatcaacttctgaaagttataaaacatcaattttaaatacaatttttccacttttattcttactgttgtctactgaaaacaatattctccaactaatcagaaaacctcaggctcatccttcaatttctgctcaaaactctttaagataggtttcaacagatttccatacaaaagaaaaatgcgttacattcctccctattgatgtctaatgtagtacagtgtattaagatacatacattcacccgaaacaaaataacatgttctcttagtacaaactggcaaaaaaaaatcatttaccttgtttattgtttgtagaattacccccaattcaagaaaaatgagtacatataaaaattaggatttataaaatatgaattagataatataaatgaatttattttaaggtgatttgaagcaaaaggtcaccaagtatattacaatacaatctgatttacaaaatcatatttcaaaacaaattttctaggaacacagatactccataaagcagggtaccttggctaaaacaccaatgtctcacttacatagaatttgataaggaaaatgaaactttacactaaaattgttaggtagagcatgtggaagtattcaaaagaaacctgacgttaaagtcctatgaaaattttcttaaaatatgcatgaaaaacatacttgtaaatttacgatacttgttacgaatcaagtttttgatattacaaatgtgaaaaaaaaaccttcaaatgtcaggttaccgtttttactgtttaatgaaaaagacaaagctaaagaccacatataaattattgacctgcatactaactaccactataacgagaacatgactgcagtttacaaggatgaagctctttatattctcatttggagaggactgttgtagtacatttgacatgtaatatatttaaacaagtatcaatttctttcttcttcttcttttttttttttttgtagagatggtgtcttacccaggctggagtgcagtggtcatcatagctcattgcaatctctaactcctgggctcaagtgatcctcctgtttcaacctccttagtagctgggactacaggcatgcaccaccatgtacagttatttttttttttgagatggggtcttgctatgttgcccaggctggtcttgaactcctggcctcaagcaatcctcccacctcaatctcccaaagtgctggaattgcaggtgtgagccactgtaccaagtcacaagtatcattttcctaagggctaccaaacagcaatattagtaccattactgccttatttaaggtaattaaaatcaactttttctaaacttagaggaattcttcactcccctaaagtatagcctctacctacttttttagtctaatttcttcttattcaccatcatccaccctatgcttcagttaaaaagggttaatagctatccctggaatgtcttcccatctccatgcctttacccaagtggttcccatgcctagaatttcctccctcatagcttcagctgtcaaagttgaacccattcttcaagtagcacttcggtctctgctttatccaggatgctctctgatgtccctaatcagacagcatttcttaatcttcatccctacagcattctgtatctttcttggagattaattttactctcttatatgttatactcatcacattcaagtgtcttctagcttagagtatatcataggtgctcaacaaatgtttgttacatgaatgaatacatatgctccttgagagaaaggcactaattttattcctcattgtgtctctttgctatctccccaaggtgagacctctgcaaagccaggcaacaacccgtccacatgtactcagcacctagaacagcacatcatagtgcactgtcaacaatctacagatgtttgtgaaatcaaccaattaactaatctgctgtcgttttttcagtacttaacactcctgacagaattgcacattcttagaattggatatttatatttttcatttaataaaaaatatttttaaattattattcaataactcttccttgagtgtgtcctgcttgctaggaagtggatattacatacagcagacaaaatagccgtgatccctaatgggctcatagactaatgggagagaaaactattaaagaaacaaatgtatggccaaatatgaaattaaaattctaataagggctgggaaagaaaggagaaagcaaagtatggacaactgggtggtgctcattaagggtggagatcagggaaggcttctcagaggatgtgatgttaaaatgcaagtgaaggatgaacgagagttagaaaaatgaaaagtgggaggtggggtgggcatttcagggagaaaagcagcctcaggaagagcctggtgcacctggtcacagtggtggtatggggtcaatgaagggaaaatggctgcatgaggccagagagcctggctggggccaggtcagcagactcccaccaactccggggaggaggctggattcttagtgcaacaggaagccatggcagggcagatgaagaataaatgaactggctgcttcactactaccctgtcccaagggcccagaccatgaaacggtcttttatttggtttcaaatccaaataaaaacctatgtaggtatagaatcaaaagaaggagttaaaaatttgggaaggttttatacattttcctgttaacagaaaatttaaatataaaaatattttattatctcagagaggcaacagagatttatgctctttgattcagagataaactttgtcttgtagaatgggaaaaaatgactaggtaagatgattttcctttatcacttttcagaagacaagtcataatggaaatgactcaagataccacaatttggaagatgagtgactgtctttgccatgggagcagagtgagggtttgctaaacatcagctgaaaggagagatgtgctcttgctcttagttacagacaggcactgtatgtgatgtggccccataaaaatcctggcagatgatgtagcttcctgtcatcttcctcccataactgcaaagtccaggagacagagtcccctttccttggtagaaggaagtaaactttggcataagacacattttgtgccaactacctaacagcaatgtttaaataaaaataaaatgctattggagcatttcaatacatatcataaaaacaggccaggcgcagtggctcatgcctgtaatgccagcactttgggaggccaaagtgggcaaatcactcgagtccaggagttcgagaccagcctgagcaacatggtgagactcccatctctactacaaacacaaaaattagcagggtgtggtggtgcgtgcctatagtctcaactactcgagaggctgacgtgggggaatcacctgagcccagggagctgctgaggctgccacgaaccatgattgcgctactgcactctagcctggttgacagagtgagaccctgaaaaacaaaatgaaacaaaacctaagattgaacaacaaaaagcaacactaagcattttatccagaagcaagaaaaccctaccaagaatttgtatttgttcatcagaatagataacccaaatgaatactccacagaacaagactgccgtttatttaataggtggtaggtttttaaatgggagataggttatttcttcctttctccccacccacagagttttggccacttccagaccatgttcagctgacattcttttcaaagactcaaaaaaaggtaatgcactctcagtggaaaggtagtgttccaccagttttggtaaatactgatctaggcctgaacttttgatttctgaatgaaagaacaagatgattcatatatgccttaaggaaaaagtaagtctggtgaccagatctgaatgaaagcaaaaaggcttgaatttaaaaagcgaatcctgtttaaattttgggcaaatcatctaacatatcctctttccttttgcaatctacactaagaatactatttttttttccagtttaagaaaagttgacctaccaaagccagaactgctaaataattacaaaacagttgttttagaaatcacttcaccctccgaaaggagtcaactttccatgtatacttaaaatcactcataaaaatggatttaccatttaagaaataattttcaaacacacatgtagtttgtcaaatgaagcctcactgttcattcattcattcattcattcattcgacagatattgattgagccctgttatgggccagatgctgattgtggcacttgtgatacagcagtgaacagaagagtctaaactccctgccccaatggtgcttgcattcctgtgttacgtccacacagctgtgtaactgactctgaagaaaaatgagcttttaaaacataataaacatttcagttttgccagatgaaaaattctaaagatttgttacactacaatgtaaatatagctaatattactgagttatatactcaaaaatggttaagagaataaatgtgttcatttaaccaaaaatttttttaaatgaaaaaaataagcataacaaacatttactgagtacttaccatgttaggcagagcatcatctcatttaatcacaacaaccttagcaggaaggcactattattattctgttttacagatgggtacactgaggcacaaagaggttaaacaatttatccaggatcacatatccaagggatagagctgagatataggcccaagtaatctgataccagcaacttgtctcctaactccatacaaaaagtttcaaagataatactattttcagttggaactacagttaataatacaaaaatagtaataataatatagtacaaggaataataatcaactttttttttttaatcctgatgatttgtaacccaacttactgtccttttgatggccattttttcctaaaaacctcagtgttgaacaaactgctttcaaccacttctctgtaagccataatattcttttccttcaaatggaaataaagaaaaatcacacaggatggtttcttttagacaagatcaggcacgttcagggtggtgtggccatagacgcggatggtttcttttaaaacagacattactgaaactgtaaatatttttagccttttgtacttttcatccagcagcttaactgagaatgatatagaaacatttaaaaatagccactcagtactctgaaaaccattagtttagcacatacccagcacctgcttgacacatcttaatcaacactcttttgctagtcatattaaaaaaagagagaacccttttgctttcagaattttttcccttaaaaaacgtatgtgtcaccagggtattttgccctctctctttctaacttagagggtaacacctggagtaagtcatgggtgactaatgaagatgcaactttcccctcagcatgatatacttcacaggatggaagtaaaagcttctaataggagcatttattacaattgttaggattgtaatggaaagttaattttgttttatagtttgtagaaatgattcaggatgatatgagaacactttctataaacctgcactgataaaaggaagatgatagtgatgacacatgatatactttctgagttgtttttccaggggtgggaaagttcaatccacagatttcaagacagaaagaagaaaggaaaggagaaggaaggaagaaagaaaacaaaattttttttagaattgactatgctcaaatacactgtgctttttagcatcaaactttcaaccatggtctgagcagcactatgttgtaacaaaactggagtagccagcctgagcaaacatgaacatcacaatattttaaagttcaaataacataaggcaccagttttaagactgcccgggtatcctttttagcaatacaaagattcacacaacttggtgacagacagcttttccctccagccaaatctgatgaagacttgataatatcacctgccataatcaaaattcctgggcacatgggaaggtctctgactcaaatcaaagagagctttgggccccaaagctatgggccccacagctatgggctaccaaagaaaggttataaccaggctccagtgtaaaccattttgtttcttttaacagttttagatcttctaaagtatatgagatgatattaataaaatttaaatttcctgctaaatttttttagtctctttccttaaaagtaaaacttacaatgatcagaaagcatgctttcttctggctttatcattcaacttcccaggcaaagatgatcaacagcaacactcttatctaaagcaaaagtaatggatatgattatcactctggacagaaagtctgtatttgcccatttttatcaatgattgagacaatgatccagaagctgtattggtacaaaaacacaacaccagggatgccagaaacaggattacaaaagttctcacaaggttaaaaatagaccaaaatgaatatagtcaagtttactaggctcaaatgtgaggtcctgtatggtcagtacatggaggtccagcagcctcttgattcaatacaggcagtgtgatgggtttgcaaaaatgtactcttaggctgcattaataaagacactgttctcaaggccagataagccacagtccctctcaaactgctcagaaagagtagctttagggccaggtgcagtggctcacgcctataatcccagcactttgggaggccaaagcaggcggaccacttgaggtaaggagttcaagaccagcttgggtaacatggcaaaactcgtctctacaagacatacacaaattagctaggcatggtggtatgcaactgtagacccagctacttgggaggctgaggcaggagaattgcttgagcctgggaggtgaagggtgcagtgagccaagattgcgccattgtactccaacctggatgacaggagtgaaatcttgcctcaaaaaaaaaagggaggtacttctataatttgtccactaccttttaaggaactttctgataaactggagaaagcaaaaaggagtgagatcagaatgactgtggaactaatattatgagaaatattgaggggaactgggcatagataactttgaaaaagactttattatggcagatttgccaagtaaactgataattagaattattttcgatatagaaattaggataccttagaagaggtatctgcatttgatgggtgttaaacttcaggatgtttaaggtcttgctcaactctaccaatctgtaattacatggggaaaagtgctatgtccctcatgaaattaaatactaagaactggagggaggctgcatcaacagattttctgtatcatgtattgaagagttaattttctccaaccaagctagtgaatgaaagggtaactcaagatgaaataatgatgtcaaagcatttttaatatacctcgtggaagaatccaagtgtattttaaagagaaaacacagcacttgttacaccatatatttcatatttgacctgaagttggttacacagaggccttagtcataataaaaaacttctctctgctcaaatgcagtatgtacatagtcataaatgaaaacatcattgccgaactattttttttaaactatcatggcacaaattgcttttaacaaagaagtcatattccaaaagaccttttgtacacaattgtgcagtgtatctttgtcttactgtttagtatcctaaaagaaatagttttcaaaatatctacattcatttataaaaacttgaatgcaggtaatttagcaacaaatcacaactagctgagaactgacataaaagaatgatctccagggccagaaataaaccccaaaagataagacatactagaaaaacatgagagagagaaacaaaatcaatagactatcatctcaatatctagtatgaagcttggtaaagagttgatgaatagaaataaatgatccctacagacagactcaattaagtatacagcataatttgttcatgaaaaaatgagtatgtgaatcttcctagatcttttcaaaaattacttaaaaatattaaataaacatttttaaaatgggtatattaaagcatcctaataaaatgaagctgattgattggttgctctaagggagtagtgataaaataatctgctatataaatcctggatcatataatggtataatgcccctcaaaggtagtagaggaaggtgggttttaggccacttttaaattaattgctctctacctgtttgaatcacacacaatatgtttggctttaagaaaataaaaaggacctagagcagaaaaatagcttatacatagtatctatatattatatttagaatatacattttatatttaagagacatttcctcttggacttttatcctacaataaacaactacaaccataaaaacagtaccagcaaaacccaatctataaggagatttgtagaaaagtaacaacttgatatattctagctgtataaagaggtctcttgtcaattcattatcatccacttacaagtattttatgtacatcttaaaagcctgaagaagttattgtaatgtttcaaactcaaaactactcccctgagcattgatataacttatactccctacaaccaaccaacccaaatctcagtttgcctccattaacgctccaaaataagtcaagattgtaaatacagtgggttctcaatcaattgactttttcaacatcagatgggtggctggagccttcacaaacttcagagccctaatagagatccccttttctagcccacataaataatacaaatcatatctctatgatcattagagatgcaaaaaatcggtacaggcctttctccccttctaacacattatcttaggcttgttttatttatttaatttttacattcctcatgtgatctgtggccacacaagactgattctccaaactgaacttcattctatctgctccacaataagcaatatttattcattttcactcaacaattgtttactaaaaatgtactgtgtgtaagacattgtgctaagagcaagtaagtactaggaagtcacagttctatcatcaagttttaaatctagtaggtgaaagactcatacagaagtatcaaggcagccatgggccacctgagtggtgaaactgagacccaaagagtgtcaggaagacaggaggcactcaactgtggtaaatggggagaatgacagaggagatggcatttgagttgggcctgagaggacaggttgtccaggatttggattgacaatgatttaagggaagagaagagggaagaagaaaacagccaactttaagcaaaggaaacacaatgagacaaatttgcaaaagcaaaaaatgtaatgagcattgcataccaccagaagagcaggtgaataagggtactagctagaagcagcaaggttcattcatttgtattagagaaaagtgcaagataaatggttcatctgaacaatgggtggtttcacagggtttgaaaacatctctccctctgtaagtcatactatctccgactgaagggtccaacgtgaagcaggaacgaaggggccagtcctgtttggttgtccaggtgcaggacccaaaaccagcaacacacagagtgacatatgttgtgactatgcccttctcatatcaaccccaaaatgtaccgaaacactgaaaagacattttccaacggagacttgcccaagttttccttttaaaactattcagttttgaacctccaaattctgaatttcaaactcaaccacctgctttctcagcaacttcaccagtgaactcaatgttgaagctcctggggaaaaaaaaaatctcacataaaacgtacagtgtgataaatccaggcctcatagcattagctgtgtcctcccacttcccacagggactattccatgaaacttatagtgtcttcttcctggtgcacagctgggccacgttttccagcctcctttgcagctagttggtgacatgtgattgagttctaccacgaaatataagtgaaagtgattatgctaatttctaggcctaatttctatgctaatttctaggcctactccataaaaaccttccatgtgtaacctgccatgtttttccccctctcttgatgtgatgcaaacaagcacagtaactctgggagtcacatggtgaagatggagaaactacaagatggaaggaatctgaattcctgaaggatttccaggaggaaaatgtcacctaccattcatcaacacccatttaagacctcatgtgaataaggaagaaacttgtgttagaacagtgaaatgttgagaagttatcttgtatttttttattttgaaaaataatttttattacgtatatttatggtatacaacgtgatgttataggcttaatatagatagtaaaaaggttactgtagtgaagcaaattaacatatccatcatctcagttaccctatttttgtttttatgttaagagcagctaaaatctcacttagcatgaatcccatacctatagtcttcatactgcacattagatctctatacttgttcatactactttgtatcctctgacctacatctctccatttcctgcccacaacccatatccctggtaaccactgttgtattctctctgcatatttgaaatttttttggttccacatataagtaagatcatataatatgtctttctttggcgtatttcgcttagcacaatgggctttcccatgttgtggcaaatgacaagctctcattattttctagggctgaataatattcattttgtataaaccaaatgtggtatacttacagccacttctttctctatttgtccatcatcagacacttaggttgtttccatatcttagttattgtgaatcatgctgcagtgaacatgggagtgcagacatctttatgaggtggtgatttcatttcctttgggtatatgcccagaaaaggaatggctgggtcatatatggtagttctgtttttaatttctttagaaacctctataacgttttccataacggctatacccaatctacattcccaccaacagtggacaagagtcctccacatcctcaccaacatttgttatcttttgactttttgataacagccatcctaacagttgtgaggaggtaaatcacagtggttttgatttgcatttccctgatatgatgttgtgtaccctttcatatgcctgtggccatctttgtgtcttctttagaaaaatgtctactcaggccttttgcccattttataaatcaggtaattcgtttgttctttgctattgagttgtatgagttcctgataaattttggctactaactccttaccaaatacatgatttacaatatatctgatgtacattggaatattgggatatactgattggaattttttcccaatctgtaggctgctacttcactttgttgattgtttcctttactgtacagaaactttctagtttggtgtagtcccatttatttattttatttttgagatggagtctcactctgtcctccaggctagagtgcagtggcgccatctcggctcactacaatctcggcctcctgggttcaagcgattctcctgcctcagcctcccaagtagctggaattacaggtgtgcgccaccacacccagctaatttttgtatttttagtagagatggggtttcaccatgttggccaggatggtctcgatctcctgaccttgtgatccccctacctcagcctcccaaaagtgccgggattacaggcgtgagccactgcgcccagcccccatttatttaattttgcttttgtggcctgagctcttgttgtgatatccaaaagctgactaccaacgccaatgtccaggagctattcccctatgttcctgtgtaggagttttatagtttctgcttttatgtttaggtcttttatcaattttgagttgatttttgtatgtggtatacgataacagtccaattccattcttttgcatgtggaaatccagttttcttaacatcctatcaaagagactattcttttcccattgtgtcttcttggtgcccttgtcaaaaattagttgactatatatacgtggatttatttctggactctctattctgttccactggtctatgtgtctgtttttatgcctgtataatactgtctttattactataactttgtaatataatttttaaatcaggaagtataatacctccaactttgttttgctttttcataattgttttggctattcagggtctttcatggttctgtacaaatttaagaagcattttttctatttctgtgaagaaggtcactggaattttgatagagattgcaccgaatctgtatattgctttgggtactatggacatttcaacaatattaattcttctgatccatgagcatgtgatatctttccatttttttgtgcttaatttctttcattaatgttttatagttttcagtgtacacatctttcacattggttgaatttattcctaggtattttgttctttttgatgctttgttaagtgggaccattttcttcatgttcttttcaaacagactgtaattggtatgaaaaaaaacgcaactgattttgcatgttgattttgcaccccacagctttactgaattcattcgttgttctaacagtttttttgtgtggaatctgcaggggcttttttccccccctacaatataggatcacaccatctgcaaatagagataactttacttcttcctgacctcaatgcctttaatttcttttccttatctaattactattgctggtacttccagtactatgttgaatagaagtggtgaaagtgggcatccatgcctgcctgatactagaccttcatggaaaaactttcagttttcccccatgtattataatgttagctgtgggtttttcataaatggcctttattacacagagaagctttccttctatacatacactattgagcatttttctcaataaaggatgttggactttgtcaaatgctttttctgtgtcaattaagattatcatgtgatttttatctttcattctgttaatgcaatgtatcactactgattgatctgcagatgttaaaccagctttgtatgccagggataaatcccacttagtcatgacatgtaatctttttgatgtgttgttggatttggtttcctaatattttactggggctttttgcaccaatattcatcagagaaattgggtttaaattttcttttcttgtgatgtctttggctggctgggtatcagggtgatcctggcctcataaaatgtgtttgaaagtattccttctagttctatttttttggaagagtttaagaagtactggtatcaattctttgaatgtctggtagaactcagctgtgaagctatctgttcctgggcttgtctttgttgagaggtttttcattacttctccaatctatttgtgattggtctgttacaggctttctatttcttcctgagtcaatcctggtaggttgtattttcctaggaatttatctgtttcctctaggccacccaatttgttggcatataattgttcgtaatagggacttatcatcctttttattcccgaggtgtctgttgtaatttcttcaatttcatttttggttttacttgagttttcttttttctttgttagactatctatgggtttgccaattttacttaaaaaaaaacccaactcttaagtttattgattcttcctgtggcttttctattatccatttagtttatgtttgttctgatttttatttctttccttctactaatctggttttagtttgttctttttctagttccttgaggtgtaatgtcacactattcatttgagatctttcttcttttctaatgtaggcatatattgctataaactttcctctcagaactgcttctcctatatcccatcagttctggtatattgtgtttccgttgtcatttgtctcaaggcattttttaaatttatcttttaatttcttctttgacccattggttgttctggggcatgttgtttatgttccagatatttgtgaatttttcaagattcctcctgtcactgatgtctagtttataccactgtggtttgaagttatatctgaaatgatactagacataatttcaatcttaaattttgtggcctaacatatggtctatcctggagaatgttctatgtatactctagaaaaactttacattctgctgctgttggatggaaaattctgtacatgtctattgggtccatttggccaaaaatgcaattcaagtcctgcatttcttactaattttctgtctgaatgatgtacatgttgttgaactgagaagttatttttacagcagctagcattaccttaataatatacacatttcgaccaaattctttatgttagtttgggtctacccagaagcaagtaccaagatagaactagaaatacaaaagatatattgagaaaggaagccacagaatgtgggaggtccttcaaaccacacctatggacatggagaggaaaggaagaaggaatggctaggaagtcttggattccaacacagttccaagaaaggtctgctcaggccaataggagttcttgagccaatttggcccactggaaaagtcctgtgtcccacaggaatgagcctgaaataggagcccctattgtgcttggtcatgactgggagacgctagtggcaatttgtagtttagtacaatgcaagggtggctgcagaggggcagcagttgggccatcagtcaactacgcttctagctgtagatctaagcacttattttcatggacactacacccctcaaacttccaactttcaagacctacaatcccttatccatatccacacccagtctttcctcctttgttcccatctattaaaaactgagttgtcctttgtctagcccaaagctaatcttgccatgtgttctagcttacgtgccatcagatctgcttagagacattattccatcagttatctccttcttcttcctgtctaatggattatatctatcctccaggatgtaaacttgcttgagattttaaccttgaaaaagaatattaaaaaaatgttccttgacaactcttgctctccttcccttagtatctaagctccttgaaagagtagtataaatgaaccatctcatttcttatttttcaccacccactaattgctcttgctaggattactgaacctaccagttgacacatcctggaacccttgcttgacccctctgaagtattcaacattcttgactactccctccttctgcagattcctgctttgggttcgtggagcaccctatcctcaggttttcctcataccctcagatcattccttctaaagcttctttttatttgcttcctccttaaaagtccacttcctagggcttatatcattggttctctctgttctctgtttcctacattaatatcgccccttgatctcacgatctaattgagcacttatatacttatatactgatgagatcactcatgtagtcacccatgtagtctcaatactcataaccaatcagttaccaagttctgaggattctatttcttaactggctctcagcaccatcatctccttatctccccactgccactgccccatgaacttctgtaggagcagagtgaccctctcgccttggattccattcctacttatctgtacctccacagtgctgcaagagaatatttctaaagcacaaatttcatcatgaaacctctgcattgagattcctgaagttgttccccactgactacaggatgaaggccagcctccttggcatggtacgtaaggtccttcataatcagttttagtctgatcttcctccactaccttctccatgttcccaaactctcattatatgaagttatttgaaattcatacaatgtggcatatgtttcatgcttctatggccttgtatgggctctttgcccaaaatgctctatgaccctgccctaactgggggaatctactgtgcattctttcaatgtttggtttgggattcatttgtacagcgatgacttttacagaccaattcacctatctgtggagccccttcccatccccacgccccattcccaggccattcaagtggctgttgtgttgttagtacccattcatgggtaccatgcgtgcacatgattccaggacagcaatcctgccctgttcctttttgactagcactgacacagagtaggcactaaatggatgtttactgactgaaagaatgaatgatgtacagacccaatctccgaagtttggcctcacaaaatttgcctctgaaaaacaaaattatcacagagtagccaaaaaccatgatgacaccaatcaacattacatgcacacactggtgtccaagtgcaggtagtgacatctccaatttacacgtgaaaagtggatacttggcattaaaggagaaagattcaaatggtctacgtaagacagccacaaagatagctcaagagctattatcccaagggacacgcattaactgttagtaagtatataaactagagttcacatttcacacagaactttctaacacaaattggaaacaggagacgattaagctgatctaaggaaaagcatggctttgatacacaagaaactacacatgcattttacattaaatgctttttaaaattcactcacagaaaagagtacaacaattattttaaaagtcacagtttgtaaatttgatatgtaaaattggaatttaaaataaaaaatctccatggccactgaaggctgaaagagtaaaaagaaaaaggaaataaaagacaaaatgtgtagtttcaaactctctgtgatgcatctcacccctgatcagtgggaagccagttatcacattgaagacactaggtaagcacaagagtttactgaaaatggaccttttcatgaaaaatcatgggtcaaacatctctatgacatacactgctgttaaaggaaacacatagtttctcattcttgacatgatgatgcctgatgtgcttagttagacagacagcttaatatggttcccctcccaaagcttagtgaaaatagcttttttaaaaaatttgaaaaataaatccccaaacataattcttctggcaaaatattaaatcctaccgaagaaggaggctttcagggaaacagtccaaataaaccttttaatttgtttaatgttctataagctattggtatcaagaaaatgtatatctttgttttaaaatagacaaattagtgatgcatctacatgccatccacttaactttgttcctgctgttcagcctttataagagtagcattttttcttgcgctgactcctgaagcctaaatctgcaaaagtctgtgatgacatcaagcttaacattttgccaagcctgtaaaattatttctcaaaatagtgtgctaacacatcagcttttactcaaacctaaattaaatgtcaggaaaggactcccatgtttacactaactgcccattagtaaacatttctgactgtaataactgaaggtcccatgttctcaaggtaatggcaccagcaaaatcccttgaaaatttgctcctaaccacaagtctaagtaggatgtggtcactcaggttttagattgatgatgctgaagaaatgtatttacaggctgaaaagcttataaccctggccaaaacactgacttcagagcaccaggagaaactccttggactagataaagtaaatatttgaagaaaatctgcattcattgagtgatttgctggtatatacaaaatttatcctttaaggaaccaaacaggagttctaattacctccctatatttcttctccttatactttccaagttcaattacagctttgttcaatctctgccttttttactcttttgtcctctgtctgaagttttcaattaagacttactttataacaggattgtggttacgtaggaaaatgttcttattcttcagaaatgatgctgaggtcttcagggaaaaatgtcatgaaagtaagtctgcaacttacttttaaatagttctaaaaaatgaacccctcttgccaacacacatacaaaactataaattcagagacaaaataacaaatattaataattggcaaatataaacaaagggtatataaatgttcttcatatgattctttcatctcctctctaggtttgaatttttcaaaaggaaaagaaaaaaattttaaaagaattacttaatgagcaccaggttttcaaattgtaaatgcatttcttgagcatcacatatccaaaacttgagaggcctagggctaaagaaatgtcaagactaacaaaagacatgttgttgtcctctacagacatgatgttgactcaatttgcacatcctggaagtgtgtatctgggatggaggtgaagaggcattcacagccaggcatttttctccagaaagctgtccctttggggtttcctcgtctttccctcccagtgagaccctggttcacctgctgtctctccagctgtcaagcagtggttcctgggaagtctgggagacccgtgagaggttggaggtagattcaaagcaccctcatggaatgaatttaccaaataaacaactgcatgttagacctgtacatttaaaaacataagtgctacaaatattcttaaaaggctttcaaaatttcagtgaagacaagaatgctttttcaaatgtttatgtaaaaatcttatacaagctgtttgctattatagtcaggatatatttggtgagaaaaacaaaacattgtaactcaaggcatgctccatttcagacaaaacatgaactctctcctttaattatatcagccattacaacaagaaaaccttgtaaaaggttcacacatggggcccacattatggggatccacttcaccctcagagaggcttgttacacagctgagagagagcatggtggaggacagttgcttctcccttttttataaaatccttcccatttgctctaaaatagaatttctaaataacagcacccaaagagtgctcaaaataggatactaaaccactttggagggcaagacagaagtctcttgtcagcttccacaagaaagagaactttaggctgtacaagtattttctttgggatgcaaacactttgatataaaagtaactttctttaatatatttgtgctaacatgatgggaaatgcccaactcacacatcaggatcttagtgatagtgcatctatcctgaacatggctgtcttaattagcccgatgtgtctatggtaataaacaccacgctgcagaacaactcaatatacccaggtgaaatctttaccacttaaaacactttagacggcttgtaatcaattggatggcattttcccaatgagaaatcctaactgcaaggtaaggtacctttctatctatagtgagtgttgacttacgttgcaggcatggtgctaagagacttcctctgcattatcaactcattttaaacttaatactaccttgtgaagtatgtaatgtcctgggcaccagatagaagaggacagagaagcactgagaacagaagaaatgaacatttatcaagtactaccacatggtactgtaacagtgctctctatacattatcccatgtaactatctctacaaccctatgatgtaagtattagtaatgccattttaccagggagaaaactgagagatacataactggactaaggctgcagagatgggaaatgagcctatactgtcatatgcccaggtactatgtgggcacaattcctcctgatcaccacattctacaagctccaacccagatgctaaaggtagaggcaacaaccatggaggaatagccatgaatgttccttgcggccactgcacccatggaggctagagcagacctagtgccctgagggtgggatgtaaattcctttttaaatccagagggtgtgatatggagggtctatctctggtttaacgaagatactgaagccagtgaaaacagatcccaaatctggccccacgactgacccagcctcctaaagagcctgtagatgaccaactacagagagaggaaggctctagaagacagaagatgctccctgggaggttcttttcagctgtctttcttcttccctcatgcctctctatgacttaacttggcatctaggtgcacatgggcaattgttcacagcagccaaaaggtggaaacaaccctaatatcaactggtaaatggataaacaaattattgtatattgtagcatacaataaaattttatccagccacaataaggaatgaagtactgatacacacaacaatacaaatgaacctcaaaaatgttatgctaaatgaaaaaagccagacataaaaaatcacatactgcatgactcaatttatatgaaatatccagaaaaggtgaaaccatagacgcaggaagcagagaagtggtttccaggggttgagggataaggggaatgaggagtgactgcttaatggggacggagtttcctttggggtgaggaaaatgtttcagaactggatagaggtcccagtcgcacggcactgtaaatgtactatatgccactgaattgtacacttgaggagggttaattctatatgaacttacctcaattttttaaaagtacacatggcaacgcatagtctttgagcaatcttgaataacgatatacactatgccaagctataaagatgccccaccctgtgccctttttacattacacacaaatagggacggatttcctgtaagctgatcttgaagaaaaaaaacatgttagacaaagaaaatcagaactaagacatctcccccccaccaaaaaaccctcaacactgtatctttgttcttttcccatgtcctctaccctactaaaacgaacaaataatataaaccccaaccactgagtgtaccacagacagaaaacttggtacacaaaagacctaataaaataaaatctgtcaagttttgttgcccccaaattgaatagaaagatccagcaggcccttaaacatatgaaaagaagcacactcttgctggcaatcaggggaactcaaattaaaacagctagtgatcactttacaccgcagagagagaacacttaaaaagactcctaacacctggcaggggtgaggcaaacaggtactctcatattttgcaggtgtgactctacagcaatgcaacttttttggagtatcatctgacatcatgcatgagtcactgactccgtttttaggaatctatccttcaaatatcaaagtagatacacatgaatatatgtacaagaatttaactgcagtgttgttaggaatggtaaaaacctagaatgctcttgaaggtatatcagctggggaataattgaataaactatggtacaacgataccataggatattatgcaactgttaaaaagagccactagattcatatttgataaggataaatgttgtaacaaaatattaaagaaagttgcagagtattgtttatgatgccattttcatagcagaaaaaatgtcccttctccatgtaaaggtatatgtttgtatgtatgtatatgatgtatagagaaaggaaaagaaccagaggagtgggagaaagacaatcaactttttctatattcacctaaatattattttatgcattgtcctacaattttttttaaaatagaaaaagtttaagtaaacagcatttttttctgcacttgccttttttgtttttttttttttttcaagacagggtcttgctctgtcgcccaggctagagtgcagtgccatgatcttggcttactgcaacctctgcctcctgggttcaggcaattctcatgcctcagcctcctgagtagctgggattacaggtgcacaccaccatgcccagctaatttttgtatttttagagacgaggtttcaccatgttggccaaatttgcctcaaacccctgatctcaagtgatctgcctgccttggcctcccaaagtgctgggattacagccatgaaccactgtacccgaactgcacttgccttttatacatgcaagaaatgtgaaggggacagtccccaaaaacccactttgaggatatgttctgaaattagtatctactgaacttcagtctcctaagttgtatatattctgtccaacagtgcaactcgaactggactctgcagaccagccctagtcccagaataagcacagaaactgagagtagacctttagaatttttttacagcagcttgccagagtaattttatgtctgttgactataagaataataaatgtttaatcaggcttatgtttttagtttctttaaatttcatttttctagtatttcatttttctagtaaatcatttttattgtattttataaaattatcaatccatgacatactggaaattaaaaacaaaactggtccttcacccaagataattagagaagcaaaactctaaacaatgagagtcaatgttcataatgataaaacatagtaatataagatatttaggaactttaataatgaaagattagattctattgagaatacatgctaatatattcaaactcttatgaaaaaagatactaaatagatcagaagaaagctttctggtaataagaacagattactaaccattctaggtaaataattaagttcattcttgtcaggaaaaatgaactctagtttctattttcaagtgaagactaagagacctggagaataaatgaaaccccatacaactccaaaaccagctacccagagttcagccagacactttaacttttgctgaacaaaattaacttcattttcatttttttctcccctctcgtccttctgaatgaagatgctaatagcaacagaaaacagtaacagagacaagtggcagggttaggtggggctaaggtctgactactccgtgcagattctatttaataaagtttcacctaccaatattctatgctgggggtgaggggtgggaagggaagggagagagcttacatactcctaagtcttctgagttttctaaaagttgatacaccaagttacagttacccagaaaaactggtgggaagaataaagaaccaaaaaacatacttacagtccaaaagtaaaaaatatcatttgtacatacaaatttcttctccccttcctaaattttttaaactaatgctatagtgaggtgcatttccaaatctggcagcttaaataaaatcaactgtaactagcattgtggtgaatgaaatgctttacaactcacagctgtgacactgaaataaggaaatcctggattcccaccaaggggtaaccagcatcaaaagacagggcacattttgatgttttgagaatttctgagaagtcagagaaaatttaggttattttcatatcggttggactttccataataaaagagccctaaaacaaatagcagccccaagtgtggcagtgctatattgtttggattccttataacaatcagtgtgttcataagatgcttagaaatacacagaataagctgatggccccggtgagtgggacacacgctgggcagctgtgtgaacttttaaaattttaatttaatttttattttatttcaatagttttgggggaacatatggtttctggttacatggataagttccctagtggaacttcactctgagtctccagagtccattatatcattcttatgatacactatatttggttttccattcctgagttacttcacttaggataatggtctccaattccatccagattgctgtgaatgccattattttgttcctttttatggctgagtagtatttcatgatgtatatataccacattttctttatccactcattggttgatgggtatttaagctggttccatatttttgaaattgcgaattgtgctgctacaaacatgcatgtgcaagtgtctttttcatataatgacttcttttcctttgggtagataatagtgggattgctagatggaatggtagttctacttttagttctttaaggaatctccacactgttttccagagtggttgtactacctaagaaactctaaagactcatccaaaaagctcctagatcagtaaggtctcaggaggcaaaatcaatgaacacaaatcagtagcactgctatacaccaaccgtgaccatgctgagaatcaaatcaagaattaaatcccttttacaacagctgctaaataaacaaataaaatacttaggaatacacctaaccaaggaggtgaaaatctctacagggaaaactacaaaacactgctgaaagaaataatcgatggcacaaacaaatggaaacatatttcatgctcatggatgagtagaatcaatattatgaaaatgaccatactgacaaaagcaatctacagattcaatgcaattcccatcaaaatactatcatcattcttcatagaactagaaaaaacaatcctaaaattcacaaggaaccaaaaaaaggtacacatagccaatagaacaaaagcaaaaagaagaaatctggaggcatcacattgcccaatttccaactatactacaaggctatagttgccaaaacagcatggtgctggtataaaaacaggcacatagaccaatggaacagaacagagaatccggaaataaagccaaatacttacagccaactgatctttgacaaagcaaacaaaaacataaagtgaggaaagaataccctattcaataaatggtgctggaataattggcaagccacatgtagaagaatgaactggatcctcatctctcactttatacaaaaatcaactcaagatgaatcaaagacttaaatctaagacctgaaaccataaaaactctagaacactggaaaaactcttctagacattggcttaggcaaaaagttcatgcctaagaacccaaaagcaaatgcaacaaaaacaaaaataaatagttgggacctaattaaactaaaaaatcaacagagtaaaaagacaacccacagagtgggagaaaatctttgcaaactatgcacctgacaaaggactaatatccagaatctacaaggaactcaaatcagcaagataaaaacaaccccatttaaaaaaaaaaaaaaaagaaaaaagaaaaaagaaaggaaaagaaaaaaaaagaaaagaaaaaacattgtttatgaagttcagagcttggagattcattcaagtattgattgcagttttattttgaaaagaatgctacaatttatgtggtttttctcatgtttatattaaaagctaataaactaatttaaaaagaacctatcaaaaactgggcaaaggacatgaacagacaattctcaaaagaagacatccaaatagccaacaaacataagaaaaaatgctcaacatctctattagggaaatgcaaattaaaagtgcacgagataccatcttactcctgtaagaacggacataactgaaaaacaaaaaataatagatgctggcgtggatctggtaaaaagggaacactttcacactgctggtgggaatgtaagctagctgtgtaaacttatgaaacaaagaccaagctgaggtccttgcctcacctgctgtgcttcaagggctcatcagcttggtcccaaatgatgtcttcagtaggtggcgaaatgttaaaactgggagctatgtgaacgaacgcgctgaaagacaaaacacgttagatcagttaggtcactataacaaaacgtagtatcatgcaaccaagtgctgttaaccaacttccttctctgcttgacattgaactacctgcaaatttagtgcttagaaaaggtccagggacttgcccatgaggaagaactcagcaataccacagactttaatgcaactggatttcacctcctcatgtcaccaagacttactgtgcagggtacaaatggccttcttccgtgtcaaatcttatgtccccctttcactcttgttctccttgacttctttgtagtgtctgacactgttcagtagttttttttttcctctttttattctcctctctctcctgcttcgcctgtttcttttatggtttcctgctcctctttctccttctgcttcttgaccaaggacactttttaaggccctgggtttttctctctccctcagaaatcgtctgttcccagcacatcaattctctccttgcagatagccccccaatcatccccattccctcccttgaactcctctcctttattctcaactctccagtgagccatttttcctgcatatggtatctctactgcatatgctcttcaaaagccttcatttcttgctgcaacactactgctgtggaaaaatgagcttgtctattgacctcattgatttctgcaatagcagaattatcctcccagccaaccaagctccaaatcttagattcatttttgctcattccctcttcttcaattccagtcattcatcaaggcctcttgatttgttacatctcacctctatcttttgctacccacttacactgaccagatcctgcttagctgagaaaaactccctcttctcttctttcctaatgtttcctcttgtaaaattggccagcgtgctgctgccattttgatctttctatcactacccctgccattttcatcttcctctcgctatccccagcaatttgagaatcctcatcacccctctaacaagcaacctgcattgcccagtagagagaaaacaagacagcagagtagctaagaactcaggctctggatcctggtggccatgctttgaatcacagttccacaacttaactgctatgtgcctcagtctcctcatccctcaatgaaggccaggtgcagtggctcacacctgtaaccccagcactttgggaggctaaggcggaggatcgcttgaggccaggtgttcaaaaccagcctggataacataacgagttcctgtttctatggggaaaaaaaattagccaggcatggtggcacacacctgtagtcctggctactcaggaggctaaggcaaaaggatcactcgagcccaggagttcgaggccaccatgagctacgatcataccactgcactccagcctgggcaacagagcaagactctgtttctaaaaaaagtgggggcaggagggacttgataatatctcctgcaaaggcttgctgtgaagataagaatagttaaaaggtgtgaagaacttagaagagtgcctagcacagtaagcactccattaagtgttaaatggtaatggctcccagctggactggcccacacagcatctcctaaacctgtgtgctcacccttcctttgttattacaccttccatcatttggcttatacagtgtggaaactcttcttctcttggctcctctatacaaattctgcccactgtcaaggctcgggtctgatttcccactcagccagtgggaaatctgagtacttcagctgcaaactagcttttctgcctctgaacttctagaatatttactagatgtccctaaatcaagttgttttttaaattactgagtgtggagggaagctcacaggctggaaattactggtgatggagctggaggtcttgctctttcctctgggtgcccctaagtgggtaatgtctcagaaccccagcttctttctctgaaaaagttattatcttatttataaggtttcctcaaagactgaataagaacatgtaaagctcctatcatataatcaggcgtaaacattagttcccttccagtgggactataaacctccaagggtagctcacgtttctccgtgctccaaggacagtaatatgcagagattaaacagacagataggggaatacagactgaataaacgaaaacctttccaagtctgattttatgacaatattctgaaaagggcttttccatgcctattctaaacaactgacagtgcttccatcataaaatgcattttgacacacttaatcttccaagaacatacgttgattctatgccctgatgagagaatatattagctacttaacctttatctaactcttacataatattaagatttttttaagattcatttttacaaaacccagaaagtccacacacaacaaaaacaaaacaaaacaaaaaaaggaacacaaagtaattgaaaagacttttcatacctaaaaagggaatttttaatcacaaccttagtcataaacctcaacaggcaagtcagaagcagtgaaagataaaagtgccaacaagaaaatccggttgaagtgccactcgggttcatgcagtgggttacagggcgcacaagacaagctggcggaagtgggtgctgtacctttatcacagccgcccccacctgaccacctgtagcagcctcagaggaagcagacaacccccacacactttccagctgcatctttgcagccacaaagtacgcacatacaatcagctaacgtataaaagtatatcagaagcatcaatgtgaaaagggaaaaaatctttaactcgtgatgagtaacctgtgttatttagattctgtcattgagacctgatgctaaggggagacccctctaaagacacccacacaaccctgataactggcagcataagtgcataatctttgcatcaaatacctggggcactgaagaggctgaagcagcaaatcctctggtagagggtgaggaccaaatgggggtacctcagaggctacagttcctccccctagtgttcaatgacaaatggaaacatgtcactgggtccaaacgcagggaggactagtctttgctttggcaccaggctagacaaagaaaagaccccttgccccgtgaccccacattgtcctacaaaggaaaaggctggattttgttgatgaatgcaattcacatgtttggagcagtgtcatttgaaaggactgcttcagaaattcatgcaagtcacataagtggagagaaaacaggaaaaaattaagaatggctgtttacaagtcacttctaaaactttgctttgttctacttgaacaatttttatcatcatttaaagcagttaaattaaaatgcacctgcactgtaaatcgtgagagaacatacctgctcttcaaatatgacttgaaaattatttggtttctcccctacctccccctacctgggatgctctcattttacatttaatttggaaaattagaagaaaaatggaataagctcaaatcctaaccaaaatttgtttttacttttaaaatacaaccattttagaatttttaaataaatgtaaaatattttattatttacttaacttttaccttcagggttacatgtgcagatttgtgatatgggtaacttgcgtcatgggggtttgtcgtacagattattttgtcatccaggtactaagcctagtacctgataggtttttttttttctgctcttccccctcctcccactctccactctccagtaggccccagtgcctgttgttctggatgggcgtagcggctcacgcctgtaatcccagcactttgggaggccaaggcggcctgaacatctgaggtcagaagttcgagaccagcctggccaatatggtgaaacccagtctctacaaaaaaattagccaggcatggtggtgtgcacctttagtcccagctacttgggaggctgaggcaggagaacagtttgaacccaggaggcagaggctgcagtgagccgagatcacaccactgcactccagcctgggtgacagggctagatttcgtcttaaaaaaaaaaaaagaaagaaatcatcaatgggcattaaagaaaagtgtaacttttaaacctactttcatagttcaaatacacccagtatttggaggtcagagtagtcacacttcactaactttataaaggagaggctttcaataaatgcaaggaatgtctaccacagcaatacatgtgtaaaacgtttcatctatgacagccatgttctaaattaatgttatatttcctactctgaaataattttaatttatgactaaaaatggtaacaaatgttcttttcattgaggcccaagaaagtatgagagtatttattcacatattctcatttcccatgtaacatgcctagggccatcctgaatgagagcacagaaaatgtgaaggatttctctgcctagtctgcttaagatcaacaacacctataagtctaaacataaaacacacacctttaaatgatcaccattaatgttaataagcattaaaggtagacactgaagtcttttgtgttggcaaatcctagaactacattttcattcagacaggttgcctctggataaacgtctaagattttttctaaaaacaagttatggtatttataattgccttctttaaaagaatgcaaattcttttgcctacagattacgctaagcaaaagagtgagagagagaggaaatttcagtaaaattttgagaaccatagcttgcattatagattttggaatgtaccttcctgccatttaacccaaccccattttcttatttcctagtaaatacactccccagttattcatcccttattataccctgggacaatggtcattttggtaccaatcacaccttagttttccactatcacctgctaaaagttctcttgaagaaaaaaaatataactgtaagagaaacctgagtgatataacgtcagtattttaacatcctaaccctttcaaattctctctatatgagaattgactattttcatcctcccttgaaaaaatgtgttcgggcattaaaattcctctaccttggaccttttcataatggctgccttagtatttattttgatatactattcaagacaccaacagtttgaggttttcacttcttttcttgaagagtgtcacaaagtcaaatttcagcctcatctacaagacatttaaaaattacactgctttcctgatttaactcctaaatatgcccaacacaaataattatgttgttcacctgaagatatgttctagaatcttcacattgctactcataatggccccaaactggaaactatacaaattaataaatagtggtatagtcacacaatataatactatatagcatggagaatgaaaaatcaactaccatagtcaatatggtgtcatgcacaatatgagttaactgtgcatattatcgagtgaaagaagttagacacaaaatagtacattctgtatctccattgatataaagttcaaaaacaggcaaagcaaatctatgctttcccaagtcagagtagtggctaccacgggtgaagtagttactggaaggaagcctgagggatttctagggcgctgataatgctgtgtcttaatctgggaactggttacaacagcgtgttcactttatggaaattcgtcagtaagatgaatatatgttatatgcatacttttccctatttatattatcattcaattaaaaagaaataaaattaatcagcttctcttaagaaacagacttacaggaatgaaaactagtgtgtttcacacagtaaaatggaagaagcttaagagctaggttcaaattccagactctaccattaattattcaatcttagcttctctggcttccagttctataaaatggagccaacagcaaagatcaaatgacataacactgaaggcattttaagcaagaagaatatacaaatgctgagcactactgcctgaaatactaataatgtacttatccgagaagcctttaaagttacatggttctacacaaaatgttagtataaacataactggcaagataatattatcagttttgccatttaaagaacttcctaacaatcaaagatatgcaacatttattctacccaaagttaaagtgtcctgccctaacctctactttgagacacttggtaaataattttcggaagagtgtcaagatacataatattataggagacgatgtcaaatattaaagcttcaataataagtggactagagaatgattctactcacagctcacagttcaatccatctcttcttctcactgacttctcaaccattctgtgcttttccatgttttcctccttcttcccactctaccctgcctcctacctggccatgccccctttctctctgcccactgaaattctacccactcgtcagtgcccagccaaggcattcctctggtgggacacccttccaggccatggagacctttccaggccgtggagacctttccttcctttgaagcactttttttagtgcctcaaccgtctgtttgcaacagtcttggacctgagcattgaacagctatgtatctctcaagccatgatttaacaactcatgtgctcatatcttgcttccccagtagactatatgttttccctaaaggcagggacctgtgtgatacttattttaatcccccttcaatgctctgtacattgtagatattaaatgcttgctacccagtgctctactttgtgggttcaagaaagcagtaatctctaaaagtagggcaaaggtgcagactgggatttcttcaagtaagtggattctgtcggtggcacctcatctctaaaactctctgttaagctctgatcttcttttctctgagagctctcaatcactctagactttagagactaaatcagcactttgaaatcaaagtataaggtgaaccacatataattttaaatttctagtagccacattaaaaagtaaaaaggaacaggccaaatgtatcttaatatttactagttaatcctatatatgtaaaacattatcatttcaacatgtaatcaacataataaaaattatcaaggagatatatatcctttttgtttgaaagctggtgtatattgcacagcacatctcaaccacatttcatatgctcaaatgccacatgtggctgatggctaccatactggacagaccaggtttagagttcaagctagaatatgtgatttcaaaccattctgaaaaaatctaaaatcgaacaaacgctataggaatatgcagtaatcttcctaaatcttgctcttaaaaaaaaaagaatacggccaggcacggtggctcatgcctgtaatcccagcactttgggaggctgaggtgggcggatcacctgagatcaggagtttcagaccagcctggccaacatagggaaaccccgtctctactaaaaatacaaaaattagctgggcacggcagcacatgcctgtaatcgcagccactcaagaggctgaggcaggagagtcgcttgaacccaggaggtggaggttgcagtgagccgagatcatgccactgcactccagcctgggcgacagagcgagactccgtctcaaaaaaaaaaaaaaaaagtctacactactttatcattttataaagccctctgtcatacattatctcatctagatgacatacgtacagcaaacattaagccataaagtagtttcttggtcctatataccaaaagaacacagacctggtaacacacgcttaaatcaaataactcacagccttaaagaacatctattcatgagacgttttctccatttttactatacagtaaagcatattttatctcttattttaagtcatttaagaactttttattttggaattttatgactagccctttaaatattagttttgctaggaacatcaaaagaacaagtgactaattacataaaggggaaaagattaaatgaatcatggattccacttgaacttcatcagttaaaaggataattagcaaaatatttaaggaaaaagtaaatgagcttgttagtcatggccttttgaggggaaaaaggtaaaactattttacttgcctgatctcagatctagaatctaaaagataaagaggtattgtggagaatcattataaaatactcagacttcaaaggttcccataaggtcaaaatatggactatgtataagaagaaaaaatatgctaaatataaaatcaatgtattaatgagatatatttatttaaatatcccttttgagtattcttaacaggtattcagaaccctaatctgcttttgaattttcaatgaatataaaagaaaaatttgaagacattaatggagaattttaaagcaagaatctaatcctgtatgttagaaagaagaaaatacaacgttatgtaatattttaattcttataggtgcccaaatacataagcaacctaactttgacatcgggggaaactggacaaatccatttaaaactaatttagcaacaaatacttacatggttctgtggacatgtaacatcccaaggtgttttaaattgataatgtcaccatatgaactgataattttcagttgaacatacagtttattctataaaatcattaaatcttaagaaccatgagggatcttagagacatttagcccagtgcctctcaaattttgatgtttatgtgagaccccaggggcaccttgagaaagtgcagattcagactcagtaggtgtgggtggccctgagacttcatttctaacaagctccaggtgatgccgatgctgctggtccagggaccaggcagtgggtattgtggccccagtcaagtctaagggaggtcccacagcctctgcttgggcatctccagtatccaggacttgaaacctgcctccaagggtagacattacagggagggacttgtatattacagagagggaagcaacaaggaaaggctgcttccacttctagtgatggaagacactctttctctcccaacatctcctcttctccatgttgaaaatccccacttcctttggccactcttagaactgataggtttccagacccctaaacatctttatcacagaaaatgctccctctgtggtgaaaatctttcttaaaataaatcccttgggacaagacatagcatcccacacatgggacatccagacctgagagtagttgagtgagaacattacattccctgatctaaaggggacagctctcttaatgtggccttaaggaggtgtcgccttctgtaagaatcacactgcactggtggctcacaatgttgtggaggaaataataccaagcaagtgttcccatgtgcacttgaacaattatttttaactaaaatgtagcaatttacagttatttctatttaatgtcatcttgctactataacaactcacataaatcctttaaaatgtttactaataggtcacacatatataaaaaacatagacagtttttaaaaacaattaagaagaaagaatatccttgggaccactgtccaggttgggagataaaacactgccaggacctcagaagcccccagtgagccccttctctatcatacccactccttcacctctggaggtagctgttatactgctttttgtgacaatcatattaaatcatattaattttctttatagttttaccatctatgtatgtatccctaaataacatatttagttttgcatgcttttgaactttacatgaatagaatcacactgtatatattcttctatcttgcttctttctttccatattgtttgtaagattcatccattttgatgcacttttatttgtttaacaaacacatatagaatgtattgtctgccagtcattctcctaagcatgtcacaaacattgactcatttaaacttcctaacaacactatcaggtagacatcattttccctgatgtacagatgagaaaactaaggtacactgaagttcagaaattcatccaaggtcacacaataagtggcagaaccaaaatctgaacccaggcacaatccttcctcttgaccaccaagaaatgctgcctctccacacccttctatatgtggttatactagttgatttttcattgccaaatagtatcacagtgtataaatacctcacagcaaaatgtgctgattcgattcaatgttgatgggcatttatttgggttgcttccagttttttgctcttatgaacaatgcttctttgaatatgtttgtccatgttttttcttttaagttcaggggtatgcacatgtactggtttgttacacaggtaaacttgtgtcatggaggtatgctatacagattatttcatcactcaggtattaggcctggtatccattagttattttccctgattctctccctcttcccaccctctaataggtctcagtgtccgttgttcccctctatatgtccatgcgttttcatcatttagctcccacttataagtgagaatgtgcagtttggttttctgttcctgtgttagtccgcttaaggataatggcccccagctccatctatgtccctgcaaaggacatgatctcattcttttttatggctgcatagtattccatggtgtatgtaccacattttctttatccagtctatcactgatgggcatttaggttgattacatgtctttgcttattgtgaatagtgccgcaacgaacatacacgtgtatgtgtcttagaataatttatattcctttgggtatatgcacagtaatgaaactgctgggttgaatggtatttctatctttaggactttgagcaatcatcacagtcttccacaatggctgaactgatttacactcccaccgagagtgtgtaagtgttcctttttctccataaccttgccagcatcaattattttttgttttgttcatgtttcttaaagcacataggtaatcatttttcttaggtgtatacctaggggtaagatggctgtgttgtaagttatttgcaggttgaacttggttaggtaacagcaaattgttttccgatataattgtaccaagttagactcctgtcaactaaatacaaaaactcccattcattcacatccttacatggtattgtcaggttttaaaatttctgccaatccagagagtgtgtaatcatatgttactatgattttaatctgcatgtgtttgtttattaatgaagctgagcatctttttatatatttactagccaattgggtttcttcctttgtgaaatgcatgtttaagaatatgaatgtacagtatcatttttctttttggttatctggcttttttattgattcacatgtgtgctgaaccagtattatttatgtgccacaaacgtctttaccactttgggcttgttttctcattctccatagttaccactcagtgaacagaagtcctactcacttttttttccaacaataagtgaaagacccctcatgcttttttttttttcttttttgagatggagtttcgctctgttgcccaggctggagtgctgtggtgcgatcttggctcactgcaagctctgtttcctgggttcacaccattctcctgcctcagcctcccgagcagctgggactacaggtgcctgccaccatgcccggctaattttttgtatttttactagagacagggtttcatcgttttagccaggatggtcccgatctcctgacctcgtgatccacccgcctcgacctcccaaagtgctgggattacaggcgtgagccaccacacccggcctcctcatgcatttttaacttttgaactattttataagaattttttaggtctggccaggcacggcggcttacacctataatcccagcacttagggaggctgaggcaggcagatcacttgaggtcaggagttcgagaccagcctggcaaacatggtgaaaccccatctctactaagattacaaaaattagctgggcatggtggcatgtgcctgtagtccagctactcaggaggctgagccaggaggatcacttgaacctgggaggtggagggtgcagtgggccgagatcgcaccactgcactccagcttgggtgacaggacaagactccatctcaaaataaataaataaataaataaataaataaagcacttagaaaggaaaagaattatgttaaatatacatgttggtcttacagtctagaaattcagttgctttgactataaaatacaaaaagcaaaggctctgggataagaccactgtgatacgaagctaagatagtgatctctgatagtctggccaaactgcagcaaaaccaaccaaaactaaacaaaaaacaaaaatgtccccatatgtagacatacggaaatgggctgcaaaaagatgaacgtacacctgaattcctggtgacatctgggcagcccctcagcaggtagcacagttcttcctgagctagctgctccactctgctgtttcctctgactcgcattttctgttaaccttcctcttggaatcctttgacaatgactcacagggttatggggctacttagcaataccacagccctccgcaatagatgctgtgtaggagggacgcagctcagtggattgtagtctgcaccagtattttcctttctgcattcagggaggatttgcttttcagccacatttccctcaaacacagccccgacaggagatgcttagcgcagagatttctaaacgatgaaatgatctgagtttggctccttaatcataatgaaactaaaaacagtaagatgagaaaacaacagggggatcatcattcctacaaaaaacaactttatacttgggcaaaatcaagagattaaaaaaaaaaagctcaaactaacattttccaacctttcactaagagcaagggctaaaaccacatgttttgaaggtcttgcactgtgttattattagaagtcacaattctattgatactgatgagtcattcgtatcggcggaaaccaagaacttccatcaacatcatgttacacacagtcactgtggcttttctttattactggtcaaagctgcttcagaatgcttattgaaacttaagaaaaagaaggcaaactcctcaagggtgtgcaaagctttcccttccccagctgatcttactttaatcatcctttttcaagacagtttatgatgattggatcaacttgtatctacaaaaggaagtttatttagaagcctcagaaaagcaacatttcacactttccgatgaaaataagcaaaactgaactctgaaaacaaacagtgaaaccatctctgaaaatacatgctagctttaaaatgacctgaggtcaagttttttgttttgttttttaacctcaataacagggaacggatataaacaaaagctgtcatcacttagggacttcagccacataaaacaatgtcaggctagtcacttgcaccctcgcccctgcttccctactcaggacacactgctttgcactgagggagaagtgggtcaggtttcagttacgccaagaaagcctaactaagttaaaggtttatgaaaactctttctgatcttagtaggaaataacagcacattcccttttcatttattatcagccccttttgcctctccccttaaatattcccagaaaaataaagtgaagcaaaaaaaaagttttcctgaggcatatccagaaatgctatgaatctttatgcagtccctacaaaggtagaaatttgtccaattttctcccctgcaaccagaaggctgtgtctggctgctggcaggagaagaggacccagctcagcagtgaccacagatctgaaaatagcctcccagtagctaaccagcccagcagcccggagctctccaagggcggtgctggtactatgggcagtttacagtgcggccagctgagtgctacaacagctgcatgagtcagcaagcactgctggtaggaaagtgctgacatgctaaattactctcgtgtacttgagatgcacacacctacctggcaaaaacaaaaacagggtacatgcaaattagcaaacgggaacctctctacgcttgcagtttctattttccaaggttagaccaaaaatataaataatctatgccactgctcaaaaagaagtaacaactaataataattaatcatggtaataaacaactcactcttagtgttgctatgtgtggaacagctgcactgaaatctcacgagccagttaattttaactggttttaattttaactagatttaactgcttttcctcccttctgaaaaatcaaaatagttaccatatcgaccacaagaactggtaacagacaagcacagttcctgtttttcagaggggacttactttcaaacccacaatatcaacacgcttaacataagtggaaatttaaaatgtactgtttaatgtgggaaatttaaaacctgtatgctaattgagatctcatgtgccaggctttgtctgacaatgcctctcattcatctatgttctctcgttttatacgggacctaaaaatctgcaggaacactggttgtctggaactgagaatacattttcccacagaaatagggccaggccaatgagctaggattccttgatagtccgtgaaaatgtcttgaacttaaaatatgagaggttaaatttataatctaaaaagaaaatgatactacaatgatagttccaaaaccatttaaaagaaaatactcttgattaactgtgtttgaggaaatgtctaactacaggaggatgaagggacacagtcttccaagtgacactttcagacttcaactttagggtcattctggttctctaacatggtttcaattgatagtttcatttaaaatgcatagaattctcttactttggcataaagtattgttagaaaaaaaatctttatacttaccggttttaagtactgttttgttctccaaaaaaaaaattgagacttggaaaacaaaaaaggaggagaaacaagtacaaagagggggtactagagagagggaaacaaattaagtctggaacaaagaaagacacggaggtataactaaactgcaaaaacaaaggagaggtaggaactagagggcagttccccgctagacagtgtgttcccagagaaagaggactcttcatcatacccagctctggaggtgacagtgaagtcctgcaagacagttccacagactggcactagatggagccatcaactcaacatagcatggttgctggagaagggtatggtgggggagaggtgggactgaagggcgttgactctacagccaggtatttacctgccaacaactctatctaaaataagtatagtttaattaatcaaccaactctcctaatgtccagatgtcaccaccatgctgacaccactatgcttgtggtatgtcaaattgggacacaccaattttgaaataaatttatcaattcaatttgtatcaatgcaactggggtggggaggtaagtgaagttggatccgctgctttttttttcttctaaaattcaacatgcaaagataatatagaatttcaggttcattgctactgaataacaaaaatccctaaccacaaaccaaatggctttccctggaagctttgtttaaatgttaaataacataccatcttgctatagaggtttatgtgatcaactccaatgtacggcaaaaggcgggaaatgctcactgacaaatgtattattaaaaataatcttctctttgtattttaatactactttgatttaaatactgtaatccatttgcctatattctctgcctagggttgtgtttatttatcacgagccctctctccattcagaaatggtctcctatcaccaggttaccagtgtgcgaaattctattgtttttatctttagggttttacttctttggctttgtctcctattaacatgctgatgcttcagaaaagtaacacattaagtatgctcagttacttatatattagtaaaactgtgttcataaaatctttctctgagattggttttggaagggaaggacaaggactagttgaggggactgggtggccaaaaggtaagagagcatgaaacaaaaaagtgagcacagaaggaggatgggggaactggctgcaaaccgtgcctagcttctttacatctgggacacggaccatcatccctggcacttatcttcccaagaaaatgtatgaaaaggaagggttaactctgtctacattttcctcttgctgaatgggtaataatatctttcacagttaatttcatttttttttcagtttgactcttcagggcttattcatttgcataatatggaatcttgaacccacatagatattctacaaatcaatgcaagtaattctcacactaaatcagcagctttaatttaagctcaacattgtttgcatagaaatctttatgcactcatctgcttgattttttaaatcacttaaaacctccaacactgacacactaagcatctcccatttagctttctccaaaatttgaactaaatgctgaaaaataagcacagtactatacattcatacacttgatcatttcccaaattgagcttcaaatgtgtgcttaatgtttcaagtggctcctgagaatgatgcttcttgactaaagatgacaacttcggtgtctggcccaggcagagctgagtcagcattctaaacagtgaccctgcaaacctgaggtaattgggggttactgccataccaactgcctgagtcctttaaaaccattcaaatctccagctgagagttgcaacatgctaatctggcaagataatctcttcctgaaattgaccagaatgagaacaaaggttacctccttttatctgttactggtagctaatatttctaattaggatttctgatggaattagttctgaatgaacatcttcctccttggtagaatactctacctcttacaggtatagttttttaccttttcctacccaccaaaaaaacaaaaaacaaaaaacaaaacgcaaaaaacaaattccctccacctaacaagagggtaggagtgtgagttacaagtaaaccctggagacagagccatggtatttcagttatatgcctagtacttcttttgcctttatatgcatcacttttactttccgatccctaaatggacactaaaacctaaggaatgcaattattagaaagcaggccatgtgaaagacaggagatatactcactcagatttactgagaaattattttttaactttaagatagatgtcaacaaaacatccaatattttagagtgagatgacctttatttctacttctgggaactgctaaagagagttccaacttcaaatgaagaagaaaaggaaaagggagagccataacatggtaagagaacaggcccaagcatcagacagctagtgtccaactccagttctaccattcattagctgagcgacacctatgctgcggcttctagtgatcacacctagccctgggttgttctgaggattatgtgagttaatatgagcagcacacagaggaagctctcaatacaagttaactatcatcaaagaaaaagaaaatagaggggtgttagcatgaagtataatcaatttattttaaatagatgctgtcaaaattccttaattttgcatctaagaatggtctaaataagacgtgtccaatcttttggcttccctgggacacactggaagaaggagaactgtcttgggccacacataaaatacactcaacactaatgatacatgatgagctgaaacaagaaaaatagcaaaaaacaaaaaacaaacaaacaaaaacaaaaacaaaaaacctttgtgttggtccgcattcaacacgcaagaggcctgctggccatgggttggacaagcttggaataatcttcgggccacagaggatggagaccctctgctctggagtagccagggacttcagacagactatttagactcactttttcaccaaaggccctacacacatcagctgactgggagagaatatctttgtagcttctgatcattcaaatattgtcaaaaccaacctaaatatgttcaaaataagaatgttaacttgtattttttccaagtatggaaatgaacagtactcttggcagttaacttctgtttttatcaggttctaaagacccaggtaaataaatcaattctggactctgtatacaggaactattatttgccaaaatggccccagaggttccagcatggcttaggcaatactccaaagggccaaagatagtagtgaattaataggattaggaagctggagaaaaagtgaatctcaagtttcagactgtccctgatggaaggtcactccacaattcctcagggagggcttccccaacctcccgaccaggttaaatctgcccattagacactctggtgtatgaaatactttccttcacgagcagtgggttatctgttactaactgatcagtgccattcttcctaccagatgacgtgcttcatgagaccaggggccaggactgggtttgctccccattagcactgtggtcacttaacactatgcctgccatgtaagagatactcagtatatatttgtttaatgaatgaatgaggcatctgcctctaagcaacagtatttctggacacttggcccattttgcactatccacgagcttctgttgcttagaagaatacaggataggaaaaaaagaaaaattgccaaaaatctatggatactgaaatactaaggaaagatgctgagcatgtacattcactttgtttcctacttgtggaatggaaatcatcacattgggatctcccaactttaaaatccgaagtgaaggtctaagctgtctttgggttagactcctggaaagtcttgaggaaattcctgaagtatctgcagaaagtgacaggggagggagaatagaagatggcccaagactagagtgatggaagacttggaaactcgaaaagctttcttctaactaactgggactttgtctacatgccagctacaggctcaggcacacatgaagagaataatgagatgaatgggaggactggaaagtggaggatttaaatgcttaggaaaggagccaatgaaagctgacacaaggacaggagggacctagcaaccaagcgccggctctcatcacatcagcagcagcatgtcctacagccttcaggaaaagaacaaaaaggtcagggaggaaaatgacacatctcagaaccaaagggcaattcattatgaggctaaggaacaaaggagaagtcaaccagggaatatgctgaagaaacggtgattatgaagtcactggggaagactgagaggcattttggctgtagttccaatgactagaatgaaggatgatgtgaaatgcttttggattgggaagatttattattttggaaaaaaaatagctcaaggaaaaacaaatggcaaaattcctgcctgaattttgaagtagtgtcactagcaggatgaggttcaatttatacattctttagaaatgaaatggcccttggaaaagacatagtggtaagattcgcaggacatttccagccttacggaagctgagtagcatgctgatagtaaaattaagtttcagttttagatagactgacatttgaaattaacaaaaaaaaaagtaaagggaaaaaattaaaagaccctgaactgacaaaaaaaaagaaaaaaaaaagcaactactgtcttttttttttaaattaaatgtcatcacaaacaaaaaaaaaaaggtgaaagttgagttgtattttgggcaatcttactgagtttacaaaatgtttagttcatagcaggtttcagtttggacatgaacagtttgtaaatatttacataaaatttaaagataggaggacagcagaggtcatatattgctattaacaatacagaagcgattttccgtcattcccaaggccttggtgctgcgttcccatatgtggccccagctctgccaaaagcttgtcttcttttccaaagaaattccaatttttgcaaccagcattgacttctgaactgtgagtacctctgacagggtcatatgtcgctgaaacttcttcaacatccagacagggaaaggagaaaaacagggaggcagatttacagcgtctgctatctgaattgcagattttgacaaatatgttacattttatattgttctctgttctatgtgagggcagggaccatgttctctgtatgtcacagtcctacaccatgcccagtcattgattcaggactggactgtgtaatggaatggggaaataaccttcagacattcaagaaaacatgcactatattcagattaagttcattccaacatgagattagttcttccaactctgcagaatgggcaggcacgacacctacttcaaagggttgctttgaggaatcaatgaagtacattcaggcaaggtagtcagcactgggtctggcacatggtgcggattcagtaaatcaaaactattattttggtgagtgttctcaaatgtcaaactcccatggaggtcctcaggcattacccagccaagttaccccatctggtcagtaacaactaaatagagggcaggtggttcaaaagtaatggattattcacctgcaaggaatcacactgtactcatggtattaaattattcggcctttcatgtcgaattctctgttaaaaaggaagctgatcaatccctgagtgggactcaatgttgatttgaagttttgtttttttggcatctttctattttccaggtagttgtaaccattcattgggtgcatactcacaaatcatccactatatgccaggcctttagaaaacagagacacacaaagatattaaacaaaaaaagatgtttcagtctgttcagtagtgggagacaagcagcccccaggccgacactagctcttacatatgctttcatccaaaaattttttaaagatttgagccaatatttaaaaatcaggaaattccacataaatatccaatattcagcttcccctggaaaaatcaaatgatgtggcaacacaaagccagtagtcctaccaactgttccctagcaagagtctacaatgagttgagtaggggcggcctgccactccacactatgccctgctcctcaccagaaccaggtaagtacataatttgcagggctcagtgaaaaatgaaaacgaggggccctttgttcaaaaattattaagaatttccgaagaaaacagcagaaccttataccaaatatgaggtccttctgagcagggaagaggaagggggcctatgtaactgcacaggtcttatgcccatgaagctagtactggctctcaccccctggacacacaggaagatatttatttatctaagtattctctcattcattaacaatcaagcctgcatttacaataagctagatgtcacacccctgaaatctgaggttcaaaaactagagtagaggggccaggcacagcagagatagagagccactagggtctctttcctttttgttaagactggatccacaccagagacactgaaagttaatccaagtaaaattaaactgctctcaacaatacagattggcttgagcccttttgttggcatcacaggagcctcgattaggaattctgagaaacagctcacaagcgctaatgaataactaagtcctgtcggctgtgcagacagtgggcccagaagtgaagggctggcctaggagagatctgaacatgaacctgaccatctggccctctgtgactcactttgatcacaaaatgaattgcaacaaattgaagagcacatggctagagttaattgtctcatctgtaatctgaatctacttttaagcagttattattaccctctatcaggtggaaacatttcctaccatcactgcaaagtgcattttcctgatgaactataatggatcattaaattccatatctgaataacaatactgtgcacttattcagtgcctttcatccagggatttcaaggcagtttgcaaataattaagccccttacacagcagccagaggtgagctactggaaaagaattgcctgaagatactaagtcaaagggcataattcaataggaaaataataaatggctttctcccaggcactggtaatacagaaagtgaatcctgatcccctccctctctttcacctcaccccttcttcttcatagcagatcctgacatgcaacatacaaagaaccaaaaaagtaactaacaggagtgttcacaatttagctatgagttcagacacacacttaactgagaagtgtgtgtctccatgtaatcctggcaaacacactaccaactgacatttcagtccacctgcagaatagacagacagcagaagaatttactcaacacattcatgattaccaaatggcaaacctgaagcctcctgcaatgcaaaacgaaaatacggctctgcaccaataaagttatgttctaacaaaaatactttattccatggttgtgtgttccatttctgggacttcgctctatttcaatgatattcaggtttcgagagtaaaaaaaacgttggaaatgggcaatcaataaatttctttcaaaaaccagaatactagaagggaaaacatttcagccactcaaagttttgtggtgaaattataaactccagaaaaactgaatttataatggaaatgctgacagacctttcagtggagcagtttgaacgcaacactgtaatttggcaatctctcttacagactaaagactaattctaacaagatgtcattttgactcacgtttattattacctgcaagaatgaaaaacgccgtttactcgggaggtgcccgagaaccagggtggggcgatctcacattttaagcaagacgcccgctgccttaccaaaatagccctctccgccaaaggaggggcagcctttcacgctcagcttctttcatgtcagcccgagcctttgcagcaagacgtgcctttcctacatgttacattttaatgatctgagaaaaccgttatcagcgttaacatctctaattttactctaaacagacaaaagcaaaatatctcattaggcatcatctccgccaaggttcccactaggcaggaaaggatttttatctaaagtaattaccctttttagttaaatacactcaacagatgaaatttacagagagtgagagactgcagcactagacagcgaaggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccctcgtgggcacctagggtagcccgtgagcgccgcccgccgccgtctccagcggcgccgggctcccgaacacccgccgggtgagcgaagcacagcggggccacggagcgcctcgacgcggggacggggagggcagtgtccccttcataaaccagtctcctgggtgaagcttctggggcttggagactggagtgtagggtgtgtgtgtgtgtgtgtgtgtgtgtgtgttgcaccttgacttcatggaggatctgtgggagaggaggtgcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccggcggcggctgacagctgagcgcaaaggcgccgcggccaaggtcctcgcggagcagcccgggatgcgcacgccgagggttaaggaggaggccgcccggcctggagctgggatcgcaggctgggggccgggacacccgggcctcgccgggccgggggcagggccgcgggtctgacagctgctgcggctcgcgcggacgcgcgcctcctgcagcccgccctccccatgcctgacttattactctctgctcctcctccctctgctgttccaaaacacccttcgacgccagcaaaatacaatgcgcctcggccgccgtaaacagccgggagggagagcacacattcggcgcggcgcggccgccggctcggctcccacccccttcccgttcctagaaaatgccataaaagcgggcagggcgcggggagggcggctgcgcgcccggcggccggggctcccttcccgcgccgtttccccacgcctccccgcccgccccgcgcgcccgctccccccgcaaacttgccccgccaccccgcccagcggcggggcccggggcccggggcccgggactcacctcgccggagaactttgcgtccttttccgcctcctcttccccgcgtcttcccggctcgcagccccctcccggcagccggcgaggtgggcagttcgtgggtcaccgaaagctcgcggaggggacgcgcatcacatggcagctcgttcccagccccccgagtgcgccgggaagggggaggggaaggggcgaggggaggccggggggaaagcgagagcggggcggcggcgggagtgggcaggcggggtggcgagggcggcggccgctcacgttagcgctgtgcgaccgcagcccgggcgtgcacggccgctgctgccgctgctgctgctgctgctgctgctgaggcggcggcggctcggcgctgttt

SEQ ID NO: 1542 - DNA, 26448 bp, Homo sapiens
  source 1..26448: mol_type = genomic DNA
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggtgagccgggcccgcggcccgccctggtcggtggcgccacctcgacggcaggcggcggggagtgggctgggccggggggacgcgaggcggcggggcccgggggtcggcgaaggcccctcgcgggcggacaccggctccgcgccccgccacacactcccgctgcgcccggacgagtccccgctccggacccgcccttgacaggcgtcggggcgaaaggaggccccgggattcggtggcccgggaagcgaccccgcagtggctccggtgccgtccacggctcgactccagggcggaaggccgggtgtccagcgctggcctcgcgctctagggctgggagaggggcggccggcctggtcagctccggaggccccggcccaccgtggcccctgctgcccgctcggcctccgggcccgggacccgcggcgcaccctgctgaccgcggactcgagggggacactcgcaagcttggatggtggttttggggggaattttaccgctcaagttctccaacttggttgaggggtatcttggctactgtcccatgttaggcacccaatgactctggaggctggtgtcaaaacattcatatatatatgtgtgtgtgtgtattttaaattaaaattgtattattgtttgaaagtgctttcaatatgaacgtatcctagtatgatttgtaaaataaaaaacagggtgtgcttctccccagcagtttctagagatctagactagagatctgagactgtcttacagttggccattgccttaccacattgcctcacactggagagaaagagaatgatacgtgtatatttataatggcattcgcttcctgccttgttatggtattaaaatacttaggatttgttaccagtacacaaataactgactaatgatactcttgtgaatacagcagaagtatgtctcatttacatacatgcaaggatatatacttcttaatccccaagagcatgaaatttgaaaatgtaaatttggaatgagtgtgttaattttcaaaaatcagagttagttatactattctttcaattttttataaatttgagctttcaggataaaaagtttttaaaataaatatgttatacttaaagctgaattgttaacgccgtctgggcaagataaaagcagcaaagagctggtaaattattttgaagatttaaaaactcaccaaattaaaactgctgtgtaacccattgttttagaagaaagacctgtattatttcccttcatctttatgcactttttgttttaacaatattgataaaactccggtgcccagcagtgagaccgtgtacaggcagcagtttacatttacgagagattagttgtatatttattcttgaaaattagtacaagaggctgtaattagctgggatgggcacagttacatatacctttttgtgtgtctgttccacccatttttgggtgaaactgacactcatttcaaaccacctttcttaggagtctgcgtggatgtacatgatctttagtgtggtttacaactattattttgaagccttcttcctgtagacatagggatagtggtatctgttggcagcctttgttgtgagtgaagatcaagtttgaacataaacattcccagcactttgttctcagcatgaaacttacccagcaagttgagatcttcctgtacccacctggtgcatgggttaggctgtgatttcataaaccttattaaaagaaaaaaagcaggtttagttaccattattcttgtcagcaaatacaaagaactactaaatcagaagtctgatgctgggaagatttatttgaaaatttcacggtcaaaattttaaagttgaaatgtccttgaagatctcttatgttaggcttctttattttctgaaacccagagagttcaggtgtgactttgaaggtcatccagctagtaccaacaacagggagagaactagtgtcaggaaagtcctaataagaggcagtgtgtctcttcagaagttggaagtgagtgttttgggaaactgaggcatgcaggctagaatacttgattatttttgtgccctcctggccaccaagttattgggtcactgacctctgtgctgaggttgcttggattttgatgatgggactgatgaactcaagaaaagagttccctttaccaagtgaatgacttgagacttgtcagcatggcaccaaaacttaaggagaaaactaacattcagcccatgagctgtttgtgcttcattgctttcaatcctgtgctttgacacacacaatatcaggttgcacttgtgtgagttacaccttactggagactaaatgtagtggaaaatccttgaatatcattttgtatttgaaattggcttctcaatgcataatgagaaaaaggcccttgcagaaaacaaagggcgattttggaggagctgagctgaggcccgtctgagcatcatcatcttcaagaggaaatgctgtcaatcagtaaaaagctgttcattgagcatgaggagctcaagagacgacctctcttttgggggaggactcagcttcaggatgtttaaaatttaatcacgttagtaagaaaatggaaagaaaagactagacctttgtattttatttcgtcttctactgccgtcttgcagttgatcttccgccttctcctgaagtagttaggacaactccctgttttcacagaggggcagagcgaaagcaagtatcttctgtcattgctgaagcaggacggctcccggcaaagatgctgggcttcatccagccccattctaagcagctgggcctccccacctgcagtcttcctggattttgattttctgcacacttgggcttcccactaatttggcaagttcataccagtccaggccctttcctggcagaggatggcattcagtgctggtgcagccactcctccaggctcctccctgaataaacagaggccggatgttctggagtgctgttcccgccaggcctccttgggatgagagggagaccttcctccctcatggagcagggccgctctagctccatggatcttgggggttaccagtctggcactctccagggagtcctgttaagaacacagattgtggctgtgtctcatcgcctccctgccccaaccccatgttcaaatctgaattgctcagtgtagggcccagaaaactattaagtccagaaagcttttttggtggttctgattctgctgcactggcagtgggagccacggatggccagtgatcccattttggggaggaggagctgcggcttagtgcctcctgaacatctatcctgcagagcattttcccaagcctccattttccttcttggggaaactccccaggtacgcgggcttctggaggtgtgaatatggggatgacatgggaagcgagccgagacagcaccttgcaaagtctggcagggtggctggcagtgcgagagtggggaggtggtccagagatcttcctggaccccaggaagaagcaagccagagccttttctttttgtcttgcccatctggcagaatctcaccataatcatttaacagattatactcaggcactgtgacagggagatagaaacatcctttcagataacactggaaatgtttcgagttatgattgaagtagagagacccatttattttgcttaaggttcagcagagcctcctgaattttcttaaagatgagatcgttttgctctttccagatctattgcaagctgttatgcctcttagcagaggcggagcacaatcaggaaatgagtggccgttctctccttcgtatttccagcaagttgcagttgtggctgagcaagttcctgtgcgactgcatgaaagtgatttgttggggggcagatgaacagcatggccagatgccttggagcccagctcatccaggactttcattttcccctctgaagaacagcctgtgttgttcacatgagaaccgactgcacctccgagaacatcatttgtcccgttttgtagggtagatttgccctttatgagggtggagcctgtacacaggacctgcggcagcgtttgacgttggccagggctgggaaggcttaactgttggatgctatcagggctgcttgtgagtcagaaagcttcataccacccatgaggcttgcttagtgctgtcctcgtttctggaatgacacacagtcaccttatataaaccactctacatgtttattactttctattgacatttaaaaatgatgttctgatgtttatcatccaaagtagaaaaccattcatcatccagacctactctttctcctttaagttttgctgttttaatattgctcttaaatgtttaagagagcttacagaagaaactgaagacaaaggccttgcttattaggatctttgagaccctctggcactggcgaacacgagtgaaccctgtgtcacacttgaccgtgttattctccagcccctcctgggttcccttttgttgtgagtcaagtagacacctctgatctgcttctgcctcagagcatagactcagctggccttcttttttttttttttttttttgagacggagtcgcactttgtctcccaggctggggtgccgtagtgcgatcttggctcactgcaacctccgtctcctgggttcaagcgattctcctgcctcagcctcccaagtagctaggattataggtgagcgccaccatgcccatcagccggccgtctgaggcaggctccagagccccttgttttgcaggtgcaggattcatctgtatgcatcatgtggcacatgtgataccatgtgaggtatctggtgttactaagtcgtcacgtatttcgatgaaggtatctttgggaccttggcagccttttaggaagccaggcagcttgcaaaagcttaggaagaatttggggggagaggaatgaatgtagtatttttctgtctgtcaacacacacacatatatatatatatgtgccagatatgagtgggtgcttttggtaaccttatctctaaatcctcaccagctctttgaactagaaactatgaagtgtcttacacatgggacagcagatttggagaggcagtgtgcctggcctgtgataaacagaaagacttctgtggctttacccccatctgagttcctgaaggggtgacagacagacttgcctttagcgggcctggctgctttatactccccaggcacggctgctttatactccccaggcacagcttgaggtgataaacagccctgagtccatctttgtatagttaatcagaaatgttggcctgtttcttgaacctgggtctggatttaggagatgggcccgactctttactcactcctttaccccatctgaaattcactgagtgcccacagtgtgcgagtcacagtgttaaatgccatatagaggacaagtctgcccactttgagactgttctccacaaagcatgtcctgcctctccctggtccgaagcaggctgtctctcttctggaacccatattattttaatttgaatctttttgcttaagctctgcacttttctgctttgtcttggggtcacacccctgttaggagttctggggcagagtctgtgtgcttcatcgctgcctcttgatgcctggcagggtccacaggctcagaaaagatggaacgagtgactgtggagaagggtagaacatgggcctgcccagagcgcgaaggcagatacagaagagctgcccgtgaaggatgcaggtgtgtcccgggaagccttccattggttcctaagaactgcagagttgtcctgggctcctaaaggtccccagaggcctgctcctttttgtcactttgtgaatggccttctctgcacaaaggacttcagtattgattccctaagttcatccttacaggtctggagaagctcttttttgtttctcccaatgacacagcatcttacagcagggctggagaggctgggagctggcagcagccagaccctacttccatagctgtgcagagagcagcccctggcactgtgaaaagagtctcttaaaaattttttttcgtgtggctggcagcaagatcagacaccgtatacgtgaaggttcttattcactgtcaattcagaaaagcctagaatcgcagagtgccagctctgtgcgtcaggagcctgtaaacagctcagctgtccaagagctcccagcacagagctgtgccccagtgaactggggagactttttacggaaaattccttagcattcaattggagaacaaacgtttgctgttttaaagtatcttcctcagtgtttattaaagtagaattatatatttttttcagttatttaaaaaattcttccttgacattgaatgaatgaataaatgaatggatggtttaaaaattcatacagtgggaggatgggaaggccccttcatgtgcagaagaaaagccagccccttcgctggcccaccctttcagggtcagttcagacccccagcatcccagcggggttagcactccttcctgggttggacggtgtcttccccggttctgacagcgctccatgccgggcgtccctgcagtcttggggctgtggtgactcagaattaagctgagtgctctcactctcgtgtaccctgcctggctggcctgatgactcagcatggagcgctggctccctgacccagagcacacttgaactgaatgttccaggtctgagcctcagccgagcgtggctgggcgaaatggaagcctttctctcctgctgcctctcctgctgcattttaccccgggagatgaaggttttggagacgttagtgacacatggatgttatcacagtgtacagctgtgacaggagtagcagaaaggttagcatctacctggccttaccatcagacaaacctgggttctagagatcttaggcaaagcacttacccttcttgagcctcagtctcccgttgtgtgaagtgggcatagcaacacttctgttagcagggttgggagaatcaaggaagatggtgtgtgggaggcgaacgtcccaaagcctgaactgatgcatgcgtggaactcccggaaacatatgcagcctgctctgtggagtagaagtgtgtttgtggataggtgtgtggcctctccacacagcagactgtcctggctgtccgtgggcctttcagctctcagagaggcctggggtcttgtttcttagaagcaaggcctcctcttatcccccttgtatggagtgtagctgactcccccgaccagtgtccaggtggcccttggagccctccctggggcttcccgtgccccttgtgagtggaggatgtaaaggaacagtaacagatgaagctgcggggccttcgggagccttgacccagctgccagaccctgcgccatgcgtccatagatgcatctccccatcctctgcccaagataggctgggtccttgtgtcctccactgtgctgtgtagagcgctggctttactcagcctcagctcctcaaggggagggtctccctcagctgtgtctgtgcagccgcaaagtaccaggcaggagctaggagcgctgcctgtgaggggggacatcagcccaccttactgaggggccgattacctgcacagctcttctggacccagctctcaggggtgtaaatgtcaccgcagatggaaggaaggaggggttttccaagtgccaccaccctcttctggggggtgtggctgctgtggaccgaatgcttgagaagccactgcaggtgggagcagagcccccccgggactcaggggtctcaccgtccatcagagagggtccccttgcctgcatggcagctgatgaactgaggatgtttttcttttggaaattgtattttgtacagaatacacgtccgctgatgtcctgtacactgagacctaacaggcacttgtagggtcgtgtctggaggatggacttgccaggtggctgaccattccatttagcatggaaatgtagcagttgagagaggtccttttccttgactctgtctaaattcagagtttgcttcctgggatggaaatttcagatagtttccatctgtgatttgtgactttggcttgattaaagcaggtggctccgctcttttttttttcccctgaagaagaggtaggtaggttctaacatgccctgaagctaacttcatgtgaccttgggccacattccagttcctacctctgccacatggaacccgtgaggcaggctgcagggctggggctgcagggaggctggatgctgactcaggtgcccccagcaggggaaataccagcagctgcggatggtgcctggcctggagacggctgacgtgtgccctggtgaggggccatcgaggatgttgaggagacgccagcagatgttctgctcccaggcggacccttctgtgccccagcctggcctggcttttctctctaggcctcagggagatgtgtcaaggaaccacagtcagtgcggctgggcgccctgctcagccaggagtttgtctgcagagcaggcctcttccccagagcagcggcccagcctgttggagaggtgggtcgtttagggctcaggtccctagagttgtctttggctctttgcttccaggctgtgaaactttagataaagtcttaagcagagaaagtgacatccttgctaattagtcctcttaagactctcagataaaggggcttctaattctaactgtcttactaccaacttggtgagacagactaaagaattaggctttgttgaacagggcgcggtggctcacacctgtaatcccagcactttgggaggccgaggcagatggatcacttgagcccgggagttcgagagcagcctgggccccatagtgagaccttgtctctaaaataaataaataaataaatatttttttaaaaaaagaattaggctttgtaaacggtaagcccaaccagctagtgctggagaaaagctgagtccatcaataactatttgtggaataaagaaatgcaattgtggctgggcgtggtggctcacggctgtcatcccagcactttgggaggctgaggcaggaagatcacttgagatcagaagttcgagaccatcctggccaacatggtgaaaccccatctttactaaaaatacaaaattagctgggtgtggtggcacatgcctgtaatcccagctactcaggaggctgaggcaggagaatcgcttgaacccgggaggcagaggttgtggtgagccgagatcatgcctttggactccagtctgggcaataagagtgaatcttcgtctcaaaaacaaaaacaaaaattagctgggcgtggtggcaggtgcctgtaatcccagctactcgggaggctgaggcatgagaattgcttgaactcgggaggcggaggttgcagtgagctgagattgtgccattgcactctagcctgggcaacagagcgagactcagtctccaaaaaaaagaaagaaagaaagaaaaagaaacccaattgtttagggcacagagcagctcagagtttacaaagacttgtaccttatttcgtaccttatttcacttaactcttgcaaaaacccctgggaaatatggggatctttacagctgcggaaacagtagcaaggagtcctgtccatggtcacacagctggtgagcatcaaggagggactggaacccagggtggcaccttgaagacccgggctcatgctggttcattcctgtttatttggacacagctgcaaagagaagcaatgttggtttcatcttctaaaaaaattttttttcccattgaaaacacatagggacagtcatctgtttattccaggataaaatgtatatatattttagtaacaggcatattagataaagcctccagtagcctgtgacttatgatagtttatagagtatgtggttggcacacacctcttgtcttaccaggagtctttggacaaagcctaactcctcaggtgtcctgtaagtggaatgtggacttagtttattattcagaattttccccaactctattatgtgcccaaaatagtgctgggggagtgggagagaccctgtattacaatccagtggggactgaagggattttgactttggctgtagggatgttaatggctgtttattgtgtatttcagtatcaaatgggcagtaatacttaattcattcatgcaccccatcatagcaagcagagagcttcggtagggtgctgaagctcgactccagttgcactttgttttttgttttggttgttgttttaattcagagcctcactctcttgcccaggctggagtgcaatggcatgatctcagctcactgcaacctctgcctcctgggttcaagcgattctcctgcctcagcctcctgagtacctgggattgcaggcccccgccaccatgcctggctatgttttttttttgttttttttttttttgtatttttagtagagacagggtttcaccatgttggccaagctggtcttgaactcctgacctcaagtgatccgcccgcctcggcctcccaaagtcttgggattacaggtgtaagccaccacgcccagttccagttgcactttggaagaaagtgtgttttgtttgtttcctgcctgatggaggcgagccaggccacttaattttgatccaggccttagccatatggggagttccaggatttctgtgttcttgcatcttttttctttgttttagaagttttgaagtgttcacttgacccatgtgaaggctcttctggcctaaaaacccagttaatacagtctgtgtcctacttaataccccaggcctgccaagtcggaagtgctacgagacagccctaagagttgcctttgttactgtttctcctagttcagaccagagtgatggaagctgtggtttgtagatgtggagcccactttttaaagagcactgtacctggccaggcgtggtggctcacgcctgtaatctcagcactttgggaggccgagatgggcagatcacgaggtcaggagatcgagaccatcctggccaatatagtgaaaccccgtctctactaaaaacacacacaaattagctgggcatggtggcgggcacctgtagtcccagctactcaggaggctaaggcaggagagtggcgtgaacgcgggaggcggaggttgcaatgagccgagatcgcgccactgcactccagcctaggcgacagagcgagactctgtctcaaaaataaaaataaaataaagagcactgtaccatggagccaagattggggctcacagaaggtgcccattttcgggtttcagtgaccactcagtgtgcagggagtcagttgtgggtgggtcaaggtagattcttctccacggctctttcatgaacatgtgcctggcgtacgcctctctaggcagacaccttgcaggtgcccaagggttgtggttcccaccctgcttttagggcacagggttgggggttagaggcttccttctcttcatttgtttttggttttgtttttttgttgttgtttttttaagacagagtctcactctgtcgcccaggctggagtgcagtgctgcaatcttggctcactgcaacctctcacccctgggttcaagcgattctcgtgcatcatcaacttcctaagcagctgggattatgatgcccaccgccacggccagctaatttttgtatttttagaagagacagggttttgtcattttggacaggctggtctcaaactcctgggaatggatctgacctcagatgatccacccgcctcggcctcccaaagtgctgggattacagacatgaaccaccggacccgggccctcctcttcatctgggacatgaaactttggggtgctctgagttctggcagttctgatatgatttgagtgtagttaggagtagtcgtttttagatttctgtgacattaacttttccttgtttgggggcttgtatagctgttgagagcttgaagggactttggaaatcaggccacgcagagtgtcagagctgaaaggaactttccatcatcgtttttctcactgcggacctttaggcttcctcacacacctacggaatcagacctacttgggttgggcttaagagtctgcaatgtttgcatttcctgggtgcttcgataccccaagtgctggagaaccactgctttctagaacatttttgggcctccccttcattttgcagctgagaaaacgaaagttcacagagggcatgtgagccacttccgtaacacatgtatttaggggcagagccagcgttaggaccaagtgcagcctcttccgagctctcctgctgttccctcagcgcccatgttgctgctaaaaaccactagtgcagtttagacctgctcttaagcaaacgagcccaacagctcaccaaagctcagaacctgacctcaggctttctctaatcataatatcttgtacataatagggcaaattttgactcatctggggtcatttttttcctgctttctatcttggccatctcatggagttgtttggtgccctgagacatgcctcagatttttcagatttttaatgcaatgcacaaacaagggggcagaattagccaattcattttataaattaatatagtgagataagcagtgagagtcaggactgagcccctgggctcttctttcctaattggattttgtataatatgtgttcctgatgtctttagccgagataaggataatgagctctgagctgcaggcgggccctgatgaggtggccatgaggatcagcagtcatctgcttggtcaccgtggttgcatcccagtccctgtcccatgatcacacagagctgtccccccaactttgaggaggcagattccgagctcccgcttgaatcaggaaggggcacatagtaagccttatctgagagatgctggtgtaaccaagaggcattatctggatgtgcttgaacttgaaaacacttagtagactgaagagacatgttttagtcagattctagaattataaatattacacattttttcttttgattcttttatttacaaaatatctctctttgctagattgtgttgaaaacaccatagaagagagaaagggcaatttaactcttccaggtggtgttttttgtgtgtgtgtgagagtttttttggcagagtttcactcttgtagcccaggctagagtgcaatggtgtgatcttagctcactgcaacctccgcctccagcttcaagcgattctcctgcctcagcctcccgagtagctgggattacaggcacccgccaccacacacagctaatttttgtttgtgtgtgtgtgtgtgtgtgtgtgtgtgtgtgtgtatatatatatatatatatttttttttttagttggagtcttgctctgtcgcccaggctggagtgcagtggtgcgatctcggctcactgcaagctccacctcccgggttcacgccattctcctgcctcagcctcccgagtagctgggactacaggtgcctgccaccatgcccagctaattttttttttgtatttttagtagagatggggtttcaccgtgttagccaggatggtctccatctcctgacctcgtgatccacccacctcagcctgccaaagtgctgggattacaggcgtgagccaccgcgcccagcctaatttttgtattttttttagtgaagatggggtttcatcacgttggccaggctggtcttgaactcctgacctcaggtgatccacccgcctcggcctcccaaagtgctgagatgacaggtgtgagccaccacgcctggcccaggtggtgttttttacttagtaaaagcggaagcatttgctgttgtgaccctaatgatagtggatgggaacattagaatgtggcatcagcattcctggcatagacctcattacgggtgggagtttcatttttcattggaattattcattcatgtagaagtgtttaattgcctattttgtgaaattcatgttttttttatttaaagcaattttttgttgttgttgtttttttttaaacaaaaccccaccagagtagaaggggagcctggaacgtcttttagatgcagtgctcacaaggagacacttggttttttattaaatggcaaaaatgggtcattaattcacccaagcccaggaatacagacctcgggactgttggagaagcagccaggccgcccttgcctgtcctgaccgtctctgctttccagctgtgccggcaggcttggcctgttcagtggacctcacgcacggtggagacctttccccttccccccacatgcctctcatttttctgggtgccctttaccctccaggccctctgccctgctttgtgctcatctcctcctccctgacgtccttcttcacttcccagcatgtcctggcttctcctttccagtccctctgtcttgctgaggcatctcctgtgatggttggaacactcagaagggtggacctcagcccccacttccagcctggcccctggtctctagcctcatctccctcagctcagcactgacccccaagcctgccccttgccactgcttcccaccactcttctgacaccactgcccctgcctgcagtgaccacattccttccccgtggaccaagccatgtctctggaaaggttgaatattggctccagcaagcagtctctgctgtcacagtcttgtgtgcagacagagttgtttttccttcctccctctctctcctgtcttattccccttctctttttcaatggaggcacaaaatgtgctcagcgagatgcacgaggtgctcagcgagatgcacgaggtgctcagcgagatgcatgaggtgctcagctcgtggctggctcaagggctttctggatccaggggcttcccccaggaggagctgcatctcctcaaggcctgtctgaggactccaagccctggaagggtctggctataaggggttgggatcagcagctctcccagttaaaaccagagagtgtgggtgggatgtggcagagtgggcagtgtgggggtttgatggagttttacacagccatacacccatttaccactgcccagaaaaagagaatattcccatcacctcagaaagctctttcgagacccttcccagccactaccatctcctccagaagtgaccaccattctggtttctagcaccatcgattcactttgtacttcactttttcttttttttcttctttttgagacaaagtcttgctctattgcccaggctggagtacagtggcatgatctcagctcactgccacctctgcctccggggttcaggtgattctcctgcctcagcctcctgaatagcagggactacaggtgccccccaccatgcccagctaatctttgtatttttagtagagatggggtttcaccatgttggttaggctggtcttgaactcctgacctcaggtgatctgcccgccttagcctcccaaagtgctggtattacaggcttgagccaccgtgcctggccctatccttcacttttgattcctttgacactttggagtctgaaaagcataattttgtgcgtatttagggagaaactcacatttattgccagtcttccgggcatccctcttgatatgcccttataaaacctcacaacatttctccagggcaggtgttggctagctccgttttctagaaaaggaagcgaaggcttacagaggtaagagaattacccaagctcacagaactgttagaaatagaggtacgaatcacacttagaccctacctagggcagcgtctaccctggaagagcctgtgcctttccccatccctcagggcctccgtgctttccaagtaattctgcttcttgtttgtttcctgcccccttagcccatcttctaagcccctgttggcagggagtgccccttgctggtttggtaaccccataggactcctcagcgggtggcaggatgttcccccaggtggtggatgagggtttgctcactgctggtccctgctgtgtggagtgtgcagatggttgaggcttttgtgcgtggctgggaagaaacaatgagcccctgggcagccagcaaaaatgacactgcaggactaatgcaggctccgatttcggctggaaggaggaggacctcagtgagtggacagaatgcccacaggcacgttatgactcaacactgagtagcagagggtttcttcagcgcctcttgctggctccctgtcagggccatctcacggcaggaattcagctctgaatgtgaggcctggacctgctcctgctcttgggtgacctgagagttaagcaggctaatgtaatgccgccgccctgagcacgtggctgttctaatctgagaatgcctgtctgcccatgtccccaaggacacagtgacacccatgcctttcctgtgtgctggaggccctccaagggcagggtctcagcaggagggaggcagttgatgggcctgaaagggctaaaccagggtcagccacctggtgcccacgcctgcacacaaatagaaacatcacagaattaatggtctgttctctcaaagtgcagagcagccctcagtatctgtccttacttttgattgattccgcagcagtagagattgtcccctgcaagctcatagattgttagcctttggcgtttgttcgccgtgcagacagctgccttcgtcaggaaagatcactccccttcttaagagttgccttacacagatatatgcaaatgacacttatcagtagctcccctcctgggaaaggaccctcggtgctcggggactgttaggacttctgttgcgcagcccagcttgctgagagatggcattgcccagtgagtgactggccagccttgttgtctgaaataagatctttcctgtggtacatctggaacttggccttctcaagggtcccaaaatagccaggccactgaagggagaacttcaagagaggacataagagaaggaccccaactgctccttgcccaagcaggctctgttgcgttgaagaaaaagttcttcagtgatacttgttaaagcacagtcaggaagatttattcggggccatcaagataggcacagggaccacggcagtggggtcgtgcagtcatgggtagagactgggcacaacttcaaatacaacacgggcgattgggaatttatagtcaaggagcagtgtggatggaaaattagaagaggaaacatcagggctaagggtgtttctggctatgctgaccaaacaggattcttgccgaagacaggccagggtgattagacagcacctggaggctgtggaagctgatcagatagtgaggctggggagggggtttctggctaaactgacttagcagtgtcttttgctaaaacttgactttacaaggaagtgcacagatgggcctaggagatgcttcggaagcctaagatttggtcaagcagagaatctttgtcagttggcatcgttaggcgacacagttaaccctgggtgcccctctctccctatgctgcctctgcatccctgtccttccccttcctgcaaattgttctaacaatactcctgaggaggcagccctcgctccccagcccacttctctgtaaagattcccaaactgtgtcctgtgtttgggcccagtacaagctctatattgctgggaaatgtgagggcctttttggaaacagagacgcttgctgtaatgtagaggttggagctgacccctgctcctggagctcatcttctgatccgggtctctgaaaatgcgggcatgggcagctctcctacactcaccgcttccctcagtcacccagaaaagaaacctgtcttaccagtttggagaattgggacctttcctttgcttaacagatacttttggctttctcctgatgcccctaattcctaaactgttggccaaatagcaacctctatggggtggggggtttggagggtacaggggctgggagctggctgacgctttgaggcccaagtcactcgggaagatcacaatgccaagcgccacagtgtttcctctgccaggagggttcacttcccagtttctaaccagcctgtgtttctccactttttatttcaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgaggtaaggagaggccaggctcaccagcctgctggggagcaagccgctgtgcttcccaggccgggcccatcccctcaggacagtgccctgggccaggcacctgttcacatgcagggcatctgggtctagcctgcagcatcagaggtcacccagcaaagacagggtgatggccccacatcatcccccagcatctcatagggctgttcttcagtggggcagggcaggaatcatgtggcttctttttgtagctaaggaacggctcggaagggcacactgcagcctgcctgctccagatgcacacaggtggagggagcagagctgggaccggaagcctggcctgccttctggcgcctaatttccatgctccttattcacactgggctttctattcagaagcacagagatagctgtgcattattttgttcagttcaatgcttatggataaatcttaaccgcttgtggagctatgttgacaggaaaatgagaccccatgcctgccctcaccgtgcaccacagtttcaaaagaaataaggagtcaggaaggcagctgctttaagacagcattttaatcctgaagccaaacatctcagggatatgtcaatggattctgtgcattaatagctaaaaaatagttcttaatctggttcttagctgagatttgaggcattcctagtaggattcctaagcagtaagtcctctcattttcctgtctgcacatcatcctgtggtgtgtgccagcgttgttcctgggcacaaactcccgtgtcctatctgcaccctgagtcatgcttgcctctcagctccgtctgaatctgttcagcttcacacctgcttgagagtgaaagttacagttaatgtgggataccttttttcttttcttagagaggtagtacctggctgaggcaggtggatcacttgaggccaggaattcaagaccagcctggctaacacggtgaaaccccgtctctacaaaaaatacaaaaattagccgggcatggtggcacattcctgtaatcccagctactcaggaggctgaggcaggagaattgcttaaacccaggaggcagaggttgcagtgagccgagatcgcaccactgcactccagcctaggtgatagagcgagactgtctcaaaaataaaaaaataagtaatgcctatatttataatggttttgctgcaagaaatcaaagtgacacataaatgcgagacatcttcacaaatttaggctaacaaagcacttagaagaggaaatgctctcaatttcgaggtgaatagaaggtggcccagcagggaaaggtgcttgacctgccttgggccacacgggatgctggcagctcccagttgctcagccgagttctctgtagattggcagagaaagggtagtggggacaacacatcccttgtatgagcgcttcctgtgtgctggcctggggctgaggcacatgcccaggtgactgacctcatcttcagagcagcccagtgagggaggggcactcttcctatatttcaaatgaagcttagaaaatgattgaattactaggaatttgaacataggccccttgattccaaagccttcagtctttgttgtgtgtgtgtgtgttttgttttgttttgttttgttttgctttgtttgaggtggagtctctctctgttgcccagactggagtgcagtggtgtgatctcaaatcactgcaacctctgcctcctaggttcaagcaattcccctgcctcagcctcctgagtagctggcactacaggcatgcgccgccacacccagctaatttttgtatttttggtagagatggggtttcaccatgttggccaggctgctcttgaactcctgacctcaggtggtccactcacctaggcctcccaaagtgctgggattacaggtgtgagccaccgcgcccagccccagagctctcagtcttaaccgcacattttgaaaattgaaaattacagataggaggtcttacaatatggattgccctgaggaggtgcacagcagaaggcgtggtcaggatgccaagccaggggagtcatttgtggggtcatgccctctaccctgtgtctcttgcagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcaggtacgggaagttagtcgtcagcagactggttatggtggtatgtctccaggggtgcaggagctctgtgggtgccctgggttcccccttcatccctgcctatttaacatgcgtgtacctacaggcaagtgagattcgagaaattgctaggtattaacagaaatgcaggacagttgctcaggctgtgaaccctccgcactctgcagcttttgctgggctgatcattgtgcattgcggctgacttagagcagacgaaacagcttggcagaacttacatacctgggaccagcttccttagtgtccaccacaccctttcagggctcttcacacccccatccacaccgcagccacagcctcaccttgggtgtaggcagtgtgtcaccttccactcagttacccactccactctgcaggcccattctgctcattcccacccctgtgcctttgcccatgctgaacccgctccctgaaatgcccgcacagtataggttctccctgtcctctgagggacgagccagtcttgtctcctccatgaagcctactcatccttctcatctcatgatgcctcatatgagtcccttaatgagaactcccaacttgtatgagttcaacatgtcattattcggggcatttcagaagtgttcattttatctcttcagcttagggctgagcctgaccacagggcccatgtcttaacccccctcctccctttgtaatcaggtaccatgtggtctggctgaggcatcagccagctatggcggattggaagccgtgctggcctggggaaggttgtaggcaggggtctggttatcttccagtggagacacaaggtgcaggttcctggaagaggatgtcatttagtttaagcagctcacagcttagcagcaggacagtcagcagccctgggccccctgtggctgcaacttgagcagctgaatgctacagtttttaaaaaggaaagccccccgtgaacaaatgtgggatattctttcattacaaatggtcacactggccagggccctggaatagagcaccctcatcttaaaatgttgttttatttggaaataatttcaatctcatagaagagttgtgtgaatcatacagagccccacatatacttcatccagttcactgtttgtcaatatgtctgcattcgccttgtcatttcttctctcgtatattattgatgtgttttaactgtttgaaaattaattgcagacatcatgtcccttttcccctgaatagcaaatattttcctaagaggaagacattctcgttcataaccatggtagacttaccagattcaggaaatttcacattcttacaacattattatccagtacatttttgaatcttttttatagcagtttgcccccacttccaggatgtcttccaggactgaaacaaggatcatgagcaccgcatttagatgcaacttctcttcagtcttccctcagcctttctttgctttcacggccttgacggttttgaagaacacaggctgtggaacaccctctctaaagtgtttctaaagtcacttcttacacagccattgctgttagaacctaggaggggtgcgtggttgggttgtgagtggtaagggccaaagttgcgaatgtctgcattggcgaaagagatttgatggaaaaggaggttgctggagtgtagacagctacatcgatccatacttgggttcagcaatcctaggagggtcccatttgtagagagagggatattttctccacatcattcccatgtgtttctcatcatcagtgaaatgatatttcatcctgttcttaccattaaccgtgtttgtggtgacctcccttttagagctgattcaaagttcccttttgggaggctttccaggatttcaccaaactgaacgttatagtggaattgagtgttttaagctgggaatagtttagaaataatatagtccagttatttcccagttgatgaaattagggtgagattttaaaagaagtgttagatattcacttacatgaataagagccaagataaggccaagcgcagtggctcacgcctgtaatcctgtaatcctagcactttgggaggccgaggcgggggtatcacttaaggtcaggagttcaagactagcctggccaacatggtgaaaccccatctctactaaaaatacaaaaaaaaaagttaaccaggcatgttggtgggcgcctgtaatcccagctactcgggaggctggggtgggaggattgcttgaacttgggaggcagaggttgcagtgaactgagatcacaccactgcacactccagcctgggtgacagagcgaggctccgtctcaaaaacaaaaacaaaaacaaaaagcgtcaagatatttttgctttgagcatagctcattaaaaaatatatggcttactaggcgtggtggctcacacctataatcctagcactttgggaggccgaggtgggcagattgcttgagcttagaaattcaagaccagcctgggcagcatggtgaaaccctgtctctacaaaaaaatagaaaaattagccaggcatgatggtatgtgcctgtagttgcaactaatcatgaagctaaggtgagaggatcacttgaggccagaaggttgaggctgcattgagctgtgatagccccgctgcactccagcctgggcaacagagtgagaccctgtcccccacaaaaatctatatatctatatggctgtagtttatagtcacaggaaaacctgtgcagccagaggttagcacagaggcgctgtgtcattgctgaatgttaggctacagcacagctatcctgaagcaaaattgttctggagttaaccatttagagcatcttggctaatcctaaaaaaatacattggtctgggcagaaactactaggctgtcacggttttaaaaaaagaagatcgtatcttttctaaaacaggagacaagaagatcacaccgtgagcagactgtctgcacagtgtaaggaagaaggaccagaggcagcgactccaaggctgcaacacctgagagctggagtcactcaggactctgctctgagtcagcctagttcagcagtcagcatgagtttttgctatttttttccttctttccttccttccttccctccttccctccccctcccttccccccttccccttccccccttccctgcttccttcccccttcccccttccctccttccttcctgcccccttcccccttgcccccttctccccttccttccttccttccttccccccttccttccttccttcctccctccctcccttccttctttgagacaggatctcgctctgtcactcaggctggagtgcaatgacataatcgtggctcactacagccttgaattcctgggctcaagcgattcttccgcctcagccttctgagtagctgggactacgagtgcaagctcccacacctggctaatttttaaagattttttgtagggttggggtcttactatattgcccaggttagctattttcatttttgaaaattttattgggtttcttttcattgccattaagaataccatctacagagaaattcagtgagaggtaatagacaaatagcctggggtgatcaatggaagcctgactaatgattgggttacatacatgattaataccatgtttttattttgtaacagccattgattgactttgaaaatcttttatactattaaactttttttaaaaagccatttctcagttttctttctaatctgtactagctacaaacaatttctgtgactttcagtcagttattaaaaatatatttttgtgtccttttttcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtacaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaa

SEQ ID NO: 1543 - DNA, 11128 bp, Homo sapiens
  source 1..11128: mol_type = genomic DNA
ttatgcaaagcttaattttattgtctatgtagttagaaaacagtctgaaagaaaactcagtgttaaaacttatctatatataggtgttattgtatatctaaattataatctttgattcaatttttaaaaaggtgtccacaaatttaattttaaagtctgcttctgctttttaaagcaccttccttaaatgtaacctattttctttctaacaccactatttttgctatgcattggaggtgaaacatttctctataatccttagaaagtgcttatactaaaaaaaatccaatctttaaaaatttttaaagctaatatgccaatcttcttcatgtcggataaattcatcagtccatccagaaatgcaactcaatctcacaacctgaagtaatgttttctatagataatggcacgtattaaaaaaagttttagatacttcctactgaaaatttggaactccaaaatagcactcactactttaaaaaaattttattgttgatagcaaaatttccatttctatgtttttgcaattaataatagaaatatataggagacaatgtcaggaaacagataaaattgtaatttaaataaaaacaaacagtgagagcataagatttataaacatgtaaaattagtcaaattttgttttacaacaaaaagacaaatctggctaatggcccacttgttcaaatagcattaaaaacagaattgtcacacacaccaaaaataatttgttccagttatttcaactgtacattggtcctcattaaaagagaatgaaaagtacagagaaaatattttttaaaaatctcatcaggctaggtgaggtggctcgtgtctgtaatcccagcactttgggaggccacgctgggtaggttgcttgagtccaggagttcaagaccagcctggccaacatggcaaaacaccgtctctacaaaaataatacaaaaattagtgaggcatggtggcacacacttgtagtctcagctatattacttgagaggctgaggtgagaggatcacgtaagcatgggaggcagaagttgcagtgagcctagaatgcgccactgcactccagcctgggcgatagagcaagactgtctcaaaaaaaaaaaaaaaaaaaaaagaaaaaaggaaaaaatacctcatcaaattacatgtaataactgaggtttaggccaagatatttttctttaggaatgaaaatgattaagccaagaatgtgaaaatcctaacaaagtagtataattagtaaggttaattagaaatgaattttggcaaaccgagatcttaggtggctcacactccatcaagtgttcctccagtatcaaaaagaggctgtttacatgcctatacgacaatggagtggaaaagagatttttatttttctatattggcagttttcccatcagtgaccggttttattactgaacaggaacagcttaatgctgaaaatttgctgctgaatgactggcaaagactattagactcttgaaaatttctagcacaaatgcactgaggaaaaaacgttcttcctagtaagggtctattctcaaatagagatatattccctattaaaatcagtcttaaaatagaaaatatttaaaaaagtactgaaagaccttaaaaaggaaaaaaagaaattactaaaaagtacatgatcaacatgatttacagttagctatcctagaagtatgcttttttaattctaaaaatcctatttacaaagtatgcttacattgcattttaaaagacatgcatcaaatgtaaacaaatgattacagccattttataaaaagtcatattctttaaaacattttttgtcatcattaaaaattaaaaggcaataaagtgtcattgtcgtgaaacagtacgtgatcttaagggaagaaacatctcactagagtttgcacaagttccttcttcttctaactgtagatctggtggcaaaggaggagcccctgggtccccaggtctgggaagtgtagttgaagagaagatggtattttcagttctgcctacttctagaacaggcaaattcagagaagaattagtagaaaaaaagggcgtcgtgctggattctccttctggatggtacatgacagtggatgccctcagtttttcagagaaattactctcatctgaatttgatctggagaggttgttcgtggctccatctggaaaaggttcacaactgctacattttagtcctacaataaaattattcagatgtaaatgaaaaagtaactaaaaaaatggagtcactgtccatcttgtgacttgttaaagattacaagctagttaccccacaatcaaaatttaaatagcaacttgtaatttccgtcataatctatttcaaatctaatttgcttttctcaacaaccatgaagtatactattatttgcattttctatataacaaaatagtctcgtggaagttaaacgacatgctgtaattctcatttaaggtacagcgtacatataaacttaaccacctaaaattttttataaaataagaaatagctttcacaataaatattctttagtattctggtacaaaaaatattagctaataaaaaaatgtaaacggcagatgctaaaattctatctgttgatcaatgacaatggctaattcttgaataataggatattagaactaaaaggaattttagaggtcacctaggatagtctcttattattaaagacgagaaaaaagggcggggcatggtggctcacgcctgtaatcccagcactttgggaggccgaagtgggcagatcatgaggtcaggagtttgagatcagcctggccaacatggcgaaaccccatctctactaaaaatacagaaattagccaggcgtggtggcaggtgcctgcaatcgcagctactcaggaggctgaagtaggagaatcgcttgaacctgggaggcagaggttgcagtgagctgagatcatgccattgcactccagcctgggtgacaagagcaagactccgtctcaaaaaaaaaaaaaaaaaaagagaaaaaaaaggcacaggacagttaagtcatgtccaacattccaggactactttgtgggaaagtgagaactacaattcaatagataatgtcctgtttctcaacctcacagtttactcaaatgacagtggttgttcccattagctgtggtacgaatgtatccgccaaaagttcacatgttggaaacttggttgccactgcagcagtgttaggagctgaggcctttgggaggcaacagggtcatgagggctctgccctggactaatgccattatcacgggaatgggttagttattttgggagttcgactcctttttcttctctttcacactcttgccctcccttgctcttccatcttctgcccttccaccatgcatgacccttgccagatgctggcgccatggtcttggacttaaccagcctccagaactgtaagaaatgaatacatttcttttctttaaaagttacccagtctcaggtattgctacagcagaaaacaacttagataccatcaaagaattttatgatatccaaagggtatagttaaccattatccagaggattgaaagaataaacacaaacacaatttacccttctgttaggcttagcaaatattcaacctacaggcacagaaaccctgagttgacaatttttaggcaaaacctgcatagtctataaagggcacttacatgtcacttcttccactagtttttcaacctcacagtacagtcagcatgtctattccatgctatacaaactactttcttagatatggctcaaaagggaaaacttgtaatgtgtcccagcaaggggacacttatagactatgagttccttaagggcagagccctaaattattcttttctgtatccctaatgcctagaagagctgtagaacatcacatgcacatttatgtgctctggagagagacagtgaggaacagaggcaggagggggttggggatttaaattgtgtaggcaattccacacaatattccaatcagtgagtgtatattctggagtgagagtgaaatgggacaggtgaatctgctattctcttaatctgtttccatgctttcacatcttgccagactagtttaaagtcatgaatattttatgcaacgtgattcctataaacatatgccaattacttcatcttgtgatcaactggtgatcataagaaaaactagcagagttggacttttacaatactttgcctaaatactgttctttatgtgtgatgtacagtattttcagagcttactcttgaatagattaactttacattctactgactttagaaacaaatccttatgtatgcagggatttcataatagttttctataaatggtattaaatgaatacaaatacaggatattgagagatattccactttttcaatgtaatagtgtcaaataaggtaaaataagtgcaaattgaatataattttgaagtttaaactttttgaaagcaaaatgatcatttctgtttttgttttgcttttctgagacagggtcttgctctgttgcccagactggagtgcagtagcacaatcatggctcactatagcctcaatgtcccaggcttaagtgatcctcccacctcagcctcctgagtagctggaaacacaggtatgcaccatcatgcctggctaattttttaattttttgtagagacaaagtctcgctatgttgcccaggctggtctcaaaactcctgacctcaagcaatcctcctgccttggcctcctaaagtgcaggcacctggcctgctctgcattttttaaaagcattattacatttaaattagctcttagataattaagatatcttacctttcagatgttctagttttatatttctaagtttcagcacttcatctgtaatcttctgtatcaggaagttctgtgttttttctcgccgaatagattcaacaagggtgtccagaccttttgggttttcctgtaagtagtctaacaattttccagccctttttctacttgatgttcgacaagaaatttcttcagtgtcttctctactgagtattttttttgcacgtagatgatcaaaatgtctctcagctatgattttctcacacaggtatacacgtaaattttctaaggcctaaaagacataaaatatggttcaatgttatttttaacatctaagaaaatcacatacgtgactattagttggcagtcttagctggtgtgagacaatgttctaaagtcaggaggctcaggccttctaaaatgcatgctaattaagatgaaagtccaagtagacacaagtaggtcctagacattcctcactgctttgatctcaccttcaaacctaaaaaccaagaccaggctgttgtgaagagggaccagctgaatctagagggcctgggtccttggaaacagggaggtctgttgagggccatcttcgggagtaaagatgagggcaaacactactgtacattttagctatcagttggcaaggaatgcagaattagtcaggaccaataacttagtgagaggtctcacagtctgtaactttctcatgtttgttattaattactccatttccttaaactgttaaagacaaaaaacaaaaccctaaactgaaagagcccataatgtatctgtctttggggtcagctggaaagactacactctaactcagtgaatcagtcttggtggaagggagatggaaagatgtgtggggaatagggagtgttcgaaaaatgaaagaaataaagaaaaaggacaccacaaaaaagcaaacctagatttgagaagtgcctaagagcttaattagtagaaaatccatgttgatctcaataaatggcattaataatttggtaccggtgactgtattttagctcctctatttactagatatatgatcttgggcaagtaattaactcctctgtgcttgtttcctcagctgactgttatatgaggaataaagatatgcaaagtgcttagaaaagcgcttggtacatagtaagtgatcaatatatgttagtaataatgacaaaggtaatggcaggaaagtaggctaggtgaagggttcctgtggttcttggtctacgaagttccacatttacttgtttattcacatgacaagtattttacaaatctaaattcctaatatgccgagtgctgagcactgagtatacaaagatgaacaagatttgaatcctacatgcaaagggctcatggtctagctgggaatacatatcacaggtaataattataaaacaatgtgatcgggcccagaaaaaaaagattataggtcaaatacaggaaaagcacagagtgagcaaataactatgtccaggacctggtccttatcatatctggcatggactattaacaatagaaacctagctgcacttactacttccttccccctcctcaacatttctccttcaggagaaaatggaaatctggagtattatatgaattttactaaattttttttaaggatctcactctgtcacctaggctggagtgcagtggcttgatcatagctcactgcagcctggaatccctagactcaagtgatccccatcttagcctcttgagtagctaggactacaggtgtgagccaccatgcccggctaatttttaattttttttttttttttttgtagagaagggatctttgctacattacctaggctggtcttgaactcctggccttaagtgatcctcccaccttatcctcctgagttgttgggattataggtgtgggccactgtgcccagcaaattctaatattgaaattttgttaatttagaaaaaaaattaaaaacaatgttctgccctgtcttaaaggataaagttcctttacgtggcagaagagtagaaaagttaagggcatggctctaaagttggatcaacctcagtgcaaatcttgaatctagtactcacccttgtgagagctgggccaagttacttcaccactccaagctccaggtatgttattgataaaataaggattaaaaacttaactcacaggacatcaaggaggactaaatgggaatactatatatgaaggccacgcatagtctctgtacacagtaagtactcaataataactaattatggaagacaaggttcattgataatatggctcctacctacctctccagcttaatctatcactacctttgtcctgaaaatttatgctctacctaaaactatctgtctctctacatttccttacgtattttttgtctgcttttatcagaccctaaagcccctattcgtcctttaagatttaggtcagtggtcatcttctttggaaaggtttacctaactccccagaatgagttaggcaccccgtcctctgtccttgtagcaccttgtgtatacacttcatctttctatacaccaggactccacttctttcacctcatttcccaattcattcccagacatttccatcctgccccagtattcttctcgaagtcaccaatgacccccttattgccaaatattttcagtcttcatttcatttttcagctgcataaacacagttgactactccctccctgaaacaagaaaattgttacatgaataccacactctcctggttttcttcccatccctgtggatacaacttttcaatcattttcttgttgttgttgttaccctactttcaagctaacaattcactttttaaaattcttctctttaaagggttttacaccatttttctcttctagctcacagctttctaggtaaaatcattcaattccacacttacatttctagctcagatctctcttctgatctttgactttgcagatgtaattgctgatctgacatttccatgtactaatctaattacatcctcttcctcaactcccatgttcaatccatcaccaggtcatatcatttctatttcaaaaactgcatctggaattctgctccattcatctccactgccttcaccctgatccaaatcaccatcctcattcatctctatagattccaagagcctgctcactggcttccctgttcttattcttgttctcctcagtccatgaaacaggcagagggatctttaaactatacaattcttcaacaagtccctactatacttggggggaaaaaaaccccagatactttactaaaaggctcttcatgaaaatggctctagcccaccttcctaacttcacttcagattaccctctgccttcctccgatttccccaagtcaccagggtcttgcctattttaggtccttgacaaattctattctgcccagaatgctcttccctcagttctgtcaaatctttcaggaatcagtttaaatataacctctcctgaccatcctatctcaagtcgatttcccctattattgtcttggcactgtttgattccttcatagtaattgcaataatgaaaacaaaatttatttatttgttttaaactaacgtctctgtttgaagcaggcagctacgaggtatgttttagccaacactgtatatcctgcacttactagggcaccaagtagttaatgtttcagttgaatgcaaaactcactgcacttattttgtgatttaaaacaatccccctcaagaaattgagctcttttcaagttaggattgtgttttcatttttaatttttgaactgttagaaccaaccacagtatcagcctcacagtagcatgtaatccatatttattaaactgtactaaatccaactaacacaatgaggcaaataactagataggaggagggggagacactaaagaagtgggaggtcccaagacaaagggtggtagcacaccattcatcaagaaaggcaatacagcagcaacagtaagcaactttgggaaaaggatagtaaaagttcaatatttgacaaggtgagcaatctgtaggatataaaagtagatttccagtagacatttggaaataaggacctagagtggagagaaaagtccaaatatgtggataattttaaaactctctaagatcagaagacattttgaaaatatcatgaaaaaaacctctaagaaaaaagcatgcacatagtttctttcatagaccttttgaaacccatccatggtttcctcaaggttatttatttctgatataggcgtaaaatgaaatcctgaagacagataacatcaatgaattgacagagaagaacaaagacctggaagccactcttcacatctgtacttgtatacagatcttatttccttccacttgtaatttctcagttcctgttttattagctgtaaaatgggaatggcaattatcttctttagaggttgttgcgaaggttaagtgggaacattgtaaactgtgtgacacagcatctggaacataggaggcctagctcttggaagttcaaggttttactggcactcaccatgaataagacaacatttattctacagtagttatttatgttccattcttatctcaactagaatgtaaagcaggaaactgatcttcatttttttgtatccttccagacccaaggccagtgctttccatatagcaagtgctccataaatctctgttgaatgaggaaactaagcacaactcccagtcatatccagtttccttctgctggtgagtcacaccaattgtgagtacagtgtaataaaccttacagggaagaggaagggatttgaagtggatgaacatttaaaaagttgccatcctgtccagttcatcaaaatgactttgtaaaagtactgcagtgttcaataagaacacgtttcatgttgagtttctgtttttcatttgacttcagataaagtattttagtgatactcatataggtctcatctgacaaaacaagtaaacgcaaaggaaaaagaatgtcatatctcaacaaagccattcgttacgaataaatatgaaggtttatgtggttctgcaccatccgagaagagcataatttagctactgaatattttcgacgtttacctgtacattaattctcagctacgtgtattcactcccccaaccccaatttaaatatgtgggcgtctgcttactaggggaattccaggttgtgctttcagctgttgagcttcctcaagcccccttatgcaaaagagcttcacatttttggtccactgcttgggatccttcacctggtacagccttcgctctaggctgagtgagcagcctaggcagcctgacttaaggatgaatctgagccgccagtccctaacgaagcatctccaagaacccagttggggggaaagcatgaggagatgggtgaggagtgggcaagaatcaaaacaccacttggcaacaaagcccaagctctgcgtttagcgatgtaaaacctggattgacagatcactggaggatcactgccaccaaggtccctcggatgcagggctcgccacagtcctcctgtgctaggactttccgctcctccgacctggaggatcctccttgtcctcggactccaggcttccgctttcgtctcccgctgggctgcagcccgcccccgcccgccctgggcacagctgcgttactcacgtccttcttcacttcagtgaggtcctcctcggtgagggacggtgcggtgggctccatggtggaggcgggagatggcgcttcttccgggtccgggagctcgggctgcgccgccccgccctggctgggggcttcggcctccgggtaatggggaagaaggagaggaggcggagcgggtcgggagaaagacggccgccccttcgggaacagagggactcgggggtcaaaccgtagcgcttccggccccgcctctgaggtcgacggcgacgcgaatctacgcgacgcgacgcggagctcggagcagcgttccttccctctcgtagaggctcaggcgcaggcaccgccccacggcgaggcgcgtcgcttagcagagcccgccctgtctctgcggcagcctatcgacgccagcccgcgggccgatcctgttcccgcccccgaccggagcctttcgggtggctccgcccacagcgggcgtttcctcaagccacgcctgcgcaggtcgtcggtaagtggcccgggttagcttcctcataaggcatcgtttccgtgggtggggtccgtcagtgcccaggcagctggcactctcagcctttgctgcctgctcacttcggg

SEQ ID NO: 1544 - DNA, 98108 bp, Homo sapiens
  source 1..98108: mol_type = genomic DNA
ggcgggaagtgagccagggcttggcgcggcggccgtggttgcggcgcgggaagtttggatcctggttccgtccgctaggagtctgcgtgcgaggtgagtaccgcgcgcgtaactacgggtcggtccgcattgatctagccctgctctggcggcccggcccggagctggaggccgctcgggttcttccgtttcctgcactggttcgcctcggcccgctgagtcctctagtctggccaacatcctgggaggacagcagatacataaatacgttcccaaatggggaaacagaggcccggggcgggggcgaactctgccaaggtctcccggggcgtcggaggccgagcatgggctaggacctggcatgttgttgcccatatactccagtgcgtaacatgatgccctgcacagagtaatcccagcccagacctctggcactactacctccgtgtccctcctgaggaacaacgaaaacactttgtactttttctgtggccttccataatcacgagctgggctactcttgtttttgagtgtctactgtgtgccatgttcctggcacccttgatcttacaactgtagctttacgatatcccagcaaagcgaagtgcttaagaatactgcatcagattgcttgggttcgaattctggctccttcacatttagctctgtgtctactgcacgttactgaaacactaagtgtcttggttttcgtctgtcatatgggggaaatggtctcttctacttcctggcgtttttgttaggattaaacgacttaatatatgcaataataaatgcttcgaaggctacctgttacatagtacacagtaagggttctgttatcattacccagagaagcggatgaaattgtccccattttagacatggagaatctgaagtacaaagaggttgtctccgtacagaaagagcatttggtgattaagtgctagagatacaggatttgaactaagcgcctgattttaaagtatgtcccacaacattaggctttctcctatagccctcacctgtccttaggtcacacagaactttaggtacctcatggcgtgagatggagcaggtgactgacagctccttgtgccacccatgcagataaataacactggtgtgtcactgtcaagattaagggacaggaattcgagagactgcatgagagatcagaagatgaagaagcgggtaggcaaaagtattctgtttggggaatagtaaatagaattaattaaatcaacattttgttagctgggctgcttatactgtcagacagtagcttataatctactgggaagaaatgaaatttctgggtcctgtgtcactttcaatgccactcaccatgacaggtaccttataagtatagtttacagtcctatcagtaacctggagaagtagttatttccttcgttttactgaggaaaccaagagttaaaaaatcaggaaaagtgttagatgtgcagtagaacatcatcatgctgggaagttctacacatccgcttcaggacaggtggtattacctatgagcaggaagggaagggaaaaaggtaaggggaatgagtgatagtttattgttttgatttttaaatttttatctgttttttcctttttcatagtcattcctggaatgagtgagtttgtttttgtttttgtttttgggggatggagtctcgctctgtcgcccaggctggagtgcagtggcgcgatcttggctcactgcaagctccgcctcccgggttcatgccattctcctgcctcagcctcccaaatagctgggactacaggcacccaccaccacgcccagctaattttttgtatttttagtagagacggggtttcactgtgttagccaggatggtctcgatctcctgacctcgtgatccgcctgcctccgcctcccaaggtgctgggattacaggcgagccaccgcgcccggccatgagtgagattttaaatatatctgaaatgaggccaggcacagtggctcacacccataatcccagcactttgggaggatgaggcgggcgaatcacctgaggccaggagttcgagacttgcctcaccaacatggcgaaactccctctctatagtaaatacaaaattatctgggcgtggtggtgtgcgcctgtggttctagctactggggaggctgaggcacgagaatcgcttgaacccaggaggctgcagttagtcaagattgcaccactgcactccagcctgggtgacagagtgagagtccgtcagtcaatctacctgaaatgttttatgcctttaaaagagagagaatagggccgagtttaactttttaaatttggttggtgggtacatgggtgtaattctattttctgtatctttatgtaagaaatattaaaaattaaaagatatacatatatattttaatttacatatatatgtgtttttttctaagagaaaaatggatagaataaagaggtccaagataatcgtagaataatcctaggacttcagtgctgaaagcccctaagggtctccactacctgtaggataaaatctaaactccttggcatgataccagaggcttttgagcattctgtatcgctaacacatactattctacctcagcctttgtaccactagttcatagactactcttcttcacaacctcagtcctgtctgtaaagttccacttgtccttcaatatccaattcagtgttctttgaaaagcttctctatcatttgcctgtttttccttaatctgggaagccatagtcttttaagaaaagacttgattgtcagacttatctcgttgcattgtaattatttgttgacatgtctattttctgctagtctataagctccttgaaggcagtaataatgtctttcccatctctgtacttcagtgcctaccatgatgcctggcacagagtagtcactgtagatattagctgaatgaaaaatacaagttgaagacagagagtgaaagttcttggagttatgacatatggactttgttctctggaatgacagggaactattgagtttactttctttaaaaattcccgtattttattgaaacatattctcaatgtcaagaaaaatattccagtcataatcctatctttcaaacacttgaactatttttattttccatgagtcctttccaaatttcagctataaaattagttatacagatttagctatacagatttcttaggtagctgtagccttaatgtattcataacttagtgtttttcttttttctttctttttaaacctgacacttgaggaattttttttttcttttctttttttttgagatagggctcactgcagctccagcctcccgggctcaagtgatcctcccacctcagctgggagtacaggggtgtaccaccatgcctggctaattcttgtatttgttgtagagatgggcttttgattttttgtagagatagggtctcgccgtgttgttcaggctgatctcgaactcgtaggctcaagcagtttgcccacggagtgctgggactacaggtttgagcccaccgcacctggcctgcttttttcaatattaaattatttcctggctgggcgcggtagcacatgcctatgatcccagcactttgggaagccaaggttggggattgcttgagcctgggagttcaagaccagcctgggcaacatggcaaaaccccgtctctaccaaaaaataaaataaaaatctaaataaattatttattttagtgaatcagtctttatgcttgtcatttgtcttataaattttcgcaatattcctctctctttggtttaataggtatgaaatgatgctccatgttattattagaaaaatttcacaattttttcataaatttacttagtgtctgtatattctggtgagctgttgtgtttatattccctgaacatttgttcactggaactggatgttctttatgtgtttttaatattaatcatttatctgttatttgttgctaatttttcttttcttttttctttttttgagatggagtctcatcctgttgctgaggctgaagtgcagtggcgtgatctcagctcactgtaacctccgtctcccgagttcaatccattctcctgcctcagcctcctgggtagctgggattacaggcacccgccaccacgcccggctaatttttgtatttttggtacagatggggtttcaccatgtcaggctggtctcaaactcctgaccttaggtgatctacccactttggcttcccaaagtgctgggattacaggtgtgagccactgcatccagcctaatttttcttttaaaaatatttttattggccgggcacagtggctcgcgcctgtaatcccagcactttgggaggcctaggtgggcggatcatgaggtcaggagttcgagaccagtgtggccaacatgatgaaaccctgtgtctactaaaaatacaaaaatcagctgagcatggtggcacatgcctgtaatcccagctacttgggaggctgaggcaggagaatcacttgaacccaggaggcagagattgcagtgagccgagatcacaccactccactccagcctggcgacagagcaagactgcatctcaaaaaaaaaaaaattttctttattatgacaaccaagatacatttgtaaaaatatacataatttcgctggaaaccaagagttaaagtggctcacgcctgtaatcccagcactttaggaggctgaggcaggtggatcacttaagggcaggagttcgagaccagcctggccaacagggtgaaaccccatctctttttttttgagacagagtctcactctctctcccagtctggagtgcagtggcgcaatcttggctcactgaaagctccgcctcccagcttcatgccattctcctgcctcagcctcccaagtagctgggactacaggcacctgccaccaggcccggctaattttttgtatttttagtagagaccgggtttcactgtgttagccaggatggtctcgatctcctgacctcatgatccacccacctcggcctcccaaagtgctgggattacaggcatgagccgccgtgcccagcaaaaagcccatctctactaaaatacaaaaattagctggccatggtggcccatgtctgtaatcccagctacttgtgaagctgaggcaggagaatcacttgaacctgggcagcggaggttgcagtgagcctagatcaggatcacgccattgcactccagcctgggcaacagaatgagactctgtctcaaaaaaataaaataatttaaaaaaagttacataatttaaagaatagttacaaagaaattacaaagtttagttatgcataaaaattatattgtattcatggtaaattgaagactcattataaaattatagttacacataactatcatctagatcaagaaagaaatagaatattaccaggatcccaggaccccagaagtgtatctttctgatacctcctccctatgttagggataactattgtcccaattatgtatttatttattttgagacggagttttgctcttgttgcccattctggagtgcagtggcgcgatctcggctcactgcaacctctgcttcctgggttcaagcaattctcctgcctcagcctcccaagtagcttggattacaggcgcctgccaccatggctggctaattttttctatttttagtagagacggggttacatcatgttggccaggctggtcttaaactcctgacctcaggtaatctgcctgcctcggcctcccaaagtgctgggattacaggcatgagccaccgctcctggccctattgtcccaatttttgtgataatgcttttcttgtcttcatagtttgccctgatctatacatctataaataatatagctcagttttgcctggttttgagctctgtaaatgggataatactatatgcattctactgagtctttctagtttgcgttattatgtttgtgagattcttccacgttgtagatatagtttttcttttctttttttttttttttaatagtaattttggctgggcatggtagctcacttctgtaatcccagcactttgggaggctgaggaagcaagatctcttgaggccaggagttcaagaccagtctggcaacaatgggagacttgtctctataaaaaatttaaaaaattagttgagcatgatgtcatgcacctgtagttccagattctccagaggctgaggcaggaggatcacttgagcttaggagtctgaggctgcagtgaactatgattgtgccactgcgctctagcctgagtgacagagcaagaccttgtctctaaaaaaaaatttttttaaattgtttttcttaacctcttaacagagttttacatgtatagtaccacacagccacaatgttgtatggcagatctctagaatgcgttcattttgcattactgaaactttatactttttgattaacaactccccatttcctgaaagcccctaccctggcaaccactgtgcccctctttgcttctatgagtttgcctattttagatacctcgttgcagtggaatcatgtagtatttgtcctgtgactggcttacttcactttgcttaatggcttcaaggttcatctgtgtcatctcatgttgcaggattttttttttaattttttattatttaacttaattgtattgtattttattatttttcagacagggtcttgctcagctatccaggctggagtgcagtagaatgatcgttgctcactgcagcctctaactcctgggctcagatgatccttctgcctcagcctcccgagaaggtgagactacaggagtgtaccaccatgcttggctaacttttttattttttgtagatactgggtcttgctttgttgcctaggctggtctcaaactcctgggctcaagcgatactcctgccttggcctcccaaagtgctgggattacaagcatgagccacttcatctagtcaatttttttctttttaaaggctgaatatttcattctatgcgtataccactgtaaagaaaactccatttcctctctactctgtacccatataataattcctcacttctgtcaccaaatgtgtggtgttttttttccccacaatagttcagttctttagcagacactgggtgtcctacatttagctcaggtctgacactaactgccaggtgttagtgcagaccccaaatgttaagtcctccctgtccacccgcattccagaccccccacttcagactacaagcacaagtggtaagtcctccacattcagtcacagaacagtttccttactagattatcagcttattataaacaactcagaagcagccagctggaagaaatacacaggacaaggtatgtgggaaggggtgtggcacttccatgccctctccaggcacaccagcctcccaccatctctacatgttctcaccaacctagaagctccctgagccctatccttctgggtttttacgtaggcctccttacctagacatgattgattaaataattggccattggtgattaagtcactccccagcccctttgtcctacccagaggaagttttgttttgttttttgagaaggagtctcactctgtcgcccaggctggagtgcagtggtatgatcttggctcactgcaacctctaccagctgggttcaagagattctcatgtctcagcctactgaatagctggggttataggtgtgcaccatcatgcctggctaatttttgtatttttagtagagagagcgttttgccatgttgtccaggatggtctcaaactcctgacctcaggtgatctgcccgtctcggcctcccaaagtgctgggattacaggcataagccaccacgcccggcccccagaggaaggttttattgaattaattacaaactgataggtcaaagagtgtgtatgttttaccttactatgtaatactaaattgttttcaaaagtgcttgcactcccaccaatgtattagattttccgttgctctgcatgctggctaatactttatatttacatttttattttccaatctggtatattcatgtatagtagtattttctggtagcattcatttctctgattattagtgaagatgagtaccctgatgtgtttatgggctatttcctcttttttacagtccctttttttttttttgaggcggagtctcactctgttgcccaggctggagtgcagtggcaccatctcggctcactgcaagctccgcctcccgggttcacgccattcacctgcctcagcctcccaagtcccaagtagctgggactacaggcgcccgccaccatgcccggctaatttttttttttttttggattgttttagtagagacggggtttcactgtgttagccagggtggtctcaatctcctgacctcgtgatccacccgcctcggcctcccaaagtgctgggattacaggcgtgagccaccgcgcccagcctacagtccctttttttctgtcttctctattaagttgtctctgttttatgtacatataaacatatttatatatagttatctacatttttatatatacgtacatacacatttacataggtgtagcagatatcttctactttggctttttaagtggatttaacataattttagtcaatgactttttttatttttacatttctttaaagtgacataattgtaccccaacaatttatggggtacatagtgatattttgatacatatactgtataatgatcagatcagggtaattagcatatctatcatcttaaaacatttatcatttctttgtgttgggagcattcaatatcctccttctagctatttgaaactgtatagtacattattgttaactgtagtcatcctgtagtgctacagaacaccagaacttattcttcccatctagctgtaattttatattcttttctttcctttttttgagatgaagtttcactcttgttgcccaggctggagtgcaatggcacaatcttggctcactgcaacctctgcctcctgggttcaagcaattctcctgcctcagcctcccaagtagctaggattacaggcatgcgccaccatgcctggctaattttgcatttttagtagagacggggtttctccatgttggtcaggctgatctcaaactcctgacctcaggtgatccacccacctcggcctcccaaagtgctgggattacaggcatgagccaccacacccagccaattttgtattctttaacaaatctgcccctacccttcccagcctccagtgtcctctgttctagattttacttctatgagagcaacgatttttaggttccacatatgagtgagaacatatggtgtttaactttctgttctttattccacttaacacaatgtcctcaggttccatgttgctgtgaataacaggattttattcttttttatggctgaatagtattctgttgtataaatgtactataatttttttattcattcatcgcttgttgaacaccttggttgattccgtatcttggctattgtgaatagtgctgcagtaagcatgggggtgcagatgtctctttgatatactgacatcttttcctttggataagtgttcagtagtgggtttgctgaatcatatggtaggtctatttgtagttatttgaggaacttccatactgttctccatagtggctgtactagtttatattctcaccatcagtggaagtgtaagagttctcttttctctgcatcctcaccagcatttgttattttctgtctttttgataatagctttcttaactggggtaggatgatacttcattgtgtttttgtttttgtttttttaatttttaaaattttttgtagagacggagtcttgctgtgttgcccaagctggtcctgaactcctagcctcaagcaatcctcccgcctcagcctcctaaagtgctaggattcaaggcatgagccactgtgcctggccctaattgtggttttgatttgcactattttttttaacatcttttattgtgaattattgtatgttatatttcatagatataacttgtacgtgaatgagctaatatagtaggcctgaaactgttaccttcagaaaagcctgcttgcaaaattggtccctggctgtgtctgagaacttggcttttgaaacctttcctacactgatcaggttgttttactaatacctgttttccttctgagagtctgaaattttggtgggaggaaggtgcctaagtgaccagccctcaataaaacccctagattcagagtctctaaccagcttcttttgggcagaaacattgcacacacatagctgcattttcactgagagaacatgcactttctcaggggttagagagcattggaagcctgcacgtgaattcctacagacactacctgatgtgtttttttttcccttgctgatctggttgtgtatccttaaagtgttgatgatataataaatgttagctgtgagtacaactgtacactgagtcccatgagttcttccagcaaaatattgaacttagctgttaagttcctccagaaaaaaaaaaagctggaattttgattagaaatgcatcaagttatagatgaatttgaggagaattagcatctccatatcgtcttccaatgtgaatgtggttcatatgattgtttcctccctccttgacttctcttaacgactttcaattttcttttctttttttgagacagggtcttgctctctcacccaggctagagcaagtggtgcaatcacagcttactgcagcctcaacctcctgggctcaggtgatcctcccacctcagcctcctaagtagctgggaccataggcacatgccaccatgaccaacaaatatttgtatttttgtagagacagggttttgctgtgttgcccaggctgctctcaaactcctgggctcaagtgatctgcccaccttggcctcccaaagtgctgggattataggcatgagccactgtgcccagcccaattttctgaatagatatcaaggacataatttgttagatgtatttttaggtatatattattttctttaaattttttttgagacagggtctcactctgtcacccagactgaagtgcagtggcgtgatctcagctcaccgcaaccaccgccttccaggctcaagcaatattcctgcctcagcctcccgggtagctgggattataggcacgtgccactactgccaccacgttcagctaatttttatatatttagtagagacggggtttcaccatgttggccaggctggtctcgaactcctgacctcaaatgatccacccaccttggcctcccaaagtgctgagattacaggcatgagccactgcacccggccgggtatttaaatttttgatgtcatcttaaaaagttttctgacattttattttttgtttattgatgatatagaaaaacaatttatttttgtatattgaccttgtctccagcagtcttcctaaacacactgtcttagttttctatagctgctgtaataaattaccataaacttagtggcttaaaacaacatagaggccgggaacattggctcatgcctgtaatctcagcagtttgggaggccaaggtgggagtatcgcgggagcccagaaattcgagaccagtctgggcaacacggtgagtccctgtctctgtttaaaaataacaataacacacggtagctcacacctgtaatcccagcactttgagaggccgaggcgggcaggtcacctgaggtcgggagtttgagactagcctggccaacgtggcgaaactccatctctactaaaaatacaaaaattagccaggcatggtggtacgcgcttgtaatcccagctactcaggaggctgaggtaggagaattgcttgagcccaggagacagaggttgcagtttgccgagatcgcgccactgtactccagcctgggcaacaagagagaaactcagtttcaaaataaataaataaaataaataaaaacaacaacaacatagatttattatcttatagttctgtagttcagaagtctgaatgggtttcattgggctaaagtcaaggtgttggcaggctgagttcccttctggaggctcaagggcagaatccatttccttccccttttcagcttttagagactattcgtattccttgactcttggctttcctcctccattatcaaagccagcaactttgagtcctcctgaagttgccatctttctggtctgtcatcttatttcctcttccacttaaaaagacacttgtgattgcattgggtccatctggttagtccaggataatcttcctattttaaggtcagcttattagcagtcttaattccgtatgacagtaattcacctttgtcatgtaaccaagcatattcacaacatccaaggatcaggatatagacatctttggatgggtatgggagatggggatagtggtggtggtcacattattttgcctcctgcattcacttaagatttttatttttatttttatttttatttttgagacgaagtctcgctctatcgcccaggctggagtgcagtggcgtgatctcggctcactgcaacctccgcctcccgggttcaagcgattctcctgcctcaacctcccaagtagctgggattacaggtacgcgccaccatgaccacctaatttttttcttattttttatttttagtagagacagggtttcactatgttggccaggctgatctcgaactcctgacctcgtgatccacccacctcggcctcccaaagtgctgggattacaggcttgagccactgcatccagccaagaattttaataatttaatctgaagattcttttagatgttccacacacaaaattatagcctttgtgaatattaatgattttacatctttccagttaacacgccttttatttattgttcatgatctactgctctggcttggacttccagtatatatctgataaaagtattgatagtgggcattctggaattgttcctgatctaaaaagaaaagtttcctaaacttcaccttactgtattctctctgtcaggttatagaagttcctttctattcctgtttgataagagttgtgtttttttttgttgtttatttttgaggtggagtcttgctctgccacccaggctggagtgcagtggcgcaatcttggcccactgcaacttccgcctcccggttcaagtgattctcctgtctcagcctcccaagtagctgagactagaggctgcgtcactgcgcccagctaatttttgtattttaggtagagacagggtttcaccatattggccagactggtctcgaactcctgaccttgtgatctgcccgtctcagcctcccaaagtgctgggattacaggtatgagccaccatgcccggcgtgataagagttttcattatgaatggatttcactgtgaatggatgtttgattttatcatatgcttattctagaagtcttgagacgatatggttgttcagctttaatgttgtggtgaattatattaattgatttttaaatgttgaaccacttctgagtcattttttagacaacacaacttggtctcggtattttttattttatttatttatttatccttttagacagggtctcactctgttacccaggctggagtgcagtggtgtgacttcagctcactgcagccttgatctcccaagtcatcctcccatctcagcttcccaagtagctgggactataggcaagtgtcaccatgcccagttaatttttataaatttttgtggagatgagatttaatcacactgcccaggctggtctcaatcctgggctcaagcaatcctcctgccttggcctccaaaagcgctgggattataggtgtgagtcatcatgcccgtggctcttggtgtattttatacatggctagatttactttgctaacatattgtttgggacttttgcatctacatttatgaaaaagaattagcctggagtttttcactgaggagttgcccttacaggacttagtatcagagttatgctagcctcacagaatgagctggggagttggttctttctatattttggaatcgtttatgtaaaactggaatattttactgccataagtgcttagaagaactcacctgcgccactctggtcttgatgctatctttgtgggtagatttttgaccatcaataggacttctttaatggttataaggctattaggttttctgtttatttttgagtgagttttgataagttaatttttaaggaatgtgtccatctcatctaaattttaaaatttattgatgcaaagttgttcataacagcctaatgttatcttttaatgtctatagcatatgtaattaaatctcgtctttcaatctcttcttttttgtctttttacagaacaaacttggtttattgatcctctctattatatatctattattttttactcttaaaaatttttttaaaaatctatttatttatttattttgagaccggtttatgaaactggctaatttttgtatttttggtagagatgaggtttcaccatgttgccaaggctggtcttgaactcctggcctcaagtgatccacctgccttggcttcccaaagtgctgggattacaggcatgagccaatgcgtctgaccctcttctctttaaaactgcctcccttctattttcatcaggcttattttttcagtttcttttctaataattagggtcatccattttcttgtaactacttctttagttgcatattagatatttttatgtgtagatttccattattcagtttaaagtatatttgaatactcactatgatatcttacttgactgatggcttattcacaagtatatttcttgattttcaatacaaagggattttctagatctcattttctttattttgaaattttaaaaatctacagaaaagaaaacctacagaaaagttgaagaattagtgcagtatatcatcttcccaagtaaacaatttacattcataaaaatagttcatatattaggtaacaaggaaaacattagtaatttcataaagtagaaatattataattctgatcaccatgcaacaaaactagaaattaaaaatgaaatttataaaaaagcagaaaggcccttccatctggaaaattgaaaacaactattggatgtaaggaaaacagaaactgaaataaaggatttctgaaaattaacgaaatgaaaacacagcatatcagattcttaaaaaaaaaaaaaaggtaaggcactagtcaggggaaaatttataatcttcagtacatattataaatgaagaaagggaaataatgaaataaattccaaacttagaaagttaggaaaagaaaaacaagtaaatcgaaagcacaagagaataaataataaagataaaaagagaaattagtaagagaacaggaaaacatctgattcaaaaattaagatttttatcttggctgggcgcagtggctcatgccagtaatcccagcactttgggaggccgaagcaggcagatcacgaggtcaggagatcaagactatcctgtccaacacggtgaaaccccgtctctactaaatacaaaaacttagccaggcgtggtggcatgcacctgtaatcccagctactcgggatgctgaggcaggagaattgcttgaacctggaaggcagagtttgcagtgagccgagatcgtgccactgcactgcagcctgggtgacagagtgagactatgtctcaaaaaaattaaaaaaaaaagatgtgtatcttgaattgtttaatgaagcaaataaattagcctaatagaaattacaaatatacagaataagaaatggtaagtggtaagtaaccactgacacaggatagtttttataacaggattaatttatgtacctttacgtaaacaaatttgaaaactaaaatgaaatggataattatgtgtgaaaatctagtttaccaaaattgactcaagtagatgttggaagttaaatagctcaatttccattgaataagtttttaaagttatgaaataactgtctcactgaaaaataaaaaacatgaggtccaaatggtttaacaggaaaattctactacatttatggagtccaaataatcctaatgctaaataaattgttttagaacgtagaaaagaaggaaaacttccaaattctttattttccaaatggcttggtattgtaaatgctgatttagttgtctgtctccagttgttgaagggctgaagtgaaataaagtaaaacatcttaaaacactttttagttcttagaccctcttttttaaagtagctttattgatatagactgcacgtatttaaagtatacaatttgttcagttttgacatacacacatcatcaccataattcagttaatgaacatatccatcactctcaaaagtttcctcatcccccttaattctgccttcttgctctcttcttgccggtcaaccacttatctggtttctgtcactgtagaataattagcatgttctaggacttttaataaatgttataatacagtgtgtattcttttgtatctcacttcttttacacagcataattattttatatcggtttttatgaagcaagtataaaacaaatatttaacataaaaattaaaggtagcacaaagaaaattacagatgaatattatgtataaaaattatgtaaaagttctaaataaaatactaccaaacagaacagaatccagcactctattacaaaactattagctcatcaccaagatgtataccaggaatgcaaagatggtttaacattagaatcatcaatgtaattcaccatattaattaacctaaggagaacagtcatatatttacttttatatatgctgaaaaagcctttgacaagattcaacaccaatatatagtaaaaactcttaagaaattatattgtaatcaatacttctttttttttttttgagatggagtctcaccctgtcgcccaggctgaagtacagtagcatgacctcagctcactgcaacctccacctcccaggttcaagccattctcctgcctcagcctcccaagtcgctgggattacaggcgcccaccaccacacctggctaatttttgtatttttagtagagatgcggtttcaccatcttggccaggctggtctcaaagtcctgacctcaggtgatctgcccacctcggcctcccaaaatgctgggattacagatgtgagccaccatgcctggccaatcaatacttcttaatgatggtattctctctctctctctctgtctctgtctctcacgcacacatacacacacacgcgcgcacgcacgcacacacacacacacacacgcagagagagagagagagagagagagagagagagagagactttattcctaaatcctgtattttatctaataggaaaatactagaggcatttttactaagattgagaaaaatatagagatactcaccaactccacttgtatttaacattgtactgggggcttagccaatgcagttagataaatcaattagaggcacaagatttggaaaataaaaagtaatattgtccctacttgcaggtgatatggtagtgtgtctggaatactgcagaaaatcaataatgaaactaactaaacagaaaaggaattttataagaatatgcaaaaatcagtagtcttcatatacacaacaagtttgaatatataatgaagggtaaaatcccatttacagcaacaagaaaaagagaaaatatttaggaatttaaaaacatgtaaaacctaggtgaagaaatctttaaaacacttctgaataacaaaaatagccttaaacaaatgaaatcttttgttctaggacaggacaacaacatcataaaagtgcctaagttaatatatatatatatatatatatatatatatatatatttaagttaatacatatacctaagttaatatataaatttaatgcaatctcaatataaatatcaacagagttctggcactagacaagttgattctaaagttcatatagaaaaataaacatataagaataggaaaacagaagagctacaaagagaaagtagacttccagatattgtaacatgttgcaaagcttctatcatgataatattgtggtatagaccaatggtatagaatggaaagtcaataattagtctcctaaacacatgaagaatttagtgtatgataaaggtagttctgaaattattagggcagagatggactctttataaatagtgctgggacaacttgttagccacttgaaaaaacaaaattatatctatactttatatcagacacaggaataaactccaaatgaaccagaaatctaattttttttaaattacctactagaagaatacatagatgagttttctgtaacctggatgtggagaagggcaataaaagagggggaaaaattggctacattgaaaagcaaattcttgattacaaaaatgaaaaacaccataagcaaatttaaaagatagatgagaaaccaggaaaaaaatctgcaaaatacattttaaagacctactatccctagtctaaattgagagaaaaaaatactaaaatttggttaaaaaggcagaatacatgagcagatacaattttttaaaaagattcaaaaaccatccttaaatatgtgaagaaaatattcaatttcacctaaacaggaagtgtaaatttaaagctgcactgaaataccgtttctcacctatcagctctgcactaattagaaagcttcacaagaagccccattggtgaggctgtgaggaatgcaaacttgtaaaacctcctttgagggagaagttggcaatccagcagactacacatgcatttgccctttgacccagccattccacttgtagaaatattccctaaagatacattttcttttctttctttcctttttttttgagacagggtcttgcttgttgcccaggctgaagtgcagtagtgtgatcttggctcactgcagctcaaactcccaggctcaattgatcccaccttggcctctggagtagctgggaccacaagtgcatgccaccacgccttactaatttaaaaattttttttatagagacggagtctcaccatgttgcccaggctggtcttgaactcctggactcaagcaatcctgtctctgcctcccaaattgctgggatgacaggtgtgagccaccgtgcccggccttacgttttcaacagtagggaaatatgaatgcacaaagttatttgttgcagcattatttgtaattgtaaaatatcagggaataccttaaatgtccatacaggaaatttgttggtaaatatctacacaatggagtactgtacagctgtaaagaagaatgaggaaaatctttgcaaacgggtgtagagtgatttctaacatgaatggaaagcgtacatacagtgtgctattttttatgtaagaaagaagggaaaatatgagactctaatgtctgcttattttgcaaaaagaaaaacaggaaagataaatcagaaattattgaaattgataacccacaggaagtagatggcaaaggatggagagggaagaacacttctctgtggggaaaaacagtcttttatgtagttttaacttttagaactatgtaaatgttttatatattcaaaaatcaaatccacaagaacagtacaaacacaaactaatctaattcaaatgatgaatgtaatcaccctgaaggtgaggtgggactgaccaatcaagtaacttttgaatatagtactttaattatgtacccttaatctgaagaaagaaatgcaactgaattttgaactcttcttagtaggttttttttttttagtgacaggagtgtagcaatttgaaattacttcctatagtttcagattgaataaatgaataaatatatgatggttttttctatgaattttaagatagatggatagatcaatggatgtatagctgtagatacagaaatagatagaagtgtttatatttcctagatctgtctactaaaagggcctaggagcaatgatatgcaagtagcagatcatatctaatggccaggtcttagattttaaagatttttcctcattaaaataaatgaaggctgtttgaggaaatggtgattctatggctgaagcaggaaaagtaaatgaagaccatgaatgttgtgccaggtaataagaaagtgcctgatgggaacactttaaaggacagaggaaccaatggattaaagaagaaaacaagagacattagagtatatcttgagacaatgaaaacgaaaacacaacatgccaaaactcatggaatacagtgaaagcagtactagaaaggaaatttatagctacaaatgcttacattaaaaaagaaagatctgaaatcaacaatttaacttcacacttaaaggaacagtaaaaagaacaaaccaaacccaaagctacagaaacaaggaaataataaatattagggcagagataaacaaaacagggactagaaaagcagtagagaaattgacaaaacagaattgattctttgaaatgataaaaaaattgataaaactttagccagatggactaagaaaaaataagacaaattactaaaatcagaagtgaacaaggggacattataactgatttacagaagtaaaaagatttataagagaatattgtgagcaaatgtatgccaacaaatttgataacataaatgaaatggataaattcctcaaaacacataaccaccaagacagaatcatgaagaaacagaaaatctgaacagacctataactagtaaggagattgagttagtaatcaggtatcacccaacaaagaaaagctcagggccagatggcctcactggtcatttctaaccaatatttaaagaagaattaagtccaattttcctcaagctcttccaattaatgatatatttgataaagggttaatacccaggatatataaagaactcctcagcactttgggaggctgccgggacgggagaatttcttgagcctaggagttggagaccagcctaggcaacatggtgaaaccctggctctacaaaaaatttaaaaatttgccaggtgtgatggtactttgctgtggtcccagctactccgtaggctgaggtgggaggaccacttgagcccgggaggtcgaggcagccgtgagctgttgcactccagcctgggtgacagagtgaaaccctgtttcaaaaaacaaaacaaaacaaaacaaaacaaaacaaaacaaaaactcatacagctcaacaaataacccatttagaaaatagagaaaggactcgaatagacacttcaccaaagaagatatacaaatggccaataagcaaatgaaaagatgcctattatcactaatcattagagaaaggcaaatcaaaaccaggagataagacctcacacctgttagaatgcctgttataaaacaaaacaacaaccagaaaataacaagtgttgctgaggatgtggagaaattaggatgtggaaaaatgggaagccctgtgcattatttatagcaatgtgaaatggtgcaaccactgtggagaacagtgtggtggttccttaaaaattaaacataaattaccatatgattcagcaattctcaaaaagatatttgtacacccatgttcataacagcattattcacaatagccaaaaggtggaagcaaccctaacgtccttgaatggataagaaaatgtggtatgtatctacagttagatattattcagccttaaaaaggaaggagcggccaggcgcggtggctcacacttgtaatcccagccctttgggaggctgagacaggcagatcacaaggtcacaggttcaagaccagcctggccaacatggtgaaaccccgtctctactaaaaatacaaaacagaaaaattagctgggcttgatggcacgcacctgtaatcccagctactcaggaggctcgggcaggagaatcacttgaacccgggaggcagaggttgcagtgagctgagattgcgccactgcaccccagcctgggcaacagagcaagactccatctcaaaaaatattaataataataaaggaaggagcctggcatggtgactcatacctgtaatcccagctactccggaggcagaggtgggaggatcattagagctcaggagattgaggctgcagcgagctctgcacacaggaaattctgacacatgtctcacaacatagataaagcttgagaacactgtgctgagtgaaataagccagtcccgaaaaggcaaatactgtatgattccacttacagtgtgaatacattatgattcccatactgtatgagtctgctgatgacaaactattgtttttttgataatctggaagtgtctctatttcttgtggcattttaaataacagctgtattgtttttaaattattatttgtttatttttttgagacagggtcttgctctgttgcccaggttagagtgcagtggtgcaatcacagctcactgcagcctcgacttcctggttgagcagtcctcccacctcagcttcccaagtagctgggacaacaggcatgcaccatcattcctggctaatcttttgtattttttgtagagatggggtttcaccatattgcccaggctggtctccaactcctgggctcaagcgatccccccgcctcagccttccaaagggctgggattacaggcatgagctactgtgtctggcctgaatgacaggtctattgaaatacattacacatataaaattcacccattaaactgtacaatccaatggctttgagtatattcacagttatgcaaccatcaccgcaatcaatgttggaacattttcatcagcccacagagaaatttgcataccccttgccatcatccccaaatcctctcatctttcccaaccctaggcaatcagtagtctacactgtatccatggatatgtctattcttatacatttcatataaatggaatcatacactagttcatcttttgtggctggattctttcacttaacataatggtttcaaggctcgtcattactgtagcatttatcagtactatatttttttgtgtggccaaataacattttgttgaatggatatacacattttatttatccattcatcacttgatggacatttgagtggtttctgaatttggctattgtgaataatgctcctgtgaacaatttgtgtacaagtatttattttgagtacccatttttcactctttcgcatatatagctaggagtgaaattgctgggttacatggtgatatggtttgcctgtgtccccattgaaatctcatcttgaactgtggctcccataatccccatgtgtcatgggagggacctcgtgggaggtaattgaatcatgggtttttcccatgctgttcttgtgagagtgaataagtctcacgagagctgatggttttataaaaggcagttcccctgcacacactttcttgcctgccaccatataagatgtgcctttgcccctcctttgccttctgccatgattgtgaggcctccccagccatgtggaactgagtccattaaacctctttttctttataaattacccactctcaggtgtttcttcatagcagtatgaaaatggactagaacacgtggtgactatgtttcgttttttgaggtactgcttgactgttttccaaagtggctgtgccattttagagtcctaccagcagtgtatgagggttctgatttccccacattgttgccaacacttatctgttgcttttattatagctactttttaaaaataacagctttattgagatataattcatataccatgaaattcacctttaaaaacctagtgtacaattcactgcccttgatttgtgaaagatattttttctgggaaaagaattctgggttaatttctatcagcacatcgaagatatcattccactgtcttttgattttcatttttgctaaagagaaatcaattttttgtccatatggtacactgatatatttgggtgtggatttctttttatctctgcttggaattttttggctttctcaaatctgaaggttagtgtctttaattagtcctggaaaagtcccagctgttatcttttcaaatattaattcttccctattttctcttctttctggaactctggctagatttatgttagactttctactctgtcttccatgtctcctaacttctcatattttccatctgttttctctatctctctgtgtgtgcatctattaagtcaaaaactatgaagggtctgagattttaccctacatttatagctatatttatctttagccacttttctgaagttctaattatctattgttatgactgattttctttgggttgtattggtatattatcaagttgtctacatataatgataatctcatctcttctagtatttcctttttcgaatatttttgcattggcaagagcatccaatatgggagtgaaaatgagagaacaatattgtttttgctgttgtttttaatggattcacccctagtgtaaaatatatggtatttgttggttctagattttaaacacttgtaattttgtgttttaatgtgtttgttagacatggtttgagttttattaggtgccttttcaaaaatgcattgataatacatactgtgtgattctatatatatgaatcaagaagtttaagaaaccatgaacgaagagaacatatgacataaaattctgtcaaaaatctctctttgtctagaaattgtgtttgatgtttaattttatcagagaacagaaagttgcttgccccagtgccccagttaaggtaaagctgaggttcataaatacctcaacttaaaaaaatacaaaaagtagattttttgatcgttcttagttaggctcaccacctttgccccagggaaagtaactcctcccctttgaacagtcactgagtgaggcttacagagcgacgctctgtttttcaggaaccaccccctaaaatctccacttttagcagaagactggaaacagaaacatctaaatgttacttggcactgaatgtcttggagtagtctttttggcagtctatcccttgatagactgaaatagccatctttgacaacaaaatgaataaaaagtaaggtttgacctagtcttaattttgatagatccccaaccagtaactttagtgtcacttatttcaaagaaaaggcactctttttttctgctgtgtttttctccatcccatgtctctctctctctctcttttttttttaaaggtttattgtgtttacttttattctttttttatttttgagacagggtctctgttgcccaggctggagtgcagtggggtgatcatggctcactgaaacctcgacctcccgggctcaaatgatccttcccacctcagcctcctgagtaactgggactacaggcatgtgccacctcactcagctaatttttgtgtttttttgtagagacaggtcgtactttgttgcccaggctgctctgcagctcctgggctcaagcgatcctcccgctttggcttcccaaagtgctagtattacaagtgtgagccgccgtgcccagcctatttgaaaaattcttaatagccagttttaaaggtaatgcttgaagcttacatttcctgtgactttttttttttttttttttaaacacagggtctcactgtcaccccagctggagcagtggcacagaattgctcactgcagcctcgaactcctgggctcaagggatactcccacctcagcctccctgagtagttgggactgtaggtgtgtgccaccatgcctggctaaagatgggatctccctgtgttgcccaggctagtctcaaactcctgggctcaagccatccccctgcctcagcctcccaaagtgctgggattataggcgtgagccaccgctcctggcctgcttatttatattcttttgtaatggcatgataacttctttcatatatgtaggagaaaattttaatcattttccagattgaacttgtgattcttgtggtcattctaattcataggtttatttttttagtttctggttgctcattgcacccagaaattgttcctttttttaatattgtgaaacttcactagcctcaatttatttgttttcagttaatttttctcctttatcactggtctttgttattgtggatgaacaattttttttaagagatggggtctcacagtgttgcccaggctatagtgcagtggctgtttacaggtgtgatcatagtgcactacagccctgaactcctgggctcatgcaatcctcctgcctcagcctcctgagtagctgagactacaggcatgttggtgaacaattttctttttgtgtccaacaattgtatcgatattttgatggagtatgtacagaagagacacccttatggttcttagtactcaccaacttcctgaaagcattcccactgaggattttgagtaagaaaattatgtactcattaccatacttcagaatatgattctggctggagggtgctacctcgtgaggaataaccaaagagcagtgcattttaaaagcaggaagaggtcccctggagttaaggttgactgcatgctagctgtgaatccatagtgtaatcactacagttataaaatagttaatcaaacaattgtactcctgggatggctaagtagacatataaaaccatgctgtggagtaatgtaggaaatctcttattaaaatatcatggctagttttgatccaaaaataagtaagttatggaaggaatgtgggaaaagggtaagtaatgatgccatagaccactttgttctgcttagtgtcattaagactgaagatctgtgtacctctgcctccttgtcagtagtctactttgttgatgttgaaattcttagagggcaatagtctgacttcactctttatcacttcgtatttattcatgtgggaaagactcccacattgtacaggaccttgaagaggggacgcctcaacaaaagatcaaggcttttattttttatttatttatttattttttgagacagagtctagctctgtcaccaggctggagtgcagtggcacaatctcggttcactgcaacctctgcctcccgggttcaagcaattatcctgcctcagcttcccaagtaactgggattacaggcacatgccaccatgcccagctaattttgtatttttagtagagacagggattcaccatattggccaggttggtcttgatctcctgacctcatgatccgcccacctcggccttccaaagtgctgggattacaggcgtgagccaccgtgcccagccaagatcaatacttttaaactggattccaaatggtgaagtgccctaggaaatgcagagattaaggtcttaaaatattctccattaaaaagatcagggaggctgggcgcggtggctcacacctgcaatcccagcactttgggaggcggaggcaggaggatcccttgagcacaggagttcgaggccagcctgggaaacatggtgaaaccccatctctaccaaaaatacaaaaaaattagtggggcatggtggtgtgcacctgtggtccagctgtgtgggagggtgaggtgggaggaacacttgagctggggaggcggaggctgcagtgagtcaccactgcactccagcctgggcaacaaagtgagaccctgtctcaaaaaagaaaaagaaaacaagaattagggatgcttgacgaaatggccgattccaaatctggtgcaaaaaaatgcataaggtatgcctggaacatcttttgagaggaaagaagctctcaatgactcataaggttaagtcataaggactgaagagcccgcctgaaaagactcccactggccaaacatgaatcaatttgagaatcaataaggatgatcactgtattggattgaaacacacctaatatgtttaatccatgagttcataatgatactgaaaaaaaattcatcactatttgaaggtggtgaaagaatgaatatcattttttatttattattgttaatgtatgtaagggatacaagtgtagacttcttttttgttgttttttgaaacagggtcttgctctgttgcccaggctggagtgcagtggcacaatctcagctcactgcaatatctgcctcctaggctcaagcagtcctcccacctcagcctcctgagtagcagggaccacaggcccgcaccaccatgccaggctaatttttttatagttctttagagacagggttttgccatgttgcccagcctggtctcaaactcctgggctcaagcgatccgctcacctcagcctcctaaagtgctgggtctatgggcatgagccactgctgccagccacgtgaatatactgtatagtagtgaagtatgggcttttagtgtactgcatcattattttgaaacttacgataaaagtcttacagctggctacgcatggctcacacctgtaatcctagcactttggcaggctgaggtgggagaatgacttgagctcaggagttcgagaccagcctagtcaacatggtgagaccctgtctttaccaaacatttaaaaattagctgggttgtggtagtgtacacctgtagtcccagataactcaggaagctgaggtgggaggatcacttgagcccaagaggtcgaggctgcagtgagctgtgattgagccagtgtactccagcctgggcaacagatcaagaccctgtctcagaaagaaaacaaacaaacaaaaagtattcctgctaatgagtgaaagaagtaataacagaatcgaaatgtcaccattttggaggtggacttccaaaatggtggagtaaggacctcagggtgtatgtatagctgaaacaatattggatgagttgataattgttgaatctgggtgataggtatgtagggattcattccttccatctacttttttgggggtaataattaagatataattcacatgccagtgtgaattattcaatgtttattaaataactagctatattacctaaagcatgttaaagagggaaaagaagcagaaataattccttctggagaaagtgggacaaaagctgtattatgatcatgcttataaacatgaagatttctcaattggatgtaacttagtttcttctaaattctgattttcactgttatctaaagtcaagatggttgatagatatgggttaatgagtggaacacggcttatgcgaaacttcatatttctagaaatatcatctagtgttaaccctgcctcctaagatatatgctataaaataaaaatagatgtctagtaaaggtagggaaaagggtttatggggttataactatcagctaaagtgaggatttttttaactatgcatggattacagctaggatcttcctttagccccagtaattttaaggtggtttaagctgtttgttatcctgggctatagctcagcgttaccacagcttgttacacagagatataaatgtgcttggtaaacgtattctttcaggttgaaactagatgattatgaagcatagtatcttgctggtaaacctttgctctcattggtggtggtgttcctcctttccccagttctgcccttgtgcagaattcagttattcatttgttctttgggctttccgtgtgctttgatcatttcctcccacctcgctcccttccagctttcatttatccttccaggccaggtcccatttttctaaaagccctttcctaataatcccctccctaatgtcttttgtacttattttagcattgtggaggaagagagggggaacctggttattctgttattcaagtgagccttcagttagttgaagattatatatttcaagtgtcactagttgtaaatgtcaaaacagtctattgaccaaaaaaaaaaaaaaaaaaaaaaaaaagtcctattactctgggcacagttggaacaatgcctgtttgaatcaagtccttcctcccctcaaaaaacattgtgattaatgcaaagtacctaactccactgatttctttttccctcactttttaggattatggctgctgttcctcaaaataatctacaggagcaactagaacgtcactcagccagaacacttaataataaattaagtctttcaaaaccaaaattttcgtaagtgttttgactggtttgctgtcacataggcactaacttaccacattgtacacatgagatatcttctctttaaactcccccattgtacagatgaggaaatgaagctgagagattcattgattttcccactttgccaattaatggtagagtatgttttagcagcaccaggtgagattgtgtctcatctttgcatggttcctggcacataatatttgctcaataaagatttgttgagtaaatgaataattgatcttgtaaatttgggcaaataagtgttttttaagttttggggggtttttttgtttgttttgttttgttttgttttttcttttgagacggagtctcgctctgtcgcacaggctggagtgcagtggcgcgatcttggctcactgcaagctccgcctcctgggttcacgccattctcctgcctcagcctcccgagtagctgggactacaggcacctgccaccacgcctggctaatttttttttgtattttttagagacggtttcaccttgttagccaggatggtctcgatctcctgacctcatgatccacctgcctcggcctcccaaagtgctgggattacatgcatgagccaccgtgcccagcctttttttttttttcttttttgagacggagtttcgctcttcttgcccaggctggagtgccatggcacaatcttagctcaccgcaacctccgtcttccgggttcaagtgattctcctgcctcagcctcccaagtagctgggattacaggcatgcaccaccatgcctggctaattttgtatttttagtagagacaggatttgtccatgttgggcagactggtctcaaactcctgacctcaagtgatccgcccaccttggcctcccaaagtgctgggattacaggcgtgagccaccacgcccggccaattattttaatataattttatatactttcgaagaacagtttataaggaaactacagctctccagttctgcctctcctctaagctatactccagactccttctaatgatatctaataataatttatattataagtgatgcttttaccaggttgtagactttgttctgggtgcctggctttgaagtcaccactgactttgagatcattaaatccagcagatagccacgattcctgcgtcttttacttgtcctgcagattttaacagagttagcagtttttaactctttttcccctttaagttcttatcagagtagcaaaaagtagccatatttgaatctcttccgtttttcttttttctttttttttttttgagacagtctcgctctgtcacccaggctggagtgcggcagtatagtctcggctcactgtaacctccacctcctgggttcaagctattctcctgcctcagccttctgactagctagggcttcaggcatacaccactatgcccggctaattttttgtgtttttattagaggtggggtttcaccatgttggccaggctggtctcgaactcctgacctcaagcattccacctgcctcggcctcccaaagtgctgggattacaggcatgagccactgcacccggcctcttccctttttcatttatgctgtcaccccgctctggagatgctattaactaaggactactagcctgagaaataaagtagtgggaatgacctctcaaagccaaataattagcctctgaatgggaaggaccagagaacgaatacaatttaagttacctgataaatttaaaatcgagagagatggattctttgctcagttgggatacaattaatgtaacctgtgtgaattagtttaaaaaattagttttgtagagttggggggtttcttaaaatggatccatctaatctagtttttccattatttttcagaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagaggtaacaattattttatcttcattttagtatgttcattgtacttttttattcaaagctagccattgggaatagtcatgaatatatagagcttttgtccttaaggttgttagggtctttagtggtgctttttgaataatctgttggccacatttttgaggcaggacgtactgatgaaatggaaggttttagtctgctaatatagtttccaggatagctctgtgattttatacatgaagaaaatacaggagtttccccttgtccacagctttgcattctctgaggtttcagttacccgcagccggctgaggtctgaaaatattgcatcacttctcttgcgctttgggaccattattaagaaaacacaagccctgcaataccgcgacagtcaatctgataactgagaccactactaagtgattaacagcaacccaggtggacagatcaggtcggggcaagattttatcacactatactcaaaacagcttgaaactgaacacttatgaattaatttatttctgggattttccatttacatcacaatgcctacatcattcacctctcttcatctcatcatataggcattttttatcatcttatatctttacaaaggaagggtgagtagagtaagatattttgagcaagggagaccacagtcaaataacttttattgcagaatattgttataattgtgctatttcattagttgttcaccttttgctgtgcttaattaataaattaaactctatcataggtatgtatgtataggaaaacacatagtacttatcgggtttgatactatccgagatttcaggcatccaccggggtcttgtcacatatttcctgaagataagggggttgctgccgtaagatccatagaggttaaaatggtggttagtggtaaattggaaaatgaaactaagcctttctactgtaattcctttatggcttgttgccacctaatattgatgtataatgtgctctaattgcactattaaagtattataaattacattcaaagtttttcctggctagatcttgtaattatttaatgtccaaaattgagtaactgagattacccacatggggaagtaactcaccttatgaagcagttgcaaatatgagagtaaaatttttaaacccctgaatcccattaaggttactctagggtgagagagcactgaaaagtgattgacgataagcaaaactatagtctcatcaatgatgcctctgtttctgaagggaaaatttgttaaaagatagacagcaacaatttgggttgtgttttcccacatagtccaaaagagagacttaaataactgggaaactttgtgttaaagatgatttgtacaagcagccgtgtttgtgttattatcagacttatctgttgcactttacccttatttaaatatgagtgaaaagttaaaaactagaaacgtcaatagcaaatacgtgtttcgtaattaaccagagacagacatgaaaatccctaagcaaatcttcggcctcagtcgagcattcactggacttaatccacttgactcaatagtaatcatttatgaataaataagccagcattagcatgtaaagggagaggatccatacaaagtggtgtgattgtttgtgacttgccagaagcactcattcttaatcgctcatgccctgttctttctgtctcattagtggttaacaaatctatgtttatcaactgttttactgtagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttaggtaaactagctaaataattagcattattatttgtttctgggatactttaaattgtttaatttagtttataatatcatttctatataaaagtattttgtgctttctacaattattttacattcaagtgaaagcctcaaaaaaaaaccctgtttatacatttaattggttgcattctaaagatgaagtcccattatgattaattacatgaaacttcaaacaattttaggtagctgatttttttttttttttgagacagtctcgctctgtcacccaggctggagtgaagtggtatgatcttggctcactgcagcctccacctcccgggttcaagtgattcttgtgcctcagcctcccaggtagctggaactacaggtgcacaccaccatgcctggctaattttttgtattttcagtagagacgaggttttgccatgttgcccaggctagtcttgaacccctgagctcaggcaatccgcccgccttggcctcccaaagtgctaggattacaggcataagccaccttgcctggccttatatagttgattttgacataaggaatatatttctaaaaatattatatttccaaacctgacctgaaatgacacaaagctaacccattatatgggaagtgaattaggacattagtactttttaaaaaaatcctacaggatagaattggccattgtatttgttattcactcaattttagcaaattggtgacatgattattgttaattggtagtattacgagaaaaatagatactccacacgactcatcaacagcttaaattgctaagtgtcaatgttaccttcgtcctcatcccagtctcactctcagaccagttgagtggtagagtatagtatatactaaactgagcaaaagtttatatagagtctcaattctaaaccagcattctcatttaccaggtgaaacagctgaggcccagggaggagcaaggaattgcccaggttgatacaatgaatgacaaatggactcagatccagtgtagtgccttccctggtgtcatactgattccttgttgaatgcctggcttttttctttactcattaaaaatgtgtgttacgcaaataatataatcattttaacaaggattctaaataagaaggaaggagcactgctgggtgcggtggcatggtagtggcctgtagtcccatctactcaggaggctgaggcaggaggatcccttaagcccaggagttcaaggctgtagtatgctgtgattatgcctgtgagtaaccattgcactccagcctgggcaacatagcgagaccctcatctctaaaaaattaaaaagagagagagaaggaatactagtagtcccacaattctgactgttttctttatccatcttcagttttgatacatgtgtgtttgatttctgcattgttgtaatcaacatgtaattataattttatattctactttatttctcttagcattatttctaaatcattttccaattgctacatatttaattccttttaatggctacataatttatcaaattgtcatatcataaataaatttacctagagtcttagcaattaaaaaagcttgttttacaaagtatttccaaggtagactctctttgtacatttcccattgtaacttagtatacatatgtgtatatattataaaactgaaatagaattttcacaatattttttgtgcaatgcacagcttaaattctatgctacattttatttcagttttaaaaaatactggttgtaacctctgaatttcagaagtcaagtggtcagacagtatataacagagaagagagacctgtttttcaaactcctcttttccaaaacctctgtagctggccctcaagattctccatcttctggccacaatttacctttttcagctttatctccacttatgcccttgcaataacccagtggttttaatgagtcaaaccaacaatctagaaagcatatcattttctttaattataatgttattgtttaaaaaataatattaaaaagttacactgttttgatttagttagaaagttgcattccaaaattattctttaggaaaatacagttgattcccagatgtcaagcaaatagaaatgtcctttttaaaatctttctttcatagtctgacactttccccatacttgtcattcagtttgcttaaatcttatctccttggcaaagccttctaaagttccaaaaaatgttacctttctttggatttccacagtatcctctctttaacactcattcagtactaatttattttgttatttgtaaagtattttttctatgtaatcagactgaccaggtttatatgttaatatgtttttgtataatctgtgtggtgaggtaattatatatgcagacacacaaaaacacatgtacatatatttgcataataagagaagtccagaaaaagtgctttgaaatctcagaaaaaagagacattaataatcacttgctggagaagtaatgctttggctggggctagaagaacaggtgtgatttgggtacgaagagattggaatggcaggttttccaaattgagaggatcagtggcaaaatccccaaaataggcaatgcagggcttatatgaagaatgtaagtggtacagtatgactgaagatttgtgttactgaaaggacataatcggagataatgttgaaaagggctctttctggacaactttgaggaccagctaaagaagttttataattgaggaaatttaaaaaactacttctcttttctgttatatattgtctgatcagtggtagaaaaatattaagggtttcaaaattatacatttattgagtctagcctatagtatgattggcttaacattttttttatttgcagtacgttaaaggaccttgacacctctgacagaaaagaggatgttcttagcacatcaaaagatcttttgtcaaaacctgagaaaatgagtatgcaggagctgaatccagaaaccagcacagactgtgacggtacaagcaatattttagacataccatgtatttcaactacttacttttgaaaacaacgtaacacaaagattgtgttttgaacctgtggctgtatgttataaaatggcagatttgtagtttcttttcttctaatgtcataaccttgtttactggttagccagcatttgcctgaacaactcatgaactcatgctctcacaagggcgttcattccccattttgaaaatgctacttgttagaaatcatctctcatactgagccaagatctgcaactttaattctaggaggtttttaaatttttatttacaaatgagaacttccacaaaatcctgtgtttcagaaacacggaccacagagcgtaatctcatcataatagagtttccctccccctccttgactaaatattattaggtcttttaactctccttgctagaaattgctttcttgacctttcatcctccggttctcccttgtatatactctgagtctaggtctgggtcttgatgttcatttaaagctaaatacttgtttgcttgttttgtttctaattcattttttattttttattaaatatctagtgtaaataatcagatagcagtgcaagactttgataaacgacagtcccccttcccactcttggtgtctgctgctcagaggcaccttcagtctgaaaatatacatcctcttgtagacatttttctggcattatttctttttaccttctttttctctttttcactcttcctggaacttctatgatttgcatgttagacttccattaattatcttttctatttttcatctcttgattttctactttttaggatatttccttgattttatctttaactcttctgtggaatttttaaatttctatcaaggcaatttccgagagctcttctttgttctctggatatctctgtcgtgcattcgagtctgagggctgctgggcttttttagcgacgtctgcatgcatgtgcgggtcatgtgtgtagtgttctctgtgtgttgtttttgtttcctccagtttttttgtggtttattttggactcaatttattttagagatattcaggaggtgactgatgtgctgggcgctcttataaagtgccttacaatattaactaattcagtcatcaccataaactacctcaaactttaaggtagtttccttttttttttttttgagacggagtctcgctctgtcacccaggctggagtgcagtggcacaacctcagctcactgcagcctccgccttccaggatcaagtgattctcctgcctcagcctcctgattagctgggattacaggtgtgtaccaccatatctggctaattttttgtatttctaatagagacagggtttcaccattttagccaggatggtcttgatctcctgaccttgtgatccgcccacctcggccccccaaagtgctgggattacaggcgtgagccaccgcgcctggcccactttaaggtagtttctgttatccccatttaacagataatgaaactaaggtacaggagcgttaaatagttacacaccgtcatagaattagcctcagagctaggatctgaacacagcagtcttgaggcttttgagttttcattgataacaactgcattatactgtctctgtatcattaagtttcactaataaaatggttagctagaacaggggcaaggacagagttctacagcatgtcaatagaggcttccctcttggcttacaacagtccattcatcaccacttcttgttcagctagttacatatctgtcttcagaccatgtttctgttctttatccatggagacacaaaagacttgactatgtgactccaaaaagttagaggtgtgaggcagcaagaaggaatgggtgggacattgactctagagtcctacagacctgtaatagaaacctgtctcctcctactcttgactatgtgactatggcaaatagttaaacttctctggacttcagttttttcttctataaaatgaggagaatgatatctaccttgctgggtagttgtcaggattcaagataaagtgcctagtacactgcaggcctttcataaatgataactattgttatctgccagtctagtaatccttttaaaaaaggaaatacattaagacggatggtttgtttttatgaacttttgctaactctattattgtttcctcccccttagagctcacaaagcagctatttgataacaggctctagaattttgctttgaatttacatcaaatcaccagcctgtagtttttggcaatcactttcaaattttttgaaaattagaacaatgtttgtctgtcctcactttccatcagttctcttattcactagatgcctcacacacgtgtcagtgacaggggctctgagatcctgtttgcaggtttcctttgtactctgaggtataatctgtctagacaaggagtcttgggctagtctctgatagctaggtacccccttttatctccctctgagcctgtcttggctttcagttccatccgaccattgtgtattctctttccaatctgatgcttgttttccttgcagagaaaacagaagtaagataggaattcagcaattccattttacatctcatacctcacatttctctcagtcaccagaagtccaaatttcccaggccattcttgtgcagatgcccctcctcaccctgccatcttcactccctgttctgtcctcacttcctgtccttcctggcttgtaaaccatttaactgactgctctgtcagcaatgtccctgtagcctcatccgcttctctgatcattttcttccccttctttctctaattgttttctgaggatatgtactgtttcccctgcagcccacctaaactgttttttactctcacagactttaggcctgagaggtggcaaaggcatctgttgtccttgcttcctattgccattttttttcctttttttcatctttttttttttttctcgctctgtcacccaggctaaagtgcactggcgcaatctctgctcactgcaacctctgcctcccaggttcaagtgattctcctgcctcagcctcctgagtagctgggactacaggcatgcaccactatgcccagcttttttgtatttttattagagacagggtttcgccacgttgaccaggctggtgtcaaactcctgatctcaggtgatcctccagcctcagccttccaaagtgctgggattacaggcgtgagccaccatacccaggcgcagctgaggttttagatgaaggaaagggctggcacggtggctcacgcctgtaatcccagcactttgggagaccgaggtgagtggatcatttgaggtttaggagttcgagtccagcctgcccaatgtggcaaatccccatctctaataaaaatacaaaaaagccgagcgtggtagcgtgtgcttgtagtcccaggcactcaggaggctgaggcaggagaatcacttgaaccggggaaacggaggttgcagtaagccgacattgcaccactgcactccagcctggaagacagagcaagaatctgtctcaaaaaataaaataaaataaaacctctactgctttgaaattctatttattagttatggcttaatttttaaaatgggagtgggctggcaggattcagttgttcaaacatcatatcaggagttgctctgtctctcacttcccttctctctcctctcttctgtcccatctctccgggtcaaacctccatttctttctatgtgctttctacttttcctttgtatcaatcttatttgaaatctgtctttctttataaggtgacagaaatggccaccagaatcatattaagcttggaaaaagggaggtactttttcccagtcagccctaagtatttccagagttaattttcactgggctgccttgtgtcagatgcctactgagggagtgggaagggtaggtctaataggaaatcttggtaacagtatatgttaccattaaagggaagcctggattccaggcagatcaaaacaacaggtagggctcttgcctgtccaacgcttaacaatacactttgtgttggcacagtgagctttgcacatgaagttagttaaaaataaaatcatagttaactgataaacctttgttccagccaatgaccttgcttaccccaagaaatattatttattaaatattatgaaattaaatgaaaacagttatgagctcttatgataaagcgtagagacaacccaatttcaagttaattcacaggaagataataggacaatatatggttgtttatgatcttgtttttacactgcttcatattttacatatgtgactttcaaaatcttaagacttgactgggcacagtggctcacacctgtaatcctagcactttaggaggccaaggcgggaggatcacttgagcccaggagtttgagaccagcctgggcaacatggcaagaccctgtctctacaaaaaataattaattaaaaaaaaaaaaaagaagaagatgtgttgtgttgctgggcacagtggcataggcctgtagtctcacctacttggggaggctgaggcaggaggatctcttgagcccaagagtttgagggttcagtgagcagtgattgcaccactgcagtttaacctgggcaacagagccagaccccctttctttctttctttctttctttcttttttttgtgagacaaagtctcacttttgtcccccaggctggagtgcaatggcacgatctcagctcactgcaacctccacctcccaggttcaagcgattctcctgcctcagcctcccgagtagctgggattacagacacgcaccaccatgcccggctaatttttatattattagtaaagacggggtttcaccacattggccaggctggtctcgaactcctgacctcaggtgatctacccttcttggcctcccaaagtgttgggattacaggcgtgagccaccgtgcccagccccactttaaaaaaaaaaaaaaaaaagaaaaagaaatcaagatcttaagacttttttttttttttttagtgacagggtctcactgtgttgcccaggctggtcttgaactcctggacttaagcaatcctcctgccttggcctccccaaagggctgggattacagtcatgagccaccatgcctagccaagacttttttttttttccctcaaagaaaaatattaacaacataattattttatagctagacagataagtttacagcagcagcttattcatgtgatggagcacatctgtaaattaattgatactattcctgatgataaactgaaacttttggattgtgggaacgaactgcttcagcagcggaacataaggtatcttaattttcccccttctggaatatatctgattatatttctaccactctaagtgaaaaatggacagggcaaaatgttcaggctttctggcctggaaatggcataaggatgatcatcatgccactatgtttttgatttgtttacttttcaaaccactcctttaacattcgtattcatgtttttaagattgggaaaaaagcgaatatattttgctacaatttctatttggtatgaaaactacagatttgcttttgtggcctaccagagtaaactacttatatttaatacgttgttctcttttctctcttcagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactggtaagtttaaaataaattgaatgcttatatgaaaacaaaactgtcccaaaataggaattatataagaaaaaccatagcaaatcatcattgcctgaaaacattgttgctatgcaaatttctactgatgatatgaattacaaatcacaatttcaaaagcaagttgctcttttgtctctatagcagctgtagttttataaaatgtgtaattataacctattgtagtacggctctaaagtcattacaaatgtgatgtgcctttgaattaacattttttagttcctaaaacaaactcatgagggccaagtttttaatgattttgggatgggcaaaagcaaaaatggattcgcatgctaaaaatgtattttagaattctgtactgatgagaatcgattaatacaaagtagagaagcatgttttatgtgttaaaatgttaaaatatagggtagtctataaaggatatgaagtcaggagtgtcttaaatcagtcaaactacttctttgggtctaagggctcactgcatgccatgtgctatgttgggcgccgatcatttaaagatgaataacaaatactaagtagttcctgccctcctggagctcacagcttagtgagagagaagttttgagaggaatgaaattagccactgaaggctccagagaaaagccaaaaataattttaaaaccttacatcaaccctataaagttatcaaaagtattttttagctgaaataagtttataaagtacagccctccctatttttgccattgatgacttaataccacggaggtttttcttacagttacgctgctgacctttaaaacaacgattaatggatttatttttgtatcatgttagaatgtgtcatacttgatgtttgcaattatcttgagacagttgagtgttggggttagcgtaactgccagagctccgtgagtacctcttgttctctgtgctgaaccagagttgcgacagccaggctgcagagcaggggcacgtgtgagagatgttatgaaagaagagcctgaggaagctcagatgactccaaggtttcagacactgatgactgggaaaactgtgacaccagtaacacaaacaggggagtcaggaggcggagtcagatttggagaaaagctgagaagggctagtttaagtctagaggttaaagtgctggtaagtcattcaggtaccaatgtcttgcagacaacgggagctgtgtgcaggactggaacttaggagggtgtcagttgggtcttaagagaggtgtaggcatttgctgcacacgggtcatgtttaagatcataggactaggaaagctccaaaaaagaatgtctacagagcccagtcccaaatatctgaaagactccctcccctatttatggggcagatggaggtagtagagccaggaaagggaatttaaaatgagtagaaaaccatgattgtcttggtggtcatggttggaggaagggagaagaggaaggaaagaataaaagtagtggtaggtgctgtagaaaaagtcaaggaaatacttgatttgggactttggcaagtttttggtggctttgagacttgtagggaaggaaagccagtaaagagtttaagaactgtgctgcagggaaacgtgtgccagtgattctgcagggcaagggaaatgctaaagctgtactttcactgtattcatgtactgatttttcttaacgttgattattttcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggtatgtatttttagaagtgaattggcaggaatccattggcagatgttaaatgaaagctctttaatagaaataaaaagaccacctacacagtatttctatcatttagggacctcttaaacctcctgtaccatagtgagaaagcatattactttatatcctttgttctggttgttgacatcatgaagtttatagccctgtaagattttcaactcgaagctcattgtgttgaactgatctagaatttttctttgggaatttttcttttttctagtctaagcagttttggaaatcaaacagaaaaatcgctgtcagagaccatgaccatttctggcagtttatttgcaacaatctggtgttgcatagtggttaaatcatatatgcatatatgcatagtggtccatcagctatggaccaaaggcctggacttaaagaacagctctgctgctcacagcagtgtggccacatgcaaggcactttactccctgggcccattttctcatgtgtgcaatggtgatagcagtaaagtacctggttcacagagtggcatgaggattaaatgaaaatcatttagcacgatattgtgttggccccactttaaagagtctaggacattcattgtgctgttaaagcttatgacagctgttcaatgatttatagtcattcacatgagaatattaaatcaacagggcagagcgcaaggagaatttgcagtttcagtacctatgtgtagtcctccctctgtctatcacctgacttgtgacctttagcaagttagctagtgctgtcattattgtataatgttgactgggcatctgaactttttcatcctggtttttagatttagatagccttggcttaataatcagcatttcaatttttattaatttattaatcactctgtgccttcctttcaaccctattttggtgtttcagaactctaacgctggaaaaaaccttggcaatgatctaatccattgattttttttttccagggcttcccattgtcctttagggtttcaagacggcatttttaaggtccttccaccccaatttcaaccacttgtgagagagagatatatataatatataattatatataatatgtatattgtattgtatataatatgtctattatatataattataatatatagtgtgtgtgtaaatattccaaataaggtttattttatttttatttcttattatttttgagacagggtctcttgatctgtcacccatgctggaatacagtggtgctatcacagctcactgcagcttcaactgggttcaaacaatcccccccaccttagcctcccaagaagctggggctacaggcatgtgccaccacacctggctaatttttaaattttttgtagagatgggatctcactgtgttgcccaagttgatctcaaattccctgggctcaagcagtccacctgcctcaggctcccaaagtgatgggatttataaataataaaagtaaataaacattatatagaaagtaattattttaatcctagtgtcatttttagagactcttctactactagaaataaaaactttactgtattccactacattttaagtttcctgccctaattcttgcctttgctattatatatgtctatataagatgtcctaggccgggcgcagtggcttgtgcctataatcccagcactttgggaggctgaggcaggtggattacctgaggtcaggagttcaagaccagcctggccaatgtctctactaaaaatacaaaaattagcaggatgtggtggtgcatgcctatagtcctagctactggggagggtaaggcatgacaattgcttgaacctgggaggtggagattgtagtgagctcagatggcaccactgcactccagcctgggcaacagaatgagactctgtctcaaagacaaaaacaaaaacaaaaaaaacactttttttttaaagatcatttttacacattatttaaattgcctaaatataatagtttgagtcatttgagtatggcaaattgttggcaccagggacaatatgccttggtgtcctattaatgatatgatttcttttgtaacttttacattcatgctctgaagacagaacctgacagatattttttcattgttctctttcaggaggtggtaagagtttgtgttaccagctccctgcctgtgtttctcctggggtcactgttgtcatttctcccttgagatcacttatcgtagatcaagtccaaaagctgacttccttggatgtaagttataaaaatactaataaaaacacgccttagaaacaattaaatttcagtcctctggataacctttttattaaatagttcgtgatttgtaaaaaataaagcacagcagttaaatttgcagttgaacagaagtctgaaaatttgatacagataacctctagttcaatctgtttttattctacaagaatgtatcttagtaagaacttttaaccaatgctattttttgctgatgtaaatttttttaacgaatagaaaatcatttcttttttcagtactgccaggtcggcatagttctctttcccttatatcttaaagtgcatacacacatgcatgcctgcacacatatatctttttttctcatggctgagtttaaggaagtaaatgaatgcattctacttaactcttcacaatgtagttgggggtggtggctcatgcctgtaatcccagtgacttggaaggcaaaggtgggaggattgcttgaggccaagaattcaagaccagcctgggcaacacagcaagactttctctacagaaaaataaaataagctggacatggtggtgaaaacctgtggtcccagctgcttaggaagctgagggaagagggtcgctagagcccaggagtttgaggctgcagtgggtcatgatcatgccactacaatctagccttggtgaaagcgagaccccgactcaatcacattgtgattaaaaagaactgttttaagagttatgagtcaccacccctcaataagaccactagtttggttttcttccaaagaatgtcttagtgcagtggtggtagccattgttcaaccatttgtcatattatggccccttcattgtcattaatctttaaaaccctgaaatacatttatctaaaaaaaagatgccatacagtaggactggaatatcttgtataccaaattcatatttatcttatttacaaagatgaaaaataaagcaagaaaaggaaataaataatgagaagaccattttgtgttatgcttttttttgttttgttttgttttgttttaagacagtcttgttctgttgcccaggctggagtgcggtggtgcaaccttggctcactgcaacctctgcctcccaagctccagcaattttcctgccttagcctcctgagtagctggaattacaggcacctgccaccacgccaggctaatttttgtattttcagtagagatggggtttctccgtgttggccatgctagtcttgaactcctgaccccaagtgatccacctgcctcagcctcccaaaatgctgaaattacaggcgtgagccaccacgccctgcctgagttatgcttaataagggttttttaaaatgtatgtacttacatacttgttatgttgagatatgtatttcctttgataggtttgatatgtgactaataaaatatttataaaacctaaggacaaatgtaattttgtcaggttaatgtataaaattgaaattgtttactacttttatacttagattccagctacatatctgacaggtgataagactgactcagaagctacaaatatttacctccagttatcaaaaaaagacccaatcataaaacttctatatgtcactccagaaaaggtttgtatttatatcattattttaaaatatattaaagaccactagaatacatatatttttaagattttaacaaaattttgtatacgtagtgcaaagaatttttgtacaactttcatccagaaaccccaaatggtaacattttactataattgctttgtattctctctctgcatatattttcctgacacatttgattgaaaattgcagacatggtatccttttaagccctaagtacttcactgtacatttcctaaaaacaacgtattctctcatataacctcagtacaatgatcaaaattaggagatgtacattgatgcagtactattacttaatctgtaaaccttattctggtttcactagttgtcccaataatgtcctttatagcaaaagaaaatcccagatcatgcatgcattccgttgtgcttctctgtaatcttgtaaacagtttctctctcttaatatctttcgtgattttgaagtttttgaaggccagtcgttttcggaattgtccctcaatttgagtttatcttgcttcctcctgcttagattcctgttactccttgaatatcacagaaacagtgatatgttctcatgcccactgtcaggaggcacttgatgtcgattcgtcccattactgacaatgttagttaactgatcgcttggttatggtagtgtctgatagacttctccgctgtaaagttactcatttctttttggcctttgtaattagtagatatcctgttgtgggatgctttgagactacgtaaataccctgctagtgatcagaattttacccacaagttttagtatccattgatgattcttccccaaatcagttattactatgatagatataaaattattttttaaatgtagttggtgttttgccataaggaagagttttcctgttggttacactttttttttctttttttttttttgaggtagagtctcactctgtcacccaggtgggagtgctcggctcactgcaatctcggctcactgcaacctgggttcaagtgattctcctgcctcagcctcccaagtagctaggaatacaggtgtgtgccatgatacctggctaatttttgtatttttagtagagatggggtttcaccatcttggccaggctggtctcaaactcctgacctcaggcgatctgcccacctcggcctcccaaagtgctgggattacaagcgtgagccactgtgcccagcccacatatttattgatactagcatgaactcgacttcttaatttattcaatgagttacattcaattatcaagtattttgatgttctaattgtcctacatgtgaccagtgagacatctctctcaagctggcttctctgtccttttgacatgtcccggtcaagatgtgagtgctacatgtgctcgttgctactgagatgtcattgcttctaggccctgttatgaagagagctataaaatatataatttttcccccagccaacacgcatccatataacccagatatgtaaccctgttgccaatgtaaatgtatggtggccctcagatgtcttgaagcagacaaaagtttgagaaccactaacctgctaaataagctgtttgcttaatgttggtgaacattctaaaatttgatctgctattttctattacttctgctgttctcttcatagattgaaataagaaccaattttatatggaggtgtttttgtttttgtttttgttttttcgagaccgagtttcggtattgttaccaggctggagtgcagtggcacgatcttggctcactgcaacctccacctcccgagttcaagcgattctcctgcctcagccttcctgagtagctgggattacaggcatgcaccaccacgcccggctaattttgtatttttagtaaaggtggggtttcaccatgttggttaggctggtcacaaactcccgacctcggatgatccacccacctcggcttcccaaagtgctgggattacaggcgtgagccaccgcacccggccttatagaggttttaatacagcttaagttgtgatggaatttgaagaccacagaatcatgaggtgatgtgtttcagtgtttttacatgtctaatgtatttctggcctagatctgtgcaagtaacagactcatttctactctggagaatctctatgagaggaagctcttggcacgttttgttattgatgaagcacattgtgtcagtcaggtaaatactgttttttatatccggaaataccgataaatacatactaccaacaatatatgtatttactgaataaaaacccacactgagtgaacgagtctcctattttactgaagaataaggtagttcttaatacattgagcagtgttggctttttatagaaggaagctccaagtagtctgaaaagcagtatttttttttccaactagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtaagttgttgcacgtcacgtatttgagaaccctggggcagtgactgccagagctgctacatgttagaatcacctgtggcgctttaacgccaccaccccacccccaccccacccccatgcccaagttgtaacccgatggcagctaaatcagaacgtttggggctgagagccagtatttttttaaaaatccccaagtgattacaatgtgcagcagagtttgggaaccagagtcctagggcttttcttcacttactgaaattaaaactccttttcagtacctactttagaagtagggataaattgcatgccatatctatcatccctggtatagtcccagtaataaattaatttttacttatctaattttggcttccatatatcctagagtatacttcttgaaatgaaagatgaccctgctttgtcatttccccctaaggtcccagttgaatccaggatgttgaaaatagtccagatactatgtcgaatagcttttttactttgttttcttctcaacaacaaaatgcttcttgttgccaccaaatccataattcttcagtaacaaaatctactataaaagaaatccccccccccttttttttttttttgagatggagtctcgctctgtcgcccaggctggagtgcagtggcctgatctcggctcactccgagttctgcctcccggggttcacgccattctcccaccttagcctcccgagtagctgggactgtaggcgcccgccaccacgccaggctaattttttttgtatttttagtagagacggggtgtcactgtcttagccaggagggtctcgatctcctgacctcgtgatccgcccgccttggcctcccaaagtgctgggattacaggcgtgagccaccgtgcccggccaatccccacatatttatctaggctgtactggattattttatacttctacctgagtttgtagagatatggattctttggtaggtttattcactcagcaaatatttatttaacaactgttgtgtgccgagtttaaagtatttttttcttctgatttattagtgtgcactttagtttcagatgtaaacattaacatggtatgcctgaaggagtaatgactgaattggatattgaggtgaatttttaaagcacggcttttgttcatttgaaaataaagacaagctggtgctataaatattataagcagtaagaatagcaacagtatctcttagagggttatgagaagaactgaaggttccttatgaaggatatgaatgggtcatgtgattaagatagctacaaaagcttttgcaggttaaactggcagcttctaaattatctgatctaaatcaaggaattcaagcattttgggtttcttccagcctttaagttgtttggttccagcctagaattattttattgctagtagcactgttatatagcacaaatgaccatactcaagtgcaaggattttagagtcctcagaattttgtgtgtgtgatcacaaagtttggaatggaatattgtaatttaatctcacttgcagaggagtatttgtattaaatttggggaaaaatattttgcgtctataattgatatgcattataatgctatatttaagatgtcgtattaggctgggtgcagtggctcatgcctgtaatcccagcactttgggaggccgaggcaggtggatcgcctaaggtcaggagttcgagaccagcctggccaacgtggcgataccccatctctactaaaaatacaaaaattagccaggcctactggcgtgcgcctgtaatcgctgctactcaggaggctgaggcaggagaattgcttgaacccaggaggcggaggttgcagtgagccaagatcacgccactgtactccagcctgggcaacagagtaaggccctgtctcaaaaacaaaaaacaaaaaacaaaaaaaaagatgtcatattatactttagattctaataaataacctatttgcaagtaagtacttctgtaagtactacattgatctataatttttttttttttttttttttggagacaggtcttaccatgttgccatgttacccaagctggtctcgaactcctgggcttaaacagtcctcccatctcagccttcctaagtgctgagattcttctgtcctcttacgccggatgcaatctactgttcttttagatcagttacatcaatggcaaatgcctatagttaaatgataaaaaaaatttcttttccttttgaatgactttttgtaagtataggatttgtgatttatgtttgagtaaacagtgtacatatttatttatttatttagaggcaggcaccttgaatctgttttcttagtactgtggggaagagatctgcctgggaaagcaaggttgtggatttccagtctccagcacttggtacataattggcactcagtaataatcaataaatgaaaaatgtgaaggaatttgggtaaatgtaaaaatgtaggcatgtctgttgactccttaatgtgtttggcacttctctgcatttggaagtaggaaattttaaggaatactttctgggactctgtttcctgatcttttctgccagtaggccctggtttggattaaatttgctcaactgctgctatgtcgtggccctggcgaagtcaggtattcctaaggttgaagccacagcccctgtgctgctctcctcccgccagtctgtaataatattcttcctctttgggaaatataaggcacacaaaaaaggctttattccatttccttagggccttaaaatatgaactggaagagagcaaagagacaggcacatagagttaactataatagaacaataataatagctaacacttacatatccagcctactcagtgtgccaggcactgttgtcattttaagtgtatttacctccttgtccacacaaaagcaaggtaggtactcctattttcctcattctacaggtgaggaaattgagacacaaagagattatataacttcatatgcctagcaagggttggagtgagaacttaaaacaccagatagctggtttcagaatcctttaaatactaggtcaaattgcagaaagaagaaagcagtgatttgagatgtaaattacagctgcaggaactgaagaagacaagataagctagaacccccagtaacagctgttacaaggaggggtcagatcaagttttgtaaaggcactgggcattgtaggaggagtagtttatttaaaagcataggttgggcatggtgactcacgcctgtaatcccagcactttgggaggccaaggtgggcggatcacctgaggtcacgagttcaagaccagactgaccaacaaggagaaaccccgtctctactaaaaatacaaaactagccgggcctggtggtgcatacctgtaatcccagctactggggaagctgaggcaggagaatcacttgaacccgggaggcggaggttgcagggagccgagattgcaccactgcaccccagcctgggcaacaagagcgagactgtctcaaaaaaaaaaaaaaaaaaaaaaaagataaaagcgtagacagcagccgagcgcagtggctcacagctgtaatcccagcactttgggaggccaagggagacggatcacctgaggtcaggagttgaagaccagcctggccaacatgttgaaaccccatctctactaaaaatataaaaattaaccaggtgtggtggtgggcgcctgtaataccagctacttgaaaggctgagacaggaaaattggttgtacctgggaggcggaggttgcagtgatccaagatcatacgactgcactccagcctgggtgatagagcgagactccatctgaaaaacaaacaaacaaaaaaaggcttaaacagctgtattgaaataaaatttacataccataaaattcacctaaagttgacacttcaatggccttttttttttttttttttttttttagtttataaggttgtgcagccatcaccattatctaattttagaacatttttgtctctgttgaaagggagagtatacccattagcagtcaattcctactttctcactttccccattcttaggcaacccctcatctactttctgtctctgtaggtttgcgcctattctggacatttcatataaatggaatcacataacatgtggccttttgtgactgacttctttcactgagcatgtttttaaggttcctccatgttgtagcctgttttcagtatttcattcctttctattttcagataatattccattttatggatcctactttctgttttatttgcccattcatcatttgatggatgttcaagctgtttcagtgttttggtttttttgaataatgctgctgtgaacatttgtgtagaagttgttctgtggtcatcagttttatttctcttgggttgctgggtctgtggtaactgtatgattaaccttttcaattcaaggactactaaactagttttcaaagtgcctccgtcttttttttttttttttttttttttttgaggcggagtctcactctgtcacccaggctggagtgcagtggtgcaatctcggctcactacaacctccacctcctgggttcaagcgattctcctgcctcagcctcccaagtagctgggactatttttgtatttttgtatttttctaattttgtatttttagtagagatggggtttcaccatgttggccaggctgttctcaaactcctgacctcaggtgatccacccatctcgacctcccaaagtgctgggcttataggtgtgagccactgcacccgaccgcctccatcattttatattaccttcagcagtgtgtgggggttgcagtttttccacatgcttatcaacacttgttactgtctttttttattacagctatatgaagtggtaggtgaacggcattttagcaggcaaagagtgaaaattcagggctgaagtttctgttataaaagtacaggtcaggccaggctcggtggctcatgcctgtaatcccagcactttgggtggccgaggcgggtggatcacctgaggtcaggagttggagaccagcctggccaacatggtgaaaccccatctctactaaaaatacaaaaattagccgggcgtggtggcatgcacctatagtcgcagctactcgggaggctgagacaggagaattgcttgaaaccagaaagtggaggttgcagtgagccgagatcatgccactacactccagccaaaaaaaaaaaaaaaaagtacaggtcaggcccaaggaatggtgaataatccattggataagtggagaaacatagagaagggatgaccctgacaaggtggcttgacgccagatcatggaggatcttgcatataacgatggtaaaatgtttggactttattcttttggcactttaacctgggaagtggcttgatctgaactgtgtggatgaatgataaccctggcaagagaatagaggagaggatgagtgagagaacagaaagttagaggtagagcagcccttcaggaacttattgcctattgcagtcattgaggagagatgatgctggtggaaacagcagaagtggaaggaagaaacagagtcaagagagagggcaggaatggtaactaaatggaatgagaagagtggatacggttgaagtttatactagttcctggggcaggtgcctagaaccattgaccataaatggaatggaggaaggaagatgagtaataaatttgattttagatgcatgatgcctgggatgtttaagggatgagtggatgaccacgatagccatcttcataccttctttggtcacatgtacctcctgaaaaaatcctggaaaactatgtacctcctgcatatatacatatatgttttaaatatatatataatatatatgtattttatatatatgtgtgtttttattttttatatatatatgtgtgtgtgtgtgtgtgtgtattttagaccaagtttcactcttgtcgcccaggctggagtgcaatgacacgatctctgcaatctccacctcccgagttcaagtgattctcccgcctcagcctcctgagtagctgggactacaggcacttgccgccatgcccggctaatttttctatttttagtagagacggggtttcaccatgttggccaggctggtctcaaactcctaacctcaggtgatccacccgccccagcctcccaaagttctgggattacttgagccaccacgcccggccataagcatacattttgattgagaatgtatctcttaatgagataggccttttgtttgtttgtttgtttaagagatgaggtctcgttatattgttcgggttagtctggaattcctggcctcaagtgatcctcccaccttaatcttctaaatagtgtggactacaggtccacacccagctaggacttttgttgttcacttagttgacatatctggatgaattgggtccatttatatttcttatttttatggatgtaagcactaagaaatattgctcacataaacatgtagatgggaatggaaggcattttttgtagctgtaacaattatttgaattccttctgatgtatatgccaagattacgtaatgatcagtcatcaaaaattatttttaattatctgtcaattgacaactcaattaggtctttcaaatttgtggtaagcaaagaattggaaactctctgggaaaataagcaagatcaatcgttattcactttactttttctaggaaaaataccctaaaaaaaagctttaccaatacttacctaatgactattaagtagtcttattattctttcaacaagaatcttgttccctgtatccaatatgtatggaagagttggggaaatcaaaatactgttagtttcagtatacctttccaatatgatatttttgacaaaatacttttattgtgtgatacgcttttctaataacttttttgttgttgttttttgagacagagtcccaatctttcacccaggatggaataagtacagtggtgcgatctcggctcactgcaacctctgcctcccaggctcaatttatcctcctgcctcaacccgccaagtagccaggactacaggcgtgcaccaccatgcctggctaatttttatgttttttgtttgtgttgtttttttcgtagagacggagtttcaccatgttgcccagactggtctcgaactcctgagctcaaaggatctgcctgccccggcctcccaaagtgctgggattacaggcgtgagccaccattcccaaccatattgtgtgacatacttttaaatagagttttgtcaaaactgtggctatagattagctctttccaaaaatgggaaatgaccaccatataacctaattggtaaagccagtctttattgctaaattagacttcttttctttgtgggttttgttttgttttgttttgtttttgtttttgttttggagatggggtcttactctcactatgttgcccaggctggtcttgaactcctgggcttaagtgatgttcctgccctagcctcctgagtagctgggactacaggcacatactaccatgcctggctggcttcattttccttttcttttttgaggggggtggggggaatggagtttcactcttgttgcccaggctggagtacagtagctcaccgcaacctccacctccgggattcaagtgattctcctgcctcagcctcccaagtagctgggattacaggcgcccgccaccatgcccagctaattttttgtatttctggtagagacagggtttcaccatattgcgcaggctggtcttaaactcctgacctcaggtgatctgcccgcctcggcctctgaaagtgctgggattagaggcgtgagccactgcacctggcctcatttttcaattcacataaactatttagtacacatcccatgacaactattgtcaattccaaaagcaacaagctgagctctaattgactttgtttcctcacacaacactttgaaaagacatgagtttgacaccccaaacaggataatatttaccattttaatggtaatatccagcagaaccttagacaagaaacagtagaatctaacttttaagaaaactttattaaaatgtaattcacacactataaaattcatccatttaaagggtacaatttagtgggttgctttttttctgtattttcacagaattgtacaaccatccccaatatctaagtttacagcatttttatcaccccagcgagaaacctggtacccattagcagctgctccgcatcttctccctcttgtttgtgcccggcttctttcactgagcgtagttttcaagggtcatccatgttgtagcattggtcagtaagtacttcattcatttttatagctgaataatattgcagtgtatcagtattttgcattttatttatccatttatcaattgatgggaactgtctgtaactaggtatttggtaattccaaacatcttattttccaacaggcagagtaagatttgttacatgtaataaactccaagggtctattaactttttcattataacaaattgtgtaaatattgctttcagttagttacccacagtccttttgcagtagagatagttgtcttggttttaattggattcatgatctacaactttatgttctaatctcatgtcatttttattatttttagtaaaagtaatttgtttgactaaattaactggtaaacagttctgagctttttcaattgtgtctacaaattttaagaaattcagattatgtgccagatgtttttagtaacagctttgttgcggtataatccacataccatacaattcccatatttaaaaagtacaattcaaagtttttagtatattcagaattgtacaaccattgccagagttttagaacatttcatcaccctccaaaaacacccatgcccattgcagttcaatctccttttcccctcacatccccatcctgccagccctaggcaaccactaatctgctttctatgtatagatttgcctactctgggtatctcgtgtaaatagaatcatccaatatgtgatcttttttgtgactgtctacttagcataatgttttcacggtttattggtgaataatattccattgtagacgtctacgacattttattcatcagttgatattgggttgtttccatttttattttttactattatgaataatgctggtataatcatacatgtataaatttttgtgtggacatatgttttcatttctcttaggtatatgcccaggagtgaaattattgggtcatatagaaactctatgtttaaccctttcttttttttttttttgagacggagtctcactctgtagcccaggctggagtgcagtggtgcgatcttggctcactgcaacctccacctcccaggttcaagtgattcttctgcctcagcttcctgagtagctgagactacaggtgtgcgccaccacgcccagctaattttcgtatttttagtagagatgggggtttccccatattggccaggctggtcttgaactcctgacctcatgatccgcccaactcagcctcccaaagtgctggaattacaggcatgagccaccgtgcccagcctatgtttaacgttttaaagaactgtcgcactgttttccaaagtggctgtgccattttacattttcactagcgatgtatgagggttctaattttttcatatcctcaccaacacttgtttttgtctctctttttgacccaaagatttttttaaattaataaaacacttttctgaaaataaatatatttttttaatgtgggaaaaagcaataaggccattgttatgcccagtcaccatagcattcctatcggtggagagactcatgcaccgtttccaacttaagcccaaatcaactcaaatgcattttaagattttcttcatcatttgtattcctagacaattctttaatctactaccttttttgccacaatctgctacacattctgccttttcaagcactaaaaggactctaggagttttttgcaaagaaatgctgtcataagagtggtggtatcaaagtattgtttaacggtagtctcaaagactttcagggtaatgcattctgtgattatagagatgaaagaaacaacatcataaagtgaaggtcatcttcattcccaccaccttattctcagtatatctgaaatcagaacatcctaataaggaccaaaatactttgttcctagttattcttcacccttaacagaaataagtaaaacaccgaaagatatgaggccctcctaccaaggatttctagtgctttaattaaagaaaatttcacctacactcatactatttttcagtttgctttgtttggtgtcctggaggtttttacatcctggaacagtgcacagtggtaaaattcagaatggatgaaaagtaggattggtttgtttgttttcaggaagtgaggcaatcgtaaaagggaaaaatgggaaaggcgaaacaagcaggatgtctttttttttttttttttctttttagacagagtctcactcttcgcccaggctggagtgcagtggtgtgatgtcggctcactgcaacctccgcctctcaggttcaagcgattctcctgcctcagcctcctgagtagctggaattacaggcacgtgccaccatgcctggctagtttttgtatttttagtagagacagggtttcaccatgttggttaggctggtttcaaactccagatctcatgatctgcccgccttggcctcccaaagtgctgggattacaggcgtgagccaccgcgcccgtccaggatgtcttttttctaattagagacgagggtctcactttgttgcccaactggtcttgaattcctgggctcaagtgatcctcctgccttggccttccaaaatgttgagattattgatgtgagccaccacccctggccagaatttcttgtctgtgggagcattctcagatcagtcttatgaaaaaggacagccagcccttcctatctgcagtttctgcatctgcagattcacccaactgtatatcaaaaacatttgaaagaaaaatagtttctgaaagtttcaaaaagcaagatttgaatttgctgagcaccaagcgctatgctgtgtccacatgaatgaagtgatgtgtaggcatactctgctgtatcctcccgccaggacagaagaaaaatgtcacatagttactgacagtacagtgtagcaactatttacatggcatttatttaatacattgtattgagtattataagtaatctagagatggtttaaagtgtgcaggaggatgtgcataggttatatacatatactacaccattttatatcagggacttgagcatccttggatttaggtatccgaggaggccctagaaccaatcccccatgggaaaccaagggatgtgaaaattgagggtctgaatttgtttaagattcacagaacagactgaaaagacaagagaggagataatggagagaacaagctcactgaggaagtgggcgggaggaaatggggcaagaatagtagaccagaggaagaggaggagcacatctgtctcagagtcagccacattttatttggggccaagaacaaaaataaagtgactgtaatcagtagggctttaactccttctgctgtcctgcagttagctttttatgtatcctggggtgtccaatcttttggcttccctgggccatactagaagaagaacgattgtcttggaccacacataaaatacactaactggccgggtatggtggctcacacctgtaatcccagcactttgagaggccaaggtgggcagatcacctgaggtcaggagtttgagaccagcctggccaacatggtgaaaccccatctctactaaaaataacaaaaatgagctgggtgtggtggcgggcacctgtaattccagctattcaggaggctgaggcaggagaattgcttgaacccaggaggtagaggttgcagtgagccaagatcgcacccttgcactccagcctgggtgacaagcgcgagactccctctcaaaaaaataataatacactaacagtaacaatagctgatgagctttataaaagaatcataaaaaatctcactgttttaagagagcttatgaatttgtgttggaccacattcaaaaccatcctgggctgcatgtggcccgtgggctgcgggttggatgagcttgagtacctggtcaaaatttgggaacattgatggcctaaaaatacgtatatttcctgtgtgatttccttaatattttaaataatgttctaaccatctctgcttttagtcagcctcatcttggagtcaagagactgggctcctgacttactttgtctttctatatgttttctcttccacaatcctaattttttgtcatctagtcccataaacattccctctttatcaccattcttttctttaacccttagccttacttccatttcagtgttctattgtgtaagctgctagcgacaatattcaacttaagactacttggtaggctgggcccggtggctcatgcctgtaatcccagcactttgggaggccaaggcaagtggattgcttgaggtcaggagttcgagaccagcctggccaacatggtgaaactctgtctctactaaaaatacaaaaattagctgggcgcgatggtgggcatccataatcccagctacttgggaggctgaggcaggagaatggcttgaacccagcaggcagaggttgtagtgagccaagattgtgccactgcactccagcctgggcgacagagtgagactctgtctcaaaaaaaaacaaaacaaaacaaaacaaaaactacttgatattagcttgggctgctatgacagaatactgtagactgggtggcttaaacaacagaaatttatttctcttggttctgaaagccaggaagtccaagatcaagatgctggcagatcccaagtcagatgaagtccctcttcctggtttgcaagtggtagtattctctttgcatactgacatatgcgggtggggagagccagcaaggtctctacttatttttgagcacttatctcattcataactccacccctcatgacctaattatctcccggaggctccaactcctaataccatcacactgggggttaggattttaggggggacacatgtagtctataacaatacctaaagtcatattttctcataataactaaattttatgtttgggacttttttaggtttagcatgagctttaacagacataatctgaaatactatgtattaccgaaaaagcctaaaaaggtggcatttgattgcctagaatggatcagaaagcaccacccatgtgagtacagccatgtgattagctgtctagaagtaacaaatgtctttttagtaccacaataagatatataaaattgcatattaaacattcctttttgcattatgacagcactaacttgctctttatagagcagactattgcaactctctcaattctggaaattataaaatctcatttggtttaataacaataaattctaacaaaaatatattaaatactccctcctacacacgtatattataacttttggtttcaatgtctttcctcaggcttctatcagtgtttgaattatacagctttttgttttagtgccttgtcccaagcctgtctgcctttgcattatgttaactaaaatgagattctgaaattcatagtagttttccatgtaaccccctttccacttttccatggagaatatttttggtatttctattttattttttagaaattagtatacatatttgtgtggacaaatcagtcagtagagatctaccaagaaaaagtcagtgatttccccgctcagactcacctcccccaggcagctaatgtcaatagcttcatgtgtatatctagacctttggctcagtcacagagagatgacttttcctttaatatcttttaatttccatttctaaaaataacacacataataataaatataatatatgctcattaaagaaaatttatatggccaggcactgtggttcacgcctgtaatctcagcattttgggaggccgaggtgggtgaatcacttgaggtcaggatttcaagaccagcctggccaaaacggtgaaaccccatctctacaaaaattatccagacgtggtggcacgcacctgtaattccagctattctggaggctgaggcagaagaactgcttgaacccgggaggcagaggttgcagtgagttgagatcgtgccactgcactccggcctgggcgacagagcaagactgtctcaaaaaacaaaaaagaaaatttagaaagcaacaaaaagaagaaacaaaagacaaacatcactcaatgagcaaaatcactgttatgttattattaatttctagtatttttctatgcatttttttctactagcatactatatacgtttctaccgttaatctactttatatatcatgagcattttcccatgtcttttaaaaacttagaaaacacttttgatagttatagtatattttatttcacagttccctgtatttgtttccctaatgttgctcagtaaaatctttgtaatttttaaagtttgaagtaaaacttttgtttatgtccttgtatcactttatttcctaatttcccagaaagaaactgagtcaaaggtatttctaagactcttgatacatactgccatatgcttttgacaaagtttgtgcaagaatggcttttcttttttttttttttttttttttttgaggctgagtctcactctatctccaggcaggagtgcggtggtgcgatctcggctcactgcaacctctacctcctgggttaaagtgattctcctgcctcagcctcctgactagctgggattacaggtgcccaccaccacacctggctgattttttttgtatttttagtgaagatagcttttcaccatgatgtccaggctggtctcgaactcccgacctcaaatgatctgccctccttggcctcccaaagtgctgggattacaggcatgagccaccgcgcccggccaaggatggcttttttatacccacatgtatctagtgtgaagtagagcccagagttcatccaggtccacctcacgagtcattagcagcgacaggattaaaagccacatctcatttccagcacacatgaattccttgcttgaattattcacgtgtgtggtcttccagcagtataagaacactacgggagatctatttatggttcatatatttctgaaaatgtagtgtaaattgtgtttttgtttatgttaaaaattcttgtttctcagtactcttggtttcttggcagatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggtaacatttttaaagataaacaaataatagaaataatcttttatagcatataaccaaacatgcacatgtagaatgcaaactgtttttaccttgaaggtagtaaacatcaaaataagactgaaatttaaaaaacagattttctttgagacttctaaagttgctttttctttcataaaaaaaatctgcttgagatataattcacatatcataaaatttatcctttcaaagcaaacaagttagtactttttagtttatttgcaaagttgtacaataatcatctctatctaattccagaatttttgatcaccataaaaagaaacctcatacccagtcacttcccccaccccctaatgcctggaaaccacaaatctactaactactgctaacctgtttctagagtttattactctgtacattgcatgtaaatagaatcatacagtatgtggtctttgtgacttttcttttttttttttttttccggagacagagtctcactctgtcgcccagactacagtgcagtagagagatcttcgcttactgcaacctccgcctcccaggttcaagtgattctcctgcctcagcctcctgagtagatgggattacagatgtgcgccaccatggccagctgatttttgtatttaatatttttagtggagactcaaactggtctcgaactcctggcctcaagtgatccacctgcctcagcctcccaaagtgctgggattataggcatgagccacctcgcctggcctgtttgcttttatttagcataattttttcaagatttatccatattttaggatatatgagtacttcatacctttttatggtcagataatattctgttatatggatataacacagtttgtttatctactcatcagctggttagacatttggcttgtttcgtttctttctttttttttttttttttttttttgagacagggtcttactctttcattcaggctagagtgcaatggcatgatctctgctcactgcagaccgtacctcaaacaatcctcccacttcccaagtagctaggacgacaggcgcaccactatgcctggctaatttttttattttttgtatagacgaggtctccctgtgttgcccagcctggtcttgaactcctgggctcaagtgataatcctgcctcaacctaccaaattcctgcgattataggtgtgagccaccatccccgatgtgtttctacttcttggctactatgaataatggctttgtgagcattcacgtacaagtttttccacggacatatgttttcagttctcttgggtagacacctgggagtggacttgctgggtcaaatggcaactctttgtttaacttttagaggaactgtgaaactgcttttcaaagtggctctgcagttctgcattctcaccagcaatgtatgaggtgccagtgtctccacgtcttcaccaatattttttattgtccagcttttttaatgtattcatccttgtgtgtgggaaatggtatctctttgtgggtttttttttatttacatggaagaccacacacgtgaataattcaagcaaggaattcacgtcacccaggctggagtgcagtggcgcaatcttggctcactggaacttccgcctcctggttcaagcaattctcctgcctcagcctcccaagtagccgggactataggcacatgccaccacacccagcttatttttgtatttttagtagagacagggtttcaccatattggccaggctggtcgtgaactcctgacctcatgatccgcccacctcagccccccaaagtgctgggatgacaggtgtgagccaccacgcctggccctctttgtggttttgatttgcatttccctagtaactaacaatattgggcatctgtttccgagatgagaaatttgccgtcacccaggtgggtggggaggaaagctgaaaatactttaggcatctcttttttttttttttttttttttttttttttgagacgggagtctcactctgtcgcccaggctggagtgcagtggcgcgatctcagctcactgcaagctccgcctctcgggttcacgccattctcctgcctcagcctcccgagtagctgggactataggcacccgccaccacgcccggctaatttttttttgtatgtttagtagagacgagggtttcaccacgttagccaggagggtctcgatctcctgacctcgtgatccgcccgcctcggcctcccaaaatgctgggattacaggcgtgagccaccgcacccagcctactttaggcatctcttattgtggtaaatgccagccttggatagatccctctaaatgaaaggatgaatttcagcaaaacaactaataattacttggagccaatgaaaagtttcagctcaggaaaaagtatttactttgaagattcagaggaaaaatatctctcaaaattgttttctctgggaaaacagaaaattttagaggatatcagtttagtatcccgagaaagatataagaagacttaatatacgtgaactagtaacaacttccataagatcacagggtgagatgaagggagaaataaaaatccagtttatggccaggtgcagtggctcacccctgtaatcccaccactttgagaggccgatgtggacggatcacctgagatcaaggagtttgagaccagcctggccaatatggtgaaaccctgtctctactaaaaatacaaaaattagccggacgtggtgatgggcatctgtagtcccagctactcaggaggctgaggcaggggaatcacttgaacctgggagccgaaggttgcagtgagccgagatcgtgccactgtactccagcctgggaaacagaacaagactctatgtcaaaaaaaaaaaaagaaagaaaaattcagcttatccaagtaagaaaaacaaaactaagagcagaattatatattaagacacaaatggaatgactcagtctcagtggagacaatagaatcagtgatgtagtgagtagcttgagaatgcaagggaaaaaagagattaaaatggggtggggtggaaattatctttgttgacaaaaggaggtaaggattcagcctaagaatagtaagtgtacccaagcaagaaagcaggataattgaaacagataagtgtgttataaataaatacataacaaatatataacaaaaataatagaagactgtcttcagaattggaagaaggaagactgggactgaagaatttcgtacccagctcactgtcatttatgttgaaaccaacaaaaggtcattttcagatatgcaaaaagtttagaaatacatcactcatttgtcttcactgaaatactgattttagtcttcccaaattagtttatatatttaacccaaatgccagtgttttgtttttttttttttttttttttttggttttttgttcttttccctttgataaactttttctaaagtttgcctggaagaatattcaagtgaaaataactaagagagtttggcaaaaaacctaataatacaggaacactagtttgcagtacattataggcagatcagtggaacaggaaaacatgtaaaaacaatacatgataaggaaaaagtttgcatgaaagggccaggcatggtggttcacacctgtaatcccagcactttgggaggccaaggtgggaagatcacttgagcctaggagttcaagaccagcccaggcaacatggcgaaaccccatctctacaaaaaatacaaaaattagcctggcatgctggtgcacacctgtagtcccagcttctcgggagtctgaggcaggagaatagcttgaaccctggaggtggaggttgcagtgagccaaaatcacgccactgcattccagcctgggcaacagaccgagactgtctcaaaaaaaaaaaaaaatgatttttttcaagtgctttaaatggttatgtatagtataaataatctacaatggagatatatatatatatatatataactttgataaaaaatatggttaaacaataggggtttataaaaacctaattatttctgctctcagactaattaatccttacagtcagcatgtaatattagcctacaccagctcgacagacttgatctcgttagattcatgagatagaataaaacttggccattattcttcacaaagaatgattgtggcttgaagttttaaaagcgcagaaataaagaaggaaatcacaattaaacaaagccacttttcccaatttcaagaaataagagctttcagaaagagttggcagccttgcatcctcatctggaggctgcaggcggtgcctcacagccctgtgcccgccctgatactgggagatgcacctggacttcatggaaccctgtgggtcatgcttccggacctgtcggctgacacatcttgctgtgcagcttctccacctgctctccatcactagaagctacaatagtctttctgtttccaaggagatttgcctttgatcagagtgccataaatgtagatggatgactaaccgagagcgcaggccactcaccgccattcctggtgttgataaatgtacccctttactgtccacatactccagagcttgcagttccttccgctggtactcacagttactgaaatcatgtcattagtctcagtctgcctgccagatatttcagatgcctttgaaatactgttcttgcagtagcaattcatttttttaagtgctaaaaaaaaacttgcagttttatttgtgaagtgtaattttgcctggagatataacattttggtctgggttaaatagctcctaaattctcaactgaaatggatatccttgaaaactgatttatcaagctcctgagagtgaactatcaccttgcttccactaagtaatttgtaaggtctaagatccgcagtccctggtgttttttttttttttttttttttttttttttttttttggtataagtagctctcagacttttacccacatgagtttccattaaaattgtacaagctttgactttaaatcagctgatgaatagaaggagttgatgtgtgatcagctggtgctattgggaaaactgatgataagcagtggagcaggtaagaacgtattgttcctgaaccattggaggaactagcagcagtgacctctgaggagccctgggaacaccctggagctcctgagcaacacgttgcttgtgatcactgacctggatatcatgactgtgtgagcaacaccccccacacctcagtagcaaaaacagagaacagtggcagcacatcgtgggctgactgcagttgattctggctctcttacatgagaatgccaagtcatacaagaaagtgcctgccatgctgagcttctctttaccttcttgggttttaatggcattgcaagttatcagtataaaaactcatattagttatactaaatagttggaccaagttaagatattaggttgttatgtagtgtgcattttaaagtaaaacaaatgatagagcttttagaagcatctattatgaaaatgttccttcaagtctgtgccttatgaatctaataagcttttgcttttatatcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgagtaagctgggctccattgtagagacattctgtcatcttcagcctcatgatagtagtctactcctgctattgtggtacttctggtccagttttccttaaataatcgtagaaaaatagaggagtttatacagattggcaattttattttagttcatttttattataaaagtggtaagtgcttattttgtaaaactcaaatgatacagatgtgtacaaggcagaaaatttacaaaccatgccttgtagttttgcccccaaaataactctagttattggtttcctttgtatcctttcagaccctatttctgcatgcattcttgcatgtaacacatatttcaaacatgcaggaagataaaaaggagaaaataatgagctgtcatatactaccatctggattaagaaataaaacacaatcaatcgagctgaacccctccccaccaccccatagcctctcttgtctcatccgtcctctcccattagaggcaggcaaatatcttgtatttggtatgtaccttttccaaatgcacatattttaaaatgtaaatgggattatattatacatactttatatatataatgacccgatttttttcagtcaacagtaggatgtaattatcattccaatgaatacatacagcctgactacctagaattccgtagtatggttattccatggttattaaactaatcccctcttactagatcttgtttattgtttttcactgttatcaacaatgcagtattgaacatccctccctatacaaatatctttgggcatttttgcagttacttatataagattttttttttttcaagaccgagtctcactctgtcacccaggctgcagtgcagtggcagaatcttggctcactgcaacctccgcctcccgggttcaagcgattttctcacttcagcttccagagtagctgggactacaggcatgtgctaccatgcccaactaatttttgtatttttagtagagacagggatttcaccatggtgtccaggctggtctcaaactcctgacctcaggtgatccgcccacctcagcctcccaaagtgttgggattacaggtgtgagccaccacgcccggccttataggataaatttctagagttaaacttgctgggtgaaagtgaatacatattttagaattttattacattctttgctcatttttctcctgggttgtgagagttaaatatatttcctaaatatatgtatttcttctgagaccacttttttttttcttttttttttttttgagacggagtctcgctcttgttgcctaggctgaagtgcaaaggctggaatgcaatggcacgatctcggcccactgcaacctctgcctcccagatgcaagcagttctcctgcctcagcctcctgagtagctgggattacaggctcccaccaccacacccagctaatttttgtatttttagtagagacagggtttcaccatgttggccaggctggtcttgaactcctgacctccagtgatctgtccgcctcagcctcccaaagttctgggattacaggcgtgagccactatgcccagccgagaccacttttaaattaactctggcagaagtacagtgcataggaaatggcacttaccaagcactgtgcccaacactgcatatatcacctcattaccttatttgttcaaaacaactaacttgtgatgtagaggtactcccataaaaagtgagcttcggaaaggttttgtaacttttccccaggatcactgatatggcaggagcaataagagtcgttgtagtagtagtataacaatggtaattattatagataagtgtttatttagcccttcctatgtgccattctaaatgccttacatgtatcatcaactaatttcatcttcacaataaccctcagagataaaacctttgctttcctcattttacagaggaggaaaatgaaatgcagaactagtaaatggtagagccctgacagaacccaagttcgtctgattccaaagtccatgttccttgcactataccaaagtgattctcagtgaagaaaattaaatatttacacttggtttgcccatttgtgttttttttaaaatctatattaaagctaggcccaaacatggccaggcatggtggctcacacctgtaatcccagcactttgggaggccgaggccaaaaaaaaaaaaaatttaggcccaaacaatttaatagatatttaagtcctgatagcagcaactatttgggggaaaaatactcataaactggaagaaaaaaataatattttttaaaaattattttcttttttttttttttgagacggagttgcgcttttgtcacccaggctggagtgtgatggcacgatctcagctcactacaacctccacctcctgggttcaagcgattctcagcctcagcctcccgactagcagggattacaggctcgcaccaccacacccagctaatttttgtattcttagcagagacagggttttgccatgttggccaggctggtctcaagctcccgacctcaggtgatccgcccaccttggcctcccaaagtgctaggattacaggcgtgagccaccgtacctggtgttaaaattcttaagtaacaacagttgcttactgatggaaagtatgccactgctgttctcacacattggaatcaaatccgacactgccaccctcatttcctgtttcacattgattttcttgagatacttctttttatcatagcaactgcgaaaaacccagctttgcaaagatgagatattgctaataggaatgtagcacaatctaatgttaataccattaactacctcaagctaataatttgggtgatgttcaacagatgttaggcattgctgtgtttcccttcatgtaaaatattctgtctctgtgagttcaccacagcacccccgggcttgttggcacacaattttggaaccactggtgtaactactttgacctcagatactcagagaagtgcatggccactgccgtaatctcaggctctgcttcctcaggatgttcagttcggtggatgctcgactgataaatacagcaaatataagtcaaaccatcatcattggggataatgaagatttgaaaaaaaaaaacctaacatttattcctatagtactaaaatcttgaggatgaacattaatactcagttaattataatatagaatgccatgttgacaatgctgttaacagtaattttcttatttaatatttaaagttatatgaatctattctaaatatttctatgatatgctctatttttcccctataagtatgtcttactatagtcttcatctcttttagtggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggtaaaaaaagaagttttaaaattctttataattaaattttttttctcttactttaaaaatgtagatacaaattagattgcaaaaggtggtctccgacagattaacaggggaaagacagcttccttccagtagtaatttggaatggaaacatttaaaaagtaatttcatgcggtatcttttctttataattagaaccctgttaaaaaatataatggacatcagcatatccagaatattgagtttatatatgtgcactgatgattacagaatattttagaaatattaatatgcaaacatccaaaaagatccaacatgggcaggtagaatattttaaatttaatatattaatgttattaatataatacattatattaaaaatttaattgattaaattaaatatattaaaattgacgtattaatatttaatattttaaatatttaattaatatactaaaaatctcattctcaaaagagtaataactagtgtaccgtatgtttgaattcaaatcaattacattactctttttttttaactataaagaataacagtaactgcttgtggataaattcactattatctgtcctaaaatacccttggaaggttgttaaattcagtcattaggtacttattttacctatcttggtaattctacattttaatgtctactgtaacctactgcttactgagcattttcacgtttggtgtattatttacctatctgggagtattagacttatatgtgcaagatgctggagagccacaagtgaccatggtatggaccaattcatagactggagtggagaccgacatacatgtgttcatagaagtttaacactctggcttggcgcagtggctcatgcctgtaatcccagcactttgggaggccgaggcaggaggatcacctgaggtcaagagttcaagaccagcttgaccaacatggtgaaaccttgtctctactaaaaaaatacaaaattggtcggctgtggtggcccatgcctgtaatcccagctacttgggaagctgaggcaggagaatcgcttgaacctggtaggtggaggctgcagtgagccaagatcatgccattgcactccagcctgggcaacaagagcgaaactccatcaaaaaaaaaaaagtttagtactctcagtaagtatagttaaaaaatacagagcacagggcagaacagagggtagtctctctcagtgtggaactggcaaattcatgccatctcctcccaccccaccccatcccttaaacattgctatcagttccctcattcaacagatatttgttgggctgtgtaacaggcactgttgtaggaatttgggatacatcactaaacaaaatgaaaatccctgcccttgtggagcttacactctagcagagggaggccagttacaaacaatatacacaataaatatacatgaaaggataagagctgtggtgaatggcacagcagagtaaaaagacaggaggaatgggtagagtgcaggatgcagtattagacggggtggtccttggaagtctaactgagaagatgggagctgaggaaaatcttgaagaagggagttagctggcagctccctggatgtgagctttcctgcaagaagctttggctagagcaaaggccctaaggtgggggtgtgcctggtgtgttcgagagatggcaagggagcccatgtggctgagcaggattaagagccagtgaggggaagaggtgatggagagccagagcagtcagttgagggctagagtcccagagtaactggaggcctgagtaactggaaggatggagttatccttggctaagatgcagaaggctggttggcagagaagatcaggagtttggtttgggttacctaaattgggaatctaatattgaattacatattaagattcaaaaattctgaaaacagactggtggcacatgggtgatatttaaagcatggccatcagctgacagtcgggataagagaagggacggaagagaaaggagaaagtatgaaatagttgtctaggacaggggtcagtaaacttgcttttaaagggccacagcataaatattgtacacttcgcagccatagtctctgtcacaacgactcacagctttgccattgtagtctaaatgcagacataaataataaatacaccaattttctagtcatcttccatggctgtgttccaataaaactttatgcacaaaaacaggcatccagctcctgggccatagtttgctgacttctgttgtgagagaatggaggaatgataggctagggaagtataaagataatgattgcctacagcattaacagtccattcgagctttgtggccacgtagtgacagtgaaaatgccaagttcagccacataggtacagggacctatggagatggagaattggatccattatgttttgccaggtaatatgttgaagtgatctaagggcaagagagctgagggtctatgagaggtagtgattataatgatcgactggaatttcagctgagttaggaggacatctgaggttgaggatcagcagatgggcattcccaggggattgttggagtcagaataccacatggtatgagttggaaagataggatgtggtggtctgagaatggaggagttgccattattagtaagcttaaggtaggaagtgtgagcggctgatgtatgtggaggacaggatcattggagcagaggagatcaagaaccaaaagaccaaagtaagaggatcagctctgtatacctaatcaccaagaattaaggtagatggccaggtgcagtggctcacacctgtaatcccagcactttgggaggctgaggccggcggatcacctgaggtcaggagttaaagactagcctggccaacgtggtgaaaccccatctctactaaaaatacagacaaattagtcgggcatggtggcaggtgcctgtaaccccagctactcaggaggctgaggcaggagaatcgcttgaacctgggaggtggaggttgcagggagccaagattgcgccatcgcactccagcctgggcgacgagcgaaactccatctcaaaaaaaaaaaaaaaaaaaaaaaaaaaaaaattaagataggaatggagtgacagggcactttttcttgatgactctagatagggcctcagaatcacttgcagttgttagtgtaagaccagaaacctgttcatctccaggttattggtgtgtgcaaatgacaaggattagaaggtagggagggctgcatacacagaagcaccaagcatgatgcagctttttacacctgtgagtggtcagtattgatggtagagagaactaggggagagaaaggcaaaaagtcatctagtaacggggactctaaaaagtgggcaaagtttggggatagctgaaggaaatgagaaaggaaactagcaggagatgatgaaaagagcgttgactatggcaccaaagaccccagaggggttagaatccgtggatttacgtggcaccccacaggttcccacccagtatgtaacagagcactattctaggaggcatggaggatttaaattgtgtgtttgtgtgtgtgtctgtgtgttatatatgtgtttctacccacagagtgctatcaggtagttgaaagacaagacgtatctctgtgaaacagtaacaacatcgagtggtagttgttctagaacttagataagaatgaacatttgaaatttccgtaggttttggtctcggtattggtctggaaatgggttatgatgaatctactatagttaatattaaaccctagtaatctaggcattgttaccttaattatagcagaaagtattctctttttattcataggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttgggtaagtcatctgttttgaatgtttgagttacttcaattgaaattgaacatctaaagaatttattacaagtacatagaaaaactttttgtctattttcttataaaacttgagtttctgaataaaacttttaagtaacaaaagaaagtcaattattatactgttttatataatgtatatgtcactaagttgagatggtttcacatacaaagaagaaaataataaagcttatgcgagttcatctgagtgggtggaatgtaactattaaaatgtcagtaaggaaataaaatgaggattagacccataacagcatagagaataggagagagactattatcagattagtgccttaaaaatctctcaggggctgagcacagtggctcacacctgtaatcccagcactttgggaggccgaggcgggcggatcacctgagatcaggagtttgagatcagcctggccaacatggtgaaaccctgtctctactaaaaatacaaaaaattagccaggcatggtggcatgcacctgtaatcccagctactcgggaggctgaggcaggagaatcgctagaacccgggaagtgaagactgcagtgagctgagatcgcaccattgcactccagcctgggcaacaagagtgaaactgtgtctcaaaaataataaataaacaaacacacacaaaaattagccaggtgtggtggtgggcacctgtaatcccagctactcgggaggctgaggcaggagaatcgcttgaacctgggaggtggaggttgcagtgagccgaggtcacgccactgcactccagcctggcaacagagtgagactccatctcaaaaaaagaaagaaatggacagtaaagaggaagaccaaataaatagaatatttgaccctgggtgatagaaataattgaaaatagtagtttgggagagaggggagagaagactccttagtatcgtcttaaagagtttttaaaataaatacttaaataataattgaataatggaaaagaaataaaaatgagaaagagctgtcaattttaaatgattgacaaagtaaatttagtggagaggttggaaaataaagtcaagaaaatttaggaactgatcaaaatgatatatggaaaatagagaaagcatagaaaggattaatcctcagtagatgtaaaatctgacaaaaattttggaaatagaaaataaagggaattatcaaaccaatgatctaggaaaacttcctagagtggaagagataaaagttttggattaaaatgctcactgaatgccaaataagatgcctgtaaaaaaaaaaaaaaaaaaaaaaaaattaagacatatggccacgagatttgagaatactaagagttaaagacatgtcaaagaggaaaaacttttcctcaaccctcttaggttcagtgatggggcctgcaaattaaaccaacaaaaaacagattagcaagggaaaagacagatttagtcatgtgtggataggagttcacagaaaaatgtggttcaaaggggcagttagaatgtggggcttatataccatcttaatagaggaaggggagaaggaggggggcacttatggaaaaacaaatgactgttaggaaagacagatggactgttaggagaccagatgggagatacaaagtttttatgacaatgtctgtttaagtgtggtgtgaagtcttatctctgtttaaaagggtcagccttccctggtttttcccagggaggcaatttatgacaactgagttcttttgggaggccctgctttttggcagataagagatttcagatgccttctgctcaaaataatttttatgccacagtggcatattctggaccccttcagagacaattctgaaagctctggaaagaaaacaggaacccaaaccagactgacatcagcttaatatcagcaatcctggagactagcaggcaaagaaagtgagcacaggtcgtgatttgataagtggtggaacccacccatgggtccagtgaagaaaacccatagtcacagtcaggcagcagggccagtaagcaatctatgcagactaacaaaagtcaggaggaggctgggcacggtggctcacgcctgtaatcccagcactttgggaggctgaggcgggcggatcacaaggtcaggagttcgaggccagcctgaccaacatggagaaactccgtctctactaaaaatacaaaataagctgggcgtggtggcacacaccagtaatcccagctagtcgggaggctgaggcaggagaattgcttgaacccgggaggcagaggttgcagtgagccaagatcgtgccattgcactccagcgtgggcaacaagagtgaaactccatctcaaaaaaaaaagaaggaacagggcccacccaacgtagagagagagtaagaaaggaatggttttattgataacagtgaagaatgcaaatgttacttctcaaccaaaaaaaaggagagaggcccttagaaactccagggaaaagattatacaagagagcaagatcaaatataaaacaaaggaagttgtggccaggcacagtggctcatgcctgtaatcccagtactttgggaggccaaagtgggtggttcacttgaggtcaggagtttgagaccagcctggccaacatggcaaaacctcatctctacaaaaaaatacaaaaattagccgggactgatgttgtgcacctgtaatcccagctacgcaggaggccgaggcagaagaatcacttgaatctgggaggcggaggttgcagtgagctaagatcgcaccactgcactccagcctgggtgacagagcaagactccatctcaaaaaaaaaaaagttgtaaaaaaaaaaaaagttggtaaaatgtacaaaaaagtcatccatttgacatgatgggtaaacattctccttttggttccataagagtcatgacattgttccaattagggaaggaaatttgtcatcatgtaaacaacgattgaaatcaacatacagacctaaacaaggttacaggacagaacaagatgtaaatgttaatattgatgatataaaagtaaaagtacaatcgctaaaagtaaaagaaggcatacagggaaggcttgggtactaatgacatctcacatgtgggaaggggtagtggtcagaagttctattgaaagttagaaacataattagtacatgacccaacagtatcatataactagcaaaattcagagaagaataaaacaaagtgggggtggtatgaatgagataaaacctcatctttcataataaaggggcaaggacaatagataaatgtcaggcttttggacagaaggcaagatttcaggtccttctgtgtgtaggtagccacctgaagagctgaaaacaaaaactgtttaaaaagcgattcccttggggaagggaaggatgagtcaggggaatgttgcttttaattataaacctttctgtctgggtacagtggcccatgtctgtaattccagcactttgggaggccaagacagacggattgcttgagcccaggagttcaagatcagcctgagcaacctggcgaaaccctgtctctaccaaaaatacaaaaattaatcaggcatggtagcacgcacctgtagtgccagctactccagaggctgatgtgggaggatcacctgcgcccatgagatcgaggtggcagtgagctgtgatcccgccactgcacccccagcctgggcaacagagcaagaccctgactcaaaaaaaaaaaattgtatttcagccagctttcgtagttgtcctcagcagtaaggttggtccataccattcagcctatcattagcagaacggtagttctgtttctataatgtggcctttcagggatacaaattacttaaagaaaattttgaataattcaggatatatggccagaagccatttgaaatggacaataatataattatttggaactctttaaaacagagctaaagctttacgtaataaccattaattctgatttttataaatgtcacaaggtctcttaagtagattgttacaataaagttgtgtttataatgaagacattagcagtcacagcagcttatgaatgaaacaaaggatccagccaactgtggctctcggctagtaagagaaagagggaagtgtgtgtacatattcctgtcttcatctctccccttgagcatcttatagggtgttgtgcttttcttttagaatttgaataggcttcattagtgagggtgacaaaaagaatagacttaaatacttggattataaactagtagcagttttgataaccagggccagggatcatatttagaaaactgactgtcaaaaattgtttgtagccaggctcagtggctcatgcctgtaatcccaatactgtgagaagccagggtgggaggactgcttgaggccaggagttagagaccagcctgagcaatgtagtgagaccctcgtctctacaaaaaaattaaatattataaaataatgtaaagagtgtcattggattgtttgcaactcaatggataaatacctgagggaatggatggcccattctccatgatgtgcttacttcacactgtatgcctgtatcaaaatatctcatgtactacacaaatatatacacctactatgtacccacaaaaatttaaaaattaataaatactagatgcacttaaatatttaaaatttttaaattaggtgggtgtgatggcctgcacctgttatctcagctagtcaggaggctgaggcaggaggatcacttgagcccaggagtttgaggctgcagtgaaccatgattgcaccactgcactccaacctccacaatagagtgagaccctgtctctaaaaaaaaaaaaaaaaatgtagataagtaatgcacagttatcctaatacatagcacagtgataggaagctattatggtttatgtaaactctttctttgatttatttgctccaatataattttgctgctgttttttgtccatgtgtattgtaaaaagataaggaaaagtacatacaaccatagaaattttagcgttctactcaaatactctcatttaacagaaatgagtgtctgtgccggggtttgtgatctattccatctgtccaaacctgtccataaatgactttttagcctcttctatttgagggtgatgatatacgtacatttactcatcttacttcctgtatcttcttatcagggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtatagtatttttcatgtttattttattatctcacaatgagtgaaccaaaatatattattgtgaagtatagtgtctttgtccaagcttatagatactgaatttatatatactgttctatacgaacatattctgtttttcttaaattggaaagagatcttaaaattcaacccaagtaatatgacacctgtcaaaagtaatttaatgggttatcaggtcactaaatctttatatattcattaaagaagcatttatcaagaggctattctatgcttgacactggagatacaaagatggagaatgcacagcccctgttcccagtgggctcactatctgcatgacagaatagaattgccccccaaaaatgcaattaagcattaaataaagcccctgtatgggtacaagtgcacatatacccactcctatgatttgtttctctctcataaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcaggtgggtacacatgtatcctttgttacgtggcacagattaataggccgaaagttaatcttgctagggaactccttaagtgataaatatatctcagtggtttgtttctttttggggtttgttttgagacggggtctcgctgtgtcacccgggctggagtgctgtggcatgatcatgactcactgcagcctcaacctcctgggctcaagtgatcttcccacctcaatttcccaagtagctgggactacaggtacacaccagcatgcccagctaatttttgtattttttcgtagagacagagtttcaccatgttgcccagtctggtctcgaactcttggcttcaagcaatcctcctgccttagcctgccagagtgctgggattacagataagcatgagccactgagcctggcctcagttgttttaattatttttatttaatctctggattaaaatctcagagaaacaattgaaacttattctttttttgtttgtttttgagacggagtttcactcttattgcccaggctggagtgcagtggcgcgatctcagctcatcacaacctccgcctcccaggttcaagcgattcttctgcctcagcctcccaagtagctgggattacaggcatgtgccaccacgcccggctaattgtgtatttttagtagagacagggtttctccacgttggtcaggctggtctcaaactcccaacctcaggtgatccacccacctcggcctcccaaagtgctgggattataggcgtgagccaccatgcgcggccgaaacttattcttttttttttaaggacatctgaagaccattgaatattaaactcattcttaagataaaatatgttctttaacatatatatagtactttgttatatatggtataatggtaccctatgtatgttatatatggtataattttaattatagctctgtgcctatatgaaaaatacatataatcaaagtaaatggtgggtgcatgcctgtaatcccagctactcgggaggttgaggcaggaaagtagcctgaacccaggaggcagaagttgcagatatttgtatataacacagctaaacactataaggcaggcaaataatcggcacaaataatgaagtgatgtctggttttagaaattacaatgatctggccggacacggtggctcacgcctgtaatcacagcactttgggaggccaaggcaggtggatcatgaggtcaggagttcaagaccagcctgcccaagatggcaaaacccgtctctactaaaaatacaaaaaatcagccaggtgtggtggtgggtgcctgtaatcccagctacttgggagactgaggcaggagaatcacttgaacccgcgaggcagggtttcaccatgttggccaggctagtctcgaactcctgacctcaggttatccccctgcctcagcctcccaaagtgctgggattacaggcatgagccaccgcatccggccggattattgtaatttctaaaacgagacattacttcattatttgtgctgattatttgcctgctttgtagtgtttagctgtgttatgtacaaatatctgcaacctccgcctcctgggttcaaacgattctcctgcctcaacctcccgagtagctgggattacaggcatgcgcccaccatttactttgattatatgtatttttcatataggcacagagctgtggataataaaaatcaatgtccaaatcagtaaaaaaaattctttcaataaaagcactgtgtcatagtttaattagcagaattttttcttccttaatagtccataaaataacagtatcttaatatagttggcatcttagatccaatgaaatattgtaatgaccaattgtaatattgtaatgggctgggggccgtggctcacgcctgtaatccctgcactttgggaggctgaggtggacggattgcctgaggtcaggagttcgagactagcctggccaacatggtaaaaccccgtctctactaagaatacaaaaattagccaggcgtggtggcgggcgcttgtaatcccggctacttgggaacctgaggcaggagaattggttgaacccaggaggtggaggttgcagtgagccaagatcgtgccactgccctccagcctgggcgacagagcgagactccatctcaaaaaaaaaaaaaaaaaaagtctgcaatgaagagctagtttccttatgaagagattatgttttatgcttctttgaatctggatctagcacactgctatgtctttagttaataaatacttactggtctgagttatttccatgggcagatagcccaacccagaatttcagtagtagagttcctggaaaacaacgtcttcatatagttggccagctgggctatattaccttccatattcttcttcataaaatctcataatcatcaccttctctcttcttcattccctctcctacgataatcggtcattacaatatttcactgactctaagatgccaactatattaagatactgttactttatggactattaaggaagaaaaaattctgctaattaaactatgacacagtgcttttattgaaaaaattgtgttttactgatttagacattgatttttattatccacagctgtgtgcctgtatgaaaaatacatataatcaaattaccgtaggtacttataaaagttcacattcaaagcctgactcttctgagtcactttttgactgagtcgtccatgtctttgtttttccctatgtcatcactaacattctcattagccataaggcatttccagagtgttccactattttccccaggatttaatcgaaatctctgttatcagttctgttttgaaggtggtggtttcttgatgataccagaaggtgtcaacagaaggttgtacatctctcagtaacaaaaatgtagtgcggcctcatctactttgggcatcttctttcttaggtcacgtaaagcacttggttgtacttgcgagaaactatggaattgggggcctgtgtcctcagagacaaatagtgcctgggttttttttgttttgctttgttttgtttttttggagataagatcttattctgtcgcccaggctgggtgcagtggttgaacacagctcactgcagcctagacctcctgggctcaagtgatcctcctaccccagcttcctgagtagctggaactacaggcatgtaccaccatgcttggctagcttttttatttttttgcagagacagggcctcactgttacccagactggtctcatactcttaggctgaagcaatccgccctgtctcagcctcccaaagtattgggattacaggcatgagctaccacgctcagccagatagtgcttttcttaataccaaatgtattccctgctactctgtttcagaacttttctgcattcacaatcacttttttaatgctaatcacagtatagtctttttgaagacatgtcatggcagttagactcaatacatgaggtacaaacagtgcagtgactttgttgacatgctgacagtactaatagctatgactaagttctcacaagcatgagcagtaacaaccgcaaggcagctgccatttagccatcagcagttctaagacatatcttgacctcaggaatgctaaattgtgaaaaggtgtgtgtcttagaattgatgaaatttggtattttatgatatgttatttctaggcgattagtgtagtttcttaactgtcctccttacctccagctgtgaatgtgatgtacattttaatctttcaaaacctagtaaaactacaacagcttcccagataaagtatacattttatcaagggtctacatttcttcctgcctctcctactttatctttcattaaacccccttcataaaccttctgttctgtccacagtctcttgcttttcctctaaacatgggaatgatgtgaaaatcacagatgggaaaggatttgaaatccactctttgctcagctcaaatacataggaatggttactccctcactacccagagccagtgcatcagtcagtcctacagagccagcctccaaaactcacccaagcttgcttcactgtgtctccactactgcattccagttcactccatcctcactcgctcctgcaatggcttccaccaggctcccggattctactctttcctttacagtcaagttcttaaacagcagccagggtggcctttaaatgacaggcttgtctagctgcaagactgatatgcgacctctatgcagaggactcagctggctgcttgttgcctcaacccacatggggaaagagtggaggaagaaaagtttgtgctggaggaagtaacaatttggttatgccgtctagggtggggtgtacaagtctggagtgcagagaagaggctggagctggaaatagaaatgcagcgttctcagtaaagagagggcacaccagtctcagctagatgagtactggccatgggaacagtgggcaagagcagatctgctccactccacgcacatggcacaggtcccaccctcagcttcctcctgccctggctcttgcccttgctctgccctggcctatgccgctggaattggatggtgggttcctgccctctgtgcctgtctgctgcctctgaggtgctaactttgccttttacaaaattggcctgtgttcccagtaccctgcagttagttggcacttagcagacgtgtgctgaatgcgtgaatgagcctgaattcagtgggttttctatgggtgataatttaaattcctaattttatgcctttgcacagaatctttatcttctgatcctgaggttttgcttcaaattgatggtgttactgaagacaaactggaaaaatatggtgcggaagtgatttcagtattacagaaatactctgaatggacatcgccaggttagtacacagccatgtgtgttctctaaaagcctgtttaatgtgaagcgacgcgtctcactgaattagaaggatgcagttgtgtgaatgcttcctacacctcgtcacactgacatccaagtcagcccccagtggtgtgccagtcacctctgagaggacactagtgcttatgccccctgtgagtgccagttctgaacttactcataggatccaaaaggggacctttgggcccaggggttgctggttcccgtaatgcaagtgctcaagggatcagagccctgggtaccagttccagatctgccaccacgtcatgctgtgtggtctctagcaggccaccaatagcctctttgtgaatcaggttcctccaccaaggaaggaacatgttatctgacaaacatgtctaaagataaaatttaagactagtgtttaaatgttttggagaaatgagcatgcagctagaatgttattattgttagtcattgatagaacctgcctgagtgcatcattatcagacgttcccggagtcacgttaggcctgtcctgtggcacttctaatcatgagcttcatcatcattacagctttagaaatcattgacctgggggaaatgagaacaacaaagcattttgttgtaggaaatattgagagcacagaagtcttctgccctctgataacatcaccacgtaataggacacaacagacaggcccggttcagtgttcttcctgcttccagacaggcagtgtgggggtcttcccaaggatgatggaaatgatgagcaggatgagatagttcaagttctctctttacctagtcgctttttttttttttgacagagtctcactccaggctggagttcagtggcacaatcttggctcactatgcctcccagattcaagcaattatcccacctcagcctccccagtagctgagactacaggcatgcaccaccacacctgacttatttttgtatttttttggtagagttggggtttcactatgttggccaggctggtcttgaacttacgacctcaagtgatccacctgcctcagcctcctgaagtgctggggttacaggcatgagccaccacacctggtcaggttctcctaaattcttctatatggtaattagtccattaaaagccttgttccgaatacattttgacagtgagccagggttggagcagccatggtggagtcctgtgccctccatgctgctcctgtagggtggcctgtaggacaaggcagaccagccaggaaatggagactgggtccccgtgtgagctatctatagggaggtttcatgctttttgggtgccttgggatgcaaatacttatggaaattaccatcttctttgcaaatgtgtgctttcatgcggtctcacctcccgcataatatgtgacatgttcagccatattgtgcaaagacaagtttttttgtctgtaaagagtaaaataggatctagaattttcttatgttcatttactaagaaactattgttcaaagatgagatacaggaccgtttgtttcccttatattgagctgattttttcagcacatttaaaataagtaaaattgcctgccatctttatagcagttgatactttttgaattgcctaccagaactaactgcccaatcaacaacaggaacacaggccatatgcgacagtatgagctaaacctcatgtctctagttaacttcaagactatcacaaatttttttaatgaattctgattctcttttgttaaaaatgaattgccattgaacactttggggctttgtgcagtaaaaaaaggtttggttcttgctgaattgttgaatccatatggcagggaagcagctaggtatctgctaaaatgggcccctgcagcgtgtctcttcatatacactaaaaacacgtggaccagtgcgacatcacctgtaaacatctgcattttccatttgtagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaaggggtatgttttgtgacatctttttcaatatagggaacaagggaagaaaggacaaaagtgcaacagctctgccttgctttgaaggatttattaaaataagccattattaaatattgctaatggaatgacagttgttaatggagtgacaattaaggtttgatccaaaacaaaaatatttgcttcaagaaacaacaaaaaatatttgcttcagatgtttaaaacatctactgactaatagttatgactaaagttttctttctttttttaatttgaggacaaagtctgactctgttgcccaggctagagtgcagtggcacaatctcggctcactgcaacctctgcctcctgtactcaagtgatcctcccacctcagcctcctgagtagctgggactccaggtgtataccatcactcctggctaatttttgtattttttgtacagatggagtttccccatgttgcccaggctggtctcaaactcctgagctcaagtgatcagcccactttggtctccccaaagtgctggattacagacgtgagccaccgcactcagcctgactaatgtttcttgtttgcaaagatgtcttccatgttgatcttcccttagatatttgtttgcctgtttgggatgattgttcttcttaagagacttttccacctacaatactataaatcatacactagctgaataaataacaaagggttttgtgtcctcgtggcttttactattctgtcagtacttgctccgctgcttttattgctgcagaatcccatggatctccaccttgaagcacgtgcacactccctgcctttcattaacacctgggagaatcgacctcccagcctttgcaggggtagcaagaagaagccacaacagagaaaccaaaagttcagtcaagccaggcctctttaggggttgcgtaaatggcttctgtcttccccttcccatgttttcctgggccgctcgtctgggacatgtctgttctgggcgctttctgcacaccaggggaacaacaaagacagcatggtctgatatgtgtgatgatcttggcagtttccttctttcttcataattgcattgtttctgacagccgctttttgattttctgccagggcaccctctgccttctggctagtaggttaggcctggcaggagggagaccattccatcagtcttgagaacttgaccccaaagtaactgtatattgtaacagagttgcttgcagaaaaaagaaaccaaaaaaaagtccacagtcaacttttgcaagctgttgtgttttcttttgcagtttttctacctcttgtccttctgagtaataaaaaacaagaactgagtggggaaagagaaaggaaggcagacattaccaaattgtcattttcttgttaagtccataaacaaaatcttgtatgtgctaatcctcctgccagagtaccgaaattaaaggcattagaaaacgttagtttaattttgtggttttgagtgcgcaagtgatcagtaagtgctcttcagtgagaacattttcttatttccatcatttattcctccactttgggaaatactcatttcctcagtaactcacacagagccggagaccttaaaaggcatctggctcaacacccagggtttttgaagaggaagcttaggcctggcctggggagggcttatcggaggacaaccctgcctggtctcgatttcaaaggtagaagcggacactggcctgcccacacctgcccagagcacgttcacttctgcatgttgcctgtggagactcctaaaaaacacgcatggtcttccatctcatctttatgtattagaacaaagcaaaccatattgctattggctcccttatttaattttcacaacttttgtttgtaagagtgaagcactttgcagcatcatctggaacctaatctgataagaagcagtaaagctcacacttgtacccatttccatgcttgttttcagtgagcctgggtgtttaagatgggatttgttgttgttgttgtcgttatggagttttgctcttgtcacccaggctggagtgcagtggcaccatcttggctcactgcagcctctgcctcccgggttcaagctattctcctgcctcagcctcccaagtagctgggattatgggtgcacgccaccacgctgggctaatttttgtatttttagatggggtttcaccatgttggccaggctggtctcgaactcctgaccccaggtgatctacccaccttggctcccaaagtgctgggatgacaggcgtgagccactgtgcccagccaagatgggattcttttttaagccctaccagctaaagccagtgcactgtgtgactttgtgttacccttggagcagcctctttttgctccactctcctttccaccgacccagtgtgctccccggattgagagtccctgtgcagtgaaagaataaatgtggctctctgccagcaacctcacctccccaccctaccctcagagtttcacatcttcagaacaacacacaatgaaccagttgtgttctgggctctctgagtgggagtaaatggatggcccaggtgaaatggaggctgctgttggccgattcattctgtaaatcaacataaacagcaggttttctctctgggcttaatttctcagcaggaaatcagcatagggaaacttcaggctgcatctctgccagtctagcagatctctgccagttctgcagtaaaactgccttggagccagagtttaagtcatggagctccatcagaatgtcattacccacaggctgtggccctataccctcaattcagacgggaggctacttgtatgccctggtgccgtggaattagtgtggggcctgacatcagccggttacagagcagcaggaaaggcttctgcgggtaatgctgcccacagccatcactgtaaacatgccggccccatggttttgtttgtttttattttacttaagggtgggaagggagctgttatcttaaggtctgcaaggaaagtgagatgctggaaggacttggtaatcggctctggcggcttcttccttggctttagaaggcagcgagtgggagggagagctggcagatctctgggtgtaggcaggtgagccagggagctgctggacacggtcctaacagaaggccgcatctgcagccttcctggggcttcctggggctggccaggaagacgcccagctttgccactcctggccacccagctccaccccatgcatgctcaccccacagctgccttgctctggactgtgcaagtccagtcattccggggtgcctgtcagcagggagctggggccttacagcaaggtgtttcacttcttttatttggtcagaatagatgaggacatgtggacctcagctcctcttgcaggctctggttgtaggctgccgaaggtgtgggtggagagaggggcggtgggttggtcacaagtcagaaaattaagaaacagtcctgcacatttcagaaagacaaatccagaacaaatttatatgaagggccgcggtcctttattccataagtagtaaaggaaacttaccttacctagggggctcgtaggcagaaaatgcacaaggacacattaggcccagggaagtggtattgtagctctgtgcaggttgagaggaaggtcattcatttttggtttcatttaacattttgatttttttctttgtcacatttcagggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaa

SEQ ID NO: 1545 - DNA, 79879 bp, Homo sapiens
  source 1..79879: mol_type = genomic DNA
ttatttttaaaaataaaaatatttatttggaaaatattagtagcatgataactcaacctcaccagatattaacagttcatcaggtcaggcaatagaacaagtccacatgagcttcttaaaaagaaatggatgaccacttcaatagctgactccatcttccattttattactggatgattcataatccaaaatatgaagttttgggactttttctcaaaaggagaaactttgggaaagtgtctgaagcaatggtattgatcttttttttccccctttatgaaactttaactgcatacttcagtctggtggaatcttttgtgttattctgactgtcaataagaaccaaaggactatgttgatgattcctgatgatttcagcaacacttccaaagtactagaggaagaaaacatagatgaattatactttggcatttgtgttaaatttgagctccactcctcccatcttctctcattctcaagttagtaaaagttattacaccccagctgacattctgcacaaaaaaatctagtttaacaaaggctgtaaccttcaaggtggcagaccttggactttgctgtattaagtacgaagaaaaacacactgacagcctcaattagcatagctacttagagagattacttcactgagttatgataaaatattatagtatattgctttttatttaccgttaaatgtaaaactatcatacaacgcatttttctacattctttacaaaacatagatcatctcttactttgcacaagtctcagatacaagaattgatgtaataaattaaccttagaaatttagtacaaggaaatagtcatctcctaaacaaaattatgttttgttttcttttttaaacaaataaagaaagctttataaaccttcatatttccatttttacttggttcctggtaagcttagagttaacttagtgcctaattaataatgaaatttcatgctaggctctctccatacatacttatttttccaaattttgatccttgttgtctatgggttttaatttaaaattatcacaaattttgttctgaaaaataattaaagttttgaaggaaagataaaaacaaatgtaacacagatcatgaaattaaattcattgagtatacaaaagtgctacaagttcacactcattaaatgtatttagaatcactttttaaaagtggtgattgttttacaacagtgccatgagtttagcagttactatcaattgattttattttctcgattttttagataaagacaaacatccacagtaaaatttttaagtgtttattaattgtttggatgacttccaagtagctacatattgaataaagtaaaatattcagaatattggccaacatttccaaatgaaataccagttgtcttttagataattggctagctgaatattcagtcagggagagaggtaagagacagggactttcaaatacctttagtctttattctttacttcctattcaatcattcagccatcttgcaattgccaaagaaattctttcattataaatcccattaaacattcattctgcttgtttggcataatatgttgctaaaccaaatgcagttgaaagttaaagttatggactcaagggccagaaaacgaaatagcacaatctctttgaagtggattacaagggaaaaagtgtgtcctgaacctaggaagcataggagaggattgctgtacttatacaaacaaatatctcattccgtccctctagtccctgaatatttgtgagtattgccttgttgtggtgttcggggattgaagtgtgtgcagtagggagttgagctgagttgaaacatttgaagtagggaatgaagttgaagaatatttgtgatttaatttaaaaaagaattgggcataacatagttacagcttcccctcactctcctttttttctgtttttattaattcagtgtatttgagacagatacattcagtgtatttgtggacagaaaaacaacgtattggccactaagataaagcagacagttgtcaaaactgtaaaattactcaatgttgtatcacacagtgccaaaatagctgcataaacagttaaatagttaatgaattggttactttttctagccatgtacacacaaatacacacagactttcagaaaaactccacatgattgacatcatgtaaccaacactttaattttccattcagatgttcagtgtataggggacataatctttttattatagatactttaagtaagagttttaattgactgtcagtacctccagatgctattatagtaatatattacttattttggaatccataggctgaatatgttggaagtgaggtgaagctctagtctattcattctaaagtggagatgaagattcatcaggccaagaggaattcctgtttaccagagtttcctagcaggacaacgaaatccagagcccctcagggagttcaaaatttgtgagagaatttcaggacctcgaaataggacagcttcttcacccacccttaagcctcttatagaaaagctagactgctggagaagctttaggatgttaaatgataatgcggtctacattttaaaaccaaagattggtcttgattagtgcccttagattcaagagttttgcattttaaaattatctgagactttgttaaaagcaaaataaaattccccaatataaaaattctagaagaaaatgtaggggggaaacaccatgacactggatttggcaatgattttttggatatgacattaaaagcataggcaaaaaaagcaaaaatagagaagacaatatcaagcttaaaagcttttgctcagcaaataacacaatcaacagagtggaaaggtaacctatggagtgggaaaaatatttgcaaatcatttatctgataaggggttaatatccagaaacataaagaactcctaaaactcagcaacaacaaaaatcaaataacctgattataaaatggaatagacatttctctgaaaatgacttacaagtagccaaaaaagcatatgaaaaatgttcaacatcactaatcatcagagaaatgcaaattttttttttttttttttttgagacggagtctcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagagaaatgcaaattaaaaccacaatgagctgtctatcaccttacacccatttggacggctactataaaacaacaacacaattcagaatataacaagtgctggtggggatgtgaagaagttaaaccctcgtgtgctgttggtggaactgtaaaatggtgcaactgctatggaaaaaagtatgggaggttctcaaaaaattaaaaatagaatacccatatcatccagcaatcccacttctgggtatatacccccaaataattgaaagcagtgtcctggagagatttgcacacccgtgtttatagcagcactattcacaatagccaagaggtagaagcaacacaaatgtccactgatggatgttagacacacaaaatgtggtatatagatacaatgagatactatgcagccttaaaaaggaaggaaatcctaacacatgctacaacatggatgagtctcaaggacatcatgctaagttaaataagctggtcctaaaggacaaatactgtgtgattccacttgtatgaggtatctaaaatattcaaattcataaaaatagaacgtggttgctaggggctgaagggagggggaaaagggaaactgttgttcagtgggtatagggttttagttctataagatgaacaagttctggagatctgtttcacaacaatgtaaatatacttattactgagctgtacacttaaaatgattaagatggtaaattttatatgtggttttttaaccacagttgtctaaaaggcaaaataaagaatacacatgactttttcagtttgttttgcaaatgctattctcctgcctgtaatcactcaaccaaatcaattcagttgcttaataattatttatcaagtgtacactgaagccagttactgtgctctgattctggaaatacagagatgaaaagacattgtccttggcttcatgtagtggggaagacagacacttcagcaatcatgacattttccaacaattcaaatattttctagcaggtgctgggtttggaatggtgtacctttttctgaaggaatcttgaaagtaaatatttcttaccttgaattttgtttatgctattttctctgcatagattgttcttcccatttttctccttctccatccctccaacttacattctacccatttaaattcaacccgtaattcaaaaccagaataagtatcactgcatttctagaccattcatgggttactccagctcatatttcagggttcatttataggagcaggctggctaaactgagatatggtaagcactgagtttggtccagattaaagaggcattaaagttaatgtttgattaatatttaagacccatgtgatttttttttcttgctccaggcccataagctcattctggtacaagggctatagtctaatgttttaactcaagtttctgcatctcttctggatccttccctggtaacctaccttggtacttgagttgagattttaggtcttgactttggaggtctggaacttgaccctaattcttacaaccttaattcaacttgacatttcaaccttgatttatatttgcccctggactaaaatcttgggtcagactgacctcattaaataactgaatgaaaggactagcatgtacatcacatgactttttccttttctgtgttcttataggatatactgcctaaatatagtattttatcttgttctctatgacatttatgcaagcattagaacaagtacttttgtatcctttctcctcatctctagcatctaatacagtatttgatgtcattatactcaatgcatagttatagaattgaatttaaaaagaaatcactgacctcttcaccatttttctttctgcccaaggcatattgttttgttgcttcaataaatcgcacaggaatattatatactcgcttattaaagaatacaactagtgtatatggttgtttggaatcatggccagagcttttccgaataagaaatgatccatcctgtttaattttttttaaaaaacataattatggttagtattacttatatttctacaggttcaaaaaatcattttgtgaagaacacctatattacattccaaaggtaaattatttagctacattatttttattattgattagcgcttgtcttcttattttctaagaaaatagtccaggaaaatatatactcatagaaaatcctgagtgagatcaatgcttgccttttttgaaaaaaaggtaataattaattaattatttttagaaacagtctcactttgttgcccaggctggtgtgcagtggtgcaatcacagtccactacagcctggaactcctgagttcaagcgatcctcccacctcagcctcctgagtacctgggactactggcatgcaccaccatgcccagctaaatgctagctttttaatgtgctaaataaggttttatgtttataaaatttagaaatatgtgaagggacacattaagatcaaatctagaggactctcttgaactgggaaccatagccaccagttgtctatgaaaaaaaatgtatcaaacaaattccattcataagtactataagaagaaaacagaggttgggaatcaaaactttcattttatatttgcccctggactaaaatcttgggtcagactgacctcattatgaaaattctctcctcaaagaacttttataagaaaaaaaatccctagccgggcatagtggcgggcacctgtagtcccagctactcgggaggctgaggcagaagaatggcgtgaacccaggagacggagtttgcagtgagccaagatcgtgccactgcactccagcctgggtgacagagcgagacaacatcaaaaaaaaaaagaaagaaaaagaaaaagaaaaaaaaatccccaaactgtaagacagtaattcaaattttattaaattttttaataaaaatatttagaatcataaaataaaaaattacgaacaaaagatggacaaaaagcagaatgaaatgcaacaagagttgatcaaactcaggaaacaaactgaagaaaaagacaagcctatctcaacaaagaacaaattataagatgtccaagggacgagagcttcaaatgaagatttaagaaatgacacttgaaggaaggtgtggaaacaaccaggagagaaaatgggatttaataaaataagtaccatagaatcaaagacagtgatgggagaaaaaatgacaaaaaagatccaaaacgcatgtaaattgagtgcttgcagaagaaaaacaaataagggaacagaacaaccctttaagactatgatctaagaaaacttattggatataagagaaaacttaaatctacgtattgaaagggcttctgtctacttgagaaaattgatttggaattatcaactcagagatatattctggtaaaatgattagactttaaaaacaaaaagtctgcagagccaccagactaaagtatcaaattacatagaagggcaagaaagtcacattggtatcagacttctcaagagcttcatacagaacaacacaatctagtggagcaacacttttcaaactcaaattaaggattttatagccagccaagatttcttccaactactaggatatgaaaaaacagttttttaactctctttctctttttattcccccacagcagtctcactcttgttgcccaggctggagagcagtggcatgatctcggctcactgcaacttccgcctcctaggcccaaccgattctcctgcttcagcctccggaggagctgggattataggcgcccgccatcacgcctggctaatttttttattttcagtagagatgaggttttgccatcttggccaggctggtctcaaactcctgacctcaagtgatccactcacctcggccccccaaagtgctaggattacaggcataagccactgcgcctggctgagaaaatagttttgaatataaaggaactcagggaataatgtaaacacgatttttcctcagaatctactacaggtacacttcatcaaaggaaagagacaatggtggaagtccaccaaaggactgacggaacacactaatatatttacttgtagagctaggactaaaacaagggtgaggaagaacagtatgtaaatgctatatattctgacaaagtggagtgcaagaaaacaaagaaaaagaaaatgggaggagaagagagaaagaaaaagtgtcactttaatcttgaattgtccaagctgtccctggtgttcctacatgattgaagttgggctctccaaacatttacttccaggtattttttgtttgtttgtttgtttgccatcttgactcaaatttttaatcctgcacattgatccaaaatagcctgtcactgttcactcctcagtggagctcatgcagcaccaagccttccatagacctcccctggagctttctcgtctcccactgtttggagggcagtggaggctgtgggtccttgaggagatgaaaggacaagtagaaatgagatggaggaacttgaaagagaggaggggatagcagtttctcttgagtaagtaaaggaaaaagatccttgtatctacacttgttgcaattatttaattagcatatcataaggacgacaactgtgtctattacaggctgagggcaaaacgtgtgatttaaaaatgatcagaccttggccgggcgcggtggctcacgtctgtaatcccagcactttgggaggccaaggccgccaggcagatcaactgaggtcaggagttcgagagcagcctggccaacatggtaaaaccccgtctctactaaaaatacaaaaattagccgggcttgggggcacacacatgtaatcccagctgcttgggaggctgaggcatgagaatcacttgaacttgggaggcaggcagaggttgcagtgagctgagatcgagccactgcactccagtgaaactgcatcatctcaaaacaaataaataaaataaaataaaataaaaataataaataataaaaatgatcagaccttgtttgatctgtgcaatgcctcttcagcagactttcgatcacaggctccagcataccatggcttgcagagaacgccagcttcctgtgaaatggagggcactggtcagcatgggatggtccctacttaactctaatttctgtgtactagaaacaaagacccatttgcattatcaagacaggcctctacatttacaccaataattttaagatgagttttatttttcctttgatcaaacacaaggattataccgttaacttgttttttgtatttttttttcatttggccttagctaggttcctgaattatttctttctttctcctaaataagtaataatccccctttccattgtgctcttattgctcttactttgtggagtgctttacaatttccaaagcatttttacaaatattattttatttgattcttgcaagaaaggatatatgccttctttgaaggcaagaaggacacatgctattatccgtattttacatttttacatatatttgtatggaaacttagaaagacttgcccaagggcacacagagtcctttctctgtccctttataaactgtgctgtcttatatgtgatttaatatcatcagcctctacagatctatttggaggaaattacaaagtttaaataaaatctatgtgagaggaagaataatgaaaacacatttccttgctagttttgaggaaacattaactggagcaatgtcttagtcattgaaaaaaaacaacaactgggtattctgtccctattaccaaatgacagttcacataatgatgtaaaatacagtctctgttctcaaggttcactccaaatgtcttcttctcagaagacatgctctttcctgcagtttcctggtaacaatttagtgacatcaagagttcatttcatacctgttctgaaatagtggaattagatgaaaagctgggtaggggcccatccacagttgggtttcccccttctgtaaatcctgaaagggatcagaaaagtccttcaattaatcttcatatttcttgaactctttctatgcctatcccctaacactgtactaggtgctgccagggacacatccaccaaaaaaaatccttaaggcaatggttccaaaagtgtggtccaaggacccctggaaatctcgaaaatcctttcaggtggttcaagaggtcttttctttttgaattacctatcactatgaaacccaattttcctcatgtagttccaccagaaaaacattgcaacagatgaaatgtagaaacagagatgagaatccagcagtctctgttatgttgcagtaacatacattaaagagatttacaaaatgtaaactaatgccactcttttccctaaattgtttttgtttggaaaatatagttatttttcataaaaatattatttatgttaacatgtaatgagtttaatattatttttaaatggattaataaatgttttaaatgtctcagttttaattcttaaaatactaggtatcaatagaaacatgtaaaccaaagctctttgggtctacaattattttaagagtgttaaagtggttctgagaccaaaatgtctgagaattgctgacttcaggcatcaactccctcaaagagtttacagtctaaatgtggaaacatgtgaaatacgaaaaagacttatctgcattcattcattcattcattcattcattcattcttgtttctctgccatggatcaaaggcattggggatatacagcagttaacaaaacagcaaaatgccctgctctcctggaacttaaattttaatggattgagatgggcaataaagacataagtaaaaaatatatatataatgttagagggtcataaatgctatgaagaaaaataaatcaggaaaggaagaatatgtgggtgagatctgcaggtggagagggaggaggcactggacatcccaggaaagaatgtcccgggtagagggagctgtgaaggcaaggcctggcatatctaaggaatagcaagggtgccactgtgcctggagtacagtaagaaaaggggagaagagtaagagatacagtcagacaggaggcaatgaagggaccagatttataggacttggtggacccttaacatgactcaagagctgtaatgaacatgataagggaagcttttggagggttttgaacaggggggtaacatgatctgcctatgttttaacagggtcattccagctgctgggctggaaacagagggtggcaacagcagagtgggggaggccagttcggtgttcttgcaggagatgacagtgacttggacagatcacagcagtggaagcagtgagagtggttggattctggatctattttgaaggaatagctggaaggtgtgtgaagaaagcaagtgagaagtcaagggtgactctaaggtttttgacaacagcaaccagagttgtcctttattaagatggggaaatctgcaggagaaagaattctggataaactaagtgcttcagataatagtgccctggatgtttagagaaggcagccaccattgtaagaggagggggcagtgagggcttggcaggcccaacaaagatgggccaaaaggaaggatgtattctaataggaggggaacagcactcccaggtgagagcagcaaaggtgagtgagtgaacagactttccctaggtgcacagtgcagggcagtttgtggtttctgcagttctggcagttggaagagtacccatggctaatattttctgacacccgaatgtgctaggcctattctgttttcaacatgcgtgcatctcgtcctttcaccagctctttgtggaatgagctattatgcccattttatagaacaggccttctcagaccatcctgtctacagcagcagccctccctgcctccgttactctctgccacccacccctgctgctgcgctgtatttttctttatagcacttcagcatttacctgatatgatattatttgtgcgtttatttttactctctgtctccttcagtagaatataagtttcatgaggacagggtctttatttgtttcgttcatccttgtatctcctgtgcctagaacaatgcctggcacacggcatatggtcactaacaactgaatgaatgacttggtttgaaaaacggtaaaaggtataataaacctttttaaataatgaaaaataaatttctgtagccaaatcattttcactttgtgttgtcagaattttttttaaaaactagtaaaagtttcatttatttaagatgaatattattaaaaatttaaaaagccaatttatgtttagtaaaaaaaatgcataaaaattttgcatgtggacaattactgtttatttaaatggatttaagctttattattttggaatatatcccaaattatctatgtaaagcagagtttttttcttcctttttttcccacattgagttgcaggcaaattaaggtttgggcagttacgttctgtgagcctgacttatccgattcatatatttttagggtgatgtttgccttggaaaaattatccagatatttgccgtatcttctttttaaggtaccttttgtagacatattttgtgatctttaaaatatattttgacttaatttaaatcggtattatttgtttagaaccaaacactatagctggtgcttcccatatgttgttttacttgatcttattattttgaaaacagctgtattgtttttgtaaaaaaaaaaaaagttaaaaaaggatgcatgatcagtaaaatattaaatcgctactaaaaaaagtaaaaattgcctcaaatatatttacttttcaaaacaactctgtgaaataaacattcttggccccattttacaggtaaggaaacaagtgggagaagatgccaggataacgcagctggaagcgacagtgctgtgttagaacccaggcctatcagactctaggatccagcctcgaccactccctgatacactacatggcttcgttgtacttacttggcagaggtatgggtttttggtggatttgtctgcaagaaagaatttcagataattaaaggacaaagcacaatatgagtaagtttgactttttgtttacactgatgatgctgtgaacaggcacatcacaaataaatcaatacaaatggccaataaaatgtatctaaagataaaagagccaccaaaaccttaaagataagtaagactcttccttttagttttgaaaaaggaggaaatcttgactaaagtattgtattttagtcaagttcaataattaacccaattagtaggtctctgcaactctacacagttattttaaagttgctcaacaccttttaacacgtaactgcaaaacaatgaaatgttggatttttacctagcactgcaagtcagtgtcactgtgcagtgaaacaatgcacatgttaattcctgcagcaacaagaggaaactgatctttaaaggaaaggattcttacttctgggcaggaggaaacactggtgactgcacagcttcttgtctgtgacttgaccctcggtggcgttcagcaggtataggtttttctggatcaggaaaattatcatattaggattagagtgaaatgtctgtcctcatcccaaaacccagcaacatcagctgagaagaaccaaatttgatcagaagtcttcccgggaacatgtcttagttactgagatgtcatggatctgtgcacttgccagtctgttgatgtggttgtgctatgaggaccaggactccctcccagcagtgttacaggtacatcctaccacctctgcattcatccactggcaatgtacatagagactgaacccacgggccctgaaactttaagtgtgtgagtataggtggaagccagaagatgagaacattttagccaccctctaaacaactcaccctctacttgccatgtggcctccacacaggtggagacaacaccctggtgggtcttgattagtcataagacgtggtataagcagtgtgttactgataagaggcacactactgagttcataaatgatctctttttgcaaaattaattggatcaaattcaaggttatccctataataatgtaaatctcacttgcatttcagtgttttcctgagcagaagaggaaagggtgggaaatgagcataaacctgaagtgtaagaaatttatgttgaagcccatagtgaactctactgctgaaccattaataaatgtgatcacacattattttaatactttactctccctcaaatttgtcgttggggggtggggtgtgttaaaatcttggtatgttcatgtgtgagtctgcatggaagaaaggctgagaactacagaaaccccaaagaaataaaagtagtaagaactcaaagattcaaataaatggtaagatagacgtcagggtttcttaccattcagtggtgcactaaagcttggaaaccttgaacctctgaagattgtattttgaatttgtggcaagctacttcaaacctctatgttagatgttttgctcatgacattaaaacttggtaatttcagaaggagaaacaatgaacaccttaggtcttgccagcctataagctttgactacacctgctctgcctccgccatcctgattccttcctaggctagtagaggccactcactcactttgcatttggatggtaattgcctatgctcttgaaataaataacaaaggagggggcatgcctggcaggctcctgtactgggaaccctttgagaatgaggacacctaagcagcagtggacatgccttgggccctgcttctttcctggattttggaggctcttgtagccatgaagtctgcacaggttgtacttacttcctacagatgctcagagctcctgaagtcactatcactccacaacctggactcagcaggtctgagaggctgcaaggaatggaagtacagaaaagacaaaagcctcaaagggaaggcagaagaaagcaatacagcagaaaaggggtgatgcctcagaaatagcctagggaagcaagatatgggagacaggatgaaaaaacctaatggcgtcattaaagcagagaggtgagttgtagtgcatgctcagaaaagatccactgtccatcatcagagaaaggagagtgctttatgtagatatacgcacatcaactcagggaagagggagaatactcactacatttttaaccctgggtatcttcaagtatggaattaaatgggtacagggcatgaacttctatataatgttttaagtgctgatattatagatgattcttctatttttttccggtaatttccaaacacaattttttttaacatgagcagtttctaaaaatatatataagatttttgagtgatgataaaggaagaaattctaaattactcaggaggctgaggcagaaagacaacttgagcccaggaatttgaagctgcagtgagctataattatgcaccactgcactccagtctgggctacaaagtgagaccctaactcaaaaaaaaaaaaaaaaaggaagaaaagcaattgaagatgtactaagaagacagacaattgaactttgaaaacattatcttgaaaacttagcaaaagaacttgttcaaataaacagatttttaaagttttcattactttaagtaagctattagttctaaaacatgtgaatggctctacgttagttttcacatttatgtaaggtcctagcactattgcctggcaagtcatatctgtctgccaaaaggcaggtttttgcatgcattctgtagcctactctaaacatgctgaggttctgagctagttttgctgttcattgctcattgcaaaaactattttgtttagaaaattgagtttcatgtttacaattgccccaaaaataatgtaataaatgtgtacatacaaatccttaataaaataacttttagaggacatgctcatccttcaaaataatagattttaccttcacaaacacttgaagcattctgttgagaggcaactggagtctatgtaaaagaaaaaaaggcaaggttattcaatatagcagaatgtggaaataaatgtcagagcaatattattaaaataaatattttggcagcacttttctttgatgcattgctattctttcaatcacaacaacaattacaaacccacagtccctagcccaacctttgcattaagcaacaaacagccagaagtgtcctatgaaggagcaatgtcactgtggtggagaaacctccctgccttgtcaacagggttgatggaaatcatgacccccccagcagctgccacatagtaacccatgtacagcaggcatctggcatctgctttggtctcatgaccccccccttctgtgtgtttgctaaatgattgtaaatgtcaggcttcacagtagggactaggtccaggtgggctcccttatgtagtgttgtggcccaggttcaccatgttctggccagaatctgagtttagtgaggcctatgtgtgcctgatacacaatggtctaccattagctgtggtggggagtggacacagacgcttcctgtggagagggcagggaacctggctgcccctctgatctgctgcgcacactcagtgaagctgctgggatcaagtgaggatgagctccttctatgctccagggaggagcatcctccctggctacctgaggatttgaagcttctcttggactgcttgggcagcaacttcagttgctaagattgctgtgttcaccatagctggaagcattttcaactttaaataaatggataagaataaacactgcaggaaatatgaagcacttttaaatgcaaaattaacttactgtcttcagtggtgtcgttggttttttcctggggaataaaaagagatgagctttgttaaaacacaacgaagacaaaatggagctatttaccattattttagtctcaaatttaagctagaattatgaaagcgatacaagtgtgtagaagactatccttgcagggtggagagggatggaagtgggatttagttatgatcctcctaggctcagatggagtctgctgacagatggggaaggggtcaactggggataaagtagggcaccagtccggcagaactggactcttgcaccagttgcactaattacttggcgggtgaccttgggcctctttgtcttgagtgtgaggttagattcctcacctgtcaattgaggaccaggatcagtattttcagtgtttctgtggagccccctcttccccaacagctccctgtgggggttactgtccaggacagagggtagaggtaagagggtggtccagcaggtgaggttgcagctgcacttgcccactccagcttcctccctgtctctagggactattctccactgtcttctgtgcaggctttctttcagagagatccgaaaccaaaacaagtttgaaaaccactgatgtgtggtcctgaaggtacttgcctgcactaacattctagtttgcaaaatgattcaggtgctggagcttctgaaagtcggggtgtcttgtggaacactgtaagtcaatgaactcaagattccaatagagactggagtctaatattggtaaggttgtatgctccttttctgtgtgttaaatttcttaatttaaaaaccctcaccatatctctctctcgctttgttttcggctgagagctgaagtgtgggggaagaacactaagaattcctgagcacctgtaagatgcctggcactgggttaggctcctcaggtgctatttaaaccttacagtgacattttaaggtgaggaaactgaggctcagagagacgaagtagtttgcccaaagtgatacagctgaactaagagagacgtatgcagagttttggttaataaaccttcaacatggaggctttctttggtttacacagagacagaaataagattagagccattcaggccagctttagacatatttaaatttgctttccaaataacctgttgagccaacataattttacggggtgacgtttgtaatattaacacattacaatcgtcacctgactgtttacaaagcccttctaaattcaataagaaagaatgactgtcactttcgagaggaacttcagtcgtatggctttgagggagtgccctggtatgaccagcacatagtatatatctacacacttatttacagaccataaaactgagcagcagtaagtaaagacaaaacctgctagaggctctgaaaatgattcaggtgctggagcttctgaaagtcagggtgtcttgtggaacactgtaagttagtgaactcaagacttaactaaaacttcacaggaggaaatacttctagatttatttatttatttatttatttattcatttatttatttatttgagatggagtcttgctctgttgcccaggctggagtgcagtgctgtgatctcagctcactgcaacctgcagaggttcaagtgatcctcctgcctcagcctcccaagtagctgggattacaggtgtgtgccaccacgcctggctaatttttgtatttttagtagagacggggtttcgccatgttggccaggctggtcttgaactcctggcttcaagtgagctgcccgccttggcctcccaaagtgctgggatgacaggcctgagccaccatgcctggctcatttgatgttagcagggctccttactcttggtccaagttgcagcctgccatggggagaacttctaatgaagtcaacagggcagtggggtatcaccatcctcactccccagatctcaaaagctgcttcctgcaacaggtacttacccggcccgtggcaacggggatggtgcagctggtggaggtgacttggtttcccaggccccactgtttcgacctgcacaaacatatacactactcagtccccaagtcctgagccgggggctgatgctcacactgaggctggcctctctggcaggctcagaaatatttgcacatactgtgttgctttcagttaagcacatataggtagttatattgaagctattaaggaaaacttgtgggcaaaggtgatgacacattttaaaagtgtcagtgtataagctcagagctgggatgggggttagggactccaccttaacatttctaaaggaccttctccttacccgccccctgccccatggggcaagtcctgagcccactgattctgaggactcagtgaggacccccacagaggtccttcaggaagggagccaacagctcacacctacatctgtgcacactgcacaaatgtgcacggcagaggtgcccagagacagaggctccaacccaccactcctgacacagacctcagacagtgctcctttataagcacacttaaatacggtaaatgcctctaacttcacattcagaggatatttactcactcatctctgagttttcaagggctttcgccgacaggttttccttaatggacaaattgagacaagtgcaggctgctgcccaaatctcatcttctcaagtcatagaagggacccgaagggtcttgtcccctgcacccaacctcccttcctgtacctgaagatagatgccagacaatcgttatgagggaggaagtgaaagagaagcaggatggatcttcactgtgggacagagggcaggccaggaggggagaggccagagctgagccagccccctcagcatcccctagctgcctcagacatgatgctcacctgcttggacaccattgctcagtgagaccaaggggtctcttcatgaggctcttcattaacttaactgaactgaataaatgttttcttaagaacttactacacatacaagtccacaattccgtttttttttttttttttttttttgagacagggtcttgttctgtcacccaggctggagtgcagtggggagatcacagcttactggaggcttcaaactcctggactcaagtgatcctccccactaagtagctcctgagtagctgggactacaggcatgcaccaccacacctggctaattttttgtccagatgagattttgccatgttgcccaggctggccttgaactcctggactcaatccatccacctgccttggtctcccaaagtgctgggattacaggaatgagccacggtgcctggcctataattcctaatggatttatagggcatactctgtaagtacaggctggacctgctgccctcagtctgtactttcttagtttatgagatagagcacagataagcacacattgaaataataatccattaccaaggattattgaggacttggtacatgtaaagcacatgaaggcactgtgttaggggccgaggaagaggtgaagaagcagacataggcctctgccctctcagaatttataacagggaagatacatgcaccctccatatcatctcatccaaacacagacaagaaaaagaaaaggcctcaaaaagtattgaaatagagttcaggaagttccttcccatgtatgtcactggagagaggctcccaggcttctactcagagcccactgactcttttcctaaaccctcaaggatgggagcaacagcaaagagtgggtggtgtggattgtacctggaagccttccccagcaccctgggaagcaatgccccctccatgacagctgtcttccacggtacctgaactgggtctgattttttgaaacattttggaaaagagattgcgtttggaatgtttacatttcatgtgacaacatgaaaacaataaactgaaatgtcacctgaatgtgtagtaggagtctccctgtgtttaagtaactggtgtatcaaattgaatacttaagactgacactgttaaagtacccttgactgcaatagaatttgatggaagatctcagggaagtggaacaaaatcttgtatgaaaaataaggaagtagaaagaaggtctaagtctgaatttcatcccaggggttttccctcttctgaaatgttaagggctcctttggccactatattatctttgtcagaccttcctcctggcttttctactatgcttccttttcttgcatatctcagaatagtctgccaaaaccttccttttcctttccttccctataaataacttctgacaatcagaggacagcatgattgtcatggtggaacactgtcacggaggacactggtggaaagcctatggtcttgcctcaggaagacagagttctagggaaggatggagcatgactcttcatgggtcactggcccatgaaacaatattgttccctgataatatctgccagaatggtcatggatcaaggcaggttgaacaagggattctgaataataacaataataataacaaagcactagcattttatgagtgcaagtcatctatattgagtcacttaattctcatggtatctactcatgatacccctaggcataggtgccattttttcagaggaagaaactaagaaacagagatgacttcacttgttcaaagtccggcacctagcaaatgtcagagccaggacctaaacctctggctttggagtcggctaaatccattctactggcttctcaagcacagcggggacggcaggggctgtcactgcaccagatttactatatcaccctcggcaggcaccttattggctatcaaaggaccaagagcaatattgaccagaggaaactgatgtggtgtggtgctttgacagaaacaccaactaggcacctgatggacacttttgtgatgcccactgggggactatctgaagcctttaaaggggaatggatggttattcaaagacacaggctagtagtctgatcatttcttttgtaaaaataatctctgaaggttccactgtttgcacactcggaaacccactcggactgtttaggcttgtcccttcaaaattatttcacttcttcccccttcctgtaggtactcccacctgtatgtgataatcacataaccaggacattattttcttgtttagatttgctttcttcatctgatgaccctagtattaaaatacagctataccaggttaatagcaaacttatgagtaataaatccagctggctaaagccctgttggtgattctttaaatatttaatacaaccagtgtttgaggactcattcaccctctcaaccaactgacccctccacagtctcggcacctcccctgagccagatcctggggtaggccctggaaacagctgtgagcaaataaagacagaaatctcagggcatgtgcagggcactagagggatctgtcccagcttggggccaggtaaagcctcctgagcaatgacattgaaggcaaggtctccaaggagcttgcaatgtacttaggaagcgattagactgagacacaaagtaattagggaataagtacgggctaagtgtaagggggaagagacttcctgcaaaggagagctctctgagggctacagaaaccagaggagtcttcctggaggtggaggcctcaagctgggccttgaaggatgagtaggattaggtgtcctaaaagtgagaacacaaagaccaagaagcaagacccgtgacatacaggctgattggagtactgggtgtgttttaggaagaggaggtgcttgtaaggcagtgtgttttaggaagaggaggtccttgtaaggcaagtagagctttgtaagaggtaaacaccagatattagtaatctatttctctaaaggagggttgaggtcttcatttatttatttgttaaaggttttctattccagtaacaacagccctcatcctgagttatcgggagttaggagtctccatttctgctggggcctaagcaacctggtcacgatgttttagattggcatgtttgacctttgtctctccagagggtaagatgagctggctaagatggctctgagctccactccccacttataaagcgcttgtgggttctgaggagaggttaagtaaaaccagaacttgtgaagaaagtgaataatttcacaagaaatgagtccaggaaaagatttttaaaatactcgactgttctttcattttctgtgaaggagcctgtctctggaagcagagctcagcctctcaatgacttgtgttcagctctgtgagagaagagagtgtgtgtgtatgaatgtgtgtgtgtgtgtgcacacgcgcatatgtgtgcctaggggagagggacaaggggagagagggagaggaaatgcctgtgagaatgctggagagcaggctcctacacctctctgtgctgttaatgggggtcatgggcacccctcagtgtcttgggctcagccttgggggttgccaaaacctataggagcaaccaggaacattcatggtttgggggtaggggtgacatggcaaagactagctttgtggtgagatgaaactggtaacatctggaggagttcagcggctcagtccttgtcgctgaggagagagccaagaggcaggggtatggctgctggacaagaaggtgcaaggtggctgagtaaagaaagcccagactagggtggtcacagctaaaatggaacagcaaattcaggagaaaaaaaagcaggatttggagcatgtggcctggaggctctacgcattgagaaacaggggtgcccgcaggggagggaggagtgagtttagagtcctgtgtgggagcatcaaggtgttcagaagggaagtcaggttggggttggatgccagggagttaccagtgtagacttgagacatgaatccagattaatcgatgaacgctacagaagtgaaaaatcattctctctcctcagcacttagtgtgtaccaggcactcattaagagtttcgcattcacatttgcagaattctcctgtcacagagtaggggctatgagcaccatttacagaaaagaaaatctgatgcttggagaggtgaagtacaagcccaaggtggcatagctggtaacggggcacactggggttccaaccgaggtctgtctggctcaaaaccaagcttgtaaccatcatgatgttctgaaagaactgtgggttgagggctgagggctaaattccgggaccccctcagtcaaggaaggggacacagagaagccagcaaggtgcccaggaaggtagggtgaaaaccagaacttgtctagcagatgccaaaaggcctggggaaatggccacttccacacacgtgccaccagacagtgcatgaggatgaggactggccttctgttcccaatattaagacatttggaaatacaagtgattactcttcatagttgatctgtttttcttatttgaaatagacgtaaaaccaaaccaaatcacacatacactttacctgaagctgttcctggaggagaggcgggcgttgaggaatttggcttggttgatctattcaccatgggagcttaaacacagaaatgtgtgtgtatatatatatatatatatacataaaaccattacagatacatgccattgaggaaaattcacactcagggaaaaatgatgaccagaccagagaatttgcaaagaatgggagacacccttattagacacacaaaccaataaaagaagtcttcttagaagaaacatctttagaatgggaatatcaatgacagattcataatttgatatattattatttgattatttgatgatagagatcttgttaaagtgaataatggctttgaatttcatttgccaagtgggaggtctaagagataaaggagttttattgtttttgtttttcatcaagagtgtattgaaccccttactggaggggcccaattaatagctccacctcccctaccagatgcaatacacaccattgctctgggatttcatgggtttttttctgttcttttttgtttttttaaagaggggttggtaaggagggaatgtgtatttgttcttttgtggtaatgggtggcttgggaattcaggtgggtcttgaagctgttggtgataggtacggagtacgggagagggttgctacatgatggcggactgaaacctgaatatggctaccatggagttgagagtagtagatgagtaatgttacctgaagaggtatcacttgtactggatcatattctccatagtgactatattcagagtaaacataccctgtttccatgcctaatcttatgtagcactggctttttaaggtaattcattggtcatagcatttgttgttctgtgaagggtttacggatgaaatgtttcataggcttatcatactactaaatttaaagaaccaggactcagggcatatttcactctttcattttttcactcctctgcagaaactgttcttggtgcaatgtttacaaggccaacatggtggcttgtgacattgtattaggttttatgagaaatccatttgaagcgagggcagctgaagagaactacccaggtgctttcataatgtgagatgggaagattaaagcatggaagaggaaggggaaggcagggaagggctatgatacacagagatgggttgtcactgatgctgtctgcccaaccagccaaagaagcacacactgtggcccaggggagaaagtcctgggcactgtcatttctgagcctcttagtgcttactaccaaatactcttatacatcctgatcaactgctaaaaattttcaggtgcttaaggcgacaaactcttacctttttcaggtggaggtgaactgctttctgtgggatgaatatagttttcatcattatcttccacggggaccacataatcagcctaacagaaatacaaaactgaatgagaagaatgctgtacattcatagttgactgtatgggagggagtgatttttttaaaaagcattattgagacgcaattcacatatcataaaattctactatgtaaattgtacaatttggtgacttttagtatattcacagacatatacaaccatcaccacaatctaattttaggacatttttatgcaaaaagaaaccttgcacccattagtcactccccatccaccgcttccttgacctagtcgaccacaaatctactttctttctctatagattttgcccattctggacattgaatatgcacggaatcacacaatctgtagtcttttgagacttctttcacttagtataatgttttcaaggttttcctgtggtatagtatgtatcacaactcccgtctttttatggccaaataatagtctattttatgagtatgccacatttgtttatccattcatcagctgatggacatttgagtttttttccactttttggctgtaatgaataatggtgtcatgactattcatgtacaagtttttgtgtagacatgcatttctcttgggaatatcctagaagtgaaattgttgagtcatatggtagctctaagtttaacagtcggagaaactgccaaactgttttccaaagaggctgcaccatttttcattcctgccagcaatgtatgagggctccagttttttcatatcctcaccaacacttgttatcatcctttttattacagccatccttgtgtgtgcaaaatgatatctcattatagttttgatttgcatttccctgaagactaatgatgttgagtatctttttatatacttattgtcaatttttgtatattctttggagacatgtctattcaaatctttgcccatttttaattgggttgtttatctttttattgagttataagagttatctatatattctagttataagttcttcatcagatatacaatttacaaaacttttcttccattctgtaggttacttttttactttcttattggtatcattggtggcacaaaacgtttaaattttgaagtctgttttatttattcttttattgcttgtacttttgatgtcatatccaagaaaccattgcctaacccaaagccataaagactcatatctgtgttttcctctaagagttttacagttttagctcttacagttaggtctatgctacattttcagttaatttttgtgtatggtgcgagattagaagtccagtttcattcttttgcctgtggatacatctagcaccatttacctagcactatttgttttaaaaaagtatttctctattgaatcgtcttagcacttttgtcaataattaaatgacgataaatgcagggagggagagattttatattgacaagacacaaatgaggtaaccagatctcaaaactggtttttaccacctgccctggtgggcagccaagaagggtactaggagaaacaaaaacaaaaatttattgccaggtgttcttctaagtactttacatgttttttttctcatttaatcctctaacaacacaataagagagatatcaccattggctccatttccagatgaagaaactgaggcacagaaaaattaagtagtttgctcaagttgtcaagtttaaaagtggtagacccagaagggcacagtggctcgtgcctgtaatcccagaactttgggaggctgaggcaggtggatagataagagtccaggagttcaaaaccagcctgggcaacatggtgaaaccctgtctctacaaaaaatatagaaaaattagccaaacatattggtatgcacctgtagtcccagctactccagaggctgaggtgggaaggttgcttgagcccaggaagctgaggctgcagtgagttgtgattgcgcttggcaacagaatgagaccttgtctccaaaaaaaaaaaaaaaaagtggtagatccaggatttgaactcaagcagttcaataatttagcacccatacttttatccaccacattctagtaccttccatcctccccctcctctttctgtcttatctatcctctctttatttaattgctatttcttatctctttcttcacctctgaagctggccgagaggcaccagagagttctactcacacatctcaatctgcagttatatttagagatgatctggctgagggagatgaggctttggaatcatacagacctgggaggaaatctgtgcttgggtcttttctagatgtatgacctgtgggggagttaattgctgaatcatcggaagttctcctggattctgccattcagaggtgggcacttgctcctctgtggcacagggaacctggtcctcatctctgcttcgtctctggccccacagtgtcaaactatgaactcccgaagggcagggccttctccttctctgtgtttgtgtttccagtacctggccagtcgaatgcctcactgaattgaattgaaattgcctaacccaatagccaaggctgggatgggctgacttagcagctttgaataatgggatgttgagtggctgcggatccctgcaggacctttttggttctatgggttcaccttttcggattcattagtagccagagtgacatgctttataagaacccaacttctcttctaggcgttagttcctataaaaggagaggctgagcccccaggaggcatgccaccctcttaaaccctgtagtcaacaaaatccttcaatatcttatgtctgaacacagaatattggtattgacacttggcaatgatgcctgaatggatatagggaagttggaagctccaggccctaacccagtcctacttgaccacttcaaaatgtattctttcctctgtattcttaattttgtacttgttttgttctgcagtgcttgattacagaaaatgtttttatctgcagtgtttagaatctgagctgtttagagtcatgatgatataggagttaagaaaaaattacttaggcagatagtgagggtaagatgtccttggtaaggttttccttttaataaaaagcagccccaaaatcattttcttttctaacaaagagtagcctgtaaaatcaagctgctgatatagacaagcaagctggaagcttgcatgggtgaatgctggcagttgtgccaataggaaaacgctacctgtgactaggcatgatcaaaatggtggctctgtcttcccctctctttgccagccacctgtacagtaaggagcagacaagatggcactggccaagtagaaaacccatttgtataataagattagggtggggcgaccagcctcttctgcaccatgtaaatgtcactcctgatcaaaccaatctgtggaccctgtataaatcagatatcacctcctgaagcctgcctctaaaatctgctgtggtccacctcaggcttggttttcccttcagattccactgtcttgcaagagagagagagatgctctcctctctcctttcttctgtctattaaactttctgctccttaacccacccacacgtgtccatgtcattaatcttgtcagtgcgagacgacgaaccccaggtatttaccccagacaacgatgccacttcaatgatatttctggaatggagacatttgtattcccaaagaagactgataggaaaaaagactcgatccagtctcaacaaattctgtttgtagtgtctgcccaactttctcatctttatagggttttaggagaaggaatgtaaaatgtatattcccagcattgcaattcaatgctttaacgttgttattgctgaaataagtaaatgaccaagaaccatcacattttatgtcctttattaggacataatgtggtcttattgaccactttgacattgctgcagtgttttaataccaacccccttctttcatgaacaaaacacaaaaacttgacttcagtgaatcagtgattggtcttttgaagccaggtagattattatactaccatgacctacaggtattagaaatccttcttcaattattacaatgacatgattcaaaattaaaaatagattaaaaatcatcttagatcaactccaatgtttagatgtttcagtattaataagacacttgtcataattgtttacatgtttgcctccccctaggactacagatttgaaaaataggagtagcgtgaatttatcttattttcactttcccatcggctcataccctattacttagccggagtcattttgattagctattaaatgcccacatgggctgcatcctcattaccactcatataagcatttaaaagctttccatacattattttattgaattcttataaaaataccctctaaatatattccctctgtgaccttgggtaagtttcttagcccctttacacctttgtttcctcatctgtaaagtggggctgatgatagacttcatagggttagtgtgaggatttaatgagataatgcatacaaagtgctcagaacaccagtggatacacaacattctccaagtgttagcctctctcattatagcacagatgctccttcctcctaaatgtctttgccccacctccagctctctgtttagcctgtatctctgtattttgcctataacctgcagagcagggttaaacacttttatttatgcttgtacttgacttcttcttttcccaactaatggttcagccatatcttaatgttggcttctgtttgtttgtttatttgtttttacacctctttcttatattggctctctatctgcccattccagaacgcccccgccttcatacttctctttttcccactggtgcagacttgcctgagccacctccacaaggctgctattagcaaacctctgccctgactccctggggtccattctcagttatttacagaaatgaagagccttacataacccacagtattcatctgcattctatatctgaatttgtgtcttcatgtggaattgccaaatgctgaaataatttacagtgagatcctaacagctggtctccccatcctgtcccctcccctgctcagcttctctttgccaccctattcccacccttgaaaggacaacatcgcctctcagatgggtaggtaatagtaagaaggagtgtgtgcagggtgagggtgtgtacatgcactgtatgcattgtgggagctatgacaaatcaaaaaagagaccaggattcacagctgagagagagggggatgccctggggcccagttgctttgaggccatggctggcctggtgttgctagatcttcagttttcagaagaaactagaaaactggattttgtcaaggctctagaatatggtagaaaggaatccgacatatattaaacccctctgtgtgtgaggcactgtatttagtgctgtacatatgttcttttattaaattctcaaaataacagagatgaaaaacagactcatagaagttgtctagcttgccccaaatcatacacctagaagggccaaagcaggaatttgggcctagatgctgcatctatttttatttaaaagtccatcttttccatctcctgctgggctgcaaattttataaaggcggaatgaaggtcatttcacaacatgtgtgtaagccataagttttatcctctacaggcaagttatttcttagagaagctgcaggctggtctctgtccttatttaaaatgcagggacctctgggagccataacacattaggctttatcagttactacgacagcttggatgagtttacctattcattttcaaataggagctatttcatagggaaaacaacacaaagggctaggtgctgagacagggaagattgaggaggtaaacccagagttggatgctgggccatctgaaaaggtgggtctctggacacctgctggggcagggcagctgtggggagggaggaagtgagaagcaagagctgtcaaagggaagtgagggattagctcctccacaggttgtgcggggtaccttacagactagctatctccattgtacatcctggcccatgtcaccctctgcatctgagaagagggaagtggaggagcagagagaaaagaaggtggaggaaagaaagcaaggtggcgacagtgttacagtgggtataatagctagtcaggcatgagcagggcaggagagggctcccctgccccaggaatgtcaggagaccatcaggtgattgtcaggtggctgttaattgtctctctaaaataataattggttacagccagcgccagggaaaagcagtctcccaatagatagaaaaaacctgaaactggtgatgagcagtttccgataagatctcaggagttgggcaagtgggctcaagcatgcgcattaagaggcaaaatggcagcgtttaactggtacttgaccttctagaaacattcagctggtaaggcaagaatgcttcaagggatcgtgcgtacaactccggtaagcacactgcgcatgctcacctcccaaatgctagcagggcactgcacaagcggacagcccacacaaaggaagaatcaggggagaagggacaaaagaccccggaagtgtgctagtgtataaaaccccaactcaaaggtcaaacagcgcactggatctctcaagtcgtccgcttggccctcttctaagtgtacttgacttcttttcattcctgctctgaaacttgccttggtctctccttctgccttacgcccaggaggcaagaattgaggttgctgcagacccatatggatttgctgtcagtaacaacaggacagagaagcaaaggagaataaagagagaggaagaacatcttaggaaggaaagaagagattcacaggaaaccccagggaagaaggaggggataatatgaggggcacagactcagtattgatattttaccatacacctctagtaaactgacatatttacaataagccattttggagaaaaccaagtccctttggtataatagtggagagttagagggggcagtcaatagcaggttgtaaagaaggaggacagccagcgggcaggctgtcctggtcgcttgccccacccccctctgtgtcctgggaagcctttggcacagatttactttacctcatcctcaaggaggcctttgggtttgggtgggacttgaggtttctgcaaagcagtcagggccggcagggtggaggtgagccttgctttctctgaaggccagctgggcttactgggaagtgtcttgctgaagggtggggaatgcctctggcttgatcgattgtcttgaaaggaacaaacaaaaaacataacataaaagaggctctggatcatttcctgggtggaagccattgagatccagaaagtataaaaccacgggtgtctatgtagccacaaatgatccacggggcattccttgaaagagtaaagtgaaatgttaggcccaaaatttcaactgcttattgacttaaacgacaaaaactggaagaacgtcctcattaaaaacatccttccggggcagtgatggacacccagaggttcaggagaaccaacaacccaacacttggccacacagaggggatggaagcagcactggagggcacagggtgggggtgaggtgctcctggcttttaaaaatgccaaggcctaggctccaccccagcctggcaacgtttgaactcctcgggaggagcctggcattacaggttggaaaagttccccaggttatgctaaagtgtatccaggtggtgattactcacgtggatcaacttccatgctccttccctcagtgatttcgctccattcacagggaatctgtgggatccctttggtccaggactgtccttctcatcaggtatcagaaaaggagtcaggctctaaggccaactggatctgagttctgtcccttgctctgccactcactagctgtgctctttggggctggttattcaacctctctgggactcacattcttcattgttatttttaattttttaattttttatttttttgagacaaagtcttgctctgttgcccaggctggagtgcagtggcatgatctctggttactgcaacctccgcctcccaggttcaagtgattctcctgcctcagcctctgaagtagctgggattacaggcacccaccaccatgcctggctaatttttgtatttttagtagagatggggttttaccatgttggccaggctggttttgaactcctgaccccaagtgattcacccacctcagcctcctgaagtgttaggattacaggcatgagccaccacgcctggccaacattcttcatttttaaaatgaggatcgtaatatcgaccttagagatcttgaggggattaggaagattgcagtgaaggcagtaggtacagtgtgtctgcctaataagtagaacttatatcacctgtgccatgtgagagaggcgttaggcggcctcaagtctacccagtgattcagtgagctgagcatagattcagactgatgtgttttaggaaaatcttggcataggaataacctggcatgttcttcatactgggaacagcacaggtgctagcactggcctctggattgcatcactggcctcttgctgctgcttcctgtgacagccccacctcgcccggtgcagctgtccttgcctgttaggccctcgcctctatgctcctggtgcctgcccctgccctcagccctcactccttgttgaaggtatgtggttaacttcacctccgctgcctcctcagaagcctctttctggtggtgtggctgtactcaggcatgagggcatccttccttctgtgcctataactcttgtcagttttatttgcagctcctggagtttactcagatttctgagtaaacaaatatttaatgtaatatttaagcccatcagaagtagcaaaacacaggagacaggctttgaagagtgtgatttttttttttttttttgagacagagtttcactcttgttgcccaggctggagtgcagtggtgcgatcttggctcactgcaacctccgcctcccgggttcaagtgattctactgcctcagcctccctagtagctgggattactggcatgcaccaccatgcccggctaatttttttgtatttttaatagagacggggttctgccatgttggccaggctggtcttgaactcctgacgtcaggtgatccatccactgtggcctcccaaagtgctgggattacaggtgtgagccaccgcgcttggccaagagtgtgttcttgagtgagccacttaaccaccctgaattgcagtagccctttcctccccagggttgctgtgatgattgaaaaagatcattcaccaagtatggtgggtggtgcacagagccgagttgtgatgagctgggcttcggaagctgagagccctggcttgtatcccagctccatcacttagaggatcttggcccagtcagttcactcctctgacctctttcaggattatcgaggaggttaagtagacccccaggggaaagcactaaactgtaaattagaagatctctgggagtatgtgcatcttgagtgcagctgaatgctcagtgcttagcatagttctggtgcatggcaggtgctcaaaagatcaactgtggcaacccagtaagcccagctggccttcactttactttcattcagtgaagcaaggagcagtgcctggtacactgtaaggagggggttaatggcagtgagatattacatgtagagccggtccatacaaatgctggcatcgccatgaccatcacagacatacttgctctctgaacctttggggaacttagtcacctgccaagactggaacaaagatgggcattaaaatgcatacttggggccaggcgcagtggcttatgcctgtaatcccagcactttgggaggccgaggcggttgtatcacttgaggtcaggagtttgagaccagcctggccaacatgaggaaatcctgtctctactaaaaatacaaaagttagccaggcgtggtggtgggtgcctgtggacccagctactcgggaggctgaggcaggaggctggacccaggaggcagaggttgcagtgaagcgagttcatgccactgcactccagcctgggtgacagagtgagactctgtcgcaaaaaaacaaaacaaaacaaaaaaaaaaacagacccaagctgtgtccatttaacccatgaggcttattccaggcttggggctcctgagcacctgtatcccctggtaaaaccgcatagtctggactaggcatgggaggaaggtgaggcagacactgggatcctcgaaggtcattgttttgtacagacttcttaagagaaatcccagaaccttgagcacacgaagccctaaaagtgggactaatctcagggttgctttcccttggagtgttgggagggagcacaaccatcagggtatgctgggtttgttgtttgtttgtttgtttgtttgtttgtttatgcctgctttcaatgttcccaatctaggaaagacgcctcttcccctggaatgggaaagccctacagcttgggatcctttacctcggagcccagatcccctgcttggaggtggcgggagcgggcggctggcagaggccctcaagcagcagccaggtttgtccccaccccgcaatcttggacacccccacctccccatgggcctggaaggccgagtgcccaggtctgcgggggacctcacctatatactcgcctctggcgaagggcagggctgggtgaaccggcctggtttcctgctctactggaggcggctcgtagctgtcatcagcgttctcctcggcgggcatcacgtacatctctgagtccgagtgctcatctggattttcatagtcgctgtcctgcaagtgcagatgcagacactgtgctcagcatccccgtctgtgctgcctggccgtcaggaccattcctgccttgggaggccagagcagtgacaggagacaaggcttggagaggttgacttcaaaaggctaggcagccgataagaggcaaagctggggtttgaagcaggcctttctgcctccaaagtttatcgtctccaccactgcactgtccttgggggacacaggaactacttaacgctaatgggagctgacactctgtagatccacaacaaataacaagaggagataataaaacatatttttaaaagataggaaaatggcccaataaaatagaataaccaatgggttttatctattatgaatgctgatcactgaagagaaaataggtttaatacgaagagggtgaggagacacacagggccagctagatatctttcagatgagattttttaaaaatttcaagcagaattggtaagctgcagggtcaaggcttcaaatggactcagggtttgctctcttttttttctttttttttttttcctgtttttgagatggagtctcactctgttgcccagactggagtgcagtggcgcaatctcagctcactgcagcctctgcctcctgggttccagcgattctcctgccctagtctcccaagtagctgggattacaggcatgcaccaccgtgcctggctaatttttttttgaaaccgagtcttgctttgtcgcccaggctagagtgcagtggcaggatctcagctcactgcaacctctacttcctgggttcaagttattctcctgtctcagtctctggagtagctgggattacaaattgcaccaccacgcccagctaatttttgtatttttagtaaagctggggtttcaccatgttggccaggctggtctcaaactcctgacctcaggtgatctgccagcctcggcctcccaaagcgctgagattacaggcatgagccactgcgcctggcctgtttttttaaaatccacatttcatttaagtccacactgaaaatacattgtcacggtctgaagtccaaatggcttagaaggatataaagtgcagtctccttctcagcctctctgcttctcaccgcagaggcagaaagagtcactaggtttcttgtgcatgtttttcagaggtagtttatgtatataccgtttgtacatatattcatgtggaggaaatatttgactcaggacataagaggtcctctggcctctgtgtccaccgccctcacactctgcctatcacattgcatgatctgtacatgactttccacttgctctttggcctgtcgcctttcataagcaattttatatagcaggattttttttcctgttggtctttaaaaaaaaagaattgtaggggtacatagtaggtatatatatatatggggtatatgagatattttgaaacaggcatacaacgtgtagtaataacatctgggtaaatggggtatccatcactcaagcattcattttttgtgtgtgttataaacattccaattatattcttttagttatttttaaatgcacaataaattattgttgactgtagttaccctgttgtcaaacactaggtcttattcatcctaactatatttttgcacccattaactgtccctgtttccctccccccacctgctgccccctcgaccacccttcccagcctctggtaaacatcattctactgtccgtctttatgagttcaagtgttttaatttttagctcctacaaatgaatgagaacatatagcaggatttttgtttaaaatcaagaaattctggaggctttattaacaagcctggatttcattctgcgtgcagtggggatccatctactgaagtcaaaagagctgtgagtgaatgcttactcagtctttagtacagctggtatcttcattttggttgtctgattttggggcaagtaattccttcctctccaggctgattttattttgtgctttctaagttcccttgtgtgctctttttcatccagccagcttgctcagttttcttctcttacctctgcatgtggaccaagcaatttctttgctttacatgtggctgtgtgtgtgtgtgtgtgtgtgtgtgtgtgtgttcgtgtgtgcacgcgcgtgcgcagccagcagggggcgcagctgcagtgcatctcagggagctgcggctgctgggccccaggaggagctccatgaccaagagatgggcagaaaagtcaccccttcccctcatttttcttttctttttctgcagttgaagaaggaggaactcctgtcttctgagactctgtataaactccaggtagtgtgcacagcccagggctgggcacaggactggaggtctgagtcctgggttctcattccactgaactgggtgattttcattctcttggcctcagttttcttatctgtgaaatgggtatgtggttgtatggaaggcttcttggatcccttccagatctaaaactcacaggttggagcaggctaacattctggatgaatttgatataagtgaggaataattattgtgaagaaaagtttttaggatgtcaggccttgcacatttcagagctacctcaaagagataattctgatacaacatccccagtgtcatcatggccaggtccctctctctgtggctccggagctctgctaatgttctcttgatcacagcaagcaccttggtggcaaagagcctggtcctgagatctgagggcctgggtctgaattgtggaactgcaagtgactgaaactttctagaccttggtcctggaggccccctgatgtgccagacacttattctttagttgttggttcgtttagggctcctgggcaggggtcaggcagtgatgggcactggggagtttagggcagaggcatttgctaactgatatggaaacatttaaacatttttacacctgttttggatgtgctggtgagtactctgaacaccagcactgaagttgggcataagaacacctacctcaaaggtttaaatgaggttatgtgtggaaagctcttagccaggcgcacactgagtgccagtcaagtcagctggtatgcagtatgccttgcctgtaggtgacctttccaagtcttccctcttgggacgtgcggctgaccaccagcatgtaattcagaaataagatcttcaaaaggcctcccatgggaccctgatgccctcctggtcccaggagcaaatacttacaaagtcatcggaccactgctcctcttcgtcagcagggctctctgcaacagcaggggagaagcagaaggcacaagtgtgagcctcagctggccagccccagcccatccacacacatttcgcacctgccttcccttccctttgggctttctggtgccatatacttgaccttgggttagttactacaatcatatgttcacttgcttttgactttttaaaaaatattaattctcaaagcatagagagaagtcccactgggcagagcaatgtgcgtctgatccatgtgtgggctttgttaagggacatttctgggtcccccagtagagacctacaattcatactatgtggcttctaaggacttcagaggatggcgtagtaggaacagcacaggacagggaatcagacagacctaagttcttatccaggctctgttccgaatgcgttggagtgtgggcaagacctctaacatctctgagcctcggtttccagatctatacaatgaggggatcatttctgtgatcatctctggctctaactttgacttttcttgttaaaaaaaaattatccaatgtcttagtatgtgccaggcaatattatcagagctttgccgtcttttagccctctcaaagacgctgtgaggggctgggcgttggggcttatgcctgtaatcccagcactgtagtcccagcactttgagaggccaaggcaggagggttgcttgagcccaggagttcaagaccagtctggacaacatggcaaggccccatctctacaaaaaataaaataattagctgggtgtggtggtccatatctgtagttccagctacttagcaggctgagatgggaggattgcttgagcccagggggtcgaggctgcagtgagctgtgattgtgccattgcactctagctgggatgacagagtaagaccctgtctcaaaaaaaaaaaaaaaaaaaaaaatcacctaaaccttgtgaggaaactgaggcctagagcagataagtcacatgcccaaggtcagatagtgtaataaatggcagagccaggagttgaaccctacaggttgccttccacgggcatgcgctgagcccccacatggtgctgcctcgctccaggggcaggaggtgccgtcctgggctctgcatgggcatagaaaaatggatatgacaggttgtggcccttaagtagtttatgagcttgtagaataaaataagtctgaattatgacagcccaggcgaatatttgacccctttccctccaaaacacatttagagtatgagaaacttagcatctagcctatcacataaactgaccttagaggttaaatgggattcactctgctgtgtaggaatcaagcagacacaggcccatgtggcagagtggctccatgacagcaccacagagggtcccagctccctcctgccccgctgagcagccactgccacagaggatccagtggatgttcctaaatttcccagaacctcaacagaaccttttctagttttatttttatgtttttgctattccccgctgagtagccactgccacagaggacccagtggatgttcctaaatttcccagaacctcaacagaacattttctagttttatttttatgtttttgctatttctacccctgccacagcagaccaccggactccagagagtcaaacatttggggtctccagaggcaccagcaaggaattgcagaggtgaaatggggtcaggaaggatactgtgggatcggagtggccacattttaagcaatggcggcagcagcaccctcttttgggaaaaacatgataggtgctaagaaagagcctcactctacaagccaaacatgggtcacactttgacgtgaacagaaaagaattcttacattattctttgggttgactaatgctgaattagagtgtactgcaatcactggggttggccaagaaactctagaagattgggtgaataaatcctcttcccaatatgattacctggcacaatgggggagtatgtttctttttcttttctagtctttttttttttttttgagacagagtctcactgtgttgcccaggtgggagtgcagtggcacaatcatggcttactgcagcctcaacctccttggtgcaagcgatcctgctacctcagcctcctgagtaactggcacgtgccaccatgcccagctaacttttgtattttttgtagagatggggttttgccatgttgcccaggctggtcttgaactcctgggttcaaatgactcacctgcctctgccttcaaaagtgctgggattacaggcataagccactgcatctggtcaatgtgtttctaataccttaagtctggggatcactgaagatcaacacttaagatggcaagagtttttgtaacaaccatttaaatagaaacccttataaaatgcctttatgaaacccacttccctgcctggataactgcatttgctccaccctttctcagtgagtgggggcctattttatgatcagtcactggtgaaagtagtgcattagccatctaactagtgtccctgtctccattatctttcttctccaatccatccatcctaccgtttgtagttattttattaaaataaagtttggattatgctgttcctttccttaagagtcatcagtgactccctatggaatcaagtagaggttctgtggcaacacattccaatgcctctgccttctgtcccaccaccgacttcttgcggcaggctcccacgctcactaacagtaacaccagacagcttcctcctcccgttgtgcactttgctgattctctgctctgctcgtgccgttcctgcagcccatcttctttcttccatggaaatccctatcactcctcctccacaaagtctaccacagtctcttgtcataatcaatcacttctttttctgggccctcttggaagctggtggcaccgtgatgtcacatgtacttcgttctgtcctgtgctgtgattaagttgttcatgtctctctgtactgaaaataaggcctatctaatttatctttgcatctggacagaattttgcatttgtaattaatgtattaataaatgtgtgaactaataaatgactcaaacaaaggaacattaggatagcaacaatagattccatttactgaacacttcctatgtgctgggtgccaggctaagtgttataaaagtgtattcttataacagcactatgtggtaggtgttatttttatctctattttacagtggagaaacttggttttgaaagaggttgtaaaacctgcctgaggctacttggctagtgagtttgggagctgggttggaagccaggctgtgttggctcctgcagctgaaatctcatctgagccacttagccctctgctgagcacttagataaaaccttggtgaaacgagaatgacccaatccagacatcttggcacatggagacagaaaagagagaaaagcatcatacagtatgggatagaggttgtttgttggtgccccatcgattcctagctagactatctacttcaggtcccaagtgcaactcacagcatcatattcataaagttacagtcttgcaggcaattgccaagactaaaaagcatgggagtccgaggtattaggtccaaaacagtagtcagttttccagtatctcagggagcttcccaaagtgcacaggtggtagtttagagccaggctttctaggttcaaatcctggctctgacctttacaagctgcttggtcttggaccaataatttaatattgtttaaagcttcatttcctcacccgtaaagcaaggataagaacagtgcctgtatcatatttttgtgagaatcaaataataaaatacatctgaagctcttagcaaagcctggcacacagtaatgctttagtaatgttaccgtcatcttgagcattgcaaagaatgcctcaattaacactcaaaacaccactgattctaatttactcccacgtcaatcacacactatggctaccacaaaggcatggatccaagaaagcctctattgtagtgagtaaaatttgggggagaagttcaagcttcatgtgggccaggtggattgattttgtttgtgtgattccatggtctctgccaggaagctgagatcctgggcgggccctcttgtcagttaaagcctttcctatggtgtggtttacctggtttggggcttatgctccatttaccatgtcataatcccatgccacacaatagagggactcctccctttgcctgacccaggttttaagattcatgtagccctccccagcctgtgggcacagcaccagacacaaggagatgtgagaatggccacagcggcccacatttgggcttaagctctggggtcagactgcctaacttagaatccttattctgccattttctaggagtgagatcttagctgaattgcttcacctctgggcctcagcttcccctttgctaaaatggacattattaatcgtgcttagaagagtatctgacatagagtaaagggctcaatgaatgttagctattacaatgaatttacagtctctgcaattctcagaacaatctaaaggataggtattcttatccccaggtcagaaattggaggctcactcaaattacaaaactgttccaagttcacacagtgcttagggagcaaagccaggattccaacccaggcctaaaggacctcagagtccaaggtcttctcaccaagccacacttcataatacaaataaagactaagggccagaagaatgaccacatgagactgggaaaactcagggccatgtagttttctgagaaatgtccccacacctggaatcattgccaggagcggggaaagttcagagaaaggtgtgcccagtgacagccaaaaacttgcatgaggccatgtgcccgaggtggggccgaatggggccttgaaggatgagcaggatttgggtgagagaataaggatgaaggagtgtgtcttcctccatcatctgagagaggggcttatgtgtcagccccagaagcagggcttagaggcagatgtgtgcagaatgaatgcgctgggctggagagggacaggagattctgctgagcgctcacacaaatctgatgtgctgccggccagtgggggctccagccatagtggacaccgcaggctccagtgacaagctgagatggggagctgatgaggttggtgtttaggaactcaggcatggaaagacgaaagctgatccagaccagggggtctgggaatgggaagggatggctggaaggacagtacaggactctgtggtggtggctggggcaaagggagtatgaatccagcctctcagttctgagtcaataggagcaccagagcccctggggcagatgctggtggcatcacagcatgtctgacattctgcctcagctgcagccctgatcctgctctggaggctacccggccgccagaccctgcccatctctcccccaacagagcaggtggtggcatgcagggagccagtgggaagaccgcagcaggacacagaaggaaggaaagagggagggtgggccagttgtggtggtggggacagacaccgaaaaggaacagaaagcagaactacagaggctgcaggggaggcggtgggtggccagtcccaccagtgccgccctaagaggagaaagggacatgatttaatgtggggaactgaggacaagacccagattcaggctggctgagagaggtgttctgagtctaaatacttaacatcttaggccaggcatggtgggctcacacctgtaatcccagcactttgggaggccagggcaggaggatcactggaggccgggaatttgagaacaccctggacaacatagtgagacattgtctctacaaaaaagattttagaaaattagccaggcatggtggcacatgcctgtggtcccagctactcaggaggctgaagcaggaggatcacttgagcccaggaggttgaggctgcagtgagccatgattgtacccctggaccccagcctgggtgacagggcgagaccccgtctcaaaaaaagaaaaaagaaatacttatcatcgtagaaactccctttgtctgtatgtctactcatcccttcacaggatcattaacagaggggtgggggtacagcaatgggggacatagtcctggctcagccatcacctcactgcatgacctcaggagtcactttgcctctctggtctccagttattcctaaaatgagaagcttgggttgggcaatccttcaggaatttctaagctttaaaatacctttgagcccaagtgtcattcctctattcttagttccctatggcaggactgatgttggatatagctctcccatgtcagcgtaagaccagtacctccaggggaatatggacagggagacagaaaaccaggtaaatgctggctccactaggagcaccaggcccatgacaaaagcaatgttaaatctcacttctttagtggacaaaggattgttatgcataccccatacttctgtgtgggcatttacccaagaatccctgtccaagtgccttctttgctctggatttttatttttttccatgtaagtgagtttgccacccctccaccctatatttgctctgatctcctccctgcatgatagcagagccagaggagtcacacgtggacctcccagggatgccaccccatcagagccctggacatcagagcccaagagtgcaagagaggggctctgttcagttctgactcctcaaggacttgtggggtaaccaatggggcatctgcagtgatcccagcagactctcgggcaccatgactggtctctccctgacctccatccccagccagacctcagacttcaaagataccgaaggctgttcaactgtgaaagctcaggaactgggaagcgagttcttgcattaatgtcaggagctctagtgccttcagaataagaaaaaagttcccccaaaagcatgaacacttgagcttgggtcaaagcaaggagctgcaaaatgggagtctgggatgggttttcctcttagtggctgcagtcaccttggacaggatacttaatgtccttgagacacattttcctcatctgcaaaaccgagatcgtaatttctatataacggtgctaatgagaagattaaatgagatatgtctgtgaagagcttagcttaatgcccagaacagagtcaatactcaacagattttggatatcttcccttcccacagcaatgccagctgcttggggcaatgcattctgcccagtgggccagcagttccttaggggcgatgtttcctcctcagggaaagactgaactgggattgctgggtctgaactgaaggcagcaggctccacactggcctgacctgcatccctggaggagacccagctctccattctttgtgtaattcaagctttgtccttctgtactctaactagggaagagggtatggtgactcttttactgacctcctgtggggcagttgctggtcctttctatcctctgctctctgaaggtcagcatcaccaaggtcaacacactcttggcttagagggttttgggaagccatttgtttccagaactggaaagaggacataaatccaatgtgtggggggaaaatggctggagcatttcaggagcctttggtggatcaagtgctccacagggcacgtgattggcctcccaggctcaggaggtctggtgggctctggcctccacacactacagtttccaagatcctaaagactccccaggttcaggaggagctctcagggctgatttctgaggccctggacgtgcagctgtgcagaaacctcaaggctcaggggaagcagctggaaatgctcctgggatgtgaactggggtgggggagagaacggcaagggaggatgctaactgcaggtggtgatggtggttttggaccatttccggggattgagtgtaagagcaggggaaactgggcaaggccccagtcatctggcaaagcaataagatgcatttccgagaccctggaacatcaatggatttgcaggggtcagggattgagggaataaaatctacgtgtctttcagttcaggaaaggcaatagggacagagatggtggtttatagcagggtttcttaaatatgatttacattcagatcccctggagatcttgctaaaatgtaaattctgatccagtagttctagggtggggccaagattctgcatttctaacaagctccagatgaggttgatgctatcttgctgggaatcaaactttgtgttgcaaaggcttagaagatcctgttgggccacacttctgcattccaggagagattaaatgttctgacatcaagactatttggaagggttccaggaaagggagcaggtgtctgaggacaaaaaagagaacacttcagagcatcagggatattggaagatgtgaatgcctaaagccagggaatgttaggagaggctcactttatcactgggccctgagccccagagatctgtgtttctgcaggagtgcagaataattagtattagaggggacctgacagatcttctagttcaggcctgcataatatagatgaggaaaggagcatgagatgcccaagattacacagccagttagtggctaagctgaaagaccttgtatgtgggctcagtggtttgcagttcctcttgttagcaatgtagagccatgaaaagatttaaagagaattttatttcagaacaattttctggtggaagttgagaggaccacatgcaatcaggaattaagcagattacttagagccttctaccctaggacaagcaagagatgatgaaggccttagctgtagcaatgggaatagagagggaaaaaatatttaagaggcatttaagagcaaatcaatgagatttggagattaatttttgtagaaggtgagggaaaaggaggcatcaaggttgatcccaagtgtgtgggttaggcaaaaggatgaataatagatggatgctacctcccttttccccacgcagaaatagagggaaaggagagggcctgggtgggtggatcagcaggcagacaggtgagtgtgaggggacaatcaggagggaggtccaccctgaaatcagatatgtcagtccacttaggtttccaacaattgactctgaactcctggaatctgtgtccagcatctctgatgctgttggttcatctaaaagtggcaaatattcctgcacatttgtccccgaatcctcaaattaaatgtcaccttctcagacagatcttcccacaccacctaagctcttctcctaccccacactgattccccaccattgcactcttccatcttccctcacagcaggtaccatgtttgctaatttatatttacctgtttgctttcttgtttcttatctgactccccactagtcattcagcactgtaaggtcaggggttgtatgttgttccccactccagatctagcacagtgacagtcacacaggacacactcatgaaacacgtgttgaatgaatcagaaaatgtgcgaaacagctgaagcacctggagatgtttatcccagagaagaaaccactcagatggcctaacttcttaattctctcctttgaagttgcacaggacaactctatttttatttttcttaatatttttttcttatattttaagagatgggatctcgctatattgaccaagctggtcttaaactcctggcctcaagcaatcctcccatcttggcctcccaaagtgctgggataacaggtgtgagcccctgtgcctggctctacttttcttcatatttaaaggcttgaactgtgtggccatcaggatagacataggaagtcacaaggaaattgattgtatctatatccagccagggctgcctgtcccttgctagaccatgggaaaccatcacagaaagtgtccaagcagaagctgggccttgtgtgtggaggtgaatggtggtgggataggggttaagccctggatcagatattggtctacacgacctctggggttccttttaaacccaagactccatgattttataatttgtccatcaaacttatttagttctttaacaggttgagtctgctttggtttcttttctttatttagaacttggaaggaagaatgtgtttgttctcatataactaggaagcttccttgacttattgattaggtagatattaaagcccagaacagggtccctcttttagtgccagactgtactggcatcccctgaccaactgtctaaacttgctgactgattggcagggtgatgccaataactactctgtgaattagtgagtggtccaacaggcctgtaaccagacttgggcaggttggtcagcatttctcagtgtgataagattcccttaggaggaactgcactatctgacttattgctatcttgatcagtggccgaaaaaataaaataaaatagtaagcatcatttaaggttatggtttggttttaggctgttgccctgttgagaatcatcaatgatgtctgtagctctgtggttttcactgagggatattcaggaaatctttataattaatgctatagaaagagattttaaaactatcttccaacgtatttgttctaataaagaaatgtgtattgaatatttcacttggctcaccactgccagaaacactacaaatctcaaaactaacccttctttcctgccaaagttgatcctagttggaatgaggttgcaggctaaacttggagaggactgagagtcagcaatgtgccagcaataatttattacccccaccccttcaacaatcctcaaatatcaatttaaacagcttttgatggaggaagtagtctcttccccacttaccccacactcccagccacagattagattcattagtgctgctgtggaattccacccaactttgtgcttcccctatcactgaattgtaattacttttcttttctttcttttttttttttttgagacagggtctcactctgttgccctggctggattgcagtagcatgatcacatctcactgcagccttgacctcagtgatcctcccacctcagcctcctgagtagctgggactacaggtgcatgccaccacacctggataatttgcattttttgtagagacagggttttgccatgttgcccaggctgatctcaaactcctgggctcaagcaatctgccttcctcagcctcccaaaatgctaggattgcaggtgtgagccactgcacctgggcctataattacttttaacataattgatatggtttttctgtgtacccccccaaatctcatcttgcattgtagctcccataattcccacatgctgtgggagggaccttgtaggagataattgaatcatgagtgcagtttcccccgtaccgttctggtggcagtgaataagtctcacaaaatctgatgattttatccagggtttcccctttctcttggctcgcattctaccttgcctgccgccatgtaagacatgccttttgccttccactatgattgtgaggtccccccagccatgtggaactgtgagtccattaaacctctttttctttataaattacccagtctcaggtatatctttatcagcagtgtgaaaacagactaatacaataatctatcttcccttctggactataaattcctcaaatgtatagtctatctttaacttttagcactgtattcctgcctcagatctgtgtgtgcctggcacatggaagatgtttaataagtgaccaataaataggtgggtggatggatggataaaaaaactacatctccactgtagtcaaaatgcctaatagatttagtcattcttgaaattagaaaagataccttttgttttcaaatgaggatagcgtatttccctttccataagcctaaatgtaaatatgaacattaaattagtcaagagtcagttaaagtatctgagaaataccttacctgaagcgtagtcccttcgaggaacacttggaggtgctttgacttttagcctggaaataacaaccatgagacaaaaggtcagtgagcagaacaatgatggtcaaagccgatgctagaagctgatatagacagaatagatagacaactaatagcataatggcttctcttggaccaatcaatggacagatttgatgtattgtaaatgtagtgaagccattagtcaggggttttccacctctccccatctccccagtgcatgcacaatgtggctatgacttggcaaaggtgaagtcaggtggagaagggctcagagaggtcagaatatgatagtaataagcactgagttcagaggttcaaggaagataaatgttgattggttggtaaggtaagtgttgataagaaggtaagataagatggactatattttaatgacttacaaatgtttaacaggaaaaaatcagctacaataagcgttttggttgtaggttgggctaaaattatgtttgcaccattttaaaaacgcaaataagccagacacactggctcatttctgtaatcccagcactttgggaggccaaggcaggaggatcacttgtgcctaggagttcaaaaccagcctgggtaacatagtgagactccatctctacaaaaaaataaacaaaatgagccagccatggtggcatgcacctgtggtcccagctacttgaggggctaaggtgggaggatcacttgggccccagaggtcaaagctgcagtgagccatgatcacgcccctgtactccagcttgggcgacagagcgagacactgtctttaaaaaggaaaaaaagccgaacaagtgaacagtgagtgtctcaggattggagattatgagacttagcatatttagtattcaacttgttttaagcactctcaaaactttactaaagtaaaggtgctttagtacctttatgcacatatgaaatgtgctagtcacaatccttcttcattcaataaaagaagaaaattgaaattacattttagaaaactattccaagttttgtaagttctgatacctccctttccactacttgaaatgagtaaggtttatagtcaattatttttaataattattacccattttaactaagaattatttgcttaatgaaatttaaaatatacataaataaaacttatatccagtagcctttatttactaaaatatcatatccttctatagaagcagtataactgctattatatacaaactttcatgttttgaaaaaaaaagcatagaaatttgtgtttgattaaaaaatgcacacaaaaacagtttacaaaccaaaattgtaatttgcaaaaataacaatatgtatatttacatagaaattctggttttctttttctcataggctctcaatatctattatttcattcaattctcctcacaagccagcagggtgggctgggaagatactatcattagtcccatgatgaggtatagagacagagatcatccaaggtgttgcaaggaagaaaaacaaaaacaaaactgggtctggtgcccaggttggttcaaggaatagtaaaatttccaaaagcacaaaccacctgttatccattattactatcatttcataaaagaaaaggaagggtattttactacccccaaataatctcagaataaaggaaaaactcactaaaggactgttggccactcaacactaggaataaaaggcgtagttgaactttgctctgtagctggctgctgtgcacaacccccaacacttcatgctccttattttctcatgcggccatagaccagtgaaaactctgtcacagtcttgtgttagggaaccagcgtgttcaagcgtgcttcctccgttcagggtagcacctgtggcctggcttcaagtaaaagtgtaactgcaagtcactttgagctaaagggcccctgacgtcacccggggtaatgactatggtggccataatttccaggctgagaagaaacatggtttgtcatgtaaaagtgctttggtcatccaatgggcagaatgtatgaaacagaggctgttataaaaaacttgagctccacagctgctgtaaatatgactggctatggaatagagagacattttatgcagaggcttcatgttattgagaactggtgtattgtaaaactggcaactgggggccatggaatagagaaacattttatgcagaggcttcatgttattgagaactggtgaactgtaaaactggcaattagaattgctagtgattgtaacaaggactgtctcataaagaatgagattctatctgtagcagaaataataagcaaaaatcatcacacacctctcccactcatcagacagaacatgaagccaaattctcctcctctgtaagatgaccaccacctcacaagcagaaggccatttatgtttgatgatgatcacttatgcatagagactcatttacatttcatagtctggaaataccaccaaaagtgatttcttatttttaattttagcatagattaaaacgaataaggatgctcttttgaatgcatagagaaatgaacttctataaactattttttggtccaaaatttggggagaaaaatttggtaatagcaattaaaactttaagggcacaacttcttccatttggaaatttcattttaggaatttagcctactggtatattcaaggtctgcaatgaacatttattaaagtattattcatgacatttaaattggaagaaacaaccagagaattttgattgctattatcaaattgctatccaaaaatgttgtaccggtttaaattcaaatccccccttaaagatggccaccaatatatagctagttaattgaattataatatatttaaggtagactattaaatcatctgttcagaaaagaatatggttaatttttacttactaacaaataaagatgtccatgaaatagcttaagtaaaaccaacaaagcaagttggtagaatggcgcatgcactatgataccatttatgacgaaaatgtatgtgtatagtatgtacaatgtcagtgtatgtatgtatgtgtttaagcacacacatacatacatatatacatacttatacacacatacatacatatatatacacacattgaacttaccatgacaatgtccctttctggggagtgggttaagatggagatataaggaaatgggagattttgacatcatacaattctggcctctttgattttttttccctggtgaatctgtattagttttatttaaaaaatttaaagacttaacagaataccatttcccattttctcttgaaagagacttacctactaaggtatataagacctactaaggtacgtctaccttagattttgagtggcaaatgcagatatgtacaatttttattctctttaaaaaaaaaagcttaagagtttttgatgtacaaggagttttgagatgctaggctttccctctccaagtgccaattgaaaagttcattttcaggtaataattcgaaaagcagaaatcaaaatatggaaaactggctgagcgcagtggctcttgtctgtaatcccagcactttgggaggctgaggcgggcggatcacctgaggtcaggagttcaagaccagcctgaccaacatgaagaaaccctgtctctactaaaaatacaaaattagccaggtatgctggcacgtgcctgtaatcccagctattcgctgggccgaggcaggagaatcgcttgaacccaggaggcagaggttgcggtgagctgatattgtgccattgcactccagcctgggcaacaagagcgaaactccatctcaaaaaaacaaaaaaacaaaatcaaaaacaaaaccccaaaaaaaggaaaactcacatggcatcttgaagaagctagggctgtgttttgtaacttttcatttggatttctccatacatgttttcatagcccttagctaaatggttatagaaatgattttcctgctttgacatttgttaggcaccttgaatgggcatagctcaccttccctgcagtgagaaggaaaatcaaagtccactgagtacaactgcactcacttgtcctgttccagaatgtagacctggccaccatggattccagccaatagtaaagaagggttacgtgctaaagaggtagaaacttctcatccaggtaacagagaaatttgttttcttccatgtagcacatgttgacttattttatataattaagtatttaaatagaggcgaacttactttttgattttattcattattccaccttcattgtttttaatatcatggaccatcttttgaagctgcctgtaaaaaacaaaattaaacataagatattaataaccagtctgactttttaaaaaaagtctcctactcttctcgaatacaaaaaaggggaaaaaactctaccaaaacaacctccaaataggatgaattatattgtatttaattaaattgaccatctgctactttagcgaaggagaagcatgactgattctataaggaatatggtcactgggctgtgtccccttccgttgggatgtctggaccagtctcaggctgtgaagaaagatattctgattccttgctcattgtcttagagcatctacgttacgaagatagatgctactctgtggacatagcagaggcttcaatcaggcccaaggttcttttttattaaatggtagtaggtagcatctattaaaacttccatttaaaagttactcctacctaggagtcataaagaaaatgactattaaatctggctgatatttgaaacttctgtagaacaaaaagtaatattgaggcaggagaatagggtctggagtcagggaacctaaggccaatttgcactgacttcctagaactgaatcaaatggaaaaccccacctctccatgcacaagtaacaaaaggatcagaggctactacctttgcactgcgttatagatgagaaatggaaagtgcctctgattgatcccctcctgtaaccaatcagactggtcccaggccaagtcttcctgtgtaactttgtaccttaacttcagcgtctgattgatcaccttctgcaaccaatcagactggtcgtgggccactccttcatttacataggatgtaaccaagtaaccaatgggaaacccctagaaggaaaattctgtaaccagtgctcttgagccacttggtcaagcccattcctactctgtggagtgtactttcatttcagtaaatctatgctttcattgtttcattcttctgttactttgtgcattttgtccaattctgtgttcaaaaggccaagaacctggaagactcatagtcaagaccctccactggtaacaatatgtatcaagaccctccactggtaagaatatgtacaaaatcaaaagataaatgacatgctgaaagaaatatttgcaacatatagtaataataataagaactacatattagtttgctgcaaaagtaatcacggtttttgccactggaagtaatggcaaaaactacgattatttttgcaccagcctttctcgatttacaaagaaatcttacaactcagtaagaaaaagagaaatagttcaatagaaaaatgagcaaaagatatgaacacacagctaacagaaaacaaatacaagtggtcaatagaccaatgaaaagatattgaacatcacttatatttaaacaaatctaaatctaaacaacagtgagatgtcttttcgcctatcagactggcaaaacataacaagtgtgataatatccagtgttgagaaagtaaattgttacaatcaaatctgtcaagatttaaaacgtccatgacttttgacccagcaattggactgctaagaatttgtcttatgaaaatggtcacaaaatgatatcagtatatacatataagcatgtttattgcagcgtgatgtgtaagaactctctaatcttctccctgcttcttctgccctccccacaaccataactctgaaaacaacccaatgctcattaatcattaaaagggaactagttaaataaattatgatagatccatgcaatggaatgccacagacccctaaaaaaaagaggaatatacatctatattgttgcctgaaacttctactttctaaaaaggggattattactttatgatgttttaaaatatttgaatttttatagcatgtgtagatatcatttgtattatctgtgttatacacaaatatggagaaaaatattataatgggaggatagggccatgttatgttttcctcataataattttctgacttaaaaaatgtataataaaatttcacgtggttcttccctgaaagagtaggacgttttaattcacctttcaggtaaatgcttcctttgttctgagaaaactatttgactggaccctttagataatgaactgtacacagctattgttcttgtaggaaatggtgatttccccacaatcctgaaagcagatttctctgactctgggagctaggccttgggttaggtaatagaaatagtttagcataggtctaggaaactgttggttgaggacatctgggagaaatactccttggccctttgtgaatttagaatgcccgtgcggtggaagggttactttttggtgcagcagtggagcagtttagagggtaagaggacagcttctcagaagaactctgcctgggcaggcctgtgggtgtcctctaccaagtgttaatttaaagctaaacaatgcagccatgctggtgctctgctgggtctgctctattgagggcaggccctctagcccttagggagtggagtgaaatttacaggatagggaattgggaaaagggagattgctcaaacgtaaaatgggaacttaggctgcagattttggggagatctctctccttctagggctaatggctgttaggcgctagagtgctgaagagcgcagacaaacctgagggattttcagtggtgggggtttgggcgatggcagggggtggtagccctgaatctgaggctgggtctgggcctctgctctgagaaaagccatagccagagccatcgctagctattttcaaccacataatccctctctgctgtccctgaatcttcagtaagatcttgtagtagctgcagcccggcctcagctgggccttggggaagagagtgttccactggcatggaagggtggagggaggacaggctggagtgtgaagtagaaggataggagaaacttcttttgggacagccgtatggctgcattttggagaattatctacgtaagtgaggtacccactgagggacccacgttcaaatgtatgtgtcaggggtctggtgccaagtcattgtaatttgggtaacaaaggaaatgagaccatattttatactccctagctagggaggccgggcacactgatgatacaagtgtaagagctcaggaaagagccaggcacatattatgggctcagtagcaaagagaaaaggatggttgagagacacacagagggtccctcagatgggcccttgagttgcctcagaactctacagttttctagaatttgttcacatatactctatgccaaacccttttctccttttcctgaggaactatagagaatcttcgagatagaggaaagaagaaaatgaaaataaggggtctggcagtggggagagagattgagagacagacagagagagagggggagagagagagagagagagaggaagagagaaagagagagagagagagaggttgaagtggattgattgcaaggaaattcaataatttcatatggagggcagagggcagctcgttgtaagctgactgtaactgaatggagtatctttaggctaagttaatgcttaaccaggttgaggagcaaaatgaggcagcagtgaagaatcctatcagaaatgtgtcaaaaatgggacacaggcagagtaatagggaaccaggggccaatttgcataagtgattttgctgtggatgtaaataaacagatgcaaaatgttgcaaaagaattggatgcaattttgtcatttgctcaatttggcatttggtgcttgcttggcatttcctaattactttttattgtgtattattataacaataacaattatactatgtaactatataattacagtaagttactgaagtgttgcataaactatactttttaaagttgatgcataatagcagtagatatttatggatgcatgtgatattttgatacatgcaaacaatgtgtaatgatcaaataagggtaattgggaaacccatcacctcacctcaaacatttatcatttctttgtgctgaacacattccaaatcttttcgtctagctattttgaaatatacaataaattatagttaactatagtcaccctagataaattacactttttatattttaaagttttcttctctctctgtatctcgttcacacaaattctgatgtctatagactgctttgttacaactgccaaacttctgtgatctgggaagacatagtgacccaaaaccaagatttgctgtgatgctgttagctcattatgtcaactgtccacgcatctggtgatgcacagctctgctgctctctagtattggccatttcattttgaagtgctttttgctccttattacaacttatagcacatgccatagcaaaagaatgcacaactggtctgttccaggaggggttgttctggattcaaacagcaatccttttactgagatgagttgtgtgtaggtaaagataggtaaggcataaaacagcttcactttgattatctcattcagagatatccttccatggtggggagatggataataaggtcacaatgtcctaatcttctaaagtcatagagagagagccatgctcatgtaacaaaataaaatgaagaacaaagcttatctaatacatgttttaaaatatataagtattgtaattttaagcagtatggcattttggtatttaaaaatggtgagcaggtcatataaataattataatacttgtgtaaaccaaatcaaattttatattctctcttttgtttttaattttcaagcttttgaattaagacacgtaacttagtcacactgtagtagtgtgaccctgggtaagtctgaatctcgagagatttaaattccaggaagcactgagagtagaaaagtcaccatttgaaagttacagcagtttcttccctttaaagtgccttactttagaatccgatagatctcaagagggctattggaccacaactggctgggcctcacccctggagattctcattgggttgtctgtggtgcgtcagaaaatctgcatttatgtttttatttttattattattattattttgagacggagtctcactcttgttgcccaggctggggtgcaatggcgtgatctcggctcactgcaacctctgcctcccagattcaagcgattctcctgcctcagcctcccgagtagctgagaatacaggcacctgccaccatgccgggctaattttttgtatttttagtagagacagggtttcattatgttggccaggctggtcttgaactcctgacctcgtgatctgcctgccccgggctcccaaagtgctgggattacaggcatgagccaccatgcccagctcctgcatttctaacaaattcccaggtggtgctgatgctaccagttgggagaccatcctttgtgcatgtctatgatagatcatgcctttttctattgtgggccttttagttgtgcccaagtaaagcaaatacctgtttgggggaaaaactaagttctcattaactcaagtgcaaagtttcagacaaataaattgggtggtcaattggaagcataatttgggtgtgcgcttttcagtctgtagcttctttgcaggactgttgacttttctctgtatgaattcagactaacctctgcttatatattttaatttattttatagtcatgtactttcttcttgagccacagtttgcaaaactgtagaatggagatgaagtgactgcaggcagaacatgcccctctccttgcgtgacaatggaaaagggactggcccttcttggagcagagtgccatggtcgggaccattttgccattgctattataatatggtgctctaagtgactaacagaatgcagtggcggtggcactaagactcgacctcatccctgttggtgggggataggctgtctttgctgtcactcatcctgcaaagactccaacctagaaaaaggatgtaagaaaatgaggatgtggcaggcaggcctcaggcttggtactgtgatgtttcctgtcttcccggggcctcctggttgttggtccctgtgctgcaggttgaatagaggaatcttctagaaggattcccattgaatagccttccaatttttactacccatgcataagatgtacagattttacacaactaagatcactcttgacattttgaaatctgtgtgttccacttactatattgtgaatattttcataagtgagcaccatccttaggctttatctgcatctttctttcctctgctatctgaggggcttttaaatagctgaaactctgatccaagtaggcgtgacaagaagcagtgaatcaggacccctcagcttgagggagcagagagatgaccagaccacatggcaatctgagaccaggagaagcaaaggctgtgtgagaataagtgccgaatgccttgcttctgggagcctgggatcaagaggcttggacctcaggggcagagagggaggggacaatctcaggttccctcttgtttcttcaaacccagcctctcttccagatcaccctctgaaacagtgttttctagagtaaggtctaaagattgcctgtatttatttattagaaattcagatcactggaccctaaaccatatcaatagaataaaaattccagatagagcccagcaatctgctttttaacaaattttctaggcctggtgactcttatgcacacagaaggttgacagccatttttaaaggattaggccaggctgggtgcgatggctcacgcctgtaatcccagcactttgggaggccaaggcgggccgatcatgaggtcaggagatcgagaccatcttggctaacacggtgaaaccccatctctactaaaaatacaaaaaaaaaaaattagccgggcatggtggcgggcgcctgtagtcccagctactcgggaggctgagacaggagaatggcatggacccaggaggtggagcttgcagtgagccgagatcgtgccactgcactccagcctgggcgacagagcaagactctgtctcaaaaaaaataaaaaaaattaaaaaaataaaaaaaaggaaaaaaaaaaggattaggccaggtttatccccttctaggctaagtttaaatggaaagagcaaaagagacgacttcccaacctccagagtatcttcccccatccaccatagcctggaatagctttaacagcaaatcttactattttctccataatgagtggccaaaggcttacccaggcattctccccaggaaaggaaagacactggcaatggaattttagtcaatggtatgatgtctgctttcaacaaggggaagacagcagaaggaatcggctgtggttgccaatggccaggcattcacctttacctggactcagattaatacaagtcgggcacagtgatgcttccagcctgcctgccttctcttcccaggcagcctggtgtcagagcagggactctaacccgaggagctgactgtgtacagctcagccttcttcaatgagttttttttttgttttgttttgtttttttgagatgaagtctcgctcttgtcccccaggctggagtgcaatagcacgatctcagctcactgcaacctccgcctcccaggttcaagtgattctcctacctcagcctcccgagtagctgggattacaggcgcctgccaccacgcctggctaacttttgtatttttagtagagacggggtttcaccatgttggccaggctggtctcgaacttctgacctcaggtaatccgcccacctcggcctcccaaattgctgggattacaggcatgagccaccacacctggcccttcaatgagtcttttatgaattgaagtttagaccttacatcaattggcagtctttctacatctccttcttggatgaaaaggtaggttaaagaaatcgtcttgactttggctgcacattagaatcacttaggggacttttaataatcttgacacccaggccttgcccccgaccatttaaaccagagtcattgactctcaggggatccaatgtgcagccaaggttaagaaccactgacagtgttctcaggataggagaactttgtacataccccagggaagttcgtctggccaagagagcacaaggagaggaatccatagtgagaatccacagaagggtatctgcagactgagaacagccccaggcacatagaaggataaacaagttcaggaaggatggagtttaaggacagcgagctcttccagggccaagagggcacggggagggcagctgcatgcagatatttcggccagatcaccagaggtgtccaagaaattacatatttgacaaaaacacttttccaataatttttattaaatacaggagatgatttaacagatgatattatctgtaagaagtacttttttaaaaagtttagtagaaataagatcataaaacatcttgttttccttgtagctctttagtgctgtcacagaggacaatgataggcaggtttcaggattttttttttttcatttgtctttcagaaagggtggaatgcaaagtattgctaatcagagaaaatccctgtttaatctgcatgtaggaatggattaaagagtgtctcaggtgaaagtgactctttgtaaacaaacagaataaataaatccttccttcttcatcccccgcatcttaacctcaggtccagttcttgagtttcatcctttcagtgttcataggctggtcctcctctctgagccaagatctaagcctacactttcccctttacaacaggaaaatgcagcagctggcagcagggccctcccatccatgctgtgagggcttgttagggcctctttcagcaaatgtttctaaaacctggatttcaacgatcactccttcctcaagagtgcagcagctccccggtatctactgaatcaagcctgagctttttgtcatggctcagtcactcagtctcaccctgagctccatgcccatatagaaattttatttttgttactaaattttaaaacagctcgatgatagaaaattgaacactgccaataagaaaaaggaaaagggccaggcgtggtggttcatgcctgtaatcccagcactttgggaggctgaggagggtggatcacttgaggtcaggagttcaagtactgcaagaacccctgggggctgctggctcagccctttgctttatccacgtatacttgggtatccttagaacatctgtgctggtgcaattgacctggtatctccaatttatatgtttctaaaatcaatttggagtagaaatctctgtaatgttttccttggcatatatagaaacaaaaatgcatccatgaatactttttactatgaatggatttttaaaaacacttttttaaacttaaaatttaaatacatttaaatgcatttaatttaaaaataaaaaaattaatgttcatcattaggtctgctgattctctagttgacttcctccttttttaggtgtttaatgtaattgactctgggtttctttttaagatgctactaatatagtatattttatttttgttactaaattttaaaacagctatatgatagaaaattgaaaactgacaataagaaaaagaaaaagggccgggtatggtggctcatgcctgtaatcccagcactttgggaagccaaggagggtggatcacttgaggtcaggagttcaagaccagcctggccaacatggtgaaacctttgctctactaaaaatagaaaaatcggctggcagtggtggcgtgtgcctgtaatcccagctacttgggaggctgaggcctgagaatcacttgaacccgggaggcagaggttgcagtgagacaagattgcaccactgcactccagcctgggcgacagagtgagactccatctcaaaaaaaaaaaaaaaaaaagcagcagaagaagaagcaaatggaatttataagctggcatccttggatcttcaggcttgaaacttctgaatgttctttaaccctttctctctctctttgactcttcatctcacatctctagtcacatcaaaagggtgaggaacagcagccaggtatcaggaacagcagccaggtatcaggaacagcaagtgcaaaggctcagaggtgaaactgtctgagatgtttcgggtccagtgagcagctgagagtgtcaggaaagtaggtgttgagaggatgtttacaagacaaggatgagaccgctgggagcagagacagatagtcaagggacctgttaggccaaggagatggggggttacaggcttcctgctggaagcccttggagacctttcctcggggtgtgtcatgatgagggtggaagaatggaggaggatctcggcctgggacagtggtggctgggacaccagtatggaggcaactgtgccaggcccaagcctcgagctcgtgacagcgtggtaccaaaggcaatggaataacactaggagtgccctgtgggcctcagctgtgcgaaaggaccaacaactctcaaagaggacattactgagacaaagtgccatgttggccatactggggcctgagacaaagtaaatcagcaggactgattctgtcttcatctaaaattccagtagtttcttcatcatggatttctgggcattcattttgatttttaaaatattatattaaatactatttgtatcaatttattaatgagggttaccccttaaaatttaatgtcatgctttgctgttttatacatgactcgttttgttttattccacaaatattcagtgtgtgcacactgggcatggcacatgcaggccacagagctaacctgaacacaaacccgaccctcttgtaatgcaggaaaggggctcctttcaccaccttatcacatgacagaaaccttctggcctatgtgaagccaggggacagatataggcagaccggagaattctctgattcacacaaaacatcctcctctcaggtcactcctgtcttaaagctgaagttttcagccaccaacccatcgttttgaagcagcatgatactttttagtgactatcctgttacttgcatgctgcaggactcctatgacaacttctccccctccactctttctaaagccttgtcatttctggcaccggcttcctaatgctcacttcctccagcctggccttgctatgaaataacaggaattatatttagatttgcgaattcagcactgcaggctgcttccttctggggagtgagctcatggtggagctggcagagttttgacagctttggcagtcccttccatggtgtgataatgtgaacaagcccctcaaggtcgagttagtggccttctcctccatttcacagatgcagatactgaagcccaaagagatcagagatcatgagtgtctcagactatacagctgactccgaattttgcctacaattaaggtagtcacagaaatttggaagtgagagagactttgggaatatcctgggtcaacctcctcttatgccaagggaggaaattaaattccagggaaattttgtgattgccctgagattaatttagttgaggactcctccaactcttttagtcatacctgttccttccccttccacataaggcttgagccccctgctagagaaggtggggggtacctccatggccagaggtaacccccaccttcttatgccatagttcagagctgtgattatagtacaagcccagtaagccattgctgagagaagcatcatgcatgccagtgatcagacttggaaaatcaataacggtaaaagccagcatttattgagcatgtactacgtgctaggtactttgtgtgcattatctcattaaccctcacaactaccctgtgagggaggtcctattatccccatgtttatattatgataaaaaacacataacaaaaaatttaccatcttaaccatttttaagtatccagttcaatagcattaatatattcacatagttgtagttatccctgtttttatagatgagaaaatttgactcagagaggttaaataatttgcccagatcctacagcaaataagtgatagagctggaattcaaaatcaggtctgattccggagcctatgctctcaacccactctggatgatacaggctaacttgtttcaacttggcccctcaccagggcaggcgactggcttcagcacctacgttgcctctttggataccttcctctctgtccctggagacagcacccattccctctaccaacccagtaatctttactgtgacacatgtgcccccacccctgccttgctattggtccccaaggttagacattttgctagaggggagcgtcagctcttaagggcctgtttcagactttgggaggaagagggagagtaaaaagaggaaaggacagatggcaggggaaatgggaaggagagggggtaaggcacatgggaggcaggagggaatgcggtagcggccctctggggtctggaatatgctcagaagtagggtggctgaacagagcagctggaaggacgccaccataatccatgcatcctttctcaacacccgaggcagaaaggccccctgagggtcctggagtggaggggctgtgttcccttacacacaagcatcttgctgccagggctgtttcttactatccacttattaaccgtataaagtaatttataagtttctccaaacagttcacaccctacctttttttttttttttttttttttgcttgtttcttttttttcctactgagatctgcaaatattttgtggtagtctttggcatgtctgaacggctgagcttggttataagcagtcagaaattgggctgacttggcacaagcaggagtagggatgattctactaataccctgtgtccttcaaaaaccctggtaggacttaccctatcagaggcagttatgcatcaggcacaccaccctgagactgatgagatggcaaggaaatgatgctatacctgccttaagaagttcttagaagttttgtcacttgatttgacagctgaaattggcatggcccttcccctctctgactttaggggccagtggtccttggggcctccaggaatacaacacttctctttcctttagcacattggaatgcttgctggactctgctctcaccacccacctggcagaggtcttgaataaaggaaaacttcctcacaaaactacataaaagcagattgcaaaaaccaaaaaagttaagggagactcctgtgttcatagatgacacagactcttgggtttggaagaacactaagaggtcatgtcatttagtcccttcactgtgtctgactctgatgtgctcattgttctgatgaggtgctgacagctgcaccgtgcatgtgttcactgtctgtcctctaccagcataaaaatgcaaaactgacgtctcttaaatcgaaccagctgccaataggtttgtaaaaccaagcgactgagaagtagttctagtcatgtttctgaaaatgcaattctacataattccagaaaataaaagtgtcttaagaatttgaatatgttcttttaaaaattaacttaatgggggaaaaaggaactttggctatatctacatggcatgatatatatatagtattgtcatctacttgtcctggcatccatttctgcaggtaaaagcaaagatattttcaggaagtaaagagtgattttgagggatggcattcaagaactcatatattgaaaaagtttgacccagttaaattcttcttagctctgagaaaacaaagatattgggaatgtcttgtatgtaggggtaggggtgaaaggaagcattgtaattcattaaaagcatctacaaatgtttgtcaataatacatttaaataaaaattttgaagcaatatctttttttttttttgagacagggtctcactctgtcacccaggctggggtatagtggcgttatctcggctcactaaagcctcaacctccctggctcaagtgatcctcccacctcagcctcctgagtagctggaactacaggcatgtgccatcatgcccagctaattttttgtattttttgtagagacagggtttcgccatgttgcccagactggtctcaaactcctgagctcaagggctttgtccacgtcggcctcccaaagtactgggattacaggtatgagctactgtgcctggccaacaatatctagtgggtcaaaaaaatatataatcgtgggtccccaaaatacactcatttatggtaaatataggaaattgtttaattatcaatttttaaattgtggtaaaacatacataatgtaaaattcaccatttcacccatttcaaattgtacaactcagtggcatttagtaaattcacaatattgtgcaatcaccaccactgcctagttccagaatattttcatcacccctaaataaaaccccagacccatgaagcagtcattggcaattttaaagcagattttcaaaataatttacttttgaggtattttcatgaatagcttttgttttcatcatgctaagaggttgttaatagaatttaccctaataggtagcatcgggtatattaagcccaatcatctaagatcggtttggcaactgtgatgatcttcgagtatgaagatgatgtgaaatctgaagtcctgccatggtaaaaaagagaactctgaccttgaacaggctgtaaagatcatctaaaagccaaaacaatcatatatatgtacagagttcatttttttcaatgattttatattacatttgccattttcttttttgaaattatagttctcatgtttgtatgtgattctcatagttatttgcagtgcaatgaaatactcttcctagtatgttcaatattgagtagggacattaatacactttttatgcttaaaaaattatttttcataatgaagtttttatactttgaaccaagtaagattgtaaaatgaaggggtaaaaaatggaatggggctgggggtcatttcactctaggtacgagctcagactttcttgtcttctactccaagcacccttggtcatagcctccctctggggaactcccgtttacttaggtgtggtctcccacctctggcctttccctccttatcaccatgttcctgaacaatgatccatttatccagctaggctgttgattgaaccacctctgtgagtgggtaggagagctctctgcccccttggtctgagttggttatcagataaatgagtcctgcgtgggtgctagtgacagatgactcagtgcctgaacctattacacttaatgatgtttaattttgaaccagaacattgagacactgccatatcccaagtagatgcctctctaacaacacaatccagggcaccagggaagcacagaccaggaggaagggggcattcattgagctcttactctccggtatacagaggtactgttctaatacccctgctttatgttatatattattgagatattattattcccatttttcagatgaaaaacctgaggctaaaagggattaagtgatcttctcaaagaccacaagctggtaagtgcagagcaaatgttcaaatccacatctgcctgattctttcttttcagtaagacaaaaacaccttccaagggcacctcttaaaataccacgttggtgctgtgtgcttggtctgtatataagaccagctctgctcttcataattataactcactctcagattacatgaacgattgtgggagcattctttgcaaaatatatagcagtaggataccagacacacctgagtcagtgtggaattcaagtttgggcctggaacacacaattgtctgaaatactgacagcaggaatcctcagaaggctttctgactagtaagtgactgcttttttaattttaaaacaaacgtctatgaaaagtgaagaacaaagcctgaatgttacattggccagtaaattacacaggcagacatggaggggtcgtctagagcttgaacaggtgacctggcctctctgggcctcacctttctcacctgtggaataaaggggctggagaggtgtcctttcagtcctcgcaaggcgaatctctgtgcttctccatggaagcctgtgtctctgcacattgtagaagcaggcaaggcccgagtcctcatggaacccccgaccagcactggctgcataatttctggggcccaatgtaaaatgaaaatgcagggccccttggtcgaaattgttaagaatttcaggactgcaacagcagagcattaaaccaggcacaagctccgagcacaggaccctgtgcgactgtatggccacacgcccaggaagctagggacctgtgctgcgtgttccctacaatgtgtgaaggaagggaatctggagtaggtctggggcccccagccagcatgggaggcagggatgctcctggggtaatgagagccttccttaggaaactggccaacagagaagtgtggctcagcaaacagtcaccacatgtccctcaagctggcttctttgtcttgcttttgaaataagcattgaaatagccatgctgggctgagggaaatggtctgtttggaggcctagaccacagtgctgcaaaagggttgtgaaaacattaggttaaaaaataaggcttcaggtgtagcttctggtggactccctttcagaagggaggtgaaggcaggacaggtaggaaaaggtggtgaaataaggaggaggaggggcttgtggggagggctcttttctttttggaacaaagcacagggaggaaggaggtgaagtcagactttcttgctcattgctggatggagacaaatacgccagtaatgaggaggcttaacacacagtgaagaggagcaacctcctgagagagggtttccaccgcagcagccaaccccagtgtccagtgtcagcccaacacaaaagctgcttccctacagctgtgctggggaaccccgaggtcatgtgggacctagaggacggcagccagcatcacacttcagggttctctgctcccttgatctggagcagggacttgggtaggggctggaattccaccccatcagcaggtgaggcccatttctggagcaacaggtgaaacatactctaaattcctaataatgtgcatggttcctaggggcctaggaaacccagcataaacgtggaatgaaaaaactaaggctgcctttgagcgcttaaacctcaacatctgacagagcaaacacagagaagcaaggtcaccctcaagaagcagaatggccccaagtctgtgagatttaagggggacctgatggaatgtaatcaccaatccagagacacagggtgtccaatgggaggcagtagcggtacctctctgacctccaatctgcagagacggagtcttggttaggtggacttaaaaggcctccttagtgaggctctgtctacagtgggcaagagcaccacagccctgcaagcctgggggcaggattacccaagagccttgagcatctgacattacaagagacagcgctcttctgagcacaggaccctgggtccttcacatagacctcctctcatcattcctaatatgcagaacaatcacacaaagcgtttcctgagatccagattcaatcgaaaccaatttaaagagttattttggaggggggcggggagacatagaaatgcttaatagagctggaaaaaagtctttaatgaaaaagattgaacccttaaagcctacccatcggtttcaaaaaaatatatacacactggccacagggagaccagacaagacagggtgaatcctgctccagaaactctcccagctcatggaaggattattccaaatacatgcctcttggacactgccacagaattttcatatataaccaagaagattaaaggatggacaagcaaacgcatttcatctctcctccaccagctgctttgtcttttatccaatgtccttaggcaacatattctgctctaggataagcacagtgtgtgcacctctgtccagaatttggccttattattattattatttttgagacatggtctcattctttcaccaggctggagtgcagtggcatgatcttggctcgttgcagcctcaacctcctgggcgatcctcccatttcagcctcctaagtagctgggactgcagacgcatgccaccacaccagacttatttatttatttatttatttatttatttatttatttatttttgtagagatgggtgtctcattatgttgacccggctggtcttgaacttctggctccaaacaatcctcctgcctcagcctcccaaagtgctgggattgcaggaatgactctctacacccagccagaatttggccattggatcagactcacaagcccttgaacttcttaatggctgtgttatgacataatatgctttttacctcaacattaagaatttccactcaagatttgctcagtctacttgaagaagtagaaacagactatttattacaagatgaccttatgtctggaaatcttttcctgctctcacttttctacccaggagagagcaacttatagctcaatggtgcatatagttcatgggatctagttttgtttgacacaacttttaaaaaggaacatcaaattgaaatgcaggcctaaggatttattgcccctcctctaggcaatccctcatccaaaccatcccagaccggaaacccagtgtgatctgagcaaagaccacaacaatggcaaagatatgtattgcctattctgaactttaaatacacgttgtcactataagcaaatagaaatgaatatttgcttattgttctgaagagaacatgtcacttagtctgaatcagggtttctcaacagtggcaatagggacattttgggccagatgattctttgttgtggagactgccctgtacaatgtaggatgtttagcagcatccttggggactaactactagtgtctgtaacactccccagttgtgacaaccaaatgttcccttggggacaaaattgcccctgatggagaaccattgattgaaatgatccagctatgtcttgcgggaggctggggaaggatgtttctgtggaatctattaagaagccaaagaaagcgaagtgttttaatttccctagaacaagctatcctttaatttttctctccctttttttcttgctcatgtaagaccttctttgaaaatgaaccaagctgataaattctcccaagaacagatggggttaaatcacctgtagggagaaaacaagagatcgtctgtaaatacatgcctgaagagtttggcaccagcccagttcttttcaatccagtaatctaggaggcagggctggaaaataactgtgatttggtccttggaaacctaatcaattgtatcatagtccatttggaaacatgttgtgtgaagaggaaggtgttgttcagccatggtacacaatcactgggtccagaagagaggttcctcggacatgtggactctggtttagggttttcctagcacagccatgcccagagtgggtgaggaagttgccttgagttttcttggctgatgactctgaagtccactcgcactaagccagtttctgataacgtggctcccatgtgacttgcccacagggagaaagaacccttctcagctgctctgggtagtccatccattggtgtgccgcaagatggtccagttaagtggcttctcatccagtgggatgcaggtaggcagtgtgaggggatgggaaaccagacggtccaggaagtggatctaatctccaccactagatgctgtgcctcctgcctgcagctcccctgaagtttgccaccccagttaaaaggagttggaaccacaaatatgaagagcaagagagacagcaaatgccactcagcttgggtggtttgaggtactggtggttgtgtttgctttttattgacttggtatactgactaagtggcaaatactcttctgggaacttcagtccatgttgtctcacttggtcttcacacaagcctgtgaggaaggcatctctagcttcgtttggcagctgggaaaactgaggtgtagagaaactgaatggcttcagctagtaactggccattagaatcagccctgttgggccccaatggcatggtccttctaaatatatcaagaaatatttcctgagagtcctgagataaaatggtagcctttgagaatgtaacatatgtcaaatgtggtctctgtgcttaaaggatcacagcatcagagctgagagggactttgggaaatgttctcattttgtagtttgaaccaaacaaacataggggacatgggggagctaataacctatccgggatgttgtggaagaaaaggaaagaaaagccatatatggaagagaagagccataaagaaaacctgcagggtgtggtaggtgagtgggtgtcagctgaggtgaagagggaaaggtgagtcagtgtgagggctgacgaggataccatcgaccaaaacagggaggatctgagagacagctagttgtggaaaggtgaaaagaaggtgaatttgtttctgaagaactgaaccagaaaaatcaaggaagtaaaaactccagttgaaaactccaaaccctgagaagagaaggcatgtctcagaatccattagaaaaggtctcagtgagacccctaccaggaagacccagacacccacagcagggttctgtcatgcttaacattattagtcacttagatgaacgcagagaaggaatgtttgtcacatctgcagtccatgcaaagccaagtgtcacagatgtcagaatcaatagacaaaatagtcaaaatagtcagaaagaagaaaaggaaccaacatgaaacttatcagggatcaatggaaagtccctgtttattttcagaaaatcaattacacaactatagaattagaataacaacagtaatgatattaatagctactattttgaaagtcctataatcactatgtgccagttgcttcacagaaaaatttatttaaaccttacaatagccctacaacattggtactgttattattatctttatcttacaggtgaggaaaccaaggagattaggcaatcttgcctaaaatcacacaaatcttgatttttctaatggaaaaatgccatactctttaatcaataagataactggggagacccgatttgaccacacttgtgtcaaagaccttttctagttgtaaaaatgagcaggtatgtgtttgtttatgctacaaagaaaaatacacaagcacagatgatgaatcaattgggaggttattaaaaactaaacatttcattttcaagttagttttactaatttgaaaagggatatttgcaaagtgattcaggattgtaaattttgaaatgttcccctagaaaggtgaaatttttatgatcataggaatgtttactgtggaacgattgaaacccagctctagccaggtttctgatcataactttaccttatacaattaagggaaaatcatggctaggaatcaactaaaagaccctaagtgtctatggactcctactgacagagaagcctactttagcaggcctcggtgggagcaaagacatgagaatctgtgctcacacctctctgtggtcacaagcaacttagccatctcacctatctctattcttatacagcagaaactctcaaggtgatgacccatccccactgggttcatccagaacattccctttcttcttcattttgagaattccttgtctccttccaatcctgcatgccctcctttccttggatgactctgcttcccctctcctcctagtaattccttctgctccactctcttttcagtcctgggaatatactccctggatcaaggtcattcctttcagtcctttggatggacactcactgtccttctatttttgtggctaagaatttgagcaaattctcacctaagcctaagagtataaacataactgtccacttttatggtcatctggtgccaaataattacatggttaatcaaccttcagaattgatgtcaaccagtcaggacagaggacacaaatcacaggaggcaagtatttcatctattgactcctcaccatcctatctatctaattatggaaaagagttaagatggtgcttcgagcccattgagtttacaatttcatttctttgaaaagttccacgtcaacagtacattttaccacaacaggatgattctataaagacaactgagtaatcaagtggaaaaaaagttacttttatgtaagcagatgagtgtagtgtatgattatccatggtataattttggttttctatcccataatctatggttgtatattgcccatcaactactctgtgatcaagctggactttgtcccaaagggaggaatcataaaatgatttaagttctagcacctttacttaaattcccacctggattccctgaaagagaatgcatttctgtatagttctacattatggaatatgtctgaaaacaaaaaaaaaaaaacatttggaatcctcctgttcattcagaggaaggtgcctagttagtttctttgccatgtctttctgccctctctttccctcttccttctcactgccatgtcccaagtccaggcctacaaccctggatgcttgggttacttaagcgctcctccctcccaccagatccctgcctccagtgtccctcccactccaacgcatcctaccaggctcctttaagcctactgtcatgacattgctaacagctaacagcataacctgttctccaactccctatggtcagggcactcaccatcctttgcaacctggacccaccttatttgtccaatcataccaggaccttcaggtcccacattccctactctttagtttctgctggacagaaaactctcctcactatcccacaaatggaccgtacttgtgttaagctttgagtgacagcctctgtatttcctccctcccagcacataacatgtttcctccaattctccagtattttataattttacccacctctcaaagcctacctcttaaaagtatcttctctatgaaacctcctcctgctactctaagtctcttcttacattccttctgtcgcttacagcttccattgtatcacccccgcccctcatgagggtgtagctatttgagaccaagggcaagaatgaggtgccttcttgtcccgtcagtgctgatcacacagcagcactcaacagcatgttcttgaaatggttgaacacagctgatgttgcctactgatcccagatcattgatgcatttcacattaccttttaccaagcacctcctaggcataagacctgtattctactgtgaagggttgtccctctgccaatccagactttctcttaaatattgtctcaaaagcttcaattctctggctcattgttatctgtgattacttgtctgctacatgtgtcacatcaccccctgaacatttggctaagttctaatatgtagtcagaatagaaaacactccctgaacagaggggaacatcacacaccggggcctgtcaaggtgggggactaggggagggagagaattaggagaaatacctaatgtagatgacaggtcgatgggtgcagcaaaccaccatgggatgtgtatacctatgtaacaaacctgcaccttctgcacatgtaccccagaacttaaaagtataataaaaaaaaaaaactgttaaaaaatgtgaaaaaaaaactgcactcccagaactttaaaagttccagtctctgaaagccatgatgccattacaatgagacaaaaagaagaccttcaaaagcaaaatttggggaagttgtcttttccatagctccttgactcacgcccatggggccgcttctggtttattctttttgagaggcttgttatggatattgttacattgacatgagggcattggaaagacagatctaatccccccaaacacacttgtcatatacacccacaaaataaatgagacaataaaacaatgaataacaaatgattacagctatccttaaaattaaatagtaacctgcaataaaatgggtgaggactcagtttagagaaacccttccttagaaaagttggttgcattcagattctaaaagttgaccttcagtagaatctaagcccttggcatttgttttattatctttccagagctttacactttattgtaagaggcagctaaagcaagtctctcttgttcctacacatttctttaagaactcagttcacttccctatagcaagtgccacccaatgctttccctaaaagctcagtccacttccctatagtaagtgccacccactggaaactagcaaagcattccaggatttcagtatttctgagatgccataagagcactggggggaaaaaaaggagatgaagaagggtattgggtggggaaaatcttacctcaacttctgactggcggggacggttattttattaagcttgtccattctgtttggtaattgtaagagacacgaataactgtccagtggtcacgtcagcagttcctggccctcctagggagcagcatggtaagcctctggtctcaagggttccggccactcaagtctgatttctgagagtgcaggctgctggcaaacacccctgctctagggagaagtaaaactt

SEQ ID NO: 1546 - DNA, 79819 bp, Homo sapiens
  source 1..79819: mol_type = genomic DNA
ttatttttaaaaataaaaatatttatttggaaaatattagtagcatgataactcaacctcaccagatattaacagttcatcaggtcaggcaatagaacaagtccacatgagcttcttaaaaagaaatggatgaccacttcaatagctgactccatcttccattttattactggatgattcataatccaaaatatgaagttttgggactttttctcaaaaggagaaactttgggaaagtgtctgaagcaatggtattgatcttttttttccccctttatgaaactttaactgcatacttcagtctggtggaatcttttgtgttattctgactgtcaataagaaccaaaggactatgttgatgattcctgatgatttcagcaacacttccaaagtactagaggaagaaaacatagatgaattatactttggcatttgtgttaaatttgagctccactcctcccatcttctctcattctcaagttagtaaaagttattacaccccagctgacattctgcacaaaaaaatctagtttaacaaaggctgtaaccttcaaggtggcagaccttggactttgctgtattaagtacgaagaaaaacacactgacagcctcaattagcatagctacttagagagattacttcactgagttatgataaaatattatagtatattgctttttatttaccgttaaatgtaaaactatcatacaacgcatttttctacattctttacaaaacatagatcatctcttactttgcacaagtctcagatacaagaattgatgtaataaattaaccttagaaatttagtacaaggaaatagtcatctcctaaacaaaattatgttttgttttcttttttaaacaaataaagaaagctttataaaccttcatatttccatttttacttggttcctggtaagcttagagttaacttagtgcctaattaataatgaaatttcatgctaggctctctccatacatacttatttttccaaattttgatccttgttgtctatgggttttaatttaaaattatcacaaattttgttctgaaaaataattaaagttttgaaggaaagataaaaacaaatgtaacacagatcatgaaattaaattcattgagtatacaaaagtgctacaagttcacactcattaaatgtatttagaatcactttttaaaagtggtgattgttttacaacagtgccatgagtttagcagttactatcaattgattttattttctcgattttttagataaagacaaacatccacagtaaaatttttaagtgtttattaattgtttggatgacttccaagtagctacatattgaataaagtaaaatattcagaatattggccaacatttccaaatgaaataccagttgtcttttagataattggctagctgaatattcagtcagggagagaggtaagagacagggactttcaaatacctttagtctttattctttacttcctattcaatcattcagccatcttgcaattgccaaagaaattctttcattataaatcccattaaacattcattctgcttgtttggcataatatgttgctaaaccaaatgcagttgaaagttaaagttatggactcaagggccagaaaacgaaatagcacaatctctttgaagtggattacaagggaaaaagtgtgtcctgaacctaggaagcataggagaggattgctgtacttatacaaacaaatatctcattccgtccctctagtccctgaatatttgtgagtattgccttgttgtggtgttcggggattgaagtgtgtgcagtagggagttgagctgagttgaaacatttgaagtagggaatgaagttgaagaatatttgtgatttaatttaaaaaagaattgggcataacatagttacagcttcccctcactctcctttttttctgtttttattaattcagtgtatttgagacagatacattcagtgtatttgtggacagaaaaacaacgtattggccactaagataaagcagacagttgtcaaaactgtaaaattactcaatgttgtatcacacagtgccaaaatagctgcataaacagttaaatagttaatgaattggttactttttctagccatgtacacacaaatacacacagactttcagaaaaactccacatgattgacatcatgtaaccaacactttaattttccattcagatgttcagtgtataggggacataatctttttattatagatactttaagtaagagttttaattgactgtcagtacctccagatgctattatagtaatatattacttattttggaatccataggctgaatatgttggaagtgaggtgaagctctagtctattcattctaaagtggagatgaagattcatcaggccaagaggaattcctgtttaccagagtttcctagcaggacaacgaaatccagagcccctcagggagttcaaaatttgtgagagaatttcaggacctcgaaataggacagcttcttcacccacccttaagcctcttatagaaaagctagactgctggagaagctttaggatgttaaatgataatgcggtctacattttaaaaccaaagattggtcttgattagtgcccttagattcaagagttttgcattttaaaattatctgagactttgttaaaagcaaaataaaattccccaatataaaaattctagaagaaaatgtaggggggaaacaccatgacactggatttggcaatgattttttggatatgacattaaaagcataggcaaaaaaagcaaaaatagagaagacaatatcaagcttaaaagcttttgctcagcaaataacacaatcaacagagtggaaaggtaacctatggagtgggaaaaatatttgcaaatcatttatctgataaggggttaatatccagaaacataaagaactcctaaaactcagcaacaacaaaaatcaaataacctgattataaaatggaatagacatttctctgaaaatgacttacaagtagccaaaaaagcatatgaaaaatgttcaacatcactaatcatcagagaaatgcaaattttttttttttttttttttgagacggagtctcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagagaaatgcaaattaaaaccacaatgagctgtctatcaccttacacccatttggacggctactataaaacaacaacacaattcagaatataacaagtgctggtggggatgtgaagaagttaaaccctcgtgtgctgttggtggaactgtaaaatggtgcaactgctatggaaaaaagtatgggaggttctcaaaaaattaaaaatagaatacccatatcatccagcaatcccacttctgggtatatacccccaaataattgaaagcagtgtcctggagagatttgcacacccgtgtttatagcagcactattcacaatagccaagaggtagaagcaacacaaatgtccactgatggatgttagacacacaaaatgtggtatatagatacaatgagatactatgcagccttaaaaaggaaggaaatcctaacacatgctacaacatggatgagtctcaaggacatcatgctaagttaaataagctggtcctaaaggacaaatactgtgtgattccacttgtatgaggtatctaaaatattcaaattcataaaaatagaacgtggttgctaggggctgaagggagggggaaaagggaaactgttgttcagtgggtatagggttttagttctataagatgaacaagttctggagatctgtttcacaacaatgtaaatatacttattactgagctgtacacttaaaatgattaagatggtaaattttatatgtggttttttaaccacagttgtctaaaaggcaaaataaagaatacacatgactttttcagtttgttttgcaaatgctattctcctgcctgtaatcactcaaccaaatcaattcagttgcttaataattatttatcaagtgtacactgaagccagttactgtgctctgattctggaaatacagagatgaaaagacattgtccttggcttcatgtagtggggaagacagacacttcagcaatcatgacattttccaacaattcaaatattttctagcaggtgctgggtttggaatggtgtacctttttctgaaggaatcttgaaagtaaatatttcttaccttgaattttgtttatgctattttctctgcatagattgttcttcccatttttctccttctccatccctccaacttacattctacccatttaaattcaacccgtaattcaaaaccagaataagtatcactgcatttctagaccattcatgggttactccagctcatatttcagggttcatttataggagcaggctggctaaactgagatatggtaagcactgagtttggtccagattaaagaggcattaaagttaatgtttgattaatatttaagacccatgtgatttttttttcttgctccaggcccataagctcattctggtacaagggctatagtctaatgttttaactcaagtttctgcatctcttctggatccttccctggtaacctaccttggtacttgagttgagattttaggtcttgactttggaggtctggaacttgaccctaattcttacaaccttaattcaacttgacatttcaaccttgatttatatttgcccctggactaaaatcttgggtcagactgacctcattaaataactgaatgaaaggactagcatgtacatcacatgactttttccttttctgtgttcttataggatatactgcctaaatatagtattttatcttgttctctatgacatttatgcaagcattagaacaagtacttttgtatcctttctcctcatctctagcatctaatacagtatttgatgtcattatactcaatgcatagttatagaattgaatttaaaaagaaatcactgacctcttcaccatttttctttctgcccaaggcatattgttttgttgcttcaataaatcgcacaggaatattatatactcgcttattaaagaatacaactagtgtatatggttgtttggaatcatggccagagcttttccgaataagaaatgatccatcctgtttaattttttttaaaaaacataattatggttagtattacttatatttctacaggttcaaaaaatcattttgtgaagaacacctatattacattccaaaggtaaattatttagctacattatttttattattgattagcgcttgtcttcttattttctaagaaaatagtccaggaaaatatatactcatagaaaatcctgagtgagatcaatgcttgccttttttgaaaaaaaggtaataattaattaattatttttagaaacagtctcactttgttgcccaggctggtgtgcagtggtgcaatcacagtccactacagcctggaactcctgagttcaagcgatcctcccacctcagcctcctgagtacctgggactactggcatgcaccaccatgcccagctaaatgctagctttttaatgtgctaaataaggttttatgtttataaaatttagaaatatgtgaagggacacattaagatcaaatctagaggactctcttgaactgggaaccatagccaccagttgtctatgaaaaaaaatgtatcaaacaaattccattcataagtactataagaagaaaacagaggttgggaatcaaaactttcattttatatttgcccctggactaaaatcttgggtcagactgacctcattatgaaaattctctcctcaaagaacttttataagaaaaaaaatccctagccgggcatagtggcgggcacctgtagtcccagctactcgggaggctgaggcagaagaatggcgtgaacccaggagacggagtttgcagtgagccaagatcgtgccactgcactccagcctgggtgacagagcgagacaacatcaaaaaaaaaaagaaagaaaaagaaaaagaaaaaaaaatccccaaactgtaagacagtaattcaaattttattaaattttttaataaaaatatttagaatcataaaataaaaaattacgaacaaaagatggacaaaaagcagaatgaaatgcaacaagagttgatcaaactcaggaaacaaactgaagaaaaagacaagcctatctcaacaaagaacaaattataagatgtccaagggacgagagcttcaaatgaagatttaagaaatgacacttgaaggaaggtgtggaaacaaccaggagagaaaatgggatttaataaaataagtaccatagaatcaaagacagtgatgggagaaaaaatgacaaaaaagatccaaaacgcatgtaaattgagtgcttgcagaagaaaaacaaataagggaacagaacaaccctttaagactatgatctaagaaaacttattggatataagagaaaacttaaatctacgtattgaaagggcttctgtctacttgagaaaattgatttggaattatcaactcagagatatattctggtaaaatgattagactttaaaaacaaaaagtctgcagagccaccagactaaagtatcaaattacatagaagggcaagaaagtcacattggtatcagacttctcaagagcttcatacagaacaacacaatctagtggagcaacacttttcaaactcaaattaaggattttatagccagccaagatttcttccaactactaggatatgaaaaaacagttttttaactctctttctctttttattcccccacagcagtctcactcttgttgcccaggctggagagcagtggcatgatctcggctcactgcaacttccgcctcctaggcccaaccgattctcctgcttcagcctccggaggagctgggattataggcgcccgccatcacgcctggctaatttttttattttcagtagagatgaggttttgccatcttggccaggctggtctcaaactcctgacctcaagtgatccactcacctcggccccccaaagtgctaggattacaggcataagccactgcgcctggctgagaaaatagttttgaatataaaggaactcagggaataatgtaaacacgatttttcctcagaatctactacaggtacacttcatcaaaggaaagagacaatggtggaagtccaccaaaggactgacggaacacactaatatatttacttgtagagctaggactaaaacaagggtgaggaagaacagtatgtaaatgctatatattctgacaaagtggagtgcaagaaaacaaagaaaaagaaaatgggaggagaagagagaaagaaaaagtgtcactttaatcttgaattgtccaagctgtccctggtgttcctacatgattgaagttgggctctccaaacatttacttccaggtattttttgtttgtttgtttgtttgccatcttgactcaaatttttaatcctgcacattgatccaaaatagcctgtcactgttcactcctcagtggagctcatgcagcaccaagccttccatagacctcccctggagctttctcgtctcccactgtttggagggcagtggaggctgtgggtccttgaggagatgaaaggacaagtagaaatgagatggaggaacttgaaagagaggaggggatagcagtttctcttgagtaagtaaaggaaaaagatccttgtatctacacttgttgcaattatttaattagcatatcataaggacgacaactgtgtctattacaggctgagggcaaaacgtgtgatttaaaaatgatcagaccttggccgggcgcggtggctcacgtctgtaatcccagcactttgggaggccaaggccgccaggcagatcaactgaggtcaggagttcgagagcagcctggccaacatggtaaaaccccgtctctactaaaaatacaaaaattagccgggcttgggggcacacacatgtaatcccagctgcttgggaggctgaggcatgagaatcacttgaacttgggaggcaggcagaggttgcagtgagctgagatcgagccactgcactccagtgaaactgcatcatctcaaaacaaataaataaaataaaataaaataaaaataataaataataaaaatgatcagaccttgtttgatctgtgcaatgcctcttcagcagactttcgatcacaggctccagcataccatggcttgcagagaacgccagcttcctgtgaaatggagggcactggtcagcatgggatggtccctacttaactctaatttctgtgtactagaaacaaagacccatttgcattatcaagacaggcctctacatttacaccaataattttaagatgagttttatttttcctttgatcaaacacaaggattataccgttaacttgttttttgtatttttttttcatttggccttagctaggttcctgaattatttctttctttctcctaaataagtaataatccccctttccattgtgctcttattgctcttactttgtggagtgctttacaatttccaaagcatttttacaaatattattttatttgattcttgcaagaaaggatatatgccttctttgaaggcaagaaggacacatgctattatccgtattttacatttttacatatatttgtatggaaacttagaaagacttgcccaagggcacacagagtcctttctctgtccctttataaactgtgctgtcttatatgtgatttaatatcatcagcctctacagatctatttggaggaaattacaaagtttaaataaaatctatgtgagaggaagaataatgaaaacacatttccttgctagttttgaggaaacattaactggagcaatgtcttagtcattgaaaaaaaacaacaactgggtattctgtccctattaccaaatgacagttcacataatgatgtaaaatacagtctctgttctcaaggttcactccaaatgtcttcttctcagaagacatgctctttcctgcagtttcctggtaacaatttagtgacatcaagagttcatttcatacctgttctgaaatagtggaattagatgaaaagctgggtaggggcccatccacagttgggtttcccccttctgtaaatcctgaaagggatcagaaaagtccttcaattaatcttcatatttcttgaactctttctatgcctatcccctaacactgtactaggtgctgccagggacacatccaccaaaaaaaatccttaaggcaatggttccaaaagtgtggtccaaggacccctggaaatctcgaaaatcctttcaggtggttcaagaggtcttttctttttgaattacctatcactatgaaacccaattttcctcatgtagttccaccagaaaaacattgcaacagatgaaatgtagaaacagagatgagaatccagcagtctctgttatgttgcagtaacatacattaaagagatttacaaaatgtaaactaatgccactcttttccctaaattgtttttgtttggaaaatatagttatttttcataaaaatattatttatgttaacatgtaatgagtttaatattatttttaaatggattaataaatgttttaaatgtctcagttttaattcttaaaatactaggtatcaatagaaacatgtaaaccaaagctctttgggtctacaattattttaagagtgttaaagtggttctgagaccaaaatgtctgagaattgctgacttcaggcatcaactccctcaaagagtttacagtctaaatgtggaaacatgtgaaatacgaaaaagacttatctgcattcattcattcattcattcattcattcattcttgtttctctgccatggatcaaaggcattggggatatacagcagttaacaaaacagcaaaatgccctgctctcctggaacttaaattttaatggattgagatgggcaataaagacataagtaaaaaatatatatataatgttagagggtcataaatgctatgaagaaaaataaatcaggaaaggaagaatatgtgggtgagatctgcaggtggagagggaggaggcactggacatcccaggaaagaatgtcccgggtagagggagctgtgaaggcaaggcctggcatatctaaggaatagcaagggtgccactgtgcctggagtacagtaagaaaaggggagaagagtaagagatacagtcagacaggaggcaatgaagggaccagatttataggacttggtggacccttaacatgactcaagagctgtaatgaacatgataagggaagcttttggagggttttgaacaggggggtaacatgatctgcctatgttttaacagggtcattccagctgctgggctggaaacagagggtggcaacagcagagtgggggaggccagttcggtgttcttgcaggagatgacagtgacttggacagatcacagcagtggaagcagtgagagtggttggattctggatctattttgaaggaatagctggaaggtgtgtgaagaaagcaagtgagaagtcaagggtgactctaaggtttttgacaacagcaaccagagttgtcctttattaagatggggaaatctgcaggagaaagaattctggataaactaagtgcttcagataatagtgccctggatgtttagagaaggcagccaccattgtaagaggagggggcagtgagggcttggcaggcccaacaaagatgggccaaaaggaaggatgtattctaataggaggggaacagcactcccaggtgagagcagcaaaggtgagtgagtgaacagactttccctaggtgcacagtgcagggcagtttgtggtttctgcagttctggcagttggaagagtacccatggctaatattttctgacacccgaatgtgctaggcctattctgttttcaacatgcgtgcatctcgtcctttcaccagctctttgtggaatgagctattatgcccattttatagaacaggccttctcagaccatcctgtctacagcagcagccctccctgcctccgttactctctgccacccacccctgctgctgcgctgtatttttctttatagcacttcagcatttacctgatatgatattatttgtgcgtttatttttactctctgtctccttcagtagaatataagtttcatgaggacagggtctttatttgtttcgttcatccttgtatctcctgtgcctagaacaatgcctggcacacggcatatggtcactaacaactgaatgaatgacttggtttgaaaaacggtaaaaggtataataaacctttttaaataatgaaaaataaatttctgtagccaaatcattttcactttgtgttgtcagaattttttttaaaaactagtaaaagtttcatttatttaagatgaatattattaaaaatttaaaaagccaatttatgtttagtaaaaaaaatgcataaaaattttgcatgtggacaattactgtttatttaaatggatttaagctttattattttggaatatatcccaaattatctatgtaaagcagagtttttttcttcctttttttcccacattgagttgcaggcaaattaaggtttgggcagttacgttctgtgagcctgacttatccgattcatatatttttagggtgatgtttgccttggaaaaattatccagatatttgccgtatcttctttttaaggtaccttttgtagacatattttgtgatctttaaaatatattttgacttaatttaaatcggtattatttgtttagaaccaaacactatagctggtgcttcccatatgttgttttacttgatcttattattttgaaaacagctgtattgtttttgtaaaaaaaaaaaaagttaaaaaaggatgcatgatcagtaaaatattaaatcgctactaaaaaaagtaaaaattgcctcaaatatatttacttttcaaaacaactctgtgaaataaacattcttggccccattttacaggtaaggaaacaagtgggagaagatgccaggataacgcagctggaagcgacagtgctgtgttagaacccaggcctatcagactctaggatccagcctcgaccactccctgatacactacatggcttcgttgtacttacttggcagaggtatgggtttttggtggatttgtctgcaagaaagaatttcagataattaaaggacaaagcacaatatgagtaagtttgactttttgtttacactgatgatgctgtgaacaggcacatcacaaataaatcaatacaaatggccaataaaatgtatctaaagataaaagagccaccaaaaccttaaagataagtaagactcttccttttagttttgaaaaaggaggaaatcttgactaaagtattgtattttagtcaagttcaataattaacccaattagtaggtctctgcaactctacacagttattttaaagttgctcaacaccttttaacacgtaactgcaaaacaatgaaatgttggatttttacctagcactgcaagtcagtgtcactgtgcagtgaaacaatgcacatgttaattcctgcagcaacaagaggaaactgatctttaaaggaaaggattcttacttctgggcaggaggaaacactggtgactgcacagcttcttgtctgtgacttgaccctcggtggcgttcagcaggtataggtttttctggatcaggaaaattatcatattaggattagagtgaaatgtctgtcctcatcccaaaacccagcaacatcagctgagaagaaccaaatttgatcagaagtcttcccgggaacatgtcttagttactgagatgtcatggatctgtgcacttgccagtctgttgatgtggttgtgctatgaggaccaggactccctcccagcagtgttacaggtacatcctaccacctctgcattcatccactggcaatgtacatagagactgaacccacgggccctgaaactttaagtgtgtgagtataggtggaagccagaagatgagaacattttagccaccctctaaacaactcaccctctacttgccatgtggcctccacacaggtggagacaacaccctggtgggtcttgattagtcataagacgtggtataagcagtgtgttactgataagaggcacactactgagttcataaatgatctctttttgcaaaattaattggatcaaattcaaggttatccctataataatgtaaatctcacttgcatttcagtgttttcctgagcagaagaggaaagggtgggaaatgagcataaacctgaagtgtaagaaatttatgttgaagcccatagtgaactctactgctgaaccattaataaatgtgatcacacattattttaatactttactctccctcaaatttgtcgttggggggtggggtgtgttaaaatcttggtatgttcatgtgtgagtctgcatggaagaaaggctgagaactacagaaaccccaaagaaataaaagtagtaagaactcaaagattcaaataaatggtaagatagacgtcagggtttcttaccattcagtggtgcactaaagcttggaaaccttgaacctctgaagattgtattttgaatttgtggcaagctacttcaaacctctatgttagatgttttgctcatgacattaaaacttggtaatttcagaaggagaaacaatgaacaccttaggtcttgccagcctataagctttgactacacctgctctgcctccgccatcctgattccttcctaggctagtagaggccactcactcactttgcatttggatggtaattgcctatgctcttgaaataaataacaaaggagggggcatgcctggcaggctcctgtactgggaaccctttgagaatgaggacacctaagcagcagtggacatgccttgggccctgcttctttcctggattttggaggctcttgtagccatgaagtctgcacaggttgtacttacttcctacagatgctcagagctcctgaagtcactatcactccacaacctggactcagcaggtctgagaggctgcaaggaatggaagtacagaaaagacaaaagcctcaaagggaaggcagaagaaagcaatacagcagaaaaggggtgatgcctcagaaatagcctagggaagcaagatatgggagacaggatgaaaaaacctaatggcgtcattaaagcagagaggtgagttgtagtgcatgctcagaaaagatccactgtccatcatcagagaaaggagagtgctttatgtagatatacgcacatcaactcagggaagagggagaatactcactacatttttaaccctgggtatcttcaagtatggaattaaatgggtacagggcatgaacttctatataatgttttaagtgctgatattatagatgattcttctatttttttccggtaatttccaaacacaattttttttaacatgagcagtttctaaaaatatatataagatttttgagtgatgataaaggaagaaattctaaattactcaggaggctgaggcagaaagacaacttgagcccaggaatttgaagctgcagtgagctataattatgcaccactgcactccagtctgggctacaaagtgagaccctaactcaaaaaaaaaaaaaaaaaggaagaaaagcaattgaagatgtactaagaagacagacaattgaactttgaaaacattatcttgaaaacttagcaaaagaacttgttcaaataaacagatttttaaagttttcattactttaagtaagctattagttctaaaacatgtgaatggctctacgttagttttcacatttatgtaaggtcctagcactattgcctggcaagtcatatctgtctgccaaaaggcaggtttttgcatgcattctgtagcctactctaaacatgctgaggttctgagctagttttgctgttcattgctcattgcaaaaactattttgtttagaaaattgagtttcatgtttacaattgccccaaaaataatgtaataaatgtgtacatacaaatccttaataaaataacttttagaggacatgctcatccttcaaaataatagattttaccttcacaaacacttgaagcattctgttgagaggcaactggagtctatgtaaaagaaaaaaaggcaaggttattcaatatagcagaatgtggaaataaatgtcagagcaatattattaaaataaatattttggcagcacttttctttgatgcattgctattctttcaatcacaacaacaattacaaacccacagtccctagcccaacctttgcattaagcaacaaacagccagaagtgtcctatgaaggagcaatgtcactgtggtggagaaacctccctgccttgtcaacagggttgatggaaatcatgacccccccagcagctgccacatagtaacccatgtacagcaggcatctggcatctgctttggtctcatgaccccccccttctgtgtgtttgctaaatgattgtaaatgtcaggcttcacagtagggactaggtccaggtgggctcccttatgtagtgttgtggcccaggttcaccatgttctggccagaatctgagtttagtgaggcctatgtgtgcctgatacacaatggtctaccattagctgtggtggggagtggacacagacgcttcctgtggagagggcagggaacctggctgcccctctgatctgctgcgcacactcagtgaagctgctgggatcaagtgaggatgagctccttctatgctccagggaggagcatcctccctggctacctgaggatttgaagcttctcttggactgcttgggcagcaacttcagttgctaagattgctgtgttcaccatagctggaagcattttcaactttaaataaatggataagaataaacactgcaggaaatatgaagcacttttaaatgcaaaattaacttactgtcttcagtggtgtcgttggttttttcctggggaataaaaagagatgagctttgttaaaacacaacgaagacaaaatggagctatttaccattattttagtctcaaatttaagctagaattatgaaagcgatacaagtgtgtagaagactatccttgcagggtggagagggatggaagtgggatttagttatgatcctcctaggctcagatggagtctgctgacagatggggaaggggtcaactggggataaagtagggcaccagtccggcagaactggactcttgcaccagttgcactaattacttggcgggtgaccttgggcctctttgtcttgagtgtgaggttagattcctcacctgtcaattgaggaccaggatcagtattttcagtgtttctgtggagccccctcttccccaacagctccctgtgggggttactgtccaggacagagggtagaggtaagagggtggtccagcaggtgaggttgcagctgcacttgcccactccagcttcctccctgtctctagggactattctccactgtcttctgtgcaggctttctttcagagagatccgaaaccaaaacaagtttgaaaaccactgatgtgtggtcctgaaggtacttgcctgcactaacattctagtttgcaaaatgattcaggtgctggagcttctgaaagtcggggtgtcttgtggaacactgtaagtcaatgaactcaagattccaatagagactggagtctaatattggtaaggttgtatgctccttttctgtgtgttaaatttcttaatttaaaaaccctcaccatatctctctctcgctttgttttcggctgagagctgaagtgtgggggaagaacactaagaattcctgagcacctgtaagatgcctggcactgggttaggctcctcaggtgctatttaaaccttacagtgacattttaaggtgaggaaactgaggctcagagagacgaagtagtttgcccaaagtgatacagctgaactaagagagacgtatgcagagttttggttaataaaccttcaacatggaggctttctttggtttacacagagacagaaataagattagagccattcaggccagctttagacatatttaaatttgctttccaaataacctgttgagccaacataattttacggggtgacgtttgtaatattaacacattacaatcgtcacctgactgtttacaaagcccttctaaattcaataagaaagaatgactgtcactttcgagaggaacttcagtcgtatggctttgagggagtgccctggtatgaccagcacatagtatatatctacacacttatttacagaccataaaactgagcagcagtaagtaaagacaaaacctgctagaggctctgaaaatgattcaggtgctggagcttctgaaagtcagggtgtcttgtggaacactgtaagttagtgaactcaagacttaactaaaacttcacaggaggaaatacttctagatttatttatttatttatttatttattcatttatttatttatttgagatggagtcttgctctgttgcccaggctggagtgcagtgctgtgatctcagctcactgcaacctgcagaggttcaagtgatcctcctgcctcagcctcccaagtagctgggattacaggtgtgtgccaccacgcctggctaatttttgtatttttagtagagacggggtttcgccatgttggccaggctggtcttgaactcctggcttcaagtgagctgcccgccttggcctcccaaagtgctgggatgacaggcctgagccaccatgcctggctcatttgatgttagcagggctccttactcttggtccaagttgcagcctgccatggggagaacttctaatgaagtcaacagggcagtggggtatcaccatcctcactccccagatctcaaaagctgcttcctgcaacaggtacttacccggcccgtggcaacggggatggtgcagctggtggaggtgacttggtttcccaggccccactgtttcgacctgcacaaacatatacactactcagtccccaagtcctgagccgggggctgatgctcacactgaggctggcctctctggcaggctcagaaatatttgcacatactgtgttgctttcagttaagcacatataggtagttatattgaagctattaaggaaaacttgtgggcaaaggtgatgacacattttaaaagtgtcagtgtataagctcagagctgggatgggggttagggactccaccttaacatttctaaaggaccttctccttacccgccccctgccccatggggcaagtcctgagcccactgattctgaggactcagtgaggacccccacagaggtccttcaggaagggagccaacagctcacacctacatctgtgcacactgcacaaatgtgcacggcagaggtgcccagagacagaggctccaacccaccactcctgacacagacctcagacagtgctcctttataagcacacttaaatacggtaaatgcctctaacttcacattcagaggatatttactcactcatctctgagttttcaagggctttcgccgacaggttttccttaatggacaaattgagacaagtgcaggctgctgcccaaatctcatcttctcaagtcatagaagggacccgaagggtcttgtcccctgcacccaacctcccttcctgtacctgaagatagatgccagacaatcgttatgagggaggaagtgaaagagaagcaggatggatcttcactgtgggacagagggcaggccaggaggggagaggccagagctgagccagccccctcagcatcccctagctgcctcagacatgatgctcacctgcttggacaccattgctcagtgagaccaaggggtctcttcatgaggctcttcattaacttaactgaactgaataaatgttttcttaagaacttactacacatacaagtccacaattccgtttttttttttttttttttttttgagacagggtcttgttctgtcacccaggctggagtgcagtggggagatcacagcttactggaggcttcaaactcctggactcaagtgatcctccccactaagtagctcctgagtagctgggactacaggcatgcaccaccacacctggctaattttttgtccagatgagattttgccatgttgcccaggctggccttgaactcctggactcaatccatccacctgccttggtctcccaaagtgctgggattacaggaatgagccacggtgcctggcctataattcctaatggatttatagggcatactctgtaagtacaggctggacctgctgccctcagtctgtactttcttagtttatgagatagagcacagataagcacacattgaaataataatccattaccaaggattattgaggacttggtacatgtaaagcacatgaaggcactgtgttaggggccgaggaagaggtgaagaagcagacataggcctctgccctctcagaatttataacagggaagatacatgcaccctccatatcatctcatccaaacacagacaagaaaaagaaaaggcctcaaaaagtattgaaatagagttcaggaagttccttcccatgtatgtcactggagagaggctcccaggcttctactcagagcccactgactcttttcctaaaccctcaaggatgggagcaacagcaaagagtgggtggtgtggattgtacctggaagccttccccagcaccctgggaagcaatgccccctccatgacagctgtcttccacggtacctgaactgggtctgattttttgaaacattttggaaaagagattgcgtttggaatgtttacatttcatgtgacaacatgaaaacaataaactgaaatgtcacctgaatgtgtagtaggagtctccctgtgtttaagtaactggtgtatcaaattgaatacttaagactgacactgttaaagtacccttgactgcaatagaatttgatggaagatctcagggaagtggaacaaaatcttgtatgaaaaataaggaagtagaaagaaggtctaagtctgaatttcatcccaggggttttccctcttctgaaatgttaagggctcctttggccactatattatctttgtcagaccttcctcctggcttttctactatgcttccttttcttgcatatctcagaatagtctgccaaaaccttccttttcctttccttccctataaataacttctgacaatcagaggacagcatgattgtcatggtggaacactgtcacggaggacactggtggaaagcctatggtcttgcctcaggaagacagagttctagggaaggatggagcatgactcttcatgggtcactggcccatgaaacaatattgttccctgataatatctgccagaatggtcatggatcaaggcaggttgaacaagggattctgaataataacaataataataacaaagcactagcattttatgagtgcaagtcatctatattgagtcacttaattctcatggtatctactcatgatacccctaggcataggtgccattttttcagaggaagaaactaagaaacagagatgacttcacttgttcaaagtccggcacctagcaaatgtcagagccaggacctaaacctctggctttggagtcggctaaatccattctactggcttctcaagcacagcggggacggcaggggctgtcactgcaccagatttactatatcaccctcggcaggcaccttattggctatcaaaggaccaagagcaatattgaccagaggaaactgatgtggtgtggtgctttgacagaaacaccaactaggcacctgatggacacttttgtgatgcccactgggggactatctgaagcctttaaaggggaatggatggttattcaaagacacaggctagtagtctgatcatttcttttgtaaaaataatctctgaaggttccactgtttgcacactcggaaacccactcggactgtttaggcttgtcccttcaaaattatttcacttcttcccccttcctgtaggtactcccacctgtatgtgataatcacataaccaggacattattttcttgtttagatttgctttcttcatctgatgaccctagtattaaaatacagctataccaggttaatagcaaacttatgagtaataaatccagctggctaaagccctgttggtgattctttaaatatttaatacaaccagtgtttgaggactcattcaccctctcaaccaactgacccctccacagtctcggcacctcccctgagccagatcctggggtaggccctggaaacagctgtgagcaaataaagacagaaatctcagggcatgtgcagggcactagagggatctgtcccagcttggggccaggtaaagcctcctgagcaatgacattgaaggcaaggtctccaaggagcttgcaatgtacttaggaagcgattagactgagacacaaagtaattagggaataagtacgggctaagtgtaagggggaagagacttcctgcaaaggagagctctctgagggctacagaaaccagaggagtcttcctggaggtggaggcctcaagctgggccttgaaggatgagtaggattaggtgtcctaaaagtgagaacacaaagaccaagaagcaagacccgtgacatacaggctgattggagtactgggtgtgttttaggaagaggaggtgcttgtaaggcagtgtgttttaggaagaggaggtccttgtaaggcaagtagagctttgtaagaggtaaacaccagatattagtaatctatttctctaaaggagggttgaggtcttcatttatttatttgttaaaggttttctattccagtaacaacagccctcatcctgagttatcgggagttaggagtctccatttctgctggggcctaagcaacctggtcacgatgttttagattggcatgtttgacctttgtctctccagagggtaagatgagctggctaagatggctctgagctccactccccacttataaagcgcttgtgggttctgaggagaggttaagtaaaaccagaacttgtgaagaaagtgaataatttcacaagaaatgagtccaggaaaagatttttaaaatactcgactgttctttcattttctgtgaaggagcctgtctctggaagcagagctcagcctctcaatgacttgtgttcagctctgtgagagaagagagtgtgtgtgtatgaatgtgtgtgtgtgtgtgcacacgcgcatatgtgtgcctaggggagagggacaaggggagagagggagaggaaatgcctgtgagaatgctggagagcaggctcctacacctctctgtgctgttaatgggggtcatgggcacccctcagtgtcttgggctcagccttgggggttgccaaaacctataggagcaaccaggaacattcatggtttgggggtaggggtgacatggcaaagactagctttgtggtgagatgaaactggtaacatctggaggagttcagcggctcagtccttgtcgctgaggagagagccaagaggcaggggtatggctgctggacaagaaggtgcaaggtggctgagtaaagaaagcccagactagggtggtcacagctaaaatggaacagcaaattcaggagaaaaaaaagcaggatttggagcatgtggcctggaggctctacgcattgagaaacaggggtgcccgcaggggagggaggagtgagtttagagtcctgtgtgggagcatcaaggtgttcagaagggaagtcaggttggggttggatgccagggagttaccagtgtagacttgagacatgaatccagattaatcgatgaacgctacagaagtgaaaaatcattctctctcctcagcacttagtgtgtaccaggcactcattaagagtttcgcattcacatttgcagaattctcctgtcacagagtaggggctatgagcaccatttacagaaaagaaaatctgatgcttggagaggtgaagtacaagcccaaggtggcatagctggtaacggggcacactggggttccaaccgaggtctgtctggctcaaaaccaagcttgtaaccatcatgatgttctgaaagaactgtgggttgagggctgagggctaaattccgggaccccctcagtcaaggaaggggacacagagaagccagcaaggtgcccaggaaggtagggtgaaaaccagaacttgtctagcagatgccaaaaggcctggggaaatggccacttccacacacgtgccaccagacagtgcatgaggatgaggactggccttctgttcccaatattaagacatttggaaatacaagtgattactcttcatagttgatctgtttttcttatttgaaatagacgtaaaaccaaaccaaatcacacatacactttacctgaagctgttcctggaggagaggcgggcgttgaggaatttggcttggttgatctattcaccatgggagcttaaacacagaaatgtgtgtgtatatatatatatatatatacataaaaccattacagatacatgccattgaggaaaattcacactcagggaaaaatgatgaccagaccagagaatttgcaaagaatgggagacacccttattagacacacaaaccaataaaagaagtcttcttagaagaaacatctttagaatgggaatatcaatgacagattcataatttgatatattattatttgattatttgatgatagagatcttgttaaagtgaataatggctttgaatttcatttgccaagtgggaggtctaagagataaaggagttttattgtttttgtttttcatcaagagtgtattgaaccccttactggaggggcccaattaatagctccacctcccctaccagatgcaatacacaccattgctctgggatttcatgggtttttttctgttcttttttgtttttttaaagaggggttggtaaggagggaatgtgtatttgttcttttgtggtaatgggtggcttgggaattcaggtgggtcttgaagctgttggtgataggtacggagtacgggagagggttgctacatgatggcggactgaaacctgaatatggctaccatggagttgagagtagtagatgagtaatgttacctgaagaggtatcacttgtactggatcatattctccatagtgactatattcagagtaaacataccctgtttccatgcctaatcttatgtagcactggctttttaaggtaattcattggtcatagcatttgttgttctgtgaagggtttacggatgaaatgtttcataggcttatcatactactaaatttaaagaaccaggactcagggcatatttcactctttcattttttcactcctctgcagaaactgttcttggtgcaatgtttacaaggccaacatggtggcttgtgacattgtattaggttttatgagaaatccatttgaagcgagggcagctgaagagaactacccaggtgctttcataatgtgagatgggaagattaaagcatggaagaggaaggggaaggcagggaagggctatgatacacagagatgggttgtcactgatgctgtctgcccaaccagccaaagaagcacacactgtggcccaggggagaaagtcctgggcactgtcatttctgagcctcttagtgcttactaccaaatactcttatacatcctgatcaactgctaaaaattttcaggtgcttaaggcgacaaactcttacctttttcaggtggaggtgaactgctttctgtgggatgaatatagttttcatcattatcttccacggggaccacataatcagcctaacagaaatacaaaactgaatgagaagaatgctgtacattcatagttgactgtatgggagggagtgatttttttaaaaagcattattgagacgcaattcacatatcataaaattctactatgtaaattgtacaatttggtgacttttagtatattcacagacatatacaaccatcaccacaatctaattttaggacatttttatgcaaaaagaaaccttgcacccattagtcactccccatccaccgcttccttgacctagtcgaccacaaatctactttctttctctatagattttgcccattctggacattgaatatgcacggaatcacacaatctgtagtcttttgagacttctttcacttagtataatgttttcaaggttttcctgtggtatagtatgtatcacaactcccgtctttttatggccaaataatagtctattttatgagtatgccacatttgtttatccattcatcagctgatggacatttgagtttttttccactttttggctgtaatgaataatggtgtcatgactattcatgtacaagtttttgtgtagacatgcatttctcttgggaatatcctagaagtgaaattgttgagtcatatggtagctctaagtttaacagtcggagaaactgccaaactgttttccaaagaggctgcaccatttttcattcctgccagcaatgtatgagggctccagttttttcatatcctcaccaacacttgttatcatcctttttattacagccatccttgtgtgtgcaaaatgatatctcattatagttttgatttgcatttccctgaagactaatgatgttgagtatctttttatatacttattgtcaatttttgtatattctttggagacatgtctattcaaatctttgcccatttttaattgggttgtttatctttttattgagttataagagttatctatatattctagttataagttcttcatcagatatacaatttacaaaacttttcttccattctgtaggttacttttttactttcttattggtatcattggtggcacaaaacgtttaaattttgaagtctgttttatttattcttttattgcttgtacttttgatgtcatatccaagaaaccattgcctaacccaaagccataaagactcatatctgtgttttcctctaagagttttacagttttagctcttacagttaggtctatgctacattttcagttaatttttgtgtatggtgcgagattagaagtccagtttcattcttttgcctgtggatacatctagcaccatttacctagcactatttgttttaaaaaagtatttctctattgaatcgtcttagcacttttgtcaataattaaatgacgataaatgcagggagggagagattttatattgacaagacacaaatgaggtaaccagatctcaaaactggtttttaccacctgccctggtgggcagccaagaagggtactaggagaaacaaaaacaaaaatttattgccaggtgttcttctaagtactttacatgttttttttctcatttaatcctctaacaacacaataagagagatatcaccattggctccatttccagatgaagaaactgaggcacagaaaaattaagtagtttgctcaagttgtcaagtttaaaagtggtagacccagaagggcacagtggctcgtgcctgtaatcccagaactttgggaggctgaggcaggtggatagataagagtccaggagttcaaaaccagcctgggcaacatggtgaaaccctgtctctacaaaaaatatagaaaaattagccaaacatattggtatgcacctgtagtcccagctactccagaggctgaggtgggaaggttgcttgagcccaggaagctgaggctgcagtgagttgtgattgcgcttggcaacagaatgagaccttgtctccaaaaaaaaaaaaaaaaagtggtagatccaggatttgaactcaagcagttcaataatttagcacccatacttttatccaccacattctagtaccttccatcctccccctcctctttctgtcttatctatcctctctttatttaattgctatttcttatctctttcttcacctctgaagctggccgagaggcaccagagagttctactcacacatctcaatctgcagttatatttagagatgatctggctgagggagatgaggctttggaatcatacagacctgggaggaaatctgtgcttgggtcttttctagatgtatgacctgtgggggagttaattgctgaatcatcggaagttctcctggattctgccattcagaggtgggcacttgctcctctgtggcacagggaacctggtcctcatctctgcttcgtctctggccccacagtgtcaaactatgaactcccgaagggcagggccttctccttctctgtgtttgtgtttccagtacctggccagtcgaatgcctcactgaattgaattgaaattgcctaacccaatagccaaggctgggatgggctgacttagcagctttgaataatgggatgttgagtggctgcggatccctgcaggacctttttggttctatgggttcaccttttcggattcattagtagccagagtgacatgctttataagaacccaacttctcttctaggcgttagttcctataaaaggagaggctgagcccccaggaggcatgccaccctcttaaaccctgtagtcaacaaaatccttcaatatcttatgtctgaacacagaatattggtattgacacttggcaatgatgcctgaatggatatagggaagttggaagctccaggccctaacccagtcctacttgaccacttcaaaatgtattctttcctctgtattcttaattttgtacttgttttgttctgcagtgcttgattacagaaaatgtttttatctgcagtgtttagaatctgagctgtttagagtcatgatgatataggagttaagaaaaaattacttaggcagatagtgagggtaagatgtccttggtaaggttttccttttaataaaaagcagccccaaaatcattttcttttctaacaaagagtagcctgtaaaatcaagctgctgatatagacaagcaagctggaagcttgcatgggtgaatgctggcagttgtgccaataggaaaacgctacctgtgactaggcatgatcaaaatggtggctctgtcttcccctctctttgccagccacctgtacagtaaggagcagacaagatggcactggccaagtagaaaacccatttgtataataagattagggtggggcgaccagcctcttctgcaccatgtaaatgtcactcctgatcaaaccaatctgtggaccctgtataaatcagatatcacctcctgaagcctgcctctaaaatctgctgtggtccacctcaggcttggttttcccttcagattccactgtcttgcaagagagagagagatgctctcctctctcctttcttctgtctattaaactttctgctccttaacccacccacacgtgtccatgtcattaatcttgtcagtgcgagacgacgaaccccaggtatttaccccagacaacgatgccacttcaatgatatttctggaatggagacatttgtattcccaaagaagactgataggaaaaaagactcgatccagtctcaacaaattctgtttgtagtgtctgcccaactttctcatctttatagggttttaggagaaggaatgtaaaatgtatattcccagcattgcaattcaatgctttaacgttgttattgctgaaataagtaaatgaccaagaaccatcacattttatgtcctttattaggacataatgtggtcttattgaccactttgacattgctgcagtgttttaataccaacccccttctttcatgaacaaaacacaaaaacttgacttcagtgaatcagtgattggtcttttgaagccaggtagattattatactaccatgacctacaggtattagaaatccttcttcaattattacaatgacatgattcaaaattaaaaatagattaaaaatcatcttagatcaactccaatgtttagatgtttcagtattaataagacacttgtcataattgtttacatgtttgcctccccctaggactacagatttgaaaaataggagtagcgtgaatttatcttattttcactttcccatcggctcataccctattacttagccggagtcattttgattagctattaaatgcccacatgggctgcatcctcattaccactcatataagcatttaaaagctttccatacattattttattgaattcttataaaaataccctctaaatatattccctctgtgaccttgggtaagtttcttagcccctttacacctttgtttcctcatctgtaaagtggggctgatgatagacttcatagggttagtgtgaggatttaatgagataatgcatacaaagtgctcagaacaccagtggatacacaacattctccaagtgttagcctctctcattatagcacagatgctccttcctcctaaatgtctttgccccacctccagctctctgtttagcctgtatctctgtattttgcctataacctgcagagcagggttaaacacttttatttatgcttgtacttgacttcttcttttcccaactaatggttcagccatatcttaatgttggcttctgtttgtttgtttatttgtttttacacctctttcttatattggctctctatctgcccattccagaacgcccccgccttcatacttctctttttcccactggtgcagacttgcctgagccacctccacaaggctgctattagcaaacctctgccctgactccctggggtccattctcagttatttacagaaatgaagagccttacataacccacagtattcatctgcattctatatctgaatttgtgtcttcatgtggaattgccaaatgctgaaataatttacagtgagatcctaacagctggtctccccatcctgtcccctcccctgctcagcttctctttgccaccctattcccacccttgaaaggacaacatcgcctctcagatgggtaggtaatagtaagaaggagtgtgtgcagggtgagggtgtgtacatgcactgtatgcattgtgggagctatgacaaatcaaaaaagagaccaggattcacagctgagagagagggggatgccctggggcccagttgctttgaggccatggctggcctggtgttgctagatcttcagttttcagaagaaactagaaaactggattttgtcaaggctctagaatatggtagaaaggaatccgacatatattaaacccctctgtgtgtgaggcactgtatttagtgctgtacatatgttcttttattaaattctcaaaataacagagatgaaaaacagactcatagaagttgtctagcttgccccaaatcatacacctagaagggccaaagcaggaatttgggcctagatgctgcatctatttttatttaaaagtccatcttttccatctcctgctgggctgcaaattttataaaggcggaatgaaggtcatttcacaacatgtgtgtaagccataagttttatcctctacaggcaagttatttcttagagaagctgcaggctggtctctgtccttatttaaaatgcagggacctctgggagccataacacattaggctttatcagttactacgacagcttggatgagtttacctattcattttcaaataggagctatttcatagggaaaacaacacaaagggctaggtgctgagacagggaagattgaggaggtaaacccagagttggatgctgggccatctgaaaaggtgggtctctggacacctgctggggcagggcagctgtggggagggaggaagtgagaagcaagagctgtcaaagggaagtgagggattagctcctccacaggttgtgcggggtaccttacagactagctatctccattgtacatcctggcccatgtcaccctctgcatctgagaagagggaagtggaggagcagagagaaaagaaggtggaggaaagaaagcaaggtggcgacagtgttacagtgggtataatagctagtcaggcatgagcagggcaggagagggctcccctgccccaggaatgtcaggagaccatcaggtgattgtcaggtggctgttaattgtctctctaaaataataattggttacagccagcgccagggaaaagcagtctcccaatagatagaaaaaacctgaaactggtgatgagcagtttccgataagatctcaggagttgggcaagtgggctcaagcatgcgcattaagaggcaaaatggcagcgtttaactggtacttgaccttctagaaacattcagctggtaaggcaagaatgcttcaagggatcgtgcgtacaactccggtaagcacactgcgcatgctcacctcccaaatgctagcagggcactgcacaagcggacagcccacacaaaggaagaatcaggggagaagggacaaaagaccccggaagtgtgctagtgtataaaaccccaactcaaaggtcaaacagcgcactggatctctcaagtcgtccgcttggccctcttctaagtgtacttgacttcttttcattcctgctctgaaacttgccttggtctctccttctgccttacgcccaggaggcaagaattgaggttgctgcagacccatatggatttgctgtcagtaacaacaggacagagaagcaaaggagaataaagagagaggaagaacatcttaggaaggaaagaagagattcacaggaaaccccagggaagaaggaggggataatatgaggggcacagactcagtattgatattttaccatacacctctagtaaactgacatatttacaataagccattttggagaaaaccaagtccctttggtataatagtggagagttagagggggcagtcaatagcaggttgtaaagaaggaggacagccagcgggcaggctgtcctggtcgcttgccccacccccctctgtgtcctgggaagcctttggcacagatttactttacctcatcctcaaggaggcctttgggtttgggtgggacttgaggtttctgcaaagcagtcagggccggcagggtggaggtgagccttgctttctctgaaggccagctgggcttactgggaagtgtcttgctgaagggtggggaatgcctctggcttgatcgattgtcttgaaaggaacaaacaaaaaacataacataaaagaggctctggatcatttcctgggtggaagccattgagatccagaaagtataaaaccacgggtgtctatgtagccacaaatgatccacggggcattccttgaaagagtaaagtgaaatgttaggcccaaaatttcaactgcttattgacttaaacgacaaaaactggaagaacgtcctcattaaaaacatccttccggggcagtgatggacacccagaggttcaggagaaccaacaacccaacacttggccacacagaggggatggaagcagcactggagggcacagggtgggggtgaggtgctcctggcttttaaaaatgccaaggcctaggctccaccccagcctggcaacgtttgaactcctcgggaggagcctggcattacaggttggaaaagttccccaggttatgctaaagtgtatccaggtggtgattactcacgtggatcaacttccatgctccttccctcagtgatttcgctccattcacagggaatctgtgggatccctttggtccaggactgtccttctcatcaggtatcagaaaaggagtcaggctctaaggccaactggatctgagttctgtcccttgctctgccactcactagctgtgctctttggggctggttattcaacctctctgggactcacattcttcattgttatttttaattttttaattttttatttttttgagacaaagtcttgctctgttgcccaggctggagtgcagtggcatgatctctggttactgcaacctccgcctcccaggttcaagtgattctcctgcctcagcctctgaagtagctgggattacaggcacccaccaccatgcctggctaatttttgtatttttagtagagatggggttttaccatgttggccaggctggttttgaactcctgaccccaagtgattcacccacctcagcctcctgaagtgttaggattacaggcatgagccaccacgcctggccaacattcttcatttttaaaatgaggatcgtaatatcgaccttagagatcttgaggggattaggaagattgcagtgaaggcagtaggtacagtgtgtctgcctaataagtagaacttatatcacctgtgccatgtgagagaggcgttaggcggcctcaagtctacccagtgattcagtgagctgagcatagattcagactgatgtgttttaggaaaatcttggcataggaataacctggcatgttcttcatactgggaacagcacaggtgctagcactggcctctggattgcatcactggcctcttgctgctgcttcctgtgacagccccacctcgcccggtgcagctgtccttgcctgttaggccctcgcctctatgctcctggtgcctgcccctgccctcagccctcactccttgttgaaggtatgtggttaacttcacctccgctgcctcctcagaagcctctttctggtggtgtggctgtactcaggcatgagggcatccttccttctgtgcctataactcttgtcagttttatttgcagctcctggagtttactcagatttctgagtaaacaaatatttaatgtaatatttaagcccatcagaagtagcaaaacacaggagacaggctttgaagagtgtgatttttttttttttttttgagacagagtttcactcttgttgcccaggctggagtgcagtggtgcgatcttggctcactgcaacctccgcctcccgggttcaagtgattctactgcctcagcctccctagtagctgggattactggcatgcaccaccatgcccggctaatttttttgtatttttaatagagacggggttctgccatgttggccaggctggtcttgaactcctgacgtcaggtgatccatccactgtggcctcccaaagtgctgggattacaggtgtgagccaccgcgcttggccaagagtgtgttcttgagtgagccacttaaccaccctgaattgcagtagccctttcctccccagggttgctgtgatgattgaaaaagatcattcaccaagtatggtgggtggtgcacagagccgagttgtgatgagctgggcttcggaagctgagagccctggcttgtatcccagctccatcacttagaggatcttggcccagtcagttcactcctctgacctctttcaggattatcgaggaggttaagtagacccccaggggaaagcactaaactgtaaattagaagatctctgggagtatgtgcatcttgagtgcagctgaatgctcagtgcttagcatagttctggtgcatggcaggtgctcaaaagatcaactgtggcaacccagtaagcccagctggccttcactttactttcattcagtgaagcaaggagcagtgcctggtacactgtaaggagggggttaatggcagtgagatattacatgtagagccggtccatacaaatgctggcatcgccatgaccatcacagacatacttgctctctgaacctttggggaacttagtcacctgccaagactggaacaaagatgggcattaaaatgcatacttggggccaggcgcagtggcttatgcctgtaatcccagcactttgggaggccgaggcggttgtatcacttgaggtcaggagtttgagaccagcctggccaacatgaggaaatcctgtctctactaaaaatacaaaagttagccaggcgtggtggtgggtgcctgtggacccagctactcgggaggctgaggcaggaggctggacccaggaggcagaggttgcagtgaagcgagttcatgccactgcactccagcctgggtgacagagtgagactctgtcgcaaaaaaacaaaacaaaacaaaaaaaaaaacagacccaagctgtgtccatttaacccatgaggcttattccaggcttggggctcctgagcacctgtatcccctggtaaaaccgcatagtctggactaggcatgggaggaaggtgaggcagacactgggatcctcgaaggtcattgttttgtacagacttcttaagagaaatcccagaaccttgagcacacgaagccctaaaagtgggactaatctcagggttgctttcccttggagtgttgggagggagcacaaccatcagggtatgctgggtttgttgtttgtttgtttgtttgtttgtttgtttatgcctgctttcaatgttcccaatctaggaaagacgcctcttcccctggaatgggaaagccctacagcttgggatcctttacctcggagcccagatcccctgcttggaggtggcgggagcgggcggctggcagaggccctcaagcagcagccaggtttgtccccaccccgcaatcttggacacccccacctccccatgggcctggaaggccgagtgcccaggtctgcgggggacctcacctatatactcgcctctggcgaagggcagggctgggtgaaccggcctggtttcctgctctactggaggcggctcgtagctgtcatcagcgttctcctcggcgggcatcacgtacatctctgagtccgagtgctcatctggattttcatagtcgctgtcctgcaagtgcagatgcagacactgtgctcagcatccccgtctgtgctgcctggccgtcaggaccattcctgccttgggaggccagagcagtgacaggagacaaggcttggagaggttgacttcaaaaggctaggcagccgataagaggcaaagctggggtttgaagcaggcctttctgcctccaaagtttatcgtctccaccactgcactgtccttgggggacacaggaactacttaacgctaatgggagctgacactctgtagatccacaacaaataacaagaggagataataaaacatatttttaaaagataggaaaatggcccaataaaatagaataaccaatgggttttatctattatgaatgctgatcactgaagagaaaataggtttaatacgaagagggtgaggagacacacagggccagctagatatctttcagatgagattttttaaaaatttcaagcagaattggtaagctgcagggtcaaggcttcaaatggactcagggtttgctctcttttttttctttttttttttttcctgtttttgagatggagtctcactctgttgcccagactggagtgcagtggcgcaatctcagctcactgcagcctctgcctcctgggttccagcgattctcctgccctagtctcccaagtagctgggattacaggcatgcaccaccgtgcctggctaatttttttttgaaaccgagtcttgctttgtcgcccaggctagagtgcagtggcaggatctcagctcactgcaacctctacttcctgggttcaagttattctcctgtctcagtctctggagtagctgggattacaaattgcaccaccacgcccagctaatttttgtatttttagtaaagctggggtttcaccatgttggccaggctggtctcaaactcctgacctcaggtgatctgccagcctcggcctcccaaagcgctgagattacaggcatgagccactgcgcctggcctgtttttttaaaatccacatttcatttaagtccacactgaaaatacattgtcacggtctgaagtccaaatggcttagaaggatataaagtgcagtctccttctcagcctctctgcttctcaccgcagaggcagaaagagtcactaggtttcttgtgcatgtttttcagaggtagtttatgtatataccgtttgtacatatattcatgtggaggaaatatttgactcaggacataagaggtcctctggcctctgtgtccaccgccctcacactctgcctatcacattgcatgatctgtacatgactttccacttgctctttggcctgtcgcctttcataagcaattttatatagcaggattttttttcctgttggtctttaaaaaaaaagaattgtaggggtacatagtaggtatatatatatatggggtatatgagatattttgaaacaggcatacaacgtgtagtaataacatctgggtaaatggggtatccatcactcaagcattcattttttgtgtgtgttataaacattccaattatattcttttagttatttttaaatgcacaataaattattgttgactgtagttaccctgttgtcaaacactaggtcttattcatcctaactatatttttgcacccattaactgtccctgtttccctccccccacctgctgccccctcgaccacccttcccagcctctggtaaacatcattctactgtccgtctttatgagttcaagtgttttaatttttagctcctacaaatgaatgagaacatatagcaggatttttgtttaaaatcaagaaattctggaggctttattaacaagcctggatttcattctgcgtgcagtggggatccatctactgaagtcaaaagagctgtgagtgaatgcttactcagtctttagtacagctggtatcttcattttggttgtctgattttggggcaagtaattccttcctctccaggctgattttattttgtgctttctaagttcccttgtgtgctctttttcatccagccagcttgctcagttttcttctcttacctctgcatgtggaccaagcaatttctttgctttacatgtggctgtgtgtgtgtgtgtgtgtgtgtgtgtgtgtgttcgtgtgtgcacgcgcgtgcgcagccagcagggggcgcagctgcagtgcatctcagggagctgcggctgctgggccccaggaggagctccatgaccaagagatgggcagaaaagtcaccccttcccctcatttttcttttctttttctgcagttgaagaaggaggaactcctgtcttctgagactctgtataaactccaggtagtgtgcacagcccagggctgggcacaggactggaggtctgagtcctgggttctcattccactgaactgggtgattttcattctcttggcctcagttttcttatctgtgaaatgggtatgtggttgtatggaaggcttcttggatcccttccagatctaaaactcacaggttggagcaggctaacattctggatgaatttgatataagtgaggaataattattgtgaagaaaagtttttaggatgtcaggccttgcacatttcagagctacctcaaagagataattctgatacaacatccccagtgtcatcatggccaggtccctctctctgtggctccggagctctgctaatgttctcttgatcacagcaagcaccttggtggcaaagagcctggtcctgagatctgagggcctgggtctgaattgtggaactgcaagtgactgaaactttctagaccttggtcctggaggccccctgatgtgccagacacttattctttagttgttggttcgtttagggctcctgggcaggggtcaggcagtgatgggcactggggagtttagggcagaggcatttgctaactgatatggaaacatttaaacatttttacacctgttttggatgtgctggtgagtactctgaacaccagcactgaagttgggcataagaacacctacctcaaaggtttaaatgaggttatgtgtggaaagctcttagccaggcgcacactgagtgccagtcaagtcagctggtatgcagtatgccttgcctgtaggtgacctttccaagtcttccctcttgggacgtgcggctgaccaccagcatgtaattcagaaataagatcttcaaaaggcctcccatgggaccctgatgccctcctggtcccaggagcaaatacttacaaagtcatcggaccactgctcctcttcgtcagcagggctctctgcaacagcaggggagaagcagaaggcacaagtgtgagcctcagctggccagccccagcccatccacacacatttcgcacctgccttcccttccctttgggctttctggtgccatatacttgaccttgggttagttactacaatcatatgttcacttgcttttgactttttaaaaaatattaattctcaaagcatagagagaagtcccactgggcagagcaatgtgcgtctgatccatgtgtgggctttgttaagggacatttctgggtcccccagtagagacctacaattcatactatgtggcttctaaggacttcagaggatggcgtagtaggaacagcacaggacagggaatcagacagacctaagttcttatccaggctctgttccgaatgcgttggagtgtgggcaagacctctaacatctctgagcctcggtttccagatctatacaatgaggggatcatttctgtgatcatctctggctctaactttgacttttcttgttaaaaaaaaattatccaatgtcttagtatgtgccaggcaatattatcagagctttgccgtcttttagccctctcaaagacgctgtgaggggctgggcgttggggcttatgcctgtaatcccagcactgtagtcccagcactttgagaggccaaggcaggagggttgcttgagcccaggagttcaagaccagtctggacaacatggcaaggccccatctctacaaaaaataaaataattagctgggtgtggtggtccatatctgtagttccagctacttagcaggctgagatgggaggattgcttgagcccagggggtcgaggctgcagtgagctgtgattgtgccattgcactctagctgggatgacagagtaagaccctgtctcaaaaaaaaaaaaaaaaaaaaaaatcacctaaaccttgtgaggaaactgaggcctagagcagataagtcacatgcccaaggtcagatagtgtaataaatggcagagccaggagttgaaccctacaggttgccttccacgggcatgcgctgagcccccacatggtgctgcctcgctccaggggcaggaggtgccgtcctgggctctgcatgggcatagaaaaatggatatgacaggttgtggcccttaagtagtttatgagcttgtagaataaaataagtctgaattatgacagcccaggcgaatatttgacccctttccctccaaaacacatttagagtatgagaaacttagcatctagcctatcacataaactgaccttagaggttaaatgggattcactctgctgtgtaggaatcaagcagacacaggcccatgtggcagagtggctccatgacagcaccacagagggtcccagctccctcctgccccgctgagcagccactgccacagaggatccagtggatgttcctaaatttcccagaacctcaacagaaccttttctagttttatttttatgtttttgctattccccgctgagtagccactgccacagaggacccagtggatgttcctaaatttcccagaacctcaacagaacattttctagttttatttttatgtttttgctatttctacccctgccacagcagaccaccggactccagagagtcaaacatttggggtctccagaggcaccagcaaggaattgcagaggtgaaatggggtcaggaaggatactgtgggatcggagtggccacattttaagcaatggcggcagcagcaccctcttttgggaaaaacatgataggtgctaagaaagagcctcactctacaagccaaacatgggtcacactttgacgtgaacagaaaagaattcttacattattctttgggttgactaatgctgaattagagtgtactgcaatcactggggttggccaagaaactctagaagattgggtgaataaatcctcttcccaatatgattacctggcacaatgggggagtatgtttctttttcttttctagtctttttttttttttttgagacagagtctcactgtgttgcccaggtgggagtgcagtggcacaatcatggcttactgcagcctcaacctccttggtgcaagcgatcctgctacctcagcctcctgagtaactggcacgtgccaccatgcccagctaacttttgtattttttgtagagatggggttttgccatgttgcccaggctggtcttgaactcctgggttcaaatgactcacctgcctctgccttcaaaagtgctgggattacaggcataagccactgcatctggtcaatgtgtttctaataccttaagtctggggatcactgaagatcaacacttaagatggcaagagtttttgtaacaaccatttaaatagaaacccttataaaatgcctttatgaaacccacttccctgcctggataactgcatttgctccaccctttctcagtgagtgggggcctattttatgatcagtcactggtgaaagtagtgcattagccatctaactagtgtccctgtctccattatctttcttctccaatccatccatcctaccgtttgtagttattttattaaaataaagtttggattatgctgttcctttccttaagagtcatcagtgactccctatggaatcaagtagaggttctgtggcaacacattccaatgcctctgccttctgtcccaccaccgacttcttgcggcaggctcccacgctcactaacagtaacaccagacagcttcctcctcccgttgtgcactttgctgattctctgctctgctcgtgccgttcctgcagcccatcttctttcttccatggaaatccctatcactcctcctccacaaagtctaccacagtctcttgtcataatcaatcacttctttttctgggccctcttggaagctggtggcaccgtgatgtcacatgtacttcgttctgtcctgtgctgtgattaagttgttcatgtctctctgtactgaaaataaggcctatctaatttatctttgcatctggacagaattttgcatttgtaattaatgtattaataaatgtgtgaactaataaatgactcaaacaaaggaacattaggatagcaacaatagattccatttactgaacacttcctatgtgctgggtgccaggctaagtgttataaaagtgtattcttataacagcactatgtggtaggtgttatttttatctctattttacagtggagaaacttggttttgaaagaggttgtaaaacctgcctgaggctacttggctagtgagtttgggagctgggttggaagccaggctgtgttggctcctgcagctgaaatctcatctgagccacttagccctctgctgagcacttagataaaaccttggtgaaacgagaatgacccaatccagacatcttggcacatggagacagaaaagagagaaaagcatcatacagtatgggatagaggttgtttgttggtgccccatcgattcctagctagactatctacttcaggtcccaagtgcaactcacagcatcatattcataaagttacagtcttgcaggcaattgccaagactaaaaagcatgggagtccgaggtattaggtccaaaacagtagtcagttttccagtatctcagggagcttcccaaagtgcacaggtggtagtttagagccaggctttctaggttcaaatcctggctctgacctttacaagctgcttggtcttggaccaataatttaatattgtttaaagcttcatttcctcacccgtaaagcaaggataagaacagtgcctgtatcatatttttgtgagaatcaaataataaaatacatctgaagctcttagcaaagcctggcacacagtaatgctttagtaatgttaccgtcatcttgagcattgcaaagaatgcctcaattaacactcaaaacaccactgattctaatttactcccacgtcaatcacacactatggctaccacaaaggcatggatccaagaaagcctctattgtagtgagtaaaatttgggggagaagttcaagcttcatgtgggccaggtggattgattttgtttgtgtgattccatggtctctgccaggaagctgagatcctgggcgggccctcttgtcagttaaagcctttcctatggtgtggtttacctggtttggggcttatgctccatttaccatgtcataatcccatgccacacaatagagggactcctccctttgcctgacccaggttttaagattcatgtagccctccccagcctgtgggcacagcaccagacacaaggagatgtgagaatggccacagcggcccacatttgggcttaagctctggggtcagactgcctaacttagaatccttattctgccattttctaggagtgagatcttagctgaattgcttcacctctgggcctcagcttcccctttgctaaaatggacattattaatcgtgcttagaagagtatctgacatagagtaaagggctcaatgaatgttagctattacaatgaatttacagtctctgcaattctcagaacaatctaaaggataggtattcttatccccaggtcagaaattggaggctcactcaaattacaaaactgttccaagttcacacagtgcttagggagcaaagccaggattccaacccaggcctaaaggacctcagagtccaaggtcttctcaccaagccacacttcataatacaaataaagactaagggccagaagaatgaccacatgagactgggaaaactcagggccatgtagttttctgagaaatgtccccacacctggaatcattgccaggagcggggaaagttcagagaaaggtgtgcccagtgacagccaaaaacttgcatgaggccatgtgcccgaggtggggccgaatggggccttgaaggatgagcaggatttgggtgagagaataaggatgaaggagtgtgtcttcctccatcatctgagagaggggcttatgtgtcagccccagaagcagggcttagaggcagatgtgtgcagaatgaatgcgctgggctggagagggacaggagattctgctgagcgctcacacaaatctgatgtgctgccggccagtgggggctccagccatagtggacaccgcaggctccagtgacaagctgagatggggagctgatgaggttggtgtttaggaactcaggcatggaaagacgaaagctgatccagaccagggggtctgggaatgggaagggatggctggaaggacagtacaggactctgtggtggtggctggggcaaagggagtatgaatccagcctctcagttctgagtcaataggagcaccagagcccctggggcagatgctggtggcatcacagcatgtctgacattctgcctcagctgcagccctgatcctgctctggaggctacccggccgccagaccctgcccatctctcccccaacagagcaggtggtggcatgcagggagccagtgggaagaccgcagcaggacacagaaggaaggaaagagggagggtgggccagttgtggtggtggggacagacaccgaaaaggaacagaaagcagaactacagaggctgcaggggaggcggtgggtggccagtcccaccagtgccgccctaagaggagaaagggacatgatttaatgtggggaactgaggacaagacccagattcaggctggctgagagaggtgttctgagtctaaatacttaacatcttaggccaggcatggtgggctcacacctgtaatcccagcactttgggaggccagggcaggaggatcactggaggccgggaatttgagaacaccctggacaacatagtgagacattgtctctacaaaaaagattttagaaaattagccaggcatggtggcacatgcctgtggtcccagctactcaggaggctgaagcaggaggatcacttgagcccaggaggttgaggctgcagtgagccatgattgtacccctggaccccagcctgggtgacagggcgagaccccgtctcaaaaaaagaaaaaagaaatacttatcatcgtagaaactccctttgtctgtatgtctactcatcccttcacaggatcattaacagaggggtgggggtacagcaatgggggacatagtcctggctcagccatcacctcactgcatgacctcaggagtcactttgcctctctggtctccagttattcctaaaatgagaagcttgggttgggcaatccttcaggaatttctaagctttaaaatacctttgagcccaagtgtcattcctctattcttagttccctatggcaggactgatgttggatatagctctcccatgtcagcgtaagaccagtacctccaggggaatatggacagggagacagaaaaccaggtaaatgctggctccactaggagcaccaggcccatgacaaaagcaatgttaaatctcacttctttagtggacaaaggattgttatgcataccccatacttctgtgtgggcatttacccaagaatccctgtccaagtgccttctttgctctggatttttatttttttccatgtaagtgagtttgccacccctccaccctatatttgctctgatctcctccctgcatgatagcagagccagaggagtcacacgtggacctcccagggatgccaccccatcagagccctggacatcagagcccaagagtgcaagagaggggctctgttcagttctgactcctcaaggacttgtggggtaaccaatggggcatctgcagtgatcccagcagactctcgggcaccatgactggtctctccctgacctccatccccagccagacctcagacttcaaagataccgaaggctgttcaactgtgaaagctcaggaactgggaagcgagttcttgcattaatgtcaggagctctagtgccttcagaataagaaaaaagttcccccaaaagcatgaacacttgagcttgggtcaaagcaaggagctgcaaaatgggagtctgggatgggttttcctcttagtggctgcagtcaccttggacaggatacttaatgtccttgagacacattttcctcatctgcaaaaccgagatcgtaatttctatataacggtgctaatgagaagattaaatgagatatgtctgtgaagagcttagcttaatgcccagaacagagtcaatactcaacagattttggatatcttcccttcccacagcaatgccagctgcttggggcaatgcattctgcccagtgggccagcagttccttaggggcgatgtttcctcctcagggaaagactgaactgggattgctgggtctgaactgaaggcagcaggctccacactggcctgacctgcatccctggaggagacccagctctccattctttgtgtaattcaagctttgtccttctgtactctaactagggaagagggtatggtgactcttttactgacctcctgtggggcagttgctggtcctttctatcctctgctctctgaaggtcagcatcaccaaggtcaacacactcttggcttagagggttttgggaagccatttgtttccagaactggaaagaggacataaatccaatgtgtggggggaaaatggctggagcatttcaggagcctttggtggatcaagtgctccacagggcacgtgattggcctcccaggctcaggaggtctggtgggctctggcctccacacactacagtttccaagatcctaaagactccccaggttcaggaggagctctcagggctgatttctgaggccctggacgtgcagctgtgcagaaacctcaaggctcaggggaagcagctggaaatgctcctgggatgtgaactggggtgggggagagaacggcaagggaggatgctaactgcaggtggtgatggtggttttggaccatttccggggattgagtgtaagagcaggggaaactgggcaaggccccagtcatctggcaaagcaataagatgcatttccgagaccctggaacatcaatggatttgcaggggtcagggattgagggaataaaatctacgtgtctttcagttcaggaaaggcaatagggacagagatggtggtttatagcagggtttcttaaatatgatttacattcagatcccctggagatcttgctaaaatgtaaattctgatccagtagttctagggtggggccaagattctgcatttctaacaagctccagatgaggttgatgctatcttgctgggaatcaaactttgtgttgcaaaggcttagaagatcctgttgggccacacttctgcattccaggagagattaaatgttctgacatcaagactatttggaagggttccaggaaagggagcaggtgtctgaggacaaaaaagagaacacttcagagcatcagggatattggaagatgtgaatgcctaaagccagggaatgttaggagaggctcactttatcactgggccctgagccccagagatctgtgtttctgcaggagtgcagaataattagtattagaggggacctgacagatcttctagttcaggcctgcataatatagatgaggaaaggagcatgagatgcccaagattacacagccagttagtggctaagctgaaagaccttgtatgtgggctcagtggtttgcagttcctcttgttagcaatgtagagccatgaaaagatttaaagagaattttatttcagaacaattttctggtggaagttgagaggaccacatgcaatcaggaattaagcagattacttagagccttctaccctaggacaagcaagagatgatgaaggccttagctgtagcaatgggaatagagagggaaaaaatatttaagaggcatttaagagcaaatcaatgagatttggagattaatttttgtagaaggtgagggaaaaggaggcatcaaggttgatcccaagtgtgtgggttaggcaaaaggatgaataatagatggatgctacctcccttttccccacgcagaaatagagggaaaggagagggcctgggtgggtggatcagcaggcagacaggtgagtgtgaggggacaatcaggagggaggtccaccctgaaatcagatatgtcagtccacttaggtttccaacaattgactctgaactcctggaatctgtgtccagcatctctgatgctgttggttcatctaaaagtggcaaatattcctgcacatttgtccccgaatcctcaaattaaatgtcaccttctcagacagatcttcccacaccacctaagctcttctcctaccccacactgattccccaccattgcactcttccatcttccctcacagcaggtaccatgtttgctaatttatatttacctgtttgctttcttgtttcttatctgactccccactagtcattcagcactgtaaggtcaggggttgtatgttgttccccactccagatctagcacagtgacagtcacacaggacacactcatgaaacacgtgttgaatgaatcagaaaatgtgcgaaacagctgaagcacctggagatgtttatcccagagaagaaaccactcagatggcctaacttcttaattctctcctttgaagttgcacaggacaactctatttttatttttcttaatatttttttcttatattttaagagatgggatctcgctatattgaccaagctggtcttaaactcctggcctcaagcaatcctcccatcttggcctcccaaagtgctgggataacaggtgtgagcccctgtgcctggctctacttttcttcatatttaaaggcttgaactgtgtggccatcaggatagacataggaagtcacaaggaaattgattgtatctatatccagccagggctgcctgtcccttgctagaccatgggaaaccatcacagaaagtgtccaagcagaagctgggccttgtgtgtggaggtgaatggtggtgggataggggttaagccctggatcagatattggtctacacgacctctggggttccttttaaacccaagactccatgattttataatttgtccatcaaacttatttagttctttaacaggttgagtctgctttggtttcttttctttatttagaacttggaaggaagaatgtgtttgttctcatataactaggaagcttccttgacttattgattaggtagatattaaagcccagaacagggtccctcttttagtgccagactgtactggcatcccctgaccaactgtctaaacttgctgactgattggcagggtgatgccaataactactctgtgaattagtgagtggtccaacaggcctgtaaccagacttgggcaggttggtcagcatttctcagtgtgataagattcccttaggaggaactgcactatctgacttattgctatcttgatcagtggccgaaaaaataaaataaaatagtaagcatcatttaaggttatggtttggttttaggctgttgccctgttgagaatcatcaatgatgtctgtagctctgtggttttcactgagggatattcaggaaatctttataattaatgctatagaaagagattttaaaactatcttccaacgtatttgttctaataaagaaatgtgtattgaatatttcacttggctcaccactgccagaaacactacaaatctcaaaactaacccttctttcctgccaaagttgatcctagttggaatgaggttgcaggctaaacttggagaggactgagagtcagcaatgtgccagcaataatttattacccccaccccttcaacaatcctcaaatatcaatttaaacagcttttgatggaggaagtagtctcttccccacttaccccacactcccagccacagattagattcattagtgctgctgtggaattccacccaactttgtgcttcccctatcactgaattgtaattacttttcttttctttcttttttttttttttgagacagggtctcactctgttgccctggctggattgcagtagcatgatcacatctcactgcagccttgacctcagtgatcctcccacctcagcctcctgagtagctgggactacaggtgcatgccaccacacctggataatttgcattttttgtagagacagggttttgccatgttgcccaggctgatctcaaactcctgggctcaagcaatctgccttcctcagcctcccaaaatgctaggattgcaggtgtgagccactgcacctgggcctataattacttttaacataattgatatggtttttctgtgtacccccccaaatctcatcttgcattgtagctcccataattcccacatgctgtgggagggaccttgtaggagataattgaatcatgagtgcagtttcccccgtaccgttctggtggcagtgaataagtctcacaaaatctgatgattttatccagggtttcccctttctcttggctcgcattctaccttgcctgccgccatgtaagacatgccttttgccttccactatgattgtgaggtccccccagccatgtggaactgtgagtccattaaacctctttttctttataaattacccagtctcaggtatatctttatcagcagtgtgaaaacagactaatacaataatctatcttcccttctggactataaattcctcaaatgtatagtctatctttaacttttagcactgtattcctgcctcagatctgtgtgtgcctggcacatggaagatgtttaataagtgaccaataaataggtgggtggatggatggataaaaaaactacatctccactgtagtcaaaatgcctaatagatttagtcattcttgaaattagaaaagataccttttgttttcaaatgaggatagcgtatttccctttccataagcctaaatgtaaatatgaacattaaattagtcaagagtcagttaaagtatctgagaaataccttacctgaagcgtagtcccttcgaggaacacttggaggtgctttgacttttagcctggaaataacaaccatgagacaaaaggtcagtgagcagaacaatgatggtcaaagccgatgctagaagctgatatagacagaatagatagacaactaatagcataatggcttctcttggaccaatcaatggacagatttgatgtattgtaaatgtagtgaagccattagtcaggggttttccacctctccccatctccccagtgcatgcacaatgtggctatgacttggcaaaggtgaagtcaggtggagaagggctcagagaggtcagaatatgatagtaataagcactgagttcagaggttcaaggaagataaatgttgattggttggtaaggtaagtgttgataagaaggtaagataagatggactatattttaatgacttacaaatgtttaacaggaaaaaatcagctacaataagcgttttggttgtaggttgggctaaaattatgtttgcaccattttaaaaacgcaaataagccagacacactggctcatttctgtaatcccagcactttgggaggccaaggcaggaggatcacttgtgcctaggagttcaaaaccagcctgggtaacatagtgagactccatctctacaaaaaaataaacaaaatgagccagccatggtggcatgcacctgtggtcccagctacttgaggggctaaggtgggaggatcacttgggccccagaggtcaaagctgcagtgagccatgatcacgcccctgtactccagcttgggcgacagagcgagacactgtctttaaaaaggaaaaaaagccgaacaagtgaacagtgagtgtctcaggattggagattatgagacttagcatatttagtattcaacttgttttaagcactctcaaaactttactaaagtaaaggtgctttagtacctttatgcacatatgaaatgtgctagtcacaatccttcttcattcaataaaagaagaaaattgaaattacattttagaaaactattccaagttttgtaagttctgatacctccctttccactacttgaaatgagtaaggtttatagtcaattatttttaataattattacccattttaactaagaattatttgcttaatgaaatttaaaatatacataaataaaacttatatccagtagcctttatttactaaaatatcatatccttctatagaagcagtataactgctattatatacaaactttcatgttttgaaaaaaaaagcatagaaatttgtgtttgattaaaaaatgcacacaaaaacagtttacaaaccaaaattgtaatttgcaaaaataacaatatgtatatttacatagaaattctggttttctttttctcataggctctcaatatctattatttcattcaattctcctcacaagccagcagggtgggctgggaagatactatcattagtcccatgatgaggtatagagacagagatcatccaaggtgttgcaaggaagaaaaacaaaaacaaaactgggtctggtgcccaggttggttcaaggaatagtaaaatttccaaaagcacaaaccacctgttatccattattactatcatttcataaaagaaaaggaagggtattttactacccccaaataatctcagaataaaggaaaaactcactaaaggactgttggccactcaacactaggaataaaaggcgtagttgaactttgctctgtagctggctgctgtgcacaacccccaacacttcatgctccttattttctcatgcggccatagaccagtgaaaactctgtcacagtcttgtgttagggaaccagcgtgttcaagcgtgcttcctccgttcagggtagcacctgtggcctggcttcaagtaaaagtgtaactgcaagtcactttgagctaaagggcccctgacgtcacccggggtaatgactatggtggccataatttccaggctgagaagaaacatggtttgtcatgtaaaagtgctttggtcatccaatgggcagaatgtatgaaacagaggctgttataaaaaacttgagctccacagctgctgtaaatatgactggctatggaatagagagacattttatgcagaggcttcatgttattgagaactggtgtattgtaaaactggcaactgggggccatggaatagagaaacattttatgcagaggcttcatgttattgagaactggtgaactgtaaaactggcaattagaattgctagtgattgtaacaaggactgtctcataaagaatgagattctatctgtagcagaaataataagcaaaaatcatcacacacctctcccactcatcagacagaacatgaagccaaattctcctcctctgtaagatgaccaccacctcacaagcagaaggccatttatgtttgatgatgatcacttatgcatagagactcatttacatttcatagtctggaaataccaccaaaagtgatttcttatttttaattttagcatagattaaaacgaataaggatgctcttttgaatgcatagagaaatgaacttctataaactattttttggtccaaaatttggggagaaaaatttggtaatagcaattaaaactttaagggcacaacttcttccatttggaaatttcattttaggaatttagcctactggtatattcaaggtctgcaatgaacatttattaaagtattattcatgacatttaaattggaagaaacaaccagagaattttgattgctattatcaaattgctatccaaaaatgttgtaccggtttaaattcaaatccccccttaaagatggccaccaatatatagctagttaattgaattataatatatttaaggtagactattaaatcatctgttcagaaaagaatatggttaatttttacttactaacaaataaagatgtccatgaaatagcttaagtaaaaccaacaaagcaagttggtagaatggcgcatgcactatgataccatttatgacgaaaatgtatgtgtatagtatgtacaatgtcagtgtatgtatgtatgtgtttaagcacacacatacatacatatatacatacttatacacacatacatacatatatatacacacattgaacttaccatgacaatgtccctttctggggagtgggttaagatggagatataaggaaatgggagattttgacatcatacaattctggcctctttgattttttttccctggtgaatctgtattagttttatttaaaaaatttaaagacttaacagaataccatttcccattttctcttgaaagagacttacctactaaggtatataagacctactaaggtacgtctaccttagattttgagtggcaaatgcagatatgtacaatttttattctctttaaaaaaaaaagcttaagagtttttgatgtacaaggagttttgagatgctaggctttccctctccaagtgccaattgaaaagttcattttcaggtaataattcgaaaagcagaaatcaaaatatggaaaactggctgagcgcagtggctcttgtctgtaatcccagcactttgggaggctgaggcgggcggatcacctgaggtcaggagttcaagaccagcctgaccaacatgaagaaaccctgtctctactaaaaatacaaaattagccaggtatgctggcacgtgcctgtaatcccagctattcgctgggccgaggcaggagaatcgcttgaacccaggaggcagaggttgcggtgagctgatattgtgccattgcactccagcctgggcaacaagagcgaaactccatctcaaaaaaacaaaaaaacaaaatcaaaaacaaaaccccaaaaaaaggaaaactcacatggcatcttgaagaagctagggctgtgttttgtaacttttcatttggatttctccatacatgttttcatagcccttagctaaatggttatagaaatgattttcctgctttgacatttgttaggcaccttgaatgggcatagctcaccttccctgcagtgagaaggaaaatcaaagtccactgagtacaactgcactcacttgtcctgttccagaatgtagacctggccaccatggattccagccaatagtaaagaagggttacgtgctaaagaggtagaaacttctcatccaggtaacagagaaatttgttttcttccatgtagcacatgttgacttattttatataattaagtatttaaatagaggcgaacttactttttgattttattcattattccaccttcattgtttttaatatcatggaccatcttttgaagctgcctgtaaaaaacaaaattaaacataagatattaataaccagtctgactttttaaaaaaagtctcctactcttctcgaatacaaaaaaggggaaaaaactctaccaaaacaacctccaaataggatgaattatattgtatttaattaaattgaccatctgctactttagcgaaggagaagcatgactgattctataaggaatatggtcactgggctgtgtccccttccgttgggatgtctggaccagtctcaggctgtgaagaaagatattctgattccttgctcattgtcttagagcatctacgttacgaagatagatgctactctgtggacatagcagaggcttcaatcaggcccaaggttcttttttattaaatggtagtaggtagcatctattaaaacttccatttaaaagttactcctacctaggagtcataaagaaaatgactattaaatctggctgatatttgaaacttctgtagaacaaaaagtaatattgaggcaggagaatagggtctggagtcagggaacctaaggccaatttgcactgacttcctagaactgaatcaaatggaaaaccccacctctccatgcacaagtaacaaaaggatcagaggctactacctttgcactgcgttatagatgagaaatggaaagtgcctctgattgatcccctcctgtaaccaatcagactggtcccaggccaagtcttcctgtgtaactttgtaccttaacttcagcgtctgattgatcaccttctgcaaccaatcagactggtcgtgggccactccttcatttacataggatgtaaccaagtaaccaatgggaaacccctagaaggaaaattctgtaaccagtgctcttgagccacttggtcaagcccattcctactctgtggagtgtactttcatttcagtaaatctatgctttcattgtttcattcttctgttactttgtgcattttgtccaattctgtgttcaaaaggccaagaacctggaagactcatagtcaagaccctccactggtaacaatatgtatcaagaccctccactggtaagaatatgtacaaaatcaaaagataaatgacatgctgaaagaaatatttgcaacatatagtaataataataagaactacatattagtttgctgcaaaagtaatcacggtttttgccactggaagtaatggcaaaaactacgattatttttgcaccagcctttctcgatttacaaagaaatcttacaactcagtaagaaaaagagaaatagttcaatagaaaaatgagcaaaagatatgaacacacagctaacagaaaacaaatacaagtggtcaatagaccaatgaaaagatattgaacatcacttatatttaaacaaatctaaatctaaacaacagtgagatgtcttttcgcctatcagactggcaaaacataacaagtgtgataatatccagtgttgagaaagtaaattgttacaatcaaatctgtcaagatttaaaacgtccatgacttttgacccagcaattggactgctaagaatttgtcttatgaaaatggtcacaaaatgatatcagtatatacatataagcatgtttattgcagcgtgatgtgtaagaactctctaatcttctccctgcttcttctgccctccccacaaccataactctgaaaacaacccaatgctcattaatcattaaaagggaactagttaaataaattatgatagatccatgcaatggaatgccacagacccctaaaaaaaagaggaatatacatctatattgttgcctgaaacttctactttctaaaaaggggattattactttatgatgttttaaaatatttgaatttttatagcatgtgtagatatcatttgtattatctgtgttatacacaaatatggagaaaaatattataatgggaggatagggccatgttatgttttcctcataataattttctgacttaaaaaatgtataataaaatttcacgtggttcttccctgaaagagtaggacgttttaattcacctttcaggtaaatgcttcctttgttctgagaaaactatttgactggaccctttagataatgaactgtacacagctattgttcttgtaggaaatggtgatttccccacaatcctgaaagcagatttctctgactctgggagctaggccttgggttaggtaatagaaatagtttagcataggtctaggaaactgttggttgaggacatctgggagaaatactccttggccctttgtgaatttagaatgcccgtgcggtggaagggttactttttggtgcagcagtggagcagtttagagggtaagaggacagcttctcagaagaactctgcctgggcaggcctgtgggtgtcctctaccaagtgttaatttaaagctaaacaatgcagccatgctggtgctctgctgggtctgctctattgagggcaggccctctagcccttagggagtggagtgaaatttacaggatagggaattgggaaaagggagattgctcaaacgtaaaatgggaacttaggctgcagattttggggagatctctctccttctagggctaatggctgttaggcgctagagtgctgaagagcgcagacaaacctgagggattttcagtggtgggggtttgggcgatggcagggggtggtagccctgaatctgaggctgggtctgggcctctgctctgagaaaagccatagccagagccatcgctagctattttcaaccacataatccctctctgctgtccctgaatcttcagtaagatcttgtagtagctgcagcccggcctcagctgggccttggggaagagagtgttccactggcatggaagggtggagggaggacaggctggagtgtgaagtagaaggataggagaaacttcttttgggacagccgtatggctgcattttggagaattatctacgtaagtgaggtacccactgagggacccacgttcaaatgtatgtgtcaggggtctggtgccaagtcattgtaatttgggtaacaaaggaaatgagaccatattttatactccctagctagggaggccgggcacactgatgatacaagtgtaagagctcaggaaagagccaggcacatattatgggctcagtagcaaagagaaaaggatggttgagagacacacagagggtccctcagatgggcccttgagttgcctcagaactctacagttttctagaatttgttcacatatactctatgccaaacccttttctccttttcctgaggaactatagagaatcttcgagatagaggaaagaagaaaatgaaaataaggggtctggcagtggggagagagattgagagacagacagagagagagggggagagagagagagagagagaggaagagagaaagagagagagagagagaggttgaagtggattgattgcaaggaaattcaataatttcatatggagggcagagggcagctcgttgtaagctgactgtaactgaatggagtatctttaggctaagttaatgcttaaccaggttgaggagcaaaatgaggcagcagtgaagaatcctatcagaaatgtgtcaaaaatgggacacaggcagagtaatagggaaccaggggccaatttgcataagtgattttgctgtggatgtaaataaacagatgcaaaatgttgcaaaagaattggatgcaattttgtcatttgctcaatttggcatttggtgcttgcttggcatttcctaattactttttattgtgtattattataacaataacaattatactatgtaactatataattacagtaagttactgaagtgttgcataaactatactttttaaagttgatgcataatagcagtagatatttatggatgcatgtgatattttgatacatgcaaacaatgtgtaatgatcaaataagggtaattgggaaacccatcacctcacctcaaacatttatcatttctttgtgctgaacacattccaaatcttttcgtctagctattttgaaatatacaataaattatagttaactatagtcaccctagataaattacactttttatattttaaagttttcttctctctctgtatctcgttcacacaaattctgatgtctatagactgctttgttacaactgccaaacttctgtgatctgggaagacatagtgacccaaaaccaagatttgctgtgatgctgttagctcattatgtcaactgtccacgcatctggtgatgcacagctctgctgctctctagtattggccatttcattttgaagtgctttttgctccttattacaacttatagcacatgccatagcaaaagaatgcacaactggtctgttccaggaggggttgttctggattcaaacagcaatccttttactgagatgagttgtgtgtaggtaaagataggtaaggcataaaacagcttcactttgattatctcattcagagatatccttccatggtggggagatggataataaggtcacaatgtcctaatcttctaaagtcatagagagagagccatgctcatgtaacaaaataaaatgaagaacaaagcttatctaatacatgttttaaaatatataagtattgtaattttaagcagtatggcattttggtatttaaaaatggtgagcaggtcatataaataattataatacttgtgtaaaccaaatcaaattttatattctctcttttgtttttaattttcaagcttttgaattaagacacgtaacttagtcacactgtagtagtgtgaccctgggtaagtctgaatctcgagagatttaaattccaggaagcactgagagtagaaaagtcaccatttgaaagttacagcagtttcttccctttaaagtgccttactttagaatccgatagatctcaagagggctattggaccacaactggctgggcctcacccctggagattctcattgggttgtctgtggtgcgtcagaaaatctgcatttatgtttttatttttattattattattattttgagacggagtctcactcttgttgcccaggctggggtgcaatggcgtgatctcggctcactgcaacctctgcctcccagattcaagcgattctcctgcctcagcctcccgagtagctgagaatacaggcacctgccaccatgccgggctaattttttgtatttttagtagagacagggtttcattatgttggccaggctggtcttgaactcctgacctcgtgatctgcctgccccgggctcccaaagtgctgggattacaggcatgagccaccatgcccagctcctgcatttctaacaaattcccaggtggtgctgatgctaccagttgggagaccatcctttgtgcatgtctatgatagatcatgcctttttctattgtgggccttttagttgtgcccaagtaaagcaaatacctgtttgggggaaaaactaagttctcattaactcaagtgcaaagtttcagacaaataaattgggtggtcaattggaagcataatttgggtgtgcgcttttcagtctgtagcttctttgcaggactgttgacttttctctgtatgaattcagactaacctctgcttatatattttaatttattttatagtcatgtactttcttcttgagccacagtttgcaaaactgtagaatggagatgaagtgactgcaggcagaacatgcccctctccttgcgtgacaatggaaaagggactggcccttcttggagcagagtgccatggtcgggaccattttgccattgctattataatatggtgctctaagtgactaacagaatgcagtggcggtggcactaagactcgacctcatccctgttggtgggggataggctgtctttgctgtcactcatcctgcaaagactccaacctagaaaaaggatgtaagaaaatgaggatgtggcaggcaggcctcaggcttggtactgtgatgtttcctgtcttcccggggcctcctggttgttggtccctgtgctgcaggttgaatagaggaatcttctagaaggattcccattgaatagccttccaatttttactacccatgcataagatgtacagattttacacaactaagatcactcttgacattttgaaatctgtgtgttccacttactatattgtgaatattttcataagtgagcaccatccttaggctttatctgcatctttctttcctctgctatctgaggggcttttaaatagctgaaactctgatccaagtaggcgtgacaagaagcagtgaatcaggacccctcagcttgagggagcagagagatgaccagaccacatggcaatctgagaccaggagaagcaaaggctgtgtgagaataagtgccgaatgccttgcttctgggagcctgggatcaagaggcttggacctcaggggcagagagggaggggacaatctcaggttccctcttgtttcttcaaacccagcctctcttccagatcaccctctgaaacagtgttttctagagtaaggtctaaagattgcctgtatttatttattagaaattcagatcactggaccctaaaccatatcaatagaataaaaattccagatagagcccagcaatctgctttttaacaaattttctaggcctggtgactcttatgcacacagaaggttgacagccatttttaaaggattaggccaggctgggtgcgatggctcacgcctgtaatcccagcactttgggaggccaaggcgggccgatcatgaggtcaggagatcgagaccatcttggctaacacggtgaaaccccatctctactaaaaatacaaaaaaaaaaaattagccgggcatggtggcgggcgcctgtagtcccagctactcgggaggctgagacaggagaatggcatggacccaggaggtggagcttgcagtgagccgagatcgtgccactgcactccagcctgggcgacagagcaagactctgtctcaaaaaaaataaaaaaaattaaaaaaataaaaaaaaggaaaaaaaaaaggattaggccaggtttatccccttctaggctaagtttaaatggaaagagcaaaagagacgacttcccaacctccagagtatcttcccccatccaccatagcctggaatagctttaacagcaaatcttactattttctccataatgagtggccaaaggcttacccaggcattctccccaggaaaggaaagacactggcaatggaattttagtcaatggtatgatgtctgctttcaacaaggggaagacagcagaaggaatcggctgtggttgccaatggccaggcattcacctttacctggactcagattaatacaagtcgggcacagtgatgcttccagcctgcctgccttctcttcccaggcagcctggtgtcagagcagggactctaacccgaggagctgactgtgtacagctcagccttcttcaatgagttttttttttgttttgttttgtttttttgagatgaagtctcgctcttgtcccccaggctggagtgcaatagcacgatctcagctcactgcaacctccgcctcccaggttcaagtgattctcctacctcagcctcccgagtagctgggattacaggcgcctgccaccacgcctggctaacttttgtatttttagtagagacggggtttcaccatgttggccaggctggtctcgaacttctgacctcaggtaatccgcccacctcggcctcccaaattgctgggattacaggcatgagccaccacacctggcccttcaatgagtcttttatgaattgaagtttagaccttacatcaattggcagtctttctacatctccttcttggatgaaaaggtaggttaaagaaatcgtcttgactttggctgcacattagaatcacttaggggacttttaataatcttgacacccaggccttgcccccgaccatttaaaccagagtcattgactctcaggggatccaatgtgcagccaaggttaagaaccactgacagtgttctcaggataggagaactttgtacataccccagggaagttcgtctggccaagagagcacaaggagaggaatccatagtgagaatccacagaagggtatctgcagactgagaacagccccaggcacatagaaggataaacaagttcaggaaggatggagtttaaggacagcgagctcttccagggccaagagggcacggggagggcagctgcatgcagatatttcggccagatcaccagaggtgtccaagaaattacatatttgacaaaaacacttttccaataatttttattaaatacaggagatgatttaacagatgatattatctgtaagaagtacttttttaaaaagtttagtagaaataagatcataaaacatcttgttttccttgtagctctttagtgctgtcacagaggacaatgataggcaggtttcaggattttttttttttcatttgtctttcagaaagggtggaatgcaaagtattgctaatcagagaaaatccctgtttaatctgcatgtaggaatggattaaagagtgtctcaggtgaaagtgactctttgtaaacaaacagaataaataaatccttccttcttcatcccccgcatcttaacctcaggtccagttcttgagtttcatcctttcagtgttcataggctggtcctcctctctgagccaagatctaagcctacactttcccctttacaacaggaaaatgcagcagctggcagcagggccctcccatccatgctgtgagggcttgttagggcctctttcagcaaatgtttctaaaacctggatttcaacgatcactccttcctcaagagtgcagcagctccccggtatctactgaatcaagcctgagctttttgtcatggctcagtcactcagtctcaccctgagctccatgcccatatagaaattttatttttgttactaaattttaaaacagctcgatgatagaaaattgaacactgccaataagaaaaaggaaaagggccaggcgtggtggttcatgcctgtaatcccagcactttgggaggctgaggagggtggatcacttgaggtcaggagttcaagtactgcaagaacccctgggggctgctggctcagccctttgctttatccacgtatacttgggtatccttagaacatctgtgctggtgcaattgacctggtatctccaatttatatgtttctaaaatcaatttggagtagaaatctctgtaatgttttccttggcatatatagaaacaaaaatgcatccatgaatactttttactatgaatggatttttaaaaacacttttttaaacttaaaatttaaatacatttaaatgcatttaatttaaaaataaaaaaattaatgttcatcattaggtctgctgattctctagttgacttcctccttttttaggtgtttaatgtaattgactctgggtttctttttaagatgctactaatatagtatattttatttttgttactaaattttaaaacagctatatgatagaaaattgaaaactgacaataagaaaaagaaaaagggccgggtatggtggctcatgcctgtaatcccagcactttgggaagccaaggagggtggatcacttgaggtcaggagttcaagaccagcctggccaacatggtgaaacctttgctctactaaaaatagaaaaatcggctggcagtggtggcgtgtgcctgtaatcccagctacttgggaggctgaggcctgagaatcacttgaacccgggaggcagaggttgcagtgagacaagattgcaccactgcactccagcctgggcgacagagtgagactccatctcaaaaaaaaaaaaaaaaaaagcagcagaagaagaagcaaatggaatttataagctggcatccttggatcttcaggcttgaaacttctgaatgttctttaaccctttctctctctctttgactcttcatctcacatctctagtcacatcaaaagggtgaggaacagcagccaggtatcaggaacagcagccaggtatcaggaacagcaagtgcaaaggctcagaggtgaaactgtctgagatgtttcgggtccagtgagcagctgagagtgtcaggaaagtaggtgttgagaggatgtttacaagacaaggatgagaccgctgggagcagagacagatagtcaagggacctgttaggccaaggagatggggggttacaggcttcctgctggaagcccttggagacctttcctcggggtgtgtcatgatgagggtggaagaatggaggaggatctcggcctgggacagtggtggctgggacaccagtatggaggcaactgtgccaggcccaagcctcgagctcgtgacagcgtggtaccaaaggcaatggaataacactaggagtgccctgtgggcctcagctgtgcgaaaggaccaacaactctcaaagaggacattactgagacaaagtgccatgttggccatactggggcctgagacaaagtaaatcagcaggactgattctgtcttcatctaaaattccagtagtttcttcatcatggatttctgggcattcattttgatttttaaaatattatattaaatactatttgtatcaatttattaatgagggttaccccttaaaatttaatgtcatgctttgctgttttatacatgactcgttttgttttattccacaaatattcagtgtgtgcacactgggcatggcacatgcaggccacagagctaacctgaacacaaacccgaccctcttgtaatgcaggaaaggggctcctttcaccaccttatcacatgacagaaaccttctggcctatgtgaagccaggggacagatataggcagaccggagaattctctgattcacacaaaacatcctcctctcaggtcactcctgtcttaaagctgaagttttcagccaccaacccatcgttttgaagcagcatgatactttttagtgactatcctgttacttgcatgctgcaggactcctatgacaacttctccccctccactctttctaaagccttgtcatttctggcaccggcttcctaatgctcacttcctccagcctggccttgctatgaaataacaggaattatatttagatttgcgaattcagcactgcaggctgcttccttctggggagtgagctcatggtggagctggcagagttttgacagctttggcagtcccttccatggtgtgataatgtgaacaagcccctcaaggtcgagttagtggccttctcctccatttcacagatgcagatactgaagcccaaagagatcagagatcatgagtgtctcagactatacagctgactccgaattttgcctacaattaaggtagtcacagaaatttggaagtgagagagactttgggaatatcctgggtcaacctcctcttatgccaagggaggaaattaaattccagggaaattttgtgattgccctgagattaatttagttgaggactcctccaactcttttagtcatacctgttccttccccttccacataaggcttgagccccctgctagagaaggtggggggtacctccatggccagaggtaacccccaccttcttatgccatagttcagagctgtgattatagtacaagcccagtaagccattgctgagagaagcatcatgcatgccagtgatcagacttggaaaatcaataacggtaaaagccagcatttattgagcatgtactacgtgctaggtactttgtgtgcattatctcattaaccctcacaactaccctgtgagggaggtcctattatccccatgtttatattatgataaaaaacacataacaaaaaatttaccatcttaaccatttttaagtatccagttcaatagcattaatatattcacatagttgtagttatccctgtttttatagatgagaaaatttgactcagagaggttaaataatttgcccagatcctacagcaaataagtgatagagctggaattcaaaatcaggtctgattccggagcctatgctctcaacccactctggatgatacaggctaacttgtttcaacttggcccctcaccagggcaggcgactggcttcagcacctacgttgcctctttggataccttcctctctgtccctggagacagcacccattccctctaccaacccagtaatctttactgtgacacatgtgcccccacccctgccttgctattggtccccaaggttagacattttgctagaggggagcgtcagctcttaagggcctgtttcagactttgggaggaagagggagagtaaaaagaggaaaggacagatggcaggggaaatgggaaggagagggggtaaggcacatgggaggcaggagggaatgcggtagcggccctctggggtctggaatatgctcagaagtagggtggctgaacagagcagctggaaggacgccaccataatccatgcatcctttctcaacacccgaggcagaaaggccccctgagggtcctggagtggaggggctgtgttcccttacacacaagcatcttgctgccagggctgtttcttactatccacttattaaccgtataaagtaatttataagtttctccaaacagttcacaccctacctttttttttttttttttttttttgcttgtttcttttttttcctactgagatctgcaaatattttgtggtagtctttggcatgtctgaacggctgagcttggttataagcagtcagaaattgggctgacttggcacaagcaggagtagggatgattctactaataccctgtgtccttcaaaaaccctggtaggacttaccctatcagaggcagttatgcatcaggcacaccaccctgagactgatgagatggcaaggaaatgatgctatacctgccttaagaagttcttagaagttttgtcacttgatttgacagctgaaattggcatggcccttcccctctctgactttaggggccagtggtccttggggcctccaggaatacaacacttctctttcctttagcacattggaatgcttgctggactctgctctcaccacccacctggcagaggtcttgaataaaggaaaacttcctcacaaaactacataaaagcagattgcaaaaaccaaaaaagttaagggagactcctgtgttcatagatgacacagactcttgggtttggaagaacactaagaggtcatgtcatttagtcccttcactgtgtctgactctgatgtgctcattgttctgatgaggtgctgacagctgcaccgtgcatgtgttcactgtctgtcctctaccagcataaaaatgcaaaactgacgtctcttaaatcgaaccagctgccaataggtttgtaaaaccaagcgactgagaagtagttctagtcatgtttctgaaaatgcaattctacataattccagaaaataaaagtgtcttaagaatttgaatatgttcttttaaaaattaacttaatgggggaaaaaggaactttggctatatctacatggcatgatatatatatagtattgtcatctacttgtcctggcatccatttctgcaggtaaaagcaaagatattttcaggaagtaaagagtgattttgagggatggcattcaagaactcatatattgaaaaagtttgacccagttaaattcttcttagctctgagaaaacaaagatattgggaatgtcttgtatgtaggggtaggggtgaaaggaagcattgtaattcattaaaagcatctacaaatgtttgtcaataatacatttaaataaaaattttgaagcaatatctttttttttttttgagacagggtctcactctgtcacccaggctggggtatagtggcgttatctcggctcactaaagcctcaacctccctggctcaagtgatcctcccacctcagcctcctgagtagctggaactacaggcatgtgccatcatgcccagctaattttttgtattttttgtagagacagggtttcgccatgttgcccagactggtctcaaactcctgagctcaagggctttgtccacgtcggcctcccaaagtactgggattacaggtatgagctactgtgcctggccaacaatatctagtgggtcaaaaaaatatataatcgtgggtccccaaaatacactcatttatggtaaatataggaaattgtttaattatcaatttttaaattgtggtaaaacatacataatgtaaaattcaccatttcacccatttcaaattgtacaactcagtggcatttagtaaattcacaatattgtgcaatcaccaccactgcctagttccagaatattttcatcacccctaaataaaaccccagacccatgaagcagtcattggcaattttaaagcagattttcaaaataatttacttttgaggtattttcatgaatagcttttgttttcatcatgctaagaggttgttaatagaatttaccctaataggtagcatcgggtatattaagcccaatcatctaagatcggtttggcaactgtgatgatcttcgagtatgaagatgatgtgaaatctgaagtcctgccatggtaaaaaagagaactctgaccttgaacaggctgtaaagatcatctaaaagccaaaacaatcatatatatgtacagagttcatttttttcaatgattttatattacatttgccattttcttttttgaaattatagttctcatgtttgtatgtgattctcatagttatttgcagtgcaatgaaatactcttcctagtatgttcaatattgagtagggacattaatacactttttatgcttaaaaaattatttttcataatgaagtttttatactttgaaccaagtaagattgtaaaatgaaggggtaaaaaatggaatggggctgggggtcatttcactctaggtacgagctcagactttcttgtcttctactccaagcacccttggtcatagcctccctctggggaactcccgtttacttaggtgtggtctcccacctctggcctttccctccttatcaccatgttcctgaacaatgatccatttatccagctaggctgttgattgaaccacctctgtgagtgggtaggagagctctctgcccccttggtctgagttggttatcagataaatgagtcctgcgtgggtgctagtgacagatgactcagtgcctgaacctattacacttaatgatgtttaattttgaaccagaacattgagacactgccatatcccaagtagatgcctctctaacaacacaatccagggcaccagggaagcacagaccaggaggaagggggcattcattgagctcttactctccggtatacagaggtactgttctaatacccctgctttatgttatatattattgagatattattattcccatttttcagatgaaaaacctgaggctaaaagggattaagtgatcttctcaaagaccacaagctggtaagtgcagagcaaatgttcaaatccacatctgcctgattctttcttttcagtaagacaaaaacaccttccaagggcacctcttaaaataccacgttggtgctgtgtgcttggtctgtatataagaccagctctgctcttcataattataactcactctcagattacatgaacgattgtgggagcattctttgcaaaatatatagcagtaggataccagacacacctgagtcagtgtggaattcaagtttgggcctggaacacacaattgtctgaaatactgacagcaggaatcctcagaaggctttctgactagtaagtgactgcttttttaattttaaaacaaacgtctatgaaaagtgaagaacaaagcctgaatgttacattggccagtaaattacacaggcagacatggaggggtcgtctagagcttgaacaggtgacctggcctctctgggcctcacctttctcacctgtggaataaaggggctggagaggtgtcctttcagtcctcgcaaggcgaatctctgtgcttctccatggaagcctgtgtctctgcacattgtagaagcaggcaaggcccgagtcctcatggaacccccgaccagcactggctgcataatttctggggcccaatgtaaaatgaaaatgcagggccccttggtcgaaattgttaagaatttcaggactgcaacagcagagcattaaaccaggcacaagctccgagcacaggaccctgtgcgactgtatggccacacgcccaggaagctagggacctgtgctgcgtgttccctacaatgtgtgaaggaagggaatctggagtaggtctggggcccccagccagcatgggaggcagggatgctcctggggtaatgagagccttccttaggaaactggccaacagagaagtgtggctcagcaaacagtcaccacatgtccctcaagctggcttctttgtcttgcttttgaaataagcattgaaatagccatgctgggctgagggaaatggtctgtttggaggcctagaccacagtgctgcaaaagggttgtgaaaacattaggttaaaaaataaggcttcaggtgtagcttctggtggactccctttcagaagggaggtgaaggcaggacaggtaggaaaaggtggtgaaataaggaggaggaggggcttgtggggagggctcttttctttttggaacaaagcacagggaggaaggaggtgaagtcagactttcttgctcattgctggatggagacaaatacgccagtaatgaggaggcttaacacacagtgaagaggagcaacctcctgagagagggtttccaccgcagcagccaaccccagtgtccagtgtcagcccaacacaaaagctgcttccctacagctgtgctggggaaccccgaggtcatgtgggacctagaggacggcagccagcatcacacttcagggttctctgctcccttgatctggagcagggacttgggtaggggctggaattccaccccatcagcaggtgaggcccatttctggagcaacaggtgaaacatactctaaattcctaataatgtgcatggttcctaggggcctaggaaacccagcataaacgtggaatgaaaaaactaaggctgcctttgagcgcttaaacctcaacatctgacagagcaaacacagagaagcaaggtcaccctcaagaagcagaatggccccaagtctgtgagatttaagggggacctgatggaatgtaatcaccaatccagagacacagggtgtccaatgggaggcagtagcggtacctctctgacctccaatctgcagagacggagtcttggttaggtggacttaaaaggcctccttagtgaggctctgtctacagtgggcaagagcaccacagccctgcaagcctgggggcaggattacccaagagccttgagcatctgacattacaagagacagcgctcttctgagcacaggaccctgggtccttcacatagacctcctctcatcattcctaatatgcagaacaatcacacaaagcgtttcctgagatccagattcaatcgaaaccaatttaaagagttattttggaggggggcggggagacatagaaatgcttaatagagctggaaaaaagtctttaatgaaaaagattgaacccttaaagcctacccatcggtttcaaaaaaatatatacacactggccacagggagaccagacaagacagggtgaatcctgctccagaaactctcccagctcatggaaggattattccaaatacatgcctcttggacactgccacagaattttcatatataaccaagaagattaaaggatggacaagcaaacgcatttcatctctcctccaccagctgctttgtcttttatccaatgtccttaggcaacatattctgctctaggataagcacagtgtgtgcacctctgtccagaatttggccttattattattattatttttgagacatggtctcattctttcaccaggctggagtgcagtggcatgatcttggctcgttgcagcctcaacctcctgggcgatcctcccatttcagcctcctaagtagctgggactgcagacgcatgccaccacaccagacttatttatttatttatttatttatttatttatttatttatttttgtagagatgggtgtctcattatgttgacccggctggtcttgaacttctggctccaaacaatcctcctgcctcagcctcccaaagtgctgggattgcaggaatgactctctacacccagccagaatttggccattggatcagactcacaagcccttgaacttcttaatggctgtgttatgacataatatgctttttacctcaacattaagaatttccactcaagatttgctcagtctacttgaagaagtagaaacagactatttattacaagatgaccttatgtctggaaatcttttcctgctctcacttttctacccaggagagagcaacttatagctcaatggtgcatatagttcatgggatctagttttgtttgacacaacttttaaaaaggaacatcaaattgaaatgcaggcctaaggatttattgcccctcctctaggcaatccctcatccaaaccatcccagaccggaaacccagtgtgatctgagcaaagaccacaacaatggcaaagatatgtattgcctattctgaactttaaatacacgttgtcactataagcaaatagaaatgaatatttgcttattgttctgaagagaacatgtcacttagtctgaatcagggtttctcaacagtggcaatagggacattttgggccagatgattctttgttgtggagactgccctgtacaatgtaggatgtttagcagcatccttggggactaactactagtgtctgtaacactccccagttgtgacaaccaaatgttcccttggggacaaaattgcccctgatggagaaccattgattgaaatgatccagctatgtcttgcgggaggctggggaaggatgtttctgtggaatctattaagaagccaaagaaagcgaagtgttttaatttccctagaacaagctatcctttaatttttctctccctttttttcttgctcatgtaagaccttctttgaaaatgaaccaagctgataaattctcccaagaacagatggggttaaatcacctgtagggagaaaacaagagatcgtctgtaaatacatgcctgaagagtttggcaccagcccagttcttttcaatccagtaatctaggaggcagggctggaaaataactgtgatttggtccttggaaacctaatcaattgtatcatagtccatttggaaacatgttgtgtgaagaggaaggtgttgttcagccatggtacacaatcactgggtccagaagagaggttcctcggacatgtggactctggtttagggttttcctagcacagccatgcccagagtgggtgaggaagttgccttgagttttcttggctgatgactctgaagtccactcgcactaagccagtttctgataacgtggctcccatgtgacttgcccacagggagaaagaacccttctcagctgctctgggtagtccatccattggtgtgccgcaagatggtccagttaagtggcttctcatccagtgggatgcaggtaggcagtgtgaggggatgggaaaccagacggtccaggaagtggatctaatctccaccactagatgctgtgcctcctgcctgcagctcccctgaagtttgccaccccagttaaaaggagttggaaccacaaatatgaagagcaagagagacagcaaatgccactcagcttgggtggtttgaggtactggtggttgtgtttgctttttattgacttggtatactgactaagtggcaaatactcttctgggaacttcagtccatgttgtctcacttggtcttcacacaagcctgtgaggaaggcatctctagcttcgtttggcagctgggaaaactgaggtgtagagaaactgaatggcttcagctagtaactggccattagaatcagccctgttgggccccaatggcatggtccttctaaatatatcaagaaatatttcctgagagtcctgagataaaatggtagcctttgagaatgtaacatatgtcaaatgtggtctctgtgcttaaaggatcacagcatcagagctgagagggactttgggaaatgttctcattttgtagtttgaaccaaacaaacataggggacatgggggagctaataacctatccgggatgttgtggaagaaaaggaaagaaaagccatatatggaagagaagagccataaagaaaacctgcagggtgtggtaggtgagtgggtgtcagctgaggtgaagagggaaaggtgagtcagtgtgagggctgacgaggataccatcgaccaaaacagggaggatctgagagacagctagttgtggaaaggtgaaaagaaggtgaatttgtttctgaagaactgaaccagaaaaatcaaggaagtaaaaactccagttgaaaactccaaaccctgagaagagaaggcatgtctcagaatccattagaaaaggtctcagtgagacccctaccaggaagacccagacacccacagcagggttctgtcatgcttaacattattagtcacttagatgaacgcagagaaggaatgtttgtcacatctgcagtccatgcaaagccaagtgtcacagatgtcagaatcaatagacaaaatagtcaaaatagtcagaaagaagaaaaggaaccaacatgaaacttatcagggatcaatggaaagtccctgtttattttcagaaaatcaattacacaactatagaattagaataacaacagtaatgatattaatagctactattttgaaagtcctataatcactatgtgccagttgcttcacagaaaaatttatttaaaccttacaatagccctacaacattggtactgttattattatctttatcttacaggtgaggaaaccaaggagattaggcaatcttgcctaaaatcacacaaatcttgatttttctaatggaaaaatgccatactctttaatcaataagataactggggagacccgatttgaccacacttgtgtcaaagaccttttctagttgtaaaaatgagcaggtatgtgtttgtttatgctacaaagaaaaatacacaagcacagatgatgaatcaattgggaggttattaaaaactaaacatttcattttcaagttagttttactaatttgaaaagggatatttgcaaagtgattcaggattgtaaattttgaaatgttcccctagaaaggtgaaatttttatgatcataggaatgtttactgtggaacgattgaaacccagctctagccaggtttctgatcataactttaccttatacaattaagggaaaatcatggctaggaatcaactaaaagaccctaagtgtctatggactcctactgacagagaagcctactttagcaggcctcggtgggagcaaagacatgagaatctgtgctcacacctctctgtggtcacaagcaacttagccatctcacctatctctattcttatacagcagaaactctcaaggtgatgacccatccccactgggttcatccagaacattccctttcttcttcattttgagaattccttgtctccttccaatcctgcatgccctcctttccttggatgactctgcttcccctctcctcctagtaattccttctgctccactctcttttcagtcctgggaatatactccctggatcaaggtcattcctttcagtcctttggatggacactcactgtccttctatttttgtggctaagaatttgagcaaattctcacctaagcctaagagtataaacataactgtccacttttatggtcatctggtgccaaataattacatggttaatcaaccttcagaattgatgtcaaccagtcaggacagaggacacaaatcacaggaggcaagtatttcatctattgactcctcaccatcctatctatctaattatggaaaagagttaagatggtgcttcgagcccattgagtttacaatttcatttctttgaaaagttccacgtcaacagtacattttaccacaacaggatgattctataaagacaactgagtaatcaagtggaaaaaaagttacttttatgtaagcagatgagtgtagtgtatgattatccatggtataattttggttttctatcccataatctatggttgtatattgcccatcaactactctgtgatcaagctggactttgtcccaaagggaggaatcataaaatgatttaagttctagcacctttacttaaattcccacctggattccctgaaagagaatgcatttctgtatagttctacattatggaatatgtctgaaaacaaaaaaaaaaaaacatttggaatcctcctgttcattcagaggaaggtgcctagttagtttctttgccatgtctttctgccctctctttccctcttccttctcactgccatgtcccaagtccaggcctacaaccctggatgcttgggttacttaagcgctcctccctcccaccagatccctgcctccagtgtccctcccactccaacgcatcctaccaggctcctttaagcctactgtcatgacattgctaacagctaacagcataacctgttctccaactccctatggtcagggcactcaccatcctttgcaacctggacccaccttatttgtccaatcataccaggaccttcaggtcccacattccctactctttagtttctgctggacagaaaactctcctcactatcccacaaatggaccgtacttgtgttaagctttgagtgacagcctctgtatttcctccctcccagcacataacatgtttcctccaattctccagtattttataattttacccacctctcaaagcctacctcttaaaagtatcttctctatgaaacctcctcctgctactctaagtctcttcttacattccttctgtcgcttacagcttccattgtatcacccccgcccctcatgagggtgtagctatttgagaccaagggcaagaatgaggtgccttcttgtcccgtcagtgctgatcacacagcagcactcaacagcatgttcttgaaatggttgaacacagctgatgttgcctactgatcccagatcattgatgcatttcacattaccttttaccaagcacctcctaggcataagacctgtattctactgtgaagggttgtccctctgccaatccagactttctcttaaatattgtctcaaaagcttcaattctctggctcattgttatctgtgattacttgtctgctacatgtgtcacatcaccccctgaacatttggctaagttctaatatgtagtcagaatagaaaacactccctgaacagaggggaacatcacacaccggggcctgtcaaggtgggggactaggggagggagagaattaggagaaatacctaatgtagatgacaggtcgatgggtgcagcaaaccaccatgggatgtgtatacctatgtaacaaacctgcaccttctgcacatgtaccccagaacttaaaagtataataaaaaaaaaaaactgttaaaaaatgtgaaaaaaaaactgcactcccagaactttaaaagttccagtctctgaaagccatgatgccattacaatgagacaaaaagaagaccttcaaaagcaaaatttggggaagttgtcttttccatagctccttgactcacgcccatggggccgcttctggtttattctttttgagaggcttgttatggatattgttacattgacatgagggcattggaaagacagatctaatccccccaaacacacttgtcatatacacccacaaaataaatgagacaataaaacaatgaataacaaatgattacagctatccttaaaattaaatagtaacctgcaataaaatgggtgaggactcagtttagagaaacccttccttagaaaagttggttgcattcagattctaaaagttgaccttcagtagaatctaagcccttggcatttgttttattatctttccagagctttacactttattgtaagaggcagctaaagcaagtctctcttgttcctacacatttctttaagaactcagttcacttccctatagcaagtgccacccaatgctttccctaaaagctcagtccacttccctatagtaagtgccacccactggaaactagcaaagcattccaggatttcagtatttctgagatgccataagagcactggggggaaaaaaaggagatgaagaagggtattgggtggggaaaatcttacctcaacttctgactggcggggacggttattttattaagcttgtccattctgtttggtaattgtaagagacacgaataactgtccagtggtcacgtcagcagttcctggccctcctagggagcagcatggtaagcctctggtctcaagggttccggccactcaagt

SEQ ID NO: 1547 - DNA, 79819 bp, Homo sapiens; identical to SEQ ID NO: 1546
  source 1..79819: mol_type = genomic DNA

SEQ ID NO: 1548 - DNA, 79819 bp, Homo sapiens; identical to SEQ ID NO: 1546
  source 1..79819: mol_type = genomic DNA

SEQ ID NO: 1549 - DNA, 79879 bp, Homo sapiens; identical to SEQ ID NO: 1545
  source 1..79879: mol_type = genomic DNA

SEQ ID NO: 1550 - DNA, 79819 bp, Homo sapiens; identical to SEQ ID NO: 1546
  source 1..79819: mol_type = genomic DNA

SEQ ID NO: 1551 - DNA, 79819 bp, Homo sapiens; identical to SEQ ID NO: 1546
  source 1..79819: mol_type = genomic DNA

SEQ ID NO: 1552 - DNA, 79819 bp, Homo sapiens; identical to SEQ ID NO: 1546
  source 1..79819: mol_type = genomic DNA

SEQ ID NO: 1553 - DNA, 79819 bp, Homo sapiens; identical to SEQ ID NO: 1546
  source 1..79819: mol_type = genomic DNA

SEQ ID NO: 1554 - DNA, 22493 bp, Homo sapiens
  source 1..22493: mol_type = genomic DNA
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtacgtactatcgggtgggaagcgcggcccgggctgggtgtgaggggcggggacctgagtgagtagaactccggagaaaccctgggggagtaagcggtttttggcggctgcggcccccgggccctgccccgagtgcagaaatggggaaccgcgccggcccctctgcccagcgcaatgggcggaactgaagtcccgaggggaagctttgtattgggggtgcaattgaaggcggttgatggtgaagccattctgagtttatgtgttgactccggtacgtcattggttatttgtcatacggcagtggtgggggatggatttaccagaaagatgatcagcttataattcagagaggtgacgtatcctataatattgaccactcatgaaatgcttggtcagctcggtgatattacttcatccctattcctgcagcagtcttctcgaccgagttccaggagggatttaagctctaatgccctaaggcatccattgaatggaatgaattaacttgctgtgcacccaaaatggtactatttatgtaccatccttgggagaactgagaaaatggtcactcagagcattttctgtgttctgtggtttagatgaggccttagatgagaaaggctgcagggctccttggatatgctttttcttttacctcctgtttcagaaatataggggttacccccaaatagtgctctcagcactttcctgttcatgcttttcctcaaggatctcttcacactttcattaagtcgcttctataaatatgacttctttgtatgtatttgaaacttgggcccctctcttaactcttgtttacttctccatctgctagctggatactttgacgtggctgttttgcactaatctcacgtaaggcatgtacataaatgaaaacatgtctcatcctgttaatggtggtaggtcactctgacttgaaactttgaaattgctctggactttttcctctctctctccttccacctctaggggattctcctatacaattccatctccttgtaatttcacctttaaaacagctgttgaaaggctggttcacctccagtcttactctttcaacgcatctgtcccgctgctgtcacatcactgtcccaagataaagcttcagtcatgtcattcctgaactcagaaaccttaaatagctcctcactacttattaacaaaggtccaaaccattaacttggcatttagaggcccttactggccttccggtcttaaagctcactattgctatgctgcatatgccccatgcctctccagaagtatcctgtactgtattccagcctttcctcatgctgctttctttacccatattgcatccattccactcctgccatagatttcttccccatttggaaatagtcctcacagattgttggtgggagtggaaattggtgccaatttcttaggagggcagtttggcaatgtctgtttaaaaaatgcataaactctttgtcccaacagtctacttctaagaatttatcctacagaaagtgacacaaatatgcagataagcaaggaagctcactgcagcattgtctgaaatagcaaaaagtgaaaataacctaaataatccatctatgggggactggttaaacaaactatggtagaattctattctgctaaaaataatgtagtagatccctatatgttggtatggaaagatacctaagatatatgttttaaaagttgcagaatggtatgagtaatatttcgtttgtcataaaaataatatatgcatagatacgcaaagacaatttctggaaggctctgtgagaaactccagagtagctcatgctggagttagagggtaagaagaagtatttttacttttcagtttgtgcctccctctgtagtgttttaagtttttacagtgagtaacactcgaatagacaaagagaaatgaaaactccatccattctttgagccttagctcagtgtccacacttcctttaggaatttttcttagacttccctaatgaaagtcgctctcccctgaatttccataacattttctgtttctcattttctgtgattcctcacttctcatattctgtgattgctcgtattgtgcccttccagggaaggagacttgccttatttattgttgtaatctcagaacctggtacataatatagatgttcagcaaacctttctcgtatgaatagaataaggaccctccctttcttcttctttactctcgcacaataaagcaccttgaacttagtaattaaatatatataaaaacttgagtgacttcttaaccattggaagcagagggtaaaagagagaaaaacaaaacaaacaaacaaacaaaaaatgagtaactgagactcatccaataattaaccagaacattggggtgggaggagggtttgtgagttaaaatgtatgtatatattgttaagcgaagtgaattagttgttattccttaaagttgaaatgcccttttttggggtgttcctatcataaaacattaagaaaattgttttctatatttattaatacttaaagttgctgattgcattgttattttaatcaagccttaagcaacggcataattggtggatataatttattcacttcctatacagttggtacattaatatccctaagtgcttcacttttctctctctctctctctctctatattttttctttttttggtttttgtatttttattttatatgtggagtgcttcagtttctagttagctcttacctatttgaatgttgccttgcaactttgagaagtccaaagtttgttcatgtgtttcgtagggttaaaataaaaattatataattttattttgattttcaaaaagcttacttcgaatatgatagcatgttgttttcctcaatctttttttttttttttttgaggcagagtcttgctctgtcgcccaggctggagtgtagtggcacaatcttggcacactgcagcctccacctcccaagttcaagcaattcttgtgtcttagcttctcgagtagctgagcttacaggcatacaacactacgcccgggaaatttttatatttttagttgagatggagtttcaccatgttggccagactggtctcaaactcctgacctcaagtgatccgcccacctcagcctcccagagtgctgggattacaggcatgagccactgtgccaagactgtttttctcaattttgccaaaatttaaatctgtggcacaaattgtacttagaaatgtgtcacaagcaatgtgttgtgataactgttctatagagtgatgtaatttgatgttactgatggttaccagactataattgaagagagatgtttcagagtttaatattaatcataattttagtgtataattttagtaaagtgaccatcttacttttttttctctgattataaatcagtgattccatcttacaaaccattaaaccctatttagaaattgtatttttcttggtaggaatggtgattgatattcatcttagatgtttttgaatacctggcacaatgcttacacttttattattcaaaggaaagtgatgaggcattgatctcagcatcaggtctagatttatacacaagacaatgattatacactattttctatggtaaattaagttgctgaatcttaagagagaagaaattcttagaaaatccctcttctcctccctaacaaataacacaaccctccttttacatgtaaataacatatcgaactatatcaaaatcgatgttgacctacatttttgtttccatagaattgaaaacatactttattttaggcattgcatttttgtttatataatttcttcatgcttttgaaagcaagaatgctttagttcagtgaccgttacccacgttttggcctcaggctcctttattttatttttatttttatatctatttatttttttgagacagggtctcgctccgctgcccaggctggagtgcagtggtgcgatcatagctcgctgcagccatgaacttctgggctcaagttatcctcccacctcagcctcctgaatagctgggaccacaggtgtgtgccaccgtgcccagccattctgggcttgagcaattctcccaccttggcttcccaaagtgctaggattacaggtgtgagccactgcccctggccctcagactcctttgataatccagtgaaaactataagtcctctgccctgaaaaatatataaagatacagaattttgtgtatgttaatgttcatttatcatagactttaccttatagtagtaacttaaaaacattttttgaacattcatgactcattttttagaggaagctcagaggtaaaagtttaaaaagaaaagaaggatacctgtggttgggagactgtgtgtgtgccctcaaccccatttgtgggctcctttctacctgctactccccaacctccttttattagctgtgtcaatttgaaaggttccggctggtcagagtgcagtggtgtttacaactaattgatcacaaccagttacagatttctttgttccttctctaatcccactgcttcagttgaccagcctaaaaaaataaaataaataaaaggttcctaaatttgatttttgctggggacaggtttaagtgacacttctccagatgaagggttaatagaggacttgactatagaagacaaagcagtggagcaactggcagaaggattgctttctcattatttgccagatctgcagagatcaaaacaagccctccaggaactcacgtaagctaataaaaaaccagatatacactcatttcctctgtggcatagtcacaatttgtataattgtatactgtgttaagacataatattttttaacatgcaattataattgagtatgtctatatctttattgatagcagatgggaatagaggagtacatagtattctaaatgtaaaaagtgaaatgaatactcctagggtgttcgatctcttctaagaagtactcctaaatcttacctagaatctgtgattaggtttggcatttatcattattttatgaaagtattgcctattggggattgttcaggtggagatacacctgtttctgagtagagttgaaaaattgcctccataaaagtcacgcttgttttcagttgctggttcaaataagttgccagagatctgtaagtatcttttctgagatgatctgtttcattcccagtagataactttactagtaagtaaagattagaggatatgttaagaaaacagtttaagatagaacagaacccatagagtgggatcagtatacaaaaacatatactctggctttatcagctcccatccacagacaacacactcagcttctgcctcctcctgggtcgggacctctctggatagcccaggctggcctgtctgtcatttctttctgtggtggtcagctttacactggctataaactgctgctgctctgagacctaccctttgaaaacttacttaagaggcctttattagggcaaaaggagaggaataataactgtgcttattttataattataagtaatgttataatccttagtgttaaggtgctaaatgcatataaaagtggtactgaggccaagtgtggtggcttacacctgtaatcccagcactttgggaggctgaggcgggcggatcacttgaggtcgggagttttagaccaccctggcgaaaccctgtctctactaaaaacacaaaaaattagctgggcgtggtggtgtgcacctgtagccccagctacttgggaggctgaggcaggagaatcgctcgaactcagggggctgtttgtggtgagctgagatctgcaccactgcactccagcccaggtgacagagtgagactctgtctccgaaaaaaaaaaaaaaaaaaaaaagtggtactgggttattctaagactacatgtgtactactatagttagggagttggcaaccttctcagttttgtgctaatcccaaacaagattttttttatccctagcgcgcgatataccttatattttgatgccaatcaatctttgttgttgtatgaggtgtgatagatggaaggtaagaaactgcaagcgaacatatctgaaaaatactttacttgcaggaagctgggaatcaagttttaattgcagagtttaattgatgatgatattgtctaaaatttagtgtttcgaatagcccctacttatcttcttaggcacccagacaacaatgattattttgacgatgatagtaaaattagctactgtttgttattatatgtactatatgcccagcactttaacatatctcagttactcctgacaccaactttatgaagtatctagtattatccttatttacaattgaggaaactgaggctcagagaggttaagtaatttgaaaaagattacacaggtagtagtagaattagctattgaatatgatgcattagtagttaatatgcttcttgactgttaaggaaaggtaaacaaatttcagagaaaggaaaaagagagtatttcctcctcttttccccatctctccacaaatttcactattaataaagatataggggaaagagtactggactgagagccacctggattctagtcctggctctgccatcaaacctttggtaaagcctcttcaccattatagaaacaggtccacagagaagtaaaggagaaggtagtggtaggtagggattaagtttattttgtagctaacaatgagtaaggaagaccaagaaaaaaatttagctttatatataagaaaggttataaatattcatttatatgtatttatcattttaagaacattggaaactaaaaaaacaaggttctgggatccaggcccctaaagcagccacagaggtgcagttgtcagtggcctccatggagctcccttcgagataattcacacttggaacttgtaaggaagtagcttttctctcagataatcattcctcagacactgcattaaggcttcacaaacattgtcagcatatttactgtaaattatacaaagcttcaagggaatgaagttgagtcatcttttctgccccactgtattctctggaactttctccctttttttgagactgagtctcattctgtcatccaggttggagtgcagtggtgggatctcggctcactgcaacctctgcctcctgggttcaagagattctcctgcctcagcctcccaagtagatgggattacaagcgcgcaccactccgcccagctaatttttttgtatttttagtagagatgggtttcaccatgttggccaggctggttttgaactcctgacctcaagtgatctgcccaccttggcctcccagagtcctagggttacaggtgtgagccactgtgcccagccacattctctggaaccttctttgagagtggccagacttatgggtcaggaaagcactgtacttaaaattatagttgtattataaagggtacagatcaggacaagccaatgcagagacacacagggtagtgcctgggaggttcctgaacacaaaacttttgtttcctctcccagtgagaggaaacccccgctgccagcacatcagtgtgttcagcagcttggtgttcgaggctgcagtgaaccatggtcatgccactgtgccctagcctgggtgacagagtgagaccctatctcaacaacaaaaatttagtcttttaatctatgtacttggaatgtctctattatttagaagttctttctttgttatttttcattagcctcccatcttgaagctctaggggcccatcatgagtcactttattagtgtaaactcaggtgtgatccaaggagctcatggataacaaagacacttctgtcacttggaaaattccaaggattttagaagctctgtgccagaaacctgggacaaagatcagacaaattctttgttagataacaggtgtctgttcagatcttttgctcattttaaaattggattgtttttcttattgttgagttttaagagttctttgtatatttttgatatgagtcctttatgtgttttgcaaatattttctccaagactgtggtttgtcttattactctctttacagtgtcttttgcagagcaggagtttttaattttaataaatttatttaataaataagaaaaaatatagtcggttttttcttttatgaattgtgcttttggtagtgtgtctaaaaactcatcaccaaaccaaggtcacctagattttctcctgtgttttcttctagaagttctagttttgcattttacatttagacctatgatttattttgagttaattttgtttgtttgttttgagatggagtttctctcctgttgcccaggctgtagtgcaatggcacgatctcggctcaccacaacgtctgcctcctgggttcaagcgattctcctgactcagcctcctgagtagctgggattacaggcatgcaccaccacgcctgtctaatttttgtacttttagtagagccggggtttctccatgttggtcaggctggtctcagacctcaggtgatccgcctgcctcggcctcccaaagtgctgggattagaggtgtgagccaccacgcccggcctattctgagttaatttttgtggaggcttgtaaggtctgtgtctattaatagatgcatttctttgcgcatggatatccagttgcttcagcaccatttattgttgttgttgttgtttgagacagggtctcactctgttgcccaggctggagtgcagtggcgcagccttagctcactgcagcctccatttcctgggctcaagtgatccttccatctcggcctcccaagtagctgggaccacaggcgcacaccaccacacctggctgatttttgtattttttgtagagatggggtttcaccatattgccctggctggtcttgaattcctaggctcaagtgatcctcctgccttggcctcccaaagtgctgggattacaggtgtgagccactgtacctggccaccatttgttgaaaaaactatcctttctccactgcattacctttgcacctttgtcaaagagaagtttattgtttttgtgtaggtttatttaataagggttttctattctgttccattgatcagtatgtctgttcttttgccattaccatgctgtcttgatttctgtagctttttgttgttgtcattgtttgttttttttttgagacagggtctcactgttgcccaggctggaatgcagtggggcgatctcagctcactgcaacctctgcctctcaggttcgtgattcttgcacctcagcctcccaagtagcgggattataggtgcgcgccaccacacccagctaatttttgtattttttatagagatggggtttcaccatgttggccaggctgatcttgaacttctgacctcaggtgatccccagcctcaggctcccaaagtgctgggattacaggagtgagtcactgtgcctggccagatttctgtagctttataataagtattgaaattgggtactgtgagtcttccaattttgttcttcaatgttgtattggctcttctatgtctttgcctttccatatgaactttaaaacagtttgttgatatctatacgataacttgctgggattttgattggggttgcattgaatccttagatcaagttggaaataatttgcatcttaaaaaatattgaagggctgggtgtggtggttgatgctggtaatccaagcactttgggagcctggggcagaaggatctcttgaggccaggagttggagaccagcctgggtaatgtaatgagaccctgtctctacaaaaaaatttaaaaagtcagcctggcgtggtggtgtgcacctgtagtcatagctacttgggaggctgaggcaggggatcccttgaaccaggagttcaaggctgcagtgaactatgatcatgccgctgcagtccagcttgggtgacaaagtgagaccctatctgaacaacaacagttgagtcttttaatctgtgtacttggagtatctctctattatttagattttctttgatatttttcattagagttttatactttttgcatatagctcctgtatatattttgttatatttgtaccaccatatttcactggggatggggagctactataaatggtattgttttttaaatttcaaattcattgctggtacataggaaagaaattgacttctgtatattaaccttgtatcctgaaatcttactatacttgcctattagtttcaggaggtttcttgttgaatctttgggaatttccacataggaaatcatctgggaacaaagacagtattattgctttcttctcaatttgtataccttttatttctttttcttgtcttgctgtattagcttggacttaaagtatgatgttgaatatccttgatgaacattgatgcaaaaatcctcaataaaatactggcaaaccgaatccagcagcacatcaaaaagcttatccaccatgatcaagtaggcttcatccctgggatgcaaggctggttcaatatacgcaaatcaataaatgtaatccagcatataaacagagccaaagacaaaaaccacatgattatctcaatagatgcaaaaagcctttgacaaaattcaacaacccttcatgctaaaaactctcaataaattaggtattgatgggacgtatttcaaaataatagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttataccccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatataaatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatacccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcagcattattcacaatagcaaagacttggaaccaacccaaatgtccaacaatgatagactggattaagaaaatatggcacatatacaccatggaatactatgcagccataaaaaatgatgagttcctgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagtgcaccagcatggcacatgtatacatacgtaactaacctgcacaatgtgcacatgtaccctaaaacttaaagtataataaaaaaaaaaagtatgatgttgaataggagttgtgagaggggacatagcttgttctagttttaggagaaaattatgtagtttctcaccctaaatgttagctgcaggtttttcaaggtattccttattaagttgaggaagatcctctctcttcctagtttgttgatggtttatagtcatgaatagatgctggattttgtcaaatgctttttctacatcaattgataggaccatgtaatttttcttctttagcctgttgatgtggtagattacattgattgaatttttgaatattgaaccagctttgcgtatttggcagaaattttacttggttgtggtatgtaattctttttacacattgttggattcaatttgctaatattttgttgaggagttttatatcgatgttcatgagagatactggtctatagtttttctttcttgtaatatctttatctggtttggctttagggtaatgctagcctcatagaatgagttgggaggtgctccttttgcttctgcagttgttgccctttatccaaaggaggatatgttccaagacccctagtggatacaatattttaaataattttgtgcatgaaacaaagagttttgactgtgacttatcacatgaggtcaggtgggtcattcattgtccaaatgtttcaggttttgcaacattttggattttcaggttatggatgtcagcctttatacactatgttttttcctatacttacatacctatgataaagtttaatttataagttaggcatagtaagagattaacaacaataactaataataaaatacagcagttatactataataaaagttaagtgaatgtggtctctctttcaaaatatcttattgtgctgtacttacccttcttgtgatgatatagcacagctgcagttgactgtacgtgcctaaaactgaagaaagcaaaactgcagataaaggaggactgacatattttctggaagagactgtggggaattggtatcacgtcttccttaaatgtttggtaaaaattaccagtgaagccgtttggtcccggtactgtcttttttggaaggttattacttactgattcaatttgtctaataaatataggcctacataaactttttgtttctccttgtataagttttggtagtttgtatctttcaaagaattagtccattccatccacattatcaaatttatgagcactgagttgttgaaaatattcatttattatccttttaatgtcatgggatcagtggtgattactgctctttcatgaataatactaatactttggggtttttttttcttgattggtctcactagaggtttatcaattttattgatcttttaaagaaccacctttttgtctcattgatttttttgttttcccccttctattgttttctagttctaacagcctatttttgctgtcctgtgtatctcagatggttgacttgctgggttttcctctcatccattctgtatttcactttctgtgatctctagtccaagctggagggacaaagttatttatttatttatttatttatatttgtagagatggggtctcaccctgtcacataggctgtagtacagtggtgtgattataactcactgcagtttctaactcctgggctcaagcaatccttctgcctcagcctcccaagtagctcggaccacaggtgtgtgccaccacacccagctcattttttgtgtgtgtgtgtgttttttttgtttttgtagagggtcttgctttgttgtccacgctggtcttgaattcctggcttcaagcaatcctccttccttggcctctcaaagtgctgggattataggcatgaaccactgtgcccagccaagagacaaatttatgacctgtagggtatgccagactcagtgctggatagtagagatgttgtaattgccctgagcctgttcgttgttatttcttttttttttttatcattattctctagatagcacagttttacaagcaaatgacatatttttctttgtagcattctttaaaatattcaggtaggtgacccttttaatgtcacttattcctgtgatcctaacattgattgatgtgtaaagaaatatcaaggaagttggcttctcttcctcaatgagttttgaattagaattgtaatgagaaacattagaaattatctggtctgatcttctcactttgtaaatgaggagatttaggccagagaaataaactgaatttctaagatcatatagctaactggctgttggccggggaaagctatgatttccagtcctgtgcttttttcatcttactgcttaattattctttttgacttactatcccttgatacttcatcttcctcacctctaatctgaaaaaccattgttcctcatttcctttatgggaatgttgcaattttaagatatataaaacattgaacttcttgggcaaaatactataaaaaacttcttttttggaataatacagagagttgttaaaagtaacaagtaataaaatacttttaaatgattggattattttagttattagaaattgaagcaagaataaaagacacatttagttatcagaatgtggctttagaatattattttgaaaaatcttattctatattaaataaaccttagagagttaatacatttcctacttaactaactgttaccattaaccaagatgaatatgattccttttaatggaccggcactttaaatatgtagagtttgtcttggctgtgtgtttttgtttcagacagaaccaagttgtattgttagacacactggaacaagagatttcaaaatttaaagaatgtcattctatgttggatattaatgctttggtaagtatgatttagttgatgtaatttaatgacatcttgtcttagcaatagctaagacttagctaagcaatagctaagattttaagcttagaatttgtctttttaacaagaaaccttgattgaacttctgttgtgttgaattgttatctttcaaatgttgaatttatagtaggaaatttaacttatttgtgcatttggaatagatctgcttataattgaagacttagaaaagagaacttagacttggcatagtggctcatacctgtaatcccagcactttgggaggctgaggcaggaggattgcttgagcctagcagttcaagaccagcctgggctacatagtgagaacccatctctacaaaaagtaatttagaaaaatagttgggcatggtggcacatgcctgtagtcccagcttttccagaaactgaggtggaaggattgcttgagcccaggaggtcgaggccacaagtgagctgtgattgtgccactgtactccagcctgggtgacaaagggagaccctgtctcaaaaaacaaacaaacaaaaagagcgaactggaagtaatgaacctttggggtaccattttttttttctttaaagaaagtgcatttctctttaccaattacatggtttcttaaattagcattttatttaattatatggcatattcataatgctataataaattaatgctataggctgaagtggacgctttgagaatgatcagttatatctttcaatataaatagttgaacagttgaatttcatcagaagttctatagctttttgatgagaggaagtgatactctgtattataagaaacaaggaattaaccaaaaaaaggaacttgttttgctacctttattttctgatgaacattaaaaatagttttgtttgtgggcagggcacagtgacttatgactgtaatcccagcactttgggaggctgaggtaggaggattacttgaggcgtgcagtttaagaccaacctggccaacgtagcaagaccccatctctattaagaaaaaaagaagctgggtttacatgactgtagccattcatgcatacctcaaaaaaatggacttttctttggacaaagatggtttactaatgttttccatttgtaacaattaaaaacaaagttcatattctctggcattagaggcctgtggaagtaaatacagagccatctgcccagtagttcctggtttcttgcgagggaggtgggcaaggctacactgacctatttttgtgttccccactgaaatcctgttgcaacagaaggaatatttgttgaatgaatgaatgttgaatgaattaaccaagcagatgtaatactgttgctttagtctgaaggggcaggatggagtcttcctcttttttcttctcttagtcaagagtagtttttattatcatctgggaactgaaaactggaaggcccaggatatgtaaaaaggcactgtaacttctgagctaatcagacaatgactttacttgcagctacattaaggctgtgaatctctctactgacatttctttcatttcttctctttctgtaaccttgtctgaaaatagggtgcttttctccttctctctgacatctctaggcttgcatcatcctcccatcttctcctgacataagacttcattttagattatgcaggttggctgagttgtaaagtctgtacttaagactcctcaagaaggaaagtgtcctcacagagatcattctgcttagtctgactaaagcagcccaaggaatggattaaacttgtccacagtcctttctgtccagggctctgtggccacagtttgggttttccttatgggcagacacttcacttaaactgtttcatgtgctctggctcagtctgtctcttgtaaaggcagagagaatgttttacttttcttaaatgaaactgatagcattattagatagtcttatctgaaattttagaattatatgtttttaaagcaaaatattgtctatgcccatcttaatataaatgtctattttatgtttagtaacacttttgtcaatctgaactaaatcaaatgtctttcaaatcctactaacaatataaggaaatctttattttggaattaaaatgtgaagataaggctgtaaaaattttgaccaatttaggaagcacaaactatcatttatatattgccttatttattcattttgatattttagtctattttaacttgacttttcatttatttttccatgttaagtttgctgaggctaaacactatcatgccaagttggtgaatataagaaaagagatgctgatgcttcatgaaaaaacatcaaagttaaaagtgagttgaaaattctttcacattctttacaaaagtagaggtttaattgttttttgttgttttttttttttttcagtattctttttttttttgagacggagttttgctcttgccgcccaggctggagtgcaatggtgcaatctcggctcactgcaacctctgcctccggggttgaagcgattcttctgcctcagctccccaggtagctgggattacaggtgcccgccaccacacccacctaatttttgtatttttagtagagacagcgttctaccatgttggccaggctggtctcaaactcctgacctcaggtgatacgcctgccttggcctcccaaagtgctgagattacaggcgtgagccactgtgcccggccagtattcatattttgacttttataccctcatatacaatagcataattcattcatggtacattgttttctttttaaaaatgtcattgtttaagaaatattagagacagggtctcactacgtttccgaggctggtcttaaactcctgagctcaagcagccctctggcctcgacctccctaagtgctgggattacagacatgagccactgcgtgcagccttaaaaatatcatttttttttcaactgcactctgagcatttttactaatagctgggctgataggcttagattctctggatatgccctacagttctcatttaataagagtttagagcaacaaatttttttgaatcaaagggaccttaaattatcccaaatttaaatgtccaagatgaagtttattagtgtgaatgaattacctcaaagcagagcactgttattttcaaattaggctaaacctgtaacccctgattgctctcttggtttttaaattttttttttaacacagaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaatta

SEQ ID NO: 1555 - DNA, 36778 bp, Homo sapiens
  source 1..36778: mol_type = genomic DNA
gactttcaagctttctagtaattttattttatcaaaacaccctcccctcccatctttatgacaccatttcattcttgccaaattcggtccacccccacacacacacccccaagctctaccaaatgcctactcaaagagctgttggacccctttgtgcggctatttacatcctccctcctaaaaaatattttcatcgcaaattcagtctgtcttaattctctcgggaaatttcaggcacaataatttcttggcctttgctcagaagccactatcccagggaatcaaagaagaggtgcattcccagatgtagagaggggcctttttgtattgagtgggagcacaaaggctccagggctcctaagcttgggatttcctctgagaaagtgaaattggggcttgtggagaagagaagtagaaccaagaagcttattggcgagctcaggattcttcatccatgacatctagaatattgctcagaagaattttgaaagtgggacgctcatctgctttctaaaaccaaagaaaaagtaaagtgttagagtggctagaatccagaattcaagggaaatgcaatgagtaagcagcaaatgtttattaaatatatgctctatgcccagtagcatgccctgtcgattacaaaaggaaaaaaaaaaaaaaaagaaatagcagctctccataaagtctttgtgcacttttcatctttagtaactcaggttattagtgtgataagaacaatttgcaaattaaactgacaatcacactgatcaaaattgagggcaagttcattatgtaactgtatacaacacattcttattttggatcctcaagtgaaaaatggctaccaaacaagttcaagtggttggcagaacagaaatcccatgtgataatttttagtgattaatatttcaaaaccacaggctgtattactgagcagggattctgagtacctgggacctttttttttttttttttttttttaccactggtaacaaaaagactaaggtttttttttttttttctttttgagacagagtctcaccctgttgtccaggctggagtgcagtggtgtgagctcagctcactgccacctcccaggttcaagcgattttcctgcctcagcctcccaggtagctgggattacaggtgcacgccatcacgcccagctaattttcgtatttttagtatagaccgggtttcaccatgttggtcagactagtctcgaattcctgacctaaggtaattcccccgcctcagcctcccaaagtgctgggattacaggcgtgagccaccgcgcccggcctacgactaaggttctttttgatggccatggcccataagcccccgaggtatttggtatttagtggttcagggaacattcatgccagaatgctctcaatctgttagaaccaatggtcatcaatttcttgattccttgactcagtgattcttaaacttagctgagtatcagaatttcctgggaagtttaaaaagagatttctgggttccacttcaggcatagctaatcagaatttctggagaaaagtcccagttacctgaatttttttttgtgacacagtctcgctctgtcactcaggccagagtgcagtggcaggatctcggctcactgcaacctccacctcctgggttcaagtcattctcctgcctcagcctcctgagtagctgagattacaggcacacatcaccacgcctggttaatttttgtatttttagtagagacagggtttcaccatgttggccagaatggtctagatctcctgaccacgtgatccgcttgccttggcctcccaaactgctgggattacaggcatgagccaccatgcccagccagtaatctgcatttttaagagctccttagggtttctgatatgcatccaattttgaccactcctttaaacaggctgtggataaagtacctgtctgaaatcatttttaattagcagagtaagaaggtcctgattgggagggagcatagccaatcacccttaatcctgcatcacacagaagaaagaaggagtcctccctttctgcactttctctgtgatctgtcatttgttcgagggaaaccagccatgctcggatccagatacccacttttcacctcaccaagaaggctccagattcacatatgcacttgttggacactctgaagagttgagcatttatttcctactagaaatttaggttgccaaggatctactgaaaagtagagaaggcatcttgggaagaactcgaggtaagaggagcaaagcagtttaatagtagtaggacagatttccttatttccaaaataccacacctacccacataccccacgatgcaccatattaaaaagcaaaacaaaacaaagcaaacaaaaaacccactacctgttttagttccctttcaagcagtaggttttaaaaaaaatctcatttagccgggcgctgtggctcatgcctgtaatcccagcactttgggaggcagaggcgggtggatcacaaggtcaggagatcgagaccatcttggctaacacggtgaaaccctgtctctactaaaaatacaaaaaattagccgggcgtggtggcgggcccctgtagtcccagctactcgagaggctgaggcaggagaatgctgtgaacccaggaggcggggcttgcggtgagccgagatcacgccactgcactccagcctgggcgacagagaaagactcggtctcaaaaaaaaaaaaaaaaaaatctcatttaggacctcagccagaaacggttggcagctaataaagtagaagaaagggccaatgacacacaaaggaatgaacaaactttcatgacttttcttttgtaatgcccattcacttgtctgaatgcctctggctgcctgcttatgctagatgacatggccccacaacacctcactccctaaagctgagctggcattggagtgtactaatgacactctagtgagaatcggagtgggcctgggaaagcctctggccatcagatgatcaagttgcaggccaaggtcagagaatgtgtgcaaggcctggcgtggtggttgatgcctctaatcccagcactttgggaggccgaggtgggcggatcacttgaggccaggagttcgagatcagcctggtcaacatggcgaaatgccatctctactaaaaatacaaaattggccaggctcagtggctcacgcctgtaatcccagcactttgggaggccgaggtgggtggatcacctgaggtcaggagttcaagacctgcctggccaacatggtgaaatgctgtctctactaaaaatgcaaaaattagctgggcacggtggcatgtgcctgtagtcccagctactcgggaggctaaggcaggagaatcacttgaacccaggaggcagaggttgcagtgagccaaaatcgtgccactgcactccagcctgggtgacagagcaagactgtgtcaccaaaaaaaaaaaaaaaaattagcttggtgtggtggtgcacgcctataatcccagctacttgggaggctgagacatgagaatcgcttgaatctgggaggcgaaggttgcagtaagccaagatcgcgccactgtactccaacctgggtgaaagagcgagaccttgtctcaaattaaaaaaaaaaaaaaaggaaaaaaaagaatgtgtgcagctatcagtctttggtggctgaatggccagctaaatgggcaagtagattcaaggaaataatttaagagatcctaataaagcacttacctcatgccagcaactgtacatgatggtatataccttctctgaagccagatgaggcctgtagagacgtaggccttgggcaatgtgttcagcagtctcactgttagtaaatctctcatatggcatcttccccagggagtaaatttcccacatcaaaacccctagaaggtgaaaaaaattattaaattggtttgcagtctttttggatagcaggggtcctagtcttcctagatcaacctcaaagattagaatcagttggttccccgctctgtgctttttatattttgcccaaatttctgctatagtactgaccacactagatggagatcaaggtcgtactagactattaactcctctagaagagagacagcatcttatttgtctttgcagttatagggtctggcagagtgcctggtacataatcagtattcagaagctgttgaaaactgaatgaattgttttccttaacatggtttaagttctaaaaaggcagagatcatgtccagtttagttttcatcctcagaaacccctgtggtggctgacacacagtaagcactccccaaggattggaagaatgaaagcaagaacaatatctctgtggaggttgcaaagtgtgaattttcccattgcatttcttatcctttgagctgtataatctgtgtaatcttatccacttaccaaaagcccaaatgtcagatttgctgctgaacttgctatacatcaggacttccggtggggaccaccggactggaaatttggagcctactgagcttgtgtattcatcatccaggacatacctgcaagggattcaggacttgttgcattaggatttggaggcttgatatttgcttacgttttcttggcacggtcacaagagtgtcacaaacacacacaggctttctcaaaagtctctcctcctcaactagtatcttctacaaacgttacttttaacgaatttcctgtttttgtatctgattgagctttcctgattgacaatatggttacaagaaggatgaagtgaaataagatctagtaggtactcccttcctcttctctatccacctttcctttctctgctcttctccttcccttccttttatctgcagttgtcactgggaattagactgattaagaaagaaggaggaatggagtaaagtcatcaggattaatagatcaagataaggtattggggaaatagatttaaaaaagaggaggtagagataaagggagaaaggaaggaaagggatatgacaataaaacaaaaggatgaaagaggtggcttaaataactcagaggaagaaaaagaatagaaagatcggcagaaaacgctagaatgagaaaaaaaagaaaaggagaggattaaaactgtaacacctacccatgtttcatactgtgctatttttacttctggagggaaagatgaaaaagccacactcacctggacaggccgaaatcagatactttaacaactccttgatcgtttaccaaacagtttcgagctgcctgtagtgcaaacagagaccagtgagactccgtccccagcacagaggttaaaggcacaaagcttctgctgaccagtagaatgaagccagggaagcttcatctccttcgactacagacaccttcccacctaataggaatctgttgatgccaccaagaaattttgattcatttccaccacgtggaaagcaacctgctgtgtagtcctaggtaaagcactgaggacatacagaacgattgcattctcatgggcaattccacaccaccccattccctcactgatatgctgaaagaattaagggagaggctgggtgcagtggctcacgcctgtaatcccaacactttgggaggccgaggtgggtggatcacctgaggtcaagagttcaagaccagcctggccaacatggcgataccccatctactaaaaatacaaaaattagctgggcgtggtgttgggcgcctgtgatcccagctacttgggaggctgaggcaggagaattgcttgaatctgggaggcggagtttgcagtgagccgagatggtgccattgcactctagcctgggcaacagagcgagactccatctcaaaacaaaacaaaacaaaacaaaacaaacaaaaaacaaagaagggagaatgagaagtaagtttttttgctttctgcttttctgccagtgagactaggacaatttgagccttggcctgactgaaagaaacaggggcgcaaactctgatgcttacaggggccaggcaagttaagtaagagtgaagtgaagtggatcgagattgcaggaaatggagagtacatgcctagaggaaaggaggcggttcgtgagaatgtggacctggtatttccagacggtgtagattttcaagagaagctggaaattccagggtttttttttttttaagcgaaatgtttctttttaagggtttgctaattattatataacataaaaaaaacccacacatgtgggccaaatgcatccacaggccccagtatgtgactctgaaggaaccaaatgatggccccatgccaggagcagtcccattgggaagcacagtcccttctgttccaaatccagaatggccactgaaagaccccaccattttcttgtgggtggtagggggttgggagtgagtgactgctctgattcccaccacggcagacttcatggagctgaggctggagatatttgatgggctcagcactggggcagaggcacgcctaacttatagtactttctagataaaattgaaatgatggcaccagcagcccccctcaaccatgtatgatatatcttccactgctacttccaccccatcagccctttgtcctaggccaatccttctaaggtcccaccaggtctcggtgaaggaactgctttgactccaggtattccatggcttcacagacatccttgcacatctctagcagctgctgagtctggaagcggtggcgcatctccctcaggtagttcaggaggcagccattggccatgtactcagtgatgatgaagatggggcgctgcttggtgcagacgccatacaactgcaccagcttctcatgggaaagattcctacaggaaaggcaaggaactagtcttctccttttggctctgcataatagcaataaaggggctggggaggaaggggctgacctaggagtagagcatcagataaggggtcacaccagcaagtttattttcctctttcccaccctaaatctcaaaagtgcttaaaatgtggaagcaagcagggatttggagcccatcaattgaaaaagaaacaagtccaggaatgaaagaacgctaaggctaaattagaatatttctcttgaaagtttaattttctacatctacccccaaatgctactgagatggtacacacccatgatcaccactattctcaaccaatatctaaggcacagaaactattatcttagcacttaggactaccgccagttaaaggtaaacttcagtccctcgtcccaaacctctcttactgtaagtcatctttaagcctcagtgggttgttgtgtgaattcctagactccagcaaatagattgagagttgagtttgggctataactcacatcatgactttggcttcttcaatgaattcatcttcagacatggagccttctttgatcatcttgatggccacgtcgtactggcctctccatttcccatacttcactaccccaaattgtccagtccccagctccttcaagaaggtcaggtcctttggatcaatttcccatgatcctaacaataaagtcttggtgtgattctttggggtcatgaatgtataattcttacaatagacaaaaatccctactggggtagaaataggaaaactagtaaaagggaaatttttagaagtactaatctgtctttgcttaagtcaatctcagaaacgggattcattggttagaggaatctgggaattttaggttcaaggtggccataaggcaagaagatagactaagcaacctccccaaatccctttatgattatgttagtgatggtagttaatgaactcagggatagtactgaaaattttcccacaattaaaaataaaagacaaaaagacccaagacaacgacaaagccctttatgaatctatgtttttgcagtcccagtcgtagccactagaggaagaaaatcagtgaataacttttgcttggatctgtcttgagcgtccttgaggcagctgctgcagaacagtgtacctcaaggacactccctaaggcaaggccagcaaaggtagtttttgcaactggccagtccaccctaccccagagaaataaggagttaccgtatcccaggcctgcagtggaaggtgcattcttgttttgttgagacactggatatttgagcctggatatgagtcctgaaacagagagagaggtcatgctgttggtgtggtgtaggaggtgggatgcctcacacatcctcacttaaagcctcacacttccggtgtgtatctttctagtacattttgaatcccagaagacctccatgaacccacatatttccagaggtttctcctctcacaaaatacttttcagggacaaaaaagagaaaatactaattgaaatacactgcctaactgaatatattcccacctcccagcccaggcttagctcacatcctaccttcttgatgaagctgttcccccatatccatgccctcactaatgtctcagtttttagaaattttacagtgcttataaactttcttctgatgttgtctaacctgtatgttctttgaggacaaggacctcgactcagaatgttcccgtgttctcctctagaactgaggaaatcgctgagtacacagtaggaactcaatgaatacttgctgatgaatcagtcaccagcctcttttgtgtcttctcttaacactgaacatcaatcaccaaataaagagtcagtccctgttgggtgtaggtctgcctctgaccacctctttaccagcttctacccagtatcacagggatttcctttcacagtgaattcacactgtcctgtgaggcagattcttcctcttatcaccttgtcctgcattgcttatcctggtgtctgtaactcccttctcagttgcccctggtactcacctgcagagttgtgctgatggtagttaatgagctcagggatggtgctgaaaaggtgcttctcagccaggtaatactggctctgaggtgtggaacacacaacataatgacgtatcaccccttgagggtccctgaagaagtggatgcttagtcagtaacttgggcacaaaggtcaacagaacccaggaagtgaagtgagatgagttttgagtttcagagacagaggaagtgggacgggcacagcatcaaggagctattaggagggtacccctgttctttgtcctcagggccttggaatagtagcactcaccctgtggatttagcaaacacagacactgtatatttgccagctttgctggagtctctgacaatgaaacctccttctttcccctgaaacaacgaaaaagaagctgtctgtaggaggaagtggtgctcacacctgcatcccacctgcccaaacttgagagagaaaatagaacaacccctgattttactgccaagttccacgcttgagctacagcctcattgcttttaatattaaaaggtgcaggccgggcatggtggctcatgcctgtaatcccagcattttgggaggccgaggtgggcggatcacctgaggtcaggagttcgagaccagcctggccaacatggtgaaaccccgtctctgctaaaaatacaaaaattagtcgggcgtggtggcatgtgcctgtaatcccagctacttgggaggctgaggtaggagaattacttgaacccagaaggcggaggttgcagtgagcccagatcacgccactgcactccagcctgggtgacagaccgagagtccgtctcagaaaaacaaaaacaaaaaaaatggtgtaattgggatcccagacgatggcagctttgacactgccttgcccaaaggtagggggcagaacaggccctcagttcaagatcctcacttatgcaaggagaatgctgtgtgctagtggttccacacttacctcttgctttagcagttgctcagcctgactccgagtcatgtgtttggaataccacctgtgaagggagagtgctgcttgagtggctcctggtcataagcagattggaggttacagcaccctccagggcttgtccatgtcagtgattcagtcaactcactcaaaccctatttactgagcatctgtcatgtgcatagcacactgtatccctttcccaaacccaggttggcattgaagattcatggaaatggagagtagcaggcaaaggcaagcagcagggagttgcagggaagagatcagggactagggcacttgagaacaatccacttccatgattagggaggaaaggacaacagtagcagtttgacattttaattctttcatcaggtcgtcaactcctttttctttgagtgtgattcttctggatttgagggcatggtgacctctccagctctcataaatggagggtgtttggggggtaaaggtaagacagatacactaatttgaggtggtggcatcatttgattcagatggtactaattttaatatatatcttgaaataaaaaatatgttgaaagtagaaaaaagtgtatatatatatatacacacttgtgtatgtatacataatatacctatatatacaccagtgtatgtatacatatgtatacatatatacacttgtgtgtgttatatatatatataaatatatataaaatatatataaataaataaatatatatatatatagagagagagagttcctcctggaagattgtggactgacataaacatacttactcatacatttctatggagtcttctgcttcagtgacatagttactaggaatgtagccttcctgcctgtgaaggaaacaatgtggcagttcatccagcacctccccagcctccaggagacagattcatatgcccacgtccctgagctcagaacaaatctcaaatggaggtatatgtatcatgcacctccctcaaagacaatcatgtctctgatgcatggttaggcagtgagccagtgaggtgcagagcttatgcacatgttgcattggttatatgtgcccaacaacagaggctcagagatgtggcagaggccatgtatagggagctgcacgctgggaagtacttggagggagagcatgttcagtctggtgtgggaagaacagtctctgatgaggatgctgatcacgggaattatgccgcagcactttttgcgtgtagggagtgggcaggcaccaggctcaggaagggctggtgtggactcacccatttttatctcgtgctctccaccatggtaagttgctttcctccaagataaaatattcatcacccttccgcagctgtagatcatttgcattcattggcatgtaatcataaagggccacaacctttttcagctcacttgtggagactggtgctgctgctggctcaggcggtagtggctttttcaagatctatgtagttaggagaaaaggtaggagggtttgtcaagataccaagcactcttctcttctctcccaactctctggcttactcaagacacccaaatcaggcatactaaaatattactcagcagtcattcaacaaccatttttaagcaccagtgcaggagttctcagccttgcacacatataaagaccatgtatggaacttttaaattccaatgtactttcggaggccaaggcgggcggatcagttgaggccaggagttcgagaccagcctggccaacgtgacgaaaccccatctctactaaaaatgcaaaaatcagctgggcatggtagtgtgtgcatatagccccagctactcaggaggctgaggcaggagaataacttgaccccaggaggcggaggttgtagtgagccaagaccacgccactgcactccagcctgggtgacagagtgagactgtctcaaaaaaaaacccacaaaaaacaaaaaaccaattccaatacctagtcagtttcctcacagaccaattacatcaaaatcaaactctcaggaatgggacccaaacattactatttttaaagctcactagacaaaaaccatttatagctaaggtcaggaaaccggcttggcactaaacttgtacgtgaatctactaagtggctcagaaccttggtttccttctttgtaaaatgagtataataatacctgctctacttacttacaatatgtgagaaagggctttctagccctcaagaaggaaccaaaaaaaaaaaaaaaacttctgaagtgttagtgataggtggtgttagtgctaagtgttgagtatgttggtattaagtgttaaattcttctaactttactgtatgtttgaaaatactttccagctgggcacggtggctcacgcctgtaatcccagcactttaggaggccgaggcgggttcgagaccagcctgaacaacatggtgacacccccatctctactaaaaatacaaaaattagctgggcgtggtggtgcatgcctgtaatcccagctactcaggaggctgagacaggagaatcacttgaatctgggaggcggaggttgcagtgagccgagatcatgccattacactcgaacctgggcgacagagcgagactccgtctcaaaacaaaaacaaaagcaaaaacaaaacaacaacaaaaactttacattaaaaaaatcaggttttgttctaaacaggtgattggattacatggttgctgagagccttctatctttccatcgaggaggaaatcctaattagaagaacaaatcccccatcttagcaagaataccaattaacactgccaagtcccagggtaattctaagactctagtgtgttcttagggcttgactataagtttccatttaagcagtggcagcacccagtttccctgtatacctggtcctcctcaggcgttgggggaagaggcttttttgtcttccggtgagaactcccaggttttaagcctgcaaaacaagaagccagtgatgatatggaatgcactttaggaaaggggccaaggacaggtttggtcagggactttgccgtccatattgagtgcctttaggcaagttagaaaaagtagctaggcatgccaggtcacatagcttggagagcagattaccagctggatttcagcccccatgtgcctcctccctcccccaggaccctttgtttagcacccaaagtgtacaaccttatgctatgaccctgggcttgacagacccttgggagagtgatggaaacagtcaaaggagaaagaaattatatcgatcagattgcttacttccattcctgttctccaaaatttggcagcccatagcatttttggctgtctgagagcagcagagatactgcccatcgatccagaagcaagggtgatatttctgaaccagatcactgttgtaccggattactgtagcaggaaagaagagagagatcacatctgacatggaggagaagccaccatttgcatgttttcctctttgagcttagtggtgaacttcaagcaactgccccctccttggccaccctgaaggagagcagatcacaggaccagttggctcacatgactggcctgcctgactgtgccctggtcccagacagttcctgtgcagttttctttagtggtctgtgatgaggagtatctcccaatcaacaagataagactatctgatggcttgagagcccaacaacagaaatatgttatctatgttttcccagtagccattacaatgttcctgtaaggcaagtgtttcccagataagggaaacagtgtgcccaggccaatctccccagcttttaatactgatttctcagttccttgagtgatcttttagggataattagccttagtgagaacttctgcatgaggctttctgtatagaatagtcaacagagctgatctcaagggcaaatgaaggtgactttgcctctagaatcaacatgatttgaatcttcctagggccactgaggtagactgagctcattgccagaggtaacacagcagcttcattccctcatggagttgtgaggcccaaaagatctcccagagtaaaagtattttgcaaagaatagagtggatgcagagaggaggaattagtattggtgtttataatactatggcatatcaaaaaccttcacatgaagtcaattagaaaagttggccagacgcggtggctcacgcctgtaatcccagcactttgggaggccgaggtgggtggagcatgaggtcaggagttcaagaccagcctggccaagatggtgaaaccccgtctccactaaaagtacaaaaattacagcgtgcctgtaatcccagctactcgggaggctgaggcaagagaatcgcttgaacctggctggcggaggttgcagtgagccgagatcgcgccactgcactccagcctgggtgacagtgtgagactctgtctcaacaaaaaaaaaaaaaaagaaaagtcatccagggttcatagtgtcagataactgagagaagcaaagacaattgaaataactgatagcagcaaacactagagcaaagacccaggctggtccaggaacacgcacatttgagaacatatacatttcagcatttacagctaagaagaatcccgcacattattattattattattattattattattattattattattattattattggagatggggtcttcctgtgtttcccaggcaggccttgaattcctggactcaagcagtcctcccacctcagcttcccaaatacctgggactacaagcactcaccaccaggtccagtggctggcataactttttttaaaaaagacaaaaacaaaacaaaaccttccactgtagaaaacaactaaaatccggctgggtgtggtggctcgcacctgtaatcccagcactttgggaggcagaggcgggtagatcacctgaggtgaggagttcaagaccagcctgaccaatatgatgaaaccccgtctctactaaaaatacaaaaattagctgggcatggtggcatgcacctataatccctgctactcgggaggctgagacaggagaatcacttgaacccaggaggtggaggtcccagtgaactgggatggcgccattgtgctccagcctggccaacaggaacgaaactccaactcaaaaaaaaaaaaaaagaaaagaaaaaagaaaaagaaacaactcaaatccttaagggcttgctagtcacacttcactcacttaaggctttgcaggaaagcctaaaagctgctagtagctggtgcattttgcaggcaaatgaacaaaagttctttttttttttttaagagccattttggtacttttctccacatagatttgaaaacttcaaaccattctcccctacccaccctcaccctgactttttcagcactcctcttcaccagtgtaccaaggacagaatggtgggagctgttcagatagagtgcaggctataagggactgcattgcatagagggaattttttttttttgagacagtgtctcgctctgttgcccaggctagagtgcagtggtgccacctcggctcactgtaacctccacctcctgggttcaagcgattcttctgcctcagcctcccgagtagctgggactacaggcacgcaccaccaagcccggctaatttttgtgtttttagcagagacatggtttcaccatattggccaggatggtctcgaacttctgacctcgtgattcacccgccccccatcgcccctcaaagtgttgggattacaggcatgagccaccacgcccagcccctagagggaattttaaaacaataataaaaccgacccaaagtctgtctgccttttgttattactaagcactggtagagttgtgaacaatgtcattgatactcctccctgccaggattgattactcctaccacatccacactctggcccctccccgcatgccactccctgtcacctagggatttgaagatcctcaagtttgctctgtcttctgcagggctgggcaccagtagacatgccaaagaatacctaatcgacaattagccactctaataaactaagcttgctaatacgataatgaggggaaataaggcttcttgtcttccccacccctagcacactcattaagaaacctccctacattctcaaataatgtctgcctcttaagaggtcccttgaagatgacaccccttcttttgttggctaatccaaagctggtatttccagctacttaggacaggattgcaaaagcagggtgtacaagtgggagggctgggggagactgcttgcttcaccaatgcacattcccctattgggaagcactaatggttagtacatattctccaagcacttgatgggctggtcttttctatccatatttatgaggttaatgtctaaaattctgtttcaggcatacatgaatcattcctttccatactgtttgtaggagatttgccaatgctattctcttattcattttggtgaggtcaggtcatttgcctacttttgaatttgcaattaggataggttctattgagcttgaccaaagattcaagaataagtataggcaaatatttgtggtgctggaacatagaagggcccactgccatatttaaggaaatggaaagagagagtctgtggctaagcccacaggaatacaacctttgcatggcaagcaccattgagaaaatgtggcagctggatatgaggtatctgaggctatgcttttaaaattgaggtataggcctggtgcagtggctcacgccttgggaggctgaggtgggcagatcacttgaggtcaggcatttgagaccagcctggctaacatggtgaaatcccgtctctaccaaaaatacaaaaattagctgggcgtggtggtgagcgcctgtaatcccagctacttgggaggctgaggcaggagaatcgcttgaacgcaggaggcagagtttgcagtgagccgagattgtgccactgcactccagcctgcacgatagagcaagactctctctctcaaaataaaaaaaaataaataaataaaattgaggtataatttacatataataaagtgcacagatttaatgtgtacagcaaaccatatttttccacacccatttaacctccttgagatccagcacctcatgcctcttcagtcaatatccctgcaaaggtaaccagtattctcatgaggtccccttttcatgtcaatgatttcttattggtgcattttacccaagagtaggataataaaaacataaaaacaaacaagaaaaaaacaaaaagagtggaataatatcattattttgtggctcctaggctaactcactattgacattggcagcacctgggactgtcctgggattgttaggacttgcacctaaatctcccagcaatcatggtatttgtcagaaggtgcctactttttggctcttgttgttagcccaggacggttcaacaagactatacccaggtggaactactgggaaaaaaaatgcctttggtgaaacataagggaagagaaggcaaagatgtgcctagccacactccctgatcacactgatgacccagctgaagtgatggtgtttctgtttatttattttggctttatttttagcctgttgtgaatttacttagctaatgaaccttaaaagcagcacataatcaagattgtaaggttaacatctgagttaggaaaccaagctcggctgggcatagtggcttacgcctgtaatctcagcacattgggaggccgaggcaggtggatcacctgaggtcaggagttcaagaccagcctggccaacatgatgaaaccctgtctctaccaaagatacaaaaattagccgggcatgatggtgcacgcctgtagtcccagctactcgggaggctgagggaggagaattgcttgaacctaggaggcggcggttgcagtgagccaacatcacgtcactctactccagcctgggcaacagagtgagactccatatcaagaaaaaaaaaaaagaaaaaaagaaagctcacaagctcacaagctggatatccttatcttcggtcattactcacccttaaatatagtggacattcaataaatatttgttgggccaggtgtggtggctcatgctttaatcccagcagtttgggaggcagaggcgggtggatcacctgaggtcaggagtttgagacgagcctggccaacatggtgaaaccctgtcgctactaaaaatacaaaaattagctgggcatggtggcaggcgcctgtcatcccaactactcgggaggctgaggtaggagaatcgcttgaactcgggaggcggaggttgcagtgagccgagatcgtgccattgcactccagcctgggtgacaagagcgaaactccatctcaaaataaataaataaataaataaataaataaataaataaataaataaatatttgttggactaaactatgactggttttgaaattagtatatgaagtgtaaagaagttaccaacttgagcatgccagtttctcccttatttctccttcagctagtctgccttgcattcccccatttccagactaaaacctagccatttatcgatgtggagcccaagctggtgatggttgtttattcccacagataaatcagttaacacaactactgatccctttctgtgtgcaaggcgctgtatgaggcattgtggagagaactaaagaagtacaagtatacatgtcctgcagagctcttatcccagtctctgcaaatatttctgtggctggagatagtatattggttcaggacatggagtctggggcctgaattcaaagcctgaccctgccatttaccaaccgagggcctttgggcaagttacttaacctctctgtacctcagctttcttatctgtaaaatggggatgacaagataactgcctcatatggttaatacaaagttaatatatgtaaagaacttaaagaagagcctgtatcacaataagcagtattaaagagtttgctcattttgtagccccagggctaaagcagaccccttatcttaaaatatgccaagaactgaactgtgtattgcaggatatcacctatttgtaatattcaacatagctttactatagaatattttgcaaccaactacatgtgaaatttctggacttggaaaccaagcagcgcaaaactatgcaatgagcttgggctttggagtcatacagacacagggatgtgataagaatccaggctccaccattcactgtgtgcccatgagcaagttgcataacatctttgagcttcagtttcctcatctgtaaataggggaataatacatacttcttaaggctactgcaaagatcaaataagtaatacatttgaagcacttgggacagagcctgctacatagtaagtgctcattaagtgttagttatcattgttgttgtttttaggccaaggttgttgtgaaaattaaatgagataatatataaaaggtatttagctcaatatctggcacatagcaataattgaatagatgatccttcatcttcgttcctcctgttccctttcagtttgaaagacttggctaatataattttgaccaaccaaacttgcattcaagggagtgtacaaggctggtatagccagccagtgagtatcagaatctaaatgtttattaagacaaagggctgtcatgcaataacccaaccataccattatcagtctgccatccttcctgtttctctaggcagcctttcctgatgtcaactcaaccagttaatctctcagtcacttgacatgtggctatatatacacacaaatatgtgtgcatgcatcctgtgctgcaagcatttacagtcaagtttatctgaacacactgtatggttgatgtgaaatgctgaaactgttcaagtttaggtcctcacaaagcaaggaatatgaaatatttccttgggaaatatttatccacaacaaagagatgtacagtgctttcgtatacagtgatttacagttttccatgtgcttttacatgtattattacttcatttgatccttacaacaaccccagaggtagatgtggcatgaattaccattattctcctttgagaagaagaaactgagcatcaaagaagcttgttggccttcttgccagaaatcacccagtttgtaaatggtaaaagagggcttgaaaccaggttctctgactctgacttcaagcactctcatacatcatctatttaattttttggagctaggtattttatacttaggattctaaatattgcataaccattgaatgccacaccacccttgtattcagtgcaaaaaatgggacttttcttaataaatagagaaatggaggtgcctaaaattacaaaattgcactagagagatagtgatagaactgggaaactcttagtctaatattttatcttttattcatatgatggaatactaagctcaattgtattactaatattgaaacaaaatacaaactttcctttgtttctttgttatttgtctttctttcctccctcatccccttccttctttccttgcttccttccttcctgtctccctcctcccctccctctctctttcttttctccccttctatccatttttttcttcttttctctctacgtttctcctttctctttctttctcgtttctctcttccttctttccttttcctcccgtctatctcctcttccttcctttccttctttctttggaaacatttattttccaaataattctcaccgtttttgagctggtgaatccaccgcttccttagttcttcagttggggagaagacgtagagaggcccttcatcatatacaacctgggtcgatgaaaacacagacttcagcagttaggattcagaaaaaaggagaaagaccttgaaagtactaatcttaggggacaatttgtatatttattgtagaaaacaaagaaaggcagaatcttcagtcagcaatggtgttcaggttatgtgaactatctgaaggattcctgaactcttcatatctaggaatgtagcgtttaaaagctcttagaatttttcatactcttaggtcctcctgacttgtgcttcaattcatgcataaacttattttataaggtctccgtctgcccttgctggagataacatttttgtttatccaacaaagggtattttatcttattattaaattctgactttgtatagaagagaaatgaagtgataatctatataaattaagtcttgattagtacatatgggttattcacttggataatatggagtaaaattttaattcatggctaattacctccacctccactacctagtggcctcccctcaccaatattagccaaaataaatcaaatttggaactacaaacctacttcaaaaagggtaaggtatataataagcaatatcatcaagtcaaatagtatttttttaaccatgtacaaggcatcatgctaggtgttacgaagatgcatgaaatatataagatgtggttccaaccctcacagagtttatagacatcacataataaattctgaagtcaaatataaattaatttaaaattatctgctgttcagcattgttcactagtgcagccaaacaatgtcatcttgttgaaaggcattggtagtaaaaactgtgtctgaaatacccctctttcaaaggtttcgtaaatttgatatagtcagggacacgaacaagatccttttacatttttctttttgcttgttagtcttgctgtgctcataaatccatgacagaaagccccctcccctgagactttccacttccttttctggctttcactgttgcagaggctgctatattcacgacatgtggcctacagagttctcaggatgtaagcaagccaaactgaagaccaaatttgtagttcttgctctcctaaacagatgcatatgtggcacttcagctcttccagattacaacagaatttaggtttatgcataagtctaataagtcttcctcatactgaacttcctaatactactccccttttctatcttttcaacccacatgaccactattagacagatagtcagaaccagaaggaagtgaaatgctcactcaacaagcagagcatctttctcaatgcagttatcatagacaagacacactatgatagaattggtgctgctatgtattctttttgaggtatagagactaaaagaaactatgttagattaggtaaatagaaaagcaaacattcttagcccatgccagtctcatttcttggttcagcatccttgtccacctcaacttctattcactgggtcctcgtagccttccctctgccctgcaccccaccaccccttctaattgtgttacaggggcctttcgagatttggtgagagaaaataactcacctggaagggataagggaacctttcaatgattgaaatttgctccatttcactggactcttcacctcttctctgtaatgaaataagaaaaaatggttattggttgatgcattgctcttttctgaatttccttaggtactagaagccttttgctgtggcttcagaagtttctcctgcacagacaaggctgattcttagtgattactttctataggccaatagggacacatatccaatacgacccaacacatacccagtcaagagagactcaggtatttcaaatcactgggaaaatggaggtttctaaaaaattgttgttgggacaaatatttaaccactaacgttgtggggaggagaggagttaggtagctatgctacaccatacaccaaagaaaattccagatggattcaagagcttaatataaaaaataaaactatgaatgactgagagtaaatataagcaattatttatataatcctgtgggaggcaagctttttctaatataaggatgaaacttagaactattaagaaaaacctgaactaatttgatgacatagactttaaatccctatatggcaaaaagcatcataaacaaaattgaaagataaaggataaactgaaaaacattttcaacatactttacagttaaaggataaatgttcttatatcaagatctctttaaaagtattagaaatgaggtaaacatctcaatgtaaaaaatggaccaaaaattaatgggcaattcacaaataaaatataaatgagcagtagaccaactttatgagtaaaagaaattgcaaaataagttagcaataaaatgctattttttttttttgagacggagtcttgctctgtcgtccagcctggatgtgcagtggtgcgatctcggctcactgcaacctccgcctcctgggttcaagggagtctcctgcctcagcctcccgagtagctgggattacaggctcgcgccaccatgcccagctaatttttgtatttttagtagagacggggtttcaccatgttggtcaggctggtctcgaactcctgctcatgatccgcctgccttggcctcccaaagtgctgggattacaggcgtgagccaccacgccccacctgaaatgctatttttcttggctgtcaaattaactaatatttaaaatatctagtgttgggctgggcacagtggctcacgcctgtaatcccagcactttgggaggccgaggtgggaggatcacttgaggtcaggagtttgagatcagcctgaccaatctggtgaaaccccatctctactaaaaatacaaaaattagcagggtgtggtggtgggcgcctgtagtcccagctactcaggaggctggggcaggagaatcacttgaaccggaggcagaggttacagtgagcggagatcgcaccactgcactccagcctgggcgacacagcgagactccatctcagaaaataataataataataaaaataacaaaatatctagtgttggaaaaaatgtacagaaacaggcactctcatacatagcttgtaggtgtgtatgaaattcaattccacttctagaaaatgaaataaaaagataaaaataaccaaagtgcacagattttcttaaagagaagaacaaaattttacttctaggaaattatcataaggaaaagaataaaaaaagtacagaaagatgtatgcaagattgttcctctcaacatggtttatactatcaagtacttgtagacaaaccgaatgtgtaataatgggagattaaacaaattacaatacatccataatagggaataccatacagtcattaaaatcatgttattaaagaatatctattgtcatggggaaaagtttcccacatatcgttacattgaaaaagtacgttacaaagcaagatgtgtactatgagtctatgttttaaatatatgacatatatataagtgtatgcgtatgtgttctcagtgaagaaaaacatctgtaagtctatgtacaccaatatgttgatagttgttttaactgggtaacaggattatgcatcattttaatctttttgtattttttatatattccagagtttctgtaataaatacgcaattctcctgtgatcaagaaaatactgaaaatggtcagacccagtgggtggctcacgcctgtaatctttgcactttgggaggccgagacaggcggatcacttgaggccaggagttcaagaccagcctggccaacatggtgaaaccccgtctctactaaaaaaatacgaaaaattagccaggcatggtggtgcacacctgtaatcccagctacttgggaggctgaggcatgagaattgcttgaacccgggaggtgaaggttgcagtgagccaagatggcaccagtgcattccagcctgggcaacagagcgagactctgtctaaaaaaagaaaaaaaaaagaaaaaaagaaaatactgaaattgatatatattttttaaaagtgaactcaaaaatcagtaggttttatgtctctcgctccggaaagtgagaagagaataaatagtaaggtattaaaggatatcatgtgactcagagccctaggattatgacattcagacttacttaagcctctaaatctgatcctgagagaactgagggaataaaatcaatgatctctgaccagtttgaaaactagatatagcatcatttaaaagtttgtgttaacaaattttccatgtttagtgagatgttctgaatatgaaggaaagaagctaagattctttataaccaatatggtagagtgaagaatttttaaaggaaacttgaccgtgttccacgttgcacagcatcaccagtctatttacagagaatttaaatgttgcaaatttcttcaaatctgctgttccccatctcagacattggtctcttcttaccggaatctgtctttctggaggaggatttttttcaggaaccactgtttcaacacaagtgatcttctcaacatctattgaacccttcttactgcctcttctctgagaagtagaatgaggaagaaaatggagaaagattaagagggattaagcaaccagatgattagattttgttatctaatcattcaacaaagtgaggtggcaccaggacctgtcatgtgggggaagaaaaaaaaatccttccagatctataaatctatgactaccaaatggagggcaaataccatggaagagtgaatgactgtatgtaccttcctcataggaagtaaggaagcaatttccaactcttcgatttcattttcaacaatcatttaatgagtgctcatcaattccaagattccatggtaatattttccttgtggcttcttaggacctttgactttccggctttagctagttataggctaggaaatattttgctgaatttgaaagaacttaggtccattctactcccctcctcctaccaacgaaaatttacctcttccccaagaaagatctaaggccaagtccttgatatcttgaaactcagttttcatagtcgagaaacttaccccacgttcaaagtcatactcatagtaggagagtttgtgcacggtcaagagaaacaggcgcttcttgaagtttagaggtgatgttttctttttctgttgggatcgcttcagaaagatgctctccagaatcactgcggccatagcttcttctttctggagttcacctgtgtgctgttgataatgaaagttcctgaggacccaggacattaatcctcatccctcttggttccccctcagcctagctacctagtttcaaatggaacaaaaatgtgcacagctcacaaaataatttcttcctaccaacctcctcccacagcccccagctctgtcaggtttcaggtataatggatgcacactgaattggggggggattggttcgatgttgtgagctcatataaactgagttcttgtataaggcaatggaatgctctagatgttaaatggcacgcacctgtgtgcttggtaaggtgtagaggtagctttacactattcacctttatatgatatgtgtagaatctgtgaaaagcaaaagtatctgtgcagctgttgatcttgatatacccagaagggataatgcaggtgccagaactccactgaggcagatattggactttcagttcccaatttcctagacggtgaatataatttttcaaacattgtcccactggggtctgtaaccaagggaactaataaggatatggaggctgcacctgcagttctggacacacactaactgctgcccaactgattttgcccacacccactgactgagctacaaaggatagaagatttgttctaaagttgaaaacataattttttttggtgggttttggtggggggggggtagttgttgttttctgaccttttccccatttagcttaaattagttcttttagacagcatcatgcaaaagtgatgcaactgtcttactgatatagatgccacctctgttcatttatgaaacacaacttatttagcctccccaaacctacaatactccagaaggattcaatttaggtaactgaaacacagaaagacaaataaagttcccaaagtcaccactggcttttttattcacaccaagcaacacttcatatcagttattcacttacagtttatgcacagtgtaatattattactaattccgaactttcattggaaagataaagtgaaaacaaatgctgtcataaaaatagaacactaggccggcgcggtggctcacatctgtaatcccagcactttgggaggccgaggctggcggatcacctgaggtcaacagttcaagaccaacctggccaacatggcaaaaccccgtctctactaaaaatacaaaaatagccgggcgtagtggtggatgcctgtaatcccagctactcgggaggctgaggcaggagaatcgcttgaacccaggaggcggaggttgcagtgagccgagattgtgccattatactccagtcggggcaacaagagcgaaactccgtctcaaaaaacaaaatcaaaaacaacaacaaaaaaacactaagtaagtaacgaaaaaaccaccagccctccattcaagtttaattagtggtagggatttttcctctggtgggggggtgggggtgggaatgtgtctattttttaagtaaactccttatgcttttggtggcaccgtggaagcagaatgaataaagccagcagtttttttctactttttaagcagattattgctcacactaggaaagcaagggagtgaattttatcaaagcctgggggctatccacactgttattttgctctttcctgtggtgtaggaggttctattctcatgctggggagacgaaaatacgtcaaaggaacaccaggggtgttctggaagatcgctttgccacttatctaccatgtgtatgccactatcttctggaggtggattaattcaatattttgtaaattagattttgagaaaaattgggcaagagtgcaaacctttccctccaccctgccacacaccctgactccctggtttaaatggtctctcactggagtgacaaattgatgagtttacaatcagcccttcccaacactcagttttagctctaaactcaaagaggttcattttaacattacaattatgcatttactcaggagtagtggtaaccaaataatactactctattctcaggaactaccaactcattgagagccctgtaatcataccacaattattcttgtggcaaattataattaagtacctcttcacaatcaaagactcaaattacaggataaaaaataaaaccctaaataaattgagtactgtgaccagtaaatggggtcagaagcatcccaacaaaccatgtctggtgtacttctcttagccgaataaatcgcaggcaacattttatctttagttttgttgcaggctcttggtggatacattccctgcttagacccaccatctgtttcattcttgtcccctgctcttacttcctataagacaggtccttctggaagctgcctctactctttctctgttttagaacaaatccagtttgtacaagaggaagtcttcctctctctcaagtatctgtgtttgggcagggtttagtgctgctctgactatgaggaagtaagcaagtctctcactagccatcgcccctctgagcaaaaggtgaaatggcctccacctctagatcattgagctagaggtctaccagaattgccatgatttggtaccaccttctttgactgcttttctcctgtttcttatgatccagtccagactcacacagcctgaaaatgtggtagctcttccttaggtgccactggtccatcactcaataatgtgaaaggaaagggatccatttttgagtcctccagaaggttggtgtgtaacacacagctctgagttaaaaagtagttagagggtaaagcttctgtgggtacttattgtgaaaggccccattttttttttttttttttgagacggaatcttgctttgttgcccaggctggagtgcagtggcacgatcttggctcactgcaacctccatctcctgggttcaagcaattctcctgcctcggcctcccaagtagccgggattacaggcgtgtgccaccacacctggctaatttttgtatttttagtagaggtggggtttccccatgttggccaggctggtcttgaactcctgacctcaggtgacctgcctaccttggcctcccaaagtgctggaattacaggtatgagccaccgtgcctggccagtaaaggccccaatttttttaaaacaatttcagtagcctacagagtcggtttgaccacaaaatatgcacaatgatggctaaccctgagctccactcagggtgaagggtggaaatggaagtgacttgaatgtctcaaacatacagacacacacacacacacacacacacacacacacacaccactgttgtttatagaaagaaagaaatgggggaggagaaaaaatagacacagagctcttcatttaaaatatggagttccagtgttacaatgtcccctttattaaattataaatgcaaagatttttacagggccaccttttgcagcctcccagctccctatggagcaacagaattcagaaagacgaagcttattaacaagagtgcagccatcatacaaactgcagtatgccaaggaattaatagaaatagcacttgcagaatcagtaaactaaaccatcttgggctcttatcttcgctcataagataaaatactattaagaataataagtccaggcgcagtggctcatgcccgtaatcccagcactttgggaggctgaggctggcggatcacttgaggtcaggagttagagaccagcctggccaacatggtgaaatcccgtctctattaaaatacaaaaaattagccgggcgtggtgacaggcgcctgtagtcccagcaactcaggaggctgaggcaggagaatcgcttgaactcgggaggcggaggttgcagtgagccaagatcgtgacactgcactccagcctggagtctcaaaaaaaaaataaaaaataaaaataaaaaaaaaaaagaagaagaataccagagcaaaattcagaaaactacacagccagcctatgattgggaagagtctatgagatatgatttaaaataaaataaccagtcaactgtacttcaaatgactacttagccaaaatatccaagaagtagtgttttctcttgatttctccttgaaagcactactcaattggctaggaagattctggccattccctgtctttccttagggggatggaatggaacttctgttcctttcagtgacttctacctgacaggcattttacaggcattatttcatttattcctcacaacaaacagatgaggaaactgacacagaggttatgtgacttgtccaacctcatccatctgtagctcttggtatatcatctatagcccttgctttttttgtggtgtttcactgcctaccggagggatttttgttcgtttatttgttttttggtctttgatgaggttgatgccatctgccttggggcccctgtcattctccatggctatcatcaaagagcagttgtgacaaactcctctccattttctaggaatgttcagcaagagaggaaatggtggtaaatacaggagataagagagtattcaagatcctaagctctttcctctgcaatattcctccaggctggtaaggatgatctgtctctggtaactgtcaactatactttttttgcacttgaggactcttcttagtcttgccaggttttcttacattttccctctttaaatcattcccaaggagattctgtctaactagtgaatttctagagtcacttgttgtttcctttcctggatgtttcattgttgatggaatgaaagcacagtgtttaggtggaacatccacccttctctgtccctagggttcttattgcttactgtgaatataaaactttgatcaaatataccttctatttttttgagacagggtctcactctgtcacccaggatggagtgcagtagcaagatcaccactcactgcagcctccacctcctgggctcaagcgatcctcctgcctcagcctctcaagtagctgggactacaggtgtgcactaccacacccagctaatttttaatttttttgtagagacacgggtctcactttgttgcctaggctagtctcaaactcctggatgcaagtgatcttcttgtctcagccttccaaagtgtggggattacaggcatgagctgctgcacctggcctcaaatatactttgttttatattatgaaatatttcaaatagaaagtacagggactataacattacaatcttggactcaccgcttagctctacaaaatcctaaaattgtgccatattgcctcacgtgttaagaagtgagatacaatctatataatcaagacccctttatgtactccaaaatcttagtcttctccctccatagagattaccaatatcttgagtttggtgtttatcattcctaggtatgttttcatattattattacagatgtaagtatctataaaagatatatagtattggtttacatgtttaaaatttacatatggccaggtgcggtaactcaggcctgtaatcccagcactttgggaggctgaggcgggtggatgacaaggtcaggagtttgagagcagccagcctgaccaacatggagaaaccctgtctctactaaaaatacaaaaactagctgggccaacgctactctcccagctactcaggaggctgaggcgggagaatcccttgaacccgggaggcagaggttgcagtgagccgagatcttgccattgcactccagcctgggcaacaagagtgaaactcggtcgcgaaaaaaaaaaaaaaaaaaaaagaaaatttatatatatatatatggtacacattctccagcaacttgcttttttcccctcaatataatatgttaggatttatttatctggctagttctacttcatatgttttaattcatttttatatgcataaaatattctatatgatgaatacattccaatatatttattcattctcctgttgatggacatttaggttgtttgctttcagtgataaacaatgctgctgtgaacattattttgattttttgatctcagaatgaattctcagttacttagacaaactggcaaacctaggtccagcttatcttttggactatgcaatttgcatcattccttcttgccttttcagtcctgtcttcctgatgcttcactatgaaatgtggtagaattatcaactatctctagtgggaggttaaatttggcctacggaaaatctcttcccagtcccaagaagcatccttcacgttctaactgagatttcaattgagaattccttggccttgggaccagaagagaacgtgttaagaactgaaatactatctatataatcaagacccctttatgtactccaaaatcttagtcttctccctccttagagattaccaatatcttgaatttggtgtttatcattcctaggtacgttttcatattatcattacagatgtaaatatctataaaagatatacagtattggtttacatgtttaaaatttacatatggccacgtgtggtagctcatgcctgtaatcccagcactttgggaggctgaggcggctggatggcaaggtcaggagtttgagagcagccagcctgaccaacatggagaaaccctgtctctactaaaaatacaaaaattagcctggcgtggtggcgcgcacctgtaatcccagttactcaggaggctgaggcaggagaattgcttgaacccaggaggcggaggttgcagtgagccgagatcgtgccactgcactccagcctgggtgacagagtcagactccgtctcaaaaaaaaaaaaaaagaaaaaagaaaaaaaaatcatacccacagcaacaaagcaacctttaatcttgttaaattcccaagatgcttttgttcgggccccagtgaaacccaattattttatgataagcttcatagtcaaggctacaggggaccaaatttgtgatgaaggcatcaagccaaactcaattttcgaaagctgcatgctgaccagggaaactctcctgctgtagtcatttacaggaggccttagggctctctggttcttccacagcagttcatgttttatttatttatttatttatttatttatttttgagacagagtctcgctctgtcatccaggcttcggtacagtagcgcaatcttggctcactgcaatcgctacctcccagtttcaagcaattctcttgcctcagcctcctgagtagcttggactacagccgcacaccatgacacctgcctcggcctcccaaaatgctgggattacaggcttgagccaccgcgcctggccttatgtttttagcattttacatttttcttctgtggttttggaaacttctaggtctctgtgattcatcatctctttttgtcttgcattagcgacaatatattctggccaactgatgatggaaggagagccagagagccaatctgcaagtttatagtcagtgccagatcagatcagtggtaatactttcaatattctccctctgctctgagggtgactgctggggtgtctgtctttcactctggacttgtgtgcccttttggccttctttttcaacctagtttttgttttccttggcttaaacattttatttattttttccatcgatatcaaaataacacacgcagctgggtgcagtggggtgcacctgtagtcccagctactcaggaggctgatattggaggattgcttgagcccaagagttcaaggtcagcctgagaaacatagggagacccccatctcaaaataaaacaaaatatagtaaaataaaacatgcttattgtagaaaatatgtcaagtacagggatataaaaaagaaaaaatcattcataaactcatccagaggcattaatatatcggcatattccttccatttttttctgtgtgtgtttcttataatatttgagatcatattgcacattcagttaatttacctatttttcgtaacatctatgtatgtatgtatgcatgtatgtatgtatctatccatccatccatccgttcaaggtacctttttccaaaaaaagatctaatgttcttatttaacattattcctaattattttcccatgttattaggatctctatacaagcatcatttccagagtcaaaaaagtatgtgcattttgcattttgatacatactgccaaaatagtttccagaaacattgtcccaatttcagttccaaatagttttagagagccccctttctcattatccttatctcttttctggtccatttctaatcatttttaaaactctggttttactgcagacaaatcttttttttttttcattgagtcaatgatcttaaactccagtatattccaacttccagcttgtctaaaacttaacttctcttgactctagaatttccttcttctagggtgagctaacagactacagtttgttttcagttcagggaggtagggcagtgagaggagcttctccttgagattcaaataaccaatataatcctaaagacatcttgtgagaactttctaagagcggagagaagagcctggtattaaagcttctgggtttccaatgctctcagattgccctcagccactgcacatgaatctccatagaaactgaaagtcacacgtggcccaattgtttcagggtcctcagaggagttctccctcctccttcccctccccagatggcttcatgcataaccaagtagctttggagtcaaatatgtcaaggcctcttttctagcttcttgctgagcactgtgtcactgaaaattctagttcttccttattttcagtagttagcaatcagatctcagcaatcagatcattgtgggtgtagaagggggtatctgataactctttggagaacgcccaaactttggttttcgaaagctgtatcttccctttatacctaagtcacttcctgatatgggtctagtccactgaaaggaaactctataggaaatttgctcaaatggaaatagcaaatcatagtgataatttaaaattgcaccaatcccccataactggatggaaagttacattagttcgcaccataaggagtttacaaagaattccagggtgggtgcggtggctcacgcctgtaatcctagcactttgggaggcccaagcaggcagatcacctgaggttgggagttcgagaccagcctgaccaacatggagaaaccccgtctctactagaaatacaaaattagctgggcgtggtggcacatgcctgtaatcccagctacttgggaggctgaggcaggagaattgtttgaacccgggaggcggaggttgcggtgagctgagatcccgagatcgtgccattgcactccagcctgggcagcaagagtgaaactccgtgtcaaaaaaaaaaaaaaaaaattccaaacaaaaatatcaatagccatacgcaatggaaatttggacttcaacacaagcaagcagtttaaatagtttgaatataaaaggagtcagaatagacaggacaagccctaagggacactgtttgggtataatgctttaggttgccatgagtatttgcattttgtggcttatttggaaagtgacattattttatcaaataactgaggctccagagaggctggagtctgggcaacttatccaaggatgtcttgattggggtcaccaatcacttttattctaaatgtcatattatttgctctaggtaggccctctgggggacattggcaggtctgaggcagagtaaaaattatagcaaatactgagatccagcacttactattgccaggccctgttttaaaagctttacatgtatttgcacatttactgctcacaaccaccttatggggaaggtgctaggcaggcagggaggaggaaatggaaagggaaaggaaaagggaaaagagcgggggaagaaaggagcaagaaaaagtcaatgcaattcggcaattatttgttaagtgctaactgtatgtcagggtctggtaatcaacagaacagaggagggtataatgaagaggggatataggtagagaaaagaggatgagtgggaagaggaggaggttggagaggaggaaaggaaaggagaaataatgaagacaagagaaaagcaagccatgcacatggagggcaatggtaagaggagaaacctttgccacaacctcaagggttggccgcactgtctgggctgaggcagaggctgctttctcctggcccagtcttttacccattgttaccacgaggttggcacagcttccacacagtcctttaataagccagctctgaccctggcgacatttggcctggtacagctcaaggcaggtagcctacaccctggcctagccaggcctttccctagctcacaaaggtcaacttcataacgtggagcgtgagcttttaccatgttctcagagaatctgcctcttagtatttctttttctaaaggcttcattgacccatgtatccctattgagtcttcaagcactatttgacagaagggcttgtttttatctgactgctccctgcaatattacttttccactaagtttgccagaggtacccctttctaacatttgctacctgttcggatggtcacctcatgtcacatttttctcttcctgttccgcccaccctcagcccttgtcggaaaggaccctttcggcctctctaatcaccagaagggactgccagggccttgtgctgatgacactcccaccctccgtcagcctcctccactagctgataaatggcaccagccatgctgtctctctggtttttaggggtcccaagcaaggtacattgctgctgctgcccagcccctgccataccccagacccacctcagtcctgacttaatgcaggtagcttcccagatgcattgagatgccaggacttggaaggtgggactcgatcgcagcagacactggccctggagacatattcttacagtccagagaggaaggacagtctgagcaaaccccaccctttcacagccactcagtt

SEQ ID NO: 1556 - DNA, 84532 bp, Homo sapiens
  source 1..84532: mol_type = genomic DNA
tcagaatagaaataaagtactttatagtccataagtagaatcaggcgttaatctagttacatttggttcttgataaacattttcatagtaagtatcatctggtattcccatttgcatctttgatatgtctcctccatagttatatatgtttttctgtgcttgattaaacctgaatcctaaagagaagtgacaaatgattagaaagataccagatataataagatgctcactcaaaatgctactgtgttgtggtctgttccacattccttttcaccattcttaaagcaaatatcttcacctgaaaccagaaacaccccaaatttctgagttcatcccactttcactcccacatatcactgtccatccctacaaaaggctctgcaggacctgggttttaggtctgatctactaataactagctgtgtaatttgggacaaattatttaacctaagtcttagtgctctcatctgtaaaatggggataataaccgcacctacctcatcatattcctgcaagagttaaatgtgacagtgcatgtaaagaacttagagcatctggtatttagttggtgctctgtaactattagctaacttcttcattcacaaagggagaaatgcccttttcctctcaagagctcatgtttctcaatctgctctggatttaccttctcttgcttcttgaagaagtgacacacattatcctcttctccaatgccaacatcttcaatgtatcaccttcactggcttcagttatgcaaatctccactacttaaaataattttcacttgcttttatgctccttccaactaccatcctatatctttcttcttttcacagtaatctcttttaactcagtaacttatattgtttccttttttttttttttttttgagacagggtcttactctgttgcccaggctagagtgcagtggcgcaatcgcacagcctccacctcctgggctcaaacaactctcccgcctcagcttcccaagtagcaaggactacaggtgtatgccaccatgccctgctgacattttattttttgtagagtgagagtctctttatgttgcccaggatagtcttgaactctttgcctcaagtgatcctccaaacttagcctcccaaagtgctgggattacaggcatgagccattgtgctgggtctctgtgctgatttaaatttgtaaaagatgactatctattgagcagagaagggaatggagaagcattggtttggaggctattgcagaagcctgtagaggggtgaaggcaacttgggctgagtgggtggcagtgagctggaaataggtggattggttaatgctaaggatggctcatattaatggagtatgcattatgagataggcactattctaagctctgtgcatgattatctcattatctcacaacctatgtgctaggtactaccgttattcttcttttactagtgaagaaaccgagctagtaacttgcccaagatcatatagccagtaaagagtggagccaaaaatcaaacccaggcactctgaatcaagagtccacaatcctttgggaagccaagatgggcagatcacgagtccagcctgggcaacatggcgaaatcccatcttgacaaaaatacaaaaattagctgggcatggtggtgtgtgcctatggtcccagctacccaggaggctgaagtgggagaattgcttgagcctgggaggcagaggctgcagggaactgaggtccaggccactgcactccagcctgggcaacagagtgagaccctgtctcaaaacaaaaacaaaaacaaacaaacaaacaaacaactccacaatcctaacctctttgctttactgcttctcctatctgctagtaggacagaactcatacaccatcattaggctttggctatgttaaaattattggcgtttctggggtctgatgacactcttcttcaacatgctggcttttacttttagcatttcagtactgctaactactggcagaacaatagtggcctagaacctaaaaactattttcaacattttgaggcatttattttgccaagtgaagtctgctcatgaaaaattgttactaaaactataagtaactttttttcttcactctgtcacccaggctggagtttagtggtgcaatcttggctcactgcaacctccgcctccctgttcaaacgattctcttgccacagcctccgagtatctgagattacagacatctgccaccatgcacagctaatttttgtatttttagtagagtcagggtttcaccatgttggccaggctggtctcgaactcctgacctcaggtgatccatctgcctcagcctcccaaagtgctgggattacaggtgtgtgccactgtgcctgaccagtaacttttaaaaaaggattcatattttggctaggcgtggtggctctcgcctgtaatcccagcactttgggaggccgaggtagttggatcacaaggtcagcagatcaagaccatcccggctaacacagtgaaaccctgtctctactaaaaatacaaaaaattagcggggtgtggtggcgggtgcctgtagttccagctacttgggaggctcaggcaggagaatggtgtgaacctgggaggcggagcttgcagtgagccaacatcgcaccactgcactccagcctgggcgacagagcaagactccgtctcaaaaaaaaaaaaagattcatatttttaaaatcactttattcaaacttaaataatataggacatttccttctattcccaaataacaatcttacatacaaaggtaaaaatgacttgacaaatgcatctaaatttatatactatgcagattactgaaatgttaaatgcctagaaatacgtgtgtggaatgtattttttgttcatgagaatttcctataaagtactgctaaaaatcacctacctttgaagttagccgaagagttgcttgtagcaatttccttccagctggcaatgtacctaagcacattatatgaggattcattaaatttaatcgattcattagtacatacttagactacttctaaaattccacttttcagaaatcttagattaatgatggcatgttcactagcctccatgtgtaactctcaagactttctcaccttctagtagctcacatccagctaagaaccttcaggacaaggagttgaaggaggtataaaaatggtgcccaccatctgccatacttagtgtcctttcacctccctctagcatgccccctcattttatcctgttaattccagaaagatcatgtcctcagctgagtgtttactaagaagttagttaataacatccaaatttaaagcatgggcagaaaactctcctggagacaacaacaaaaactttctcctttgttctggattaccagattcactgtctctgatacgtgaagggaaatttaaagcatctagtttctgagctcattagagcagcagcgctgtctttgcagtgtccagaacacgttaagagatacatttaggtatggcaaatgcagctgtcacctcagctcctgaacagagactgaaatagagagacgagggttgcctgagaagaggtagaatagggaaggacaaggtacaaccttctgtgaggatgatggaaaagcaccaagaggcaggtttcctaagatttatttcaccttaggctccatatcccactttcctaaggtgcctttacaactgcacccactttaatcaaaaaatcaggtcaggatttggttacagtaggtgctaaaagggagctagcacagagaggtggagaattagaactgtcacgtaattggctgggcgcagtggctcacacctgtaataccagcactctggaaggccgaggtgggcggatcacaaggtcaggagatcgagacgaccctggctaacacggtgaaaccccatctctactaaaaatacaaaaaattagccaggtgtggtgatgcatgcctgtagtttcagctactcgggaggctgaggcaggagaacggcctaaaacctgggaggtggagcttgcagtgaactgagatggtgccactgaactccagcttgggtgacagagcgagatctcaaaaaagaaaaaaaaaaagaattatcatgtaattcagaaaacactgtgattttcttttcttttctttctttctttttttttttttttttttttttgagacaaaatctcgctcttgtgccctaggctggagtgtgatggcacgatctcggctcactgcaaccttggcctcctgggttcaagagattctcctgcctcagcctcccaagtagctgggattacaggtgcctgccaccacgcccggctaatttttgtacttttagtacagacagggtttcaccatgttggccaggctggtctcgaactcctgacctcaggtgatccacccacctcggcctcccaaagtgacactgtgattttctaattatttgttccatttgaattatttttacttctgtcaaccctgtgctcctgaagttttttgcagtaggagggtatatacttccaacagtatttaatacttatttttatggagacaaggtctcgctctgtctcccaggctgcagtgcactggtgccatcatgggtcactgcagcctcaaactaatgggctcaagtgatcctcctgcctcagcctcctgaatagatgggaccacagatgcatgtcaccacacctggctaactttttaattttttgtagagatggggtctcggtattttgcccaggctggtcttgaactcttgggctcaagtgatccacctaccttggcctcccaaagtgctgggattataggcgtgagccactgcacttggcctatccaacagtatttaattacaatcagacgttgtgtctgaatttggctccttcttactactgctaccccttggtgctctgcgaactttcttcaatggccttcaataggatactgctgggtgacttaaatgaaaggatgcaggacaagagcaggtggtgtaactccttccacaatctctcagtaggcaattcagtttggtttgaccttaaattttagcagactttgtgctttcagtggttgctcaggagcactataaagagtcatcctgcttgcttggatttatacacagaaaagactttcattccaccttcaagaaaccaagataaaagaccttgatcgatagtgtgctgagccctgacaatctggggcacaaacacttaccatagctaggccccatcactgtccctgctttatccaagattagcacatgacttttattccattattttaaaaagaacttctcataaagaacataccagcagtaattgataagaaatctaagttttacagacatagaagcaagtctgatgaaagcactaccatgctgtttatatcacagagctcatctttctcacgaagaaatttgtagaaatttttagataatagttatcaagtgtgtgtgcagtctacaatgaatccatttgttaaattacaaatttaacactttaagagctcagaaaaagtccctagccagagaggtcacaaaactacatatcttagaaatcaaaggagcagcttcagatatagaaactatccataacagacataggcacagagctctccccaacagagtatcaggaaattatttaatattttctagctggtgattgcttaataggtatgtcaaaattcacttgctgtttgaaaaacgtgatgatcctggaagaggaacatctgaatatccattaggatgaatgccagcaaaagccacggtagctgtcctgtggcattgtgcataactccgtgatggtgatgtggggattgttctgggttctaaacagctgcagcaacatagctctggatacaggaatttgcaacagtactcattagtgtgtttgagtccactagtgaaactggctctatccattcttccaaatgataataacaatgttcggttaatagttgcagtacgcatctgaagatggacatggtttcatctcaggagagcatcggtctgtcataacggactagaacaaaagcctttggggagaaactggttgttatcactaaatatcagtgttcaaggcatttatgccattctaactgtccaactgtagaaaaatgtccatagacgttgaaggatactttccaaggaattaggggtgaccaattctctagaggggacaaatgtcagacttttaaattttcatcaaacaaggtgtcaccaagccagttacaaatatctagaggtctacaaaggtcaaacggggaagtagactgtggagaccataaatgtgctggaaagaaggggcttatgcctaatgtctgcagttagctaggggaaggcctttgcaaagtttggtcttactgagataatcagtgcttgtggccaagtagtgctactgaaatatacccagataatcacacttgaaatttcatctgaaatttttgttgttcaaggctcaatgtaaaaccttgctaagagtccatgttggtacaaaattatgagtatcctcaactcagaagataaactgatagaaattatacataacttggaagcaaggtatttgcatttttttaatggaaattttcagttgctcttatcatctgaaagctaggtatatccatcccactcctatatgctatgaagaaattgcttcaagtcttactggtttatcctgggtttttttgttttgctctgttttgttttgagacagagtctcgctctgtcacccaggcttgagtgcagtggcgcgatctcagctcactgcaagctctgcctcccaatggcatgaatcgtgggttcatgccattctcctgcctcggcctcccaagtagctaggactacaggcacccaccaccacgcccggctaattttttatatttttagtagagatggggtttcactgtgttaagcaagatggtctcgatctcctgacctcaagatccgccctcctcagcctcccaaagcgctgggattacaggcatgagccacctcgcctggctggttttttttttatttattttattttttatttatttatatttatttttgagacggagtctcgctctgttgcccaggctggagtgcagtggcgcgatgtcagctcactgcaacctccacctcctgggttcacgccattctcctgtctcagcctccctagtagctgggactacaggtgcctgccaatttttggtgggttaatttttgtatttttagtggagacggggtttcaccgtgttagccaggatagtctcgatctcccgacctcatgatccacctgcctcagcctcccaaagtgctgggattacaggcgtaagccaccacacccagcctgttttttgttttttaaagggaagccattaagacttcacctactatcacttagcggatgatggcggggaaagtcttatgtggaccgagatgcctattttttcttccctttgaactcaatggttttattctttttatattccagtaatgacagaatatagaatatctggtatcaattttttgtacttgtttgccggcccttagcttgaatcggccaatggtacaagggaaaggcagagcaggatttcaaaagctcacctgagaaaattctctatccagtcctgggaaactcattcaaaatggacctctcctacctctctttccctttcttccctctcttttccactcagcaatttttactcttaggaagaaaagtaaaagcaaggcattgcagctcctttgtttggctgtcatttcttgcatcattattaccatctgcatttgttcagtgtcccaggaactacagacatgctgtctatagggaatctcaagactgaggtctgcacaaaatattggggttattgaatcatagcaatttcttcttatttaaaaatattttaaagcatctactatggacacttagtcctttattttttatcttttccttattattttctgatctatccttctcatcagtatcttcttttttcttttattcttgttttgattttcctttgtcttgatcattcttccccctttttcttcatttatctttccttgcatcattattctctcccctgcttcctctggcttctttttttcatgttctattgttcaatgaccattaacttgatttttcctaccccattttcttatctcacttttactgatttcttctgttttcttacatttctttacttacactatcttcatttaaatttttctgcctcttcatgcagtatccacattctttattgtagttgagtaaatattgaacattttaagcagctttattgaggtatataattcatatgccatacaattcccccatttaaagtatagtatccagtggcttttagtataatattagcagagttgtggctccaccaccataatgaattttcttttcttttttttgagacggagtttcactcgttgcccaggctggagtgcaatggcacgatctcagctcactgcaacctccacttcccagattcaagtgattctcctgcctcagcctcctgatagctgggattacaggtgcccgccaccaggcctgactaatttttgtatttttagtagagacagggtttcaccatgttgatcaggctggtcttgaactcgggacctcaaacagtccacccgccttgacctcccaaagagctgggattacaggcgtgagccaccacgcctggcccacaatgaattttcaattattttcattgcctcagaaagagaccctgcaccccatagccaccaccaccccctccccccagttaattctccacccccaggaaaccactaatctattttctgtctctataggtttgcctattctgggtatttcctataaataaaataacacatgatcctttgtgattggcttctttcacttagcagattcatcaatgttatggcatagatcagaacttaatttctttctttttttttaaatagaggcgctgtctcactatgtttcccaggctggtctcaaattcctaggctcaagcaatcctcccatctctgcctccaaaaatgctgggattacaggcgtgagccactacacttggctttttgtgtgtgtgtgtgtgtgtctcgctctgtcacccagactggagtacagtggtgtgatcatggctcactacagcatctacgtcctggctcaagagaacctcttacctcagcctcctgagtagctgggactacagttatgcaccagcaggcctgggataattattgattttttgtagagatggggtctcgctatgttgcccagactagtctcaaaatcctgggctcaagtaatctgcttggtctcccaaagtgctgggattacaggcatgagccaccatgcccagcccactaatttttattgtggaataatattctattggatagatctatcatatttcatttagccattcgtcagctcatggacatttggggtgtcttctgcttttttgctattatgataatgctgctatgaacatttatgcacaggtttttgtgtagacatgtatttccccttctcttgggtatatatctaggagtggagctgctggatcacatgtcagctctatgtttaaccacttgaggaactgccagattgttttccaaagtggctgcaccattgcacattcccactagcagtgtatgagttccaatttctccacattcttgcaaacacttgttattatctgtctttttaattatagctatcctagtaggtgtgaagtggtatctcattatggttttgattgcatttccttaatggggctacattaaatattctaaaatttcccccacacaagaaatcttaaaaatgttttctaagggccatagtacatcactgaaaacttataacattttagtgtctcatacagaaaggttagggaatatagatgaaagaaaacctttgtattattaatttcatgctcttagccttttttctaaatcccaaagtaagaagcaaagcagactaaagcataagaataaagtctaagaataaagagtcctaagtctaattttctgtttactatttttggatcattcattttcttacccctcatgtcttcttctgttctttctagacaaataatagatactcgggttttttttttctttgaagattgtttgtggccccaagattcaacaaggaaataggaaatgttagaaaaaaactatgatgactgcccttgttccccaagaatagcaacatgtacttactcatcaaagttcagtgtatttgtccagttcagcacttcatccacttcccattccatcacagaatctatccccccatcttcaaaagctctaatcagcccctttgttgcagtgtgaattagtcctagagtttcatgatgtgttgacttagcctccagacttcctgagtagtacctaaataggcaaaagggaaagagaagtaaatcttttgaaataggagattacaagtagatacaggcaatatatattgttgctatttacatattaaaactatttgcatattgaataaagttttcattcctatataactcagatgcatctaaaccaagatctatgtgatggaatcttctggggggaaaagcaacttaaccacactaacttaaaatcacccctcaataagttgcatttttatgatacgaagaaaaactaagttattaaattgttgaatcttagaattatagagtggaaagggtcttagaaaccaaataactaacctactcatttttataggtgaggaaataaatctttgaggagttaagtaaattttacaaaatcaagaggctaatagcagataaagagggaaggaaagtgaaaaaaggaaagagaggaagaggtaaagggaaaacagataccttttctttgtgccaggtacttttcatacagtcttatttaattctttttaaaaagacacagccaggcccagcgcggtggctcacgcctataatcacagaacttgggaggccaacatgggtggatcacgaagtcaggagttcgagaccagcctggccaacatggtgaaaccctgtctctactaaaaatacaaaaattagctgggcatggtggcgggcccctgtaatcccagctacttgggaagctgaggcaggagaatcgctagaacctgggaggtggaggttgcagcgagccgagatcatgaaactgcactccagcctgggcgacagagcaagactccatctcaaaaaaaaaaaaaaaaaaaagacacagccatttgtggcagctatttttattccccttttagagataaagaaactgagacctggagaagttaaaatatcattcaaagctgggcacagtggctcaagcctgtaatcccaacacttttggagactgagtcaggaagatcatttgaggccaggagtttgaggccagcctgggcaacagagagatcctcatctcaattaataattttaaaaatttttaaagaaattgttcaagatcatgtagcagtaaatacttatgagagccagtattcagacccttagttttaaattcagcctccttctgcagcactgcctgtcttaatctgagcacataaaataatacattcactgataatgagctgagtaactagagagaagttagtagtccttaccaagatcatcaaaactttttttggtatttattttaagatctacattggtagccattttaaagggtcacctattatgaagttgtattcatttattaattcaacactcattgattaggaaacagcatagtggtgatatggagcaagactctggtatcgaattatctggatgtgaatcttggttctgtgttacataatctgctaaataacctagcctttctgggcctcactgacctcttccttaaaatggtaatcagggccaggtgtggtagctcatgcctataatcccagcactttgggagggtaaggcaggaggatcacttgaagccagaagtttaagaacatactggacaacacagtgagaccccatctctacaaacaataaaaaacatagccaagcacagtggcacacgcctgtagtcccagctactggggaggcggaggtgggagaattgtttgagcccagaagttcaaggctgcggtcagctatgatagcactactgcactccagcctgggtaacagagtgagaccttaactcttaaaaaaaaaaaaaaatcataacactacttcctcctagcattcttgagaggtttagaagcataaatccatgtgggatgggcatggatggtggctcatgcctgcaatcccagcactttgggagactgaggtgggagactcccttgaatccaggagttcaagaccagcctgggtaaaatagggacaacctgtctctacaatttttttttttttttgagatggagttgctctgtctcccaggctggagtgcagtgatgtgatctcggctcactgcaacctccacctcccgggttcaagcaattctcctgccccagcctcccaagtagctgggactacagcccaccacgcccagctaatttttgtatttttagtagagatgaggtttcaccatattggccaggctggtctcaaactcctgacctcgtgatctgcccgcctcagcctcccaaagtgttgtgattacaggcgtgagccactgcgcccagcccaaattttttttttttttttttgagatggaatctcactctattgcccaggctggagtgcagtggcgccatctcggctcactgcaagctccgcctcccgggttcacgccagtctcctgtctcagcctcccgagtagctgggactacaggcgcctgccaccacgcctggctaattttttgtattttttagtagagacgggatttcaccgtgtgagcccggatggtctcgatctcctgacctcgtgatctgcctgcctcggcctcacaaagtgctgggattacaggtgtgagccaccgcgcccagccaaaattttttaaaataataataataaaaaaagaagtgtaaatctatgtaaagcatttagaacaatgactggtacacagtaagcattcataggctgacactgttatcgggtggcagggctataacagtgagaagatacatccttgccctcatgaaattttgacttcatcagattttaaacggataatgatccatgagagcaaatgctccgttacccaggctggagtgcagtggcacgatcttggctcactgtaacctctgcctcctgggttcaagcagttctcctgcctcagcctttcaactagctgggatcacaggagcacaccaccaggcttagctaatttttgtatttttagtagagatggggtttcaccatgttggccaggctggtctcaaactcctgacctcaagtgatctgcccgcctccacctcccaaagtgctgggattacaggtatgagccagtgtgcctgacctcttatttttcttttttcaacagtgatatatgataattcagatatcttttttctcttattaaggaagtataaaatgcactttgttttcaagagagtcatagtaattgttcaaataatttaattctcaggttttgaactcttttaaaatgttactattggccggttgcggtggcttatgcctgtaatcccaacactttgggaggccaaggcgggcggatcacgaggtcaggagattgagaccatcctggctaacacagtgaaattctgtctctactaaaaatacaaaaaaaaattagctgggcgtggtggcaggtgcttgtagtcccagctactagggaggctgaggcgggagaatggcatgaacctgggagacggagcttgcagtgagctgagatggcgccactgcactccagcctgggcaacagagcaagactccgtcttaaaataaataaataaataaataaataaataaataaataaataaaataaaatagttactattataattaaatggtataaatattgataaaataacaggtttgcaagtagaaagtgtttcaaatatagtgatcagaaataaaagatcactttataaacataatttgttttataaacaaactaatgatcttttaaaaagacctaaaattggctagggtggtggctcacgcctgtaatcccagaactttgagaggcaaaggtgggcaggtcatgtgaggtcaggagtttgaggctggcctggccaacatggtgaaacccaggccctactaaaaatacaaaaattagctgggcatggtggcatgtagctatagtcccaggcactcaggaggctaaggcaggagaatgcttgaacccagaggcagaggttgcagtgagctgacatggtgccaatgtactccagcctgggcagcagagcaagactctttctcaaaaaaaaaaaaaaaaagacataaaatttgtcttcgtaggtaattttgcaatatatttttagttgtattcaccttaacatgatcttatattctttctaaactaggaaatttagagggaaagaatattataagaaatgtttgtctaaatgtcacaacagagagagaagttaaaacaacaaagacctaggaagaatcaaagcttaagttgcaaaggaggttgaggaaagctaagatctataggacacaggaagggactagatttaaaagccagaattcttttagtaagataggggtaaaaaataaaaattttgttgattttgttcattactgattctcagcaacagtcagaatgaagagtgtttaaatgccataaatgaacaaagcacacaaagtaaaatttctcattcaccccctgcaactctatgaaaaggaaatgtaacacccagtcataagaaagcattcattcatttatttattctataagcaacatatattcattaaacatgaactaagtctgagatcctgtgctaataaatagaacagagtctctgctctgtagggactcaaagtttagtggaggtggcagacaaatacacagttaattgcaaaaatgtgaccactgagtatataaaagatccatggggcacatcaaaaggaagtacctaattgtgtctaggtatgtaagggaaggtttcagaaggagctatttgggccaagtatcaaaagatgaagatgttgttgccatgcagctgagcaccctagggagaggaaatatcatgggaggtgtaggtaacggggagcccttaacatattttaagtaaagaaattatttctgtcttagaaacatcagtttagtgtttatacagagaagacgaagggactagagaccaggaaactaattagaaggtagatgaaaaatgatgagacatcacagtggagaatgaaagaaaagatcagatttgggagatattttggaagtggaattaataggacttgatgacagattacatgtaggcactaaaagagtgataaatctaggataagccctctgtttctggcttggatgactggctaaatgcagtgtcataagctgagaccagaagaaatactgagaagaaacaacttttgtgatgcggaagattagaaattcagttttggaactgttgagtttgatatagaaatgcccacataattagaaatacagagctcagttatggatgacgattgtgttgagggtaaataaacacaggaaagaagaagtaaaacgcatattattcttcatgtgcattggcttatcaccagatgctgtttcccagctagtaatgtgacggtgcttcagcaagtcatgccaccattctgtcaaagccagctgtttctaggtgatggcacatatggtaggtgaattttgttgttctcagcctgtaaccacacttcctttgctgttaataggtcccctattagaggcaatgttgtatgaaataaaatgatgacgatggataacgcattctgttatgagaggtgttgttgccagaagtaatgcaggcagagaaataaaattaatatccagaatatttgtctatcactgtgaggacaaatggatgcctcctctattatgggaatggtctattttaatcagcctgtcaccaactagccagcatatctcattactgggggcaaagcaatggcctttgctatacagtcagctgtgactgtagccagaacaactttggtgagggggaagaccaagttgttgagtctatatagggcctccatccctgtaatcctggccactttggacaagactccacggtgcaaccactgaggtgccgggggaaaaaatgacattcacaggatggatcatcttgtccatctgattaccaagagctgtctgcctcatataagccctttggagggcattcacataggacaaaaatatattttgtatccattatgagtatacctctaccctgacctatactcaccaattttccaattttattctttgcaaatgttgatcagctgggaaactataaatgttggtcagcacagtcaatgagatccctacctcaggctttttccccttcaaatgaagtggaaaaccaaacataccacaagttgtgcccactggaaggatatcttttgatcattttctaggccaaccgaggaattgaaatcattaactgtccatttttagatgatgcagcatcctgtatagatccaacttattcctccaacatattcccccctgttaacttgtcatggggacttcctatgaagccaaaggtatggagatgatgtggaggcaatgcagcgtaagtagtggttgcaggagtatgagccacctgctcatgcagcttacttgggccttctggaccttctcagactcattcccatacagaccacatttattttacactaaaacagtgctacgtactctcaattttatggtttaattgattagataaatcccaggtcagtccatgatcatagcacttggtatcttattgtcaagcaaccagtctctaccaggaccaattgcaaatctggaacagattttcaaatggaatatagcttctggcagaagaaggaattcactgccttcttcctaaaccctagaggtctgtgctgtgattctcccattaggtctctttagagactctacagtttttcactaccatggacatttctaatgctgttgggactgctgggccataaagcccaagttgtaaggcagcttgaccacattgtggatctgctacacacctctttcttgctccatgtcccattgaagccagcttgtttgttagatcacctagtaaaggggttggaacagcatgcccaaaatatgtcatacattagctctcaaatcgagagagggcctctaagtgttgtgcttcttcaggatggatggtacaaggtacagtaacttgtctctcatttttgaaaggatatctcaaatgtctttaagcttcaattatatgccagatccttaactttttgcaaagtttatctgcctccttttagtgtgcatttatcctactaagccaccaaggagctgttattttctgctcaccacatccaatcaaggtaaggtcatcaatgtaatggacaggcataatgttctatggaaacagatgtacaagcccctggggacaagagcaggaaaggtgatgtatcttcgggaacaacatgtaaaaacacacggttctttctgtgaaaatacagactgcttctcctgttgcttagtgattgggatgggaaagaacacatttgccaggtcagttgcagcataccaggtgccaggggctgtgttgatttgctctgttgaagaagccacatctggaagcctcgctgcaattgtgccatcagctgacctctaccacttcaaagttccattagtcccagtgaactaaaggaaccagttccatcacagctttccccactgtcatctccagccttgtaaaggacagccaccacagagttcatcaagaaatatgctgctcctgggccagacgtggtggctcatgcctgtaatcccagcactttgggaggccgaggcaggcagatcacaaggtcaggagttcaagaccagcctggccaatatgttgaaaccctgcctctactaaaaatacaaaaaaaaattagccaggcatggtggcacatgcctgttatcccagctactcggcaggctgagataggagaattgcttgaacctgggaggcagaggttgcagtgagccgagattgcgccactgcactccagcctgggtgacagagtgagactccgtctcaaagaaaaaaaaaaagagaaagaaatatgctgctcccctcgctcccctcaccaagctattacttcatagcttgatgaaaaaggtatctcctggaacttcctggggtgatggctagacggtggtttagtagattgcacataacagaaacaaacacacaattccctgaacttttagaaatcctttttctaatggaacagaaattaaaaaaagaaaaaaaaaagaatgtgtaaacaaaaactcagctgtacgtaagaaaacccaactccccctaagaaggagaaagagctggagtcctttaaaaattaactgcctgtttttctgtggctagtgagccttatctctccttctttcccaggcattgtgaagaccctgtttctctagctgtgcagctgcaaggtcactagacagataaactcaagtcataaaacatgttttccttgaaaagtaagaaacgatgtaatgcacttctcaattaattgaataactatctttgtttcttgcttctgtaatatgcttccccctgcacagatctcccccaaccccatgaaatgcttaaaaggtaacttaactctttgttcagggctcagtcctttggatgttaatccgactgggccagtacacctaaaataacaaatatcctcctctaccccatcggtctctctgattccttatcaatcctgctacactacagtataccagagaagttccagcattttgcaaaggtagaactttggttggctctacctaaatcaggctttgattagctaacttaacagaccattaacataatttctggccaaagcattaaatccacaatcccaggtgagtatggccatatcagtaagttcggcccagccaactctcgatctaacaaccttagaatccaccctcacacaatgcttctgagattcctggcaatgtagattagtaatttcttgtaactgttctggtttataaactatctcctcttggagtggaccttgtacctctgtctgggctgtcctgaaatacaaatctcattgtgagctaaaggcaatgagaaatagtagagggggaatcctgaggagaatcagcttaagtgtgtgtggcaactgtgccagtgcagtcactgaaaggcttttatgcagaaaagggccgcttccctcaaaagggagagtaagggttccctacaccaacaaggcactttggaagttcaagattcttagccttgtgtatgtttgcccaaatgtcctaatcccaggcctcagagttctacttcttccccactagtgcccttatcttagtgcaaaagacctggcagagttaagcatttggtagtactgtaggcattgtaaccctgtgacccttgcaatggaacccagggttgccctcaacccatgctgtgactatgagataaaggaccacttcagagctgccagggaggtcttctgattttctgcacaggtttttaattttttttttttttactattttattgaggtatggttgatgtacaataaactacacatatttaaattgtacaatgtacagttttgacatgtctatatacctgtaaatccatcactacaataaaaaataaatctatccatcaccctctgacgtttccttgtactcctttggaatccctctctttttcctctttcctatctccagacaactactgatctgatttgtgtcacttcagatttgtgtcttctagaattgtatgtgaatggaatcatacagtatgtattcttttttgatagatttatttcattcggcattattttgaggttcgtccatgtcattctgtctatcagtagttcattctgttgtactgctgcgtagtattcctttgtgtagatatcctaccacttgcttatccattcacctgctgatgcaaatttgtgctgtttctggtttttcgcaattaaaatgacaaataaaccagctatgaacattcacatacaatctttctgtggacatgtttttatttctcttgggtaagcatgtaggggtggaatgactaggtagaatatttggtgtgtttacttgtttaaaaaaaaacttgtcaaaccgttttctgaagtacacattctaatttgcatttgctccatatccttgccaacaattggcatgacagactatttcagtcattctagtgggtgtgtaggggtatctcattatcattttagttagcacttctctaatgattaatcatagtcactggttgagttatgctaatttgctaggtatgtatcttcactgatggagtgtttattcaaattttttgcccactttaaaatgtgattgtttgagaggttttttttttgttttttttttttttacatattcttgattcaagaactttgtcagatatatattttgcaaatgttttatcccggtctatggcttttaattttgataaagtaaaatttaaaattgtttcttttatagttcctgacttctatgtcctctttaaaaaatcttggccagaacaaaaggcactaagattttctccttcaattacttttagatgctttatggtttttgctcttatatttagatctataatctcttttcagttaattttacacatgctgtaagagaacactcaagtttcatttttctgcatttgaaaatccaatttgttgaaaagactattttttcccaattaagttcccttggcacctctgttgaaaattaattaacaatatacatgggggtttatttatttatttttttgagacggagtctcgctctgtcgcccaggctggatagtgcgaggatagcagtggctggggggaaaggctgactgattccaaggaatgagtcatcttgctcacctgattattaagattcttctctgttgagattgttctttggtgagcattcacatacgacacaagcatcttctcacttggtgcccatctggagaagtctgcacatacctcttccccagaccacttgtcaccaattttctaaccatgttctttccaaatccctgaccatccagtcaaaccatccatcaatcaccatccatctatagatctatacttctggccatcttttctttcaggcacaatatacaaccaggtatgctacttgaggttctgtcccagtaggatttcccttcccctctgtactgcaagtgaagctgtaatgtatatggaacttcctgtgagtcccaccttttacttgacccccttaggcctgttaggacttgagtttgaccaatggaatgcaaaataaatgttgctgtgacttccaagataaggccttaaaaagccttgtaacttccactttctgtctttgatacttttttttgtgtttgtttcgagatggagtctcgctctgtcacccaggctggagtgcagtggtgcgatctctgctcactgcaagctccgcctcctgggttcacgccattctcctgcctcagcctcccaagtagctgggactacaggcgcctgccaccaagcccggctaattttttcttttctttttttttttttttggatttttaactagagacggggtttcaccatgttagcgaggatggtctcaatctcccgatctcgtgatctgcctgcctcagcctcccaaagtgctgggattacaggcgtgagccaccgcgcccggccacatgggggtttatttcacaattccatattctgttccattgacctatatttctgtctatatgccaataccacaatgtcatgattacagtagctttataagtcttgaaatcaagtagtatagttctccaatgttgggattcgatcaggctgctgggaaaaatattagttatgatggccacaaaacctttttggaaggcctgagggttttcacatgacctcggtaacagaccgggccgaaggcggcctggtcccattaactttagttaaaaagattaaagtagtaaacaacgggatgtggcgaagttttacctagttagcttgtttactcatgcggtcttaagacaagcctttgatgtgtgctttttactcgggaagtccacaatgtcagttagcctctaatggcgttcactcaaacttttgttaactaatcttaatgaataaatatgagtctccctagctgattggggccagctgcagtgacaagcctctcttggtgtgtaggcggttggacactcagcaggactggcaaaacagaatatctgtgtgtcagtgtgcgttttattcatctgtcgtttgggtcagggtctgcgggcagaccccctgcagctaatgccctcttgtgaggagcaatacctcatttcaaatttgtttttttcccaaaatactacgtatttccttagtaagtgtttcatcaacttacatttgcctcatccactctatttttctaagttttcttttcttttccaaatcttgccttctcttcagtttagagaaatggaattcactttcctttttgtcttccaccaccataccatcagtagatagccaaaactattgagaaacaaaaatgaacatacaaaatgttgaaatatcgattgtgaggttatctggcaatagacaagaacttctatgtgttcagtaggaatatggcaagatagaaacagaggagaggatagatactttcaaggtatttctaattaagtgatgggtgagtagtacactcagccttcagaagcacatgctacagatagatcaacaaagtactagtgtactgaggtgcttaataagtgttgaatggataaataaacagatatattctaagagtgtctcatcttctcacatgaatagacctgacctactcttagtgctgatggcttttgatgactctaatcctcaaggagtacagccacccttcaggaatgcagaagtccctgtaccatgtcctaagactttgtggtttccccgttatgacattttctcctaactggttgtctattttcccccttccaactcattccccctgctctatcacacataccctagataataaggaaagtttgttaatccttccaaacactatatatttgcccttattaaaccacttaacatgtttaccacactgtactgaaatatcctgtttacttgactgtctccctaattgaaaggcaaactacttaagtctatcccctgcatccagaacaatgtctggtatatggttgatatgcaatagtttattattaaacaaatgaatgaattcataccttgatcattttcacttttcatacttggtatattcttttgtgtttgtttttgttgttgttgttagtttgttttttgagacagagtctcactctgtcgcccaggctgaagtgcagtggtgccatctcagctcaaagtgctgggattacaggcatgagccacagagcctggtcatacttagtgttaatatattcaacataccaaattctacaatccgtatactgggtatataatctgctgagtaccagagagtatctaaagatggtctagattcaaagctgataattaaaagtagaaataaatgtagtaagaaaaagataaattgctgtgccttgaagtattattagcaacccctgagtagctaacttaagcaaaatttatcaattaaattactaggatttattattttaaaaaataattttaaaattaatttttgaaaagacaaatgggtttctaaatacgtaaggttaaaaattaacatttctcttttcttactgtatcagaaactggcctccagccattgttttctatacgatgataccagccactatgatcctcttcctgaagatgatcatttttattatgagatgtatgctttgctggaagttttgcataatttctagggctgttagcacagagatcttcaataggtctgtgagtaaaaatcttatagtatatatcaggtggaaatttaacctgtagaaggaaaagttcaaagagccattgtaatgtaactacaaaaatgttttacattttgaaaaattacattgtttcaatttcataaaaatgtgctttataactactaaataagcattcatccatacttactccacctaatctgaatcgcacatgaatgccagcagcagcatctagaagctctgcctataagaaaatatattattcttatatattattcttcaggattctgtatgtatcaattcactatttctcactctattattttaaataattgctaaatattgactatttaggaaatcagtcaggtgaaccaacctcaaataatcaattttaaattagaaaaattgttaaaaaaatttttttgagatgggatttcactctgttgcccaggctggagtgcggtggcatgatctcagctcactgcagccttaacctcctgggctcaagcgatgctcccatctcagcctcccagatagctgagactacaggtgtgcaccaccatgcctggctaattttgtatttttttttttttttgtagagacaagagtcttcctatgttgccaagctggtctcgaattcttggcctcaagtgatactcctgtcttggcctcccaaagtgctaagattacaggcatgagccactgtgctcagccattaaaaaaaattttttttttgtaattagaaaatattttatgaggccgggcatggtggctcacgcctgtaatcccagaactttgggaggccgaggtgggtggataatgaggtcaggagatcgagaccacggtgaaaccccgtctctactaaaaatacaaaaaattagctaggcatggtggcaggcacctgtagtctcagctactcaggaggctgaggcaggagaatggcacgaacccaggaggcagagtttgcagtgagccaagatcgccccactgcactccagcctgggcgacagagcaagactctgtctcaaaaaaaaaaaaaaaaaaaaagaaaagaaaagaaaatattttatgagctaaggacttaatttctttttattattattattattattattattattattttattattacactttaagttttagggtacatgtgcacaatgtgcaggttagttacataggtatacatgtgccatgctggtgcgctgcacccactaaaaggacttaatttcttatggacatctatggtaaatgaaaaaatgataccaaactgtttcctttttatgcaatatataaacataaaagccaagtaattttttagtcataaaacttaacttttaaataactcctcaaatattacatataaaatattatcttgcaggtaaattcaaagaaaaaattatgactgatcaacctaaattcaacagtagatgacctttcctaattagctattgttaaatttaaaaatccatgtttaaaattctgggccgggcgtggtggctcacacctgtaatcccaacactttgggaagccgaggagggtggattgtttgaggtcaggagttccaaagccagcctggccaacatggtgaaaccctgtctctactaaaaatacaaaaattagctgggtgtggtgtcggatgcctgtaattccagctactctggaggctgaggcaggagaatcgcttgaaccagggaggtggaggcttcagtgagcagagattgcaccactgcactccagcctgggcaacagagactctgtctcaataaataaaataaaataaaataaaataaaataaaataaaataaaataaaataaaataaaatgatataagaattgtatataataggttttctagattttagtttggtatgcagcaccaaatggaaagtagagaaaaaaattcttggtcctttatcggaagacagttcaatcttgtctcctgatcatattaggttagatcagaaaatagatgttattcaacctatagagtcttaaagacaacattaattttgcagaataatcttctcttgactaaaacttttatgaattcaaatatgaagtgtgagatcctgttataaaacatattttctatatttgagccataataatatatacacatttttttcactaaggtggacagatcttaagtgtacagctccatgaatttttacatatgtattgtactctcttgtgcttggcttattttgctcaacatgaatctgtgataaatctctaagattcgtgtatgtagttgtagatagcagcagttagttctttttcactgctatctaacattccatcatataatagaatatatgacaatttatattattgttggacatttgatatgtctctagttttgggttaaaatgaataaaactactcattctgtgaacattcatttttatgtcttctgtgggttataacaatcatttctctttgttacatacccaggaatgaaatatgagaggtcatgaggtatatatggtatgtaagtatacagatggccccgacttaaagtggttcaacttacaattttgactacaatggtgtgaaagtgatatgcattcagtagaaatcatacttcacattttgaattttgatcttttcccaggctagcaatatgtggtatgatgctcttgtcgtgatgctgggcagtggcagcaagccacagcttccagtcagccacatgatcatgagggtaaacaactgatactctacagcaggggtccccaacccccaggccatggactggtaccagtccatggcctgttaagactgggccacacagcaggaggtgagcggcaggagcattactgcctgagctccccatcctgtcagatcagcagcaacattagattctcataggtgcacaaaccctcttgtgaactgcacacgcacaggatctaggttgcatacgccttatgagaatctaatgccttgatgatctgcggtggaacagtttcatcccaaaaccatcctccacatcccaagtctgtggtaaaattatcttccactaaaccggtccctggcaccaaaaagttaggactgctgctctacagtatagactaagttaaattggtaagttatgtttggcaggttaggtatattaagtgcagtttttgcttatgatattttcaccttacaatgagtttatcttaacataaccctgccataagccaaggagcatctgtaatttgctgtactagtgactaccaaagagttttccaaatttttgtaacaatccccccaccagcaatatatgagttctggttgctccgtctctttatcaacatttggtactgtcaatccttctaattttagccattctggtggggttataatggtagctcattgtagtttttaattgtattttcttatgactaaccatgctgagcaccttgcatatgcttattggccatatggatctatcagtcatgctagtagtttatcaattttattaacatattcaatgaaccaactggcttttatttgcatagtggcaccatcatggttcaatgcagcctcaacctccctgactcaactgatccttctacctaaccattccaagtagctgggactaaaggcacgcaccatcgtgacaggctaatttttttaattttttgtaggtaagggatttctccatgttgcccaggctggtctcaaactcctgggctcaagtgatctgtgcaccttggcttcccaaactgctgggattacagatgcgaaccaccctgccagccacttctactttctattcattgatttctgattttatcttcactatttccttccttttactttttttttttttttgagacagagtcttgctctgtcgctcagtctggggtgcagtggcctgatcttggctcactgaaacctctgcctcctgagttcaagtgattctcctgcctcagcctcctgagtaggtgggattacaggcacacgcaaccacgactggctaattttttcatatttttagtagagacggggtttcaccatgttggtcagactggtctcgaactcctgacctcatgatccccctgccttggcctcccaaactgctggtattacaggcatgagccaccatgcccggcccccttccttttactttctttggtattaatttggttatctttttctagcttgaagtgtaaactttgtaaattgatttttaatttttcttcttttctaatatttgcatttagaggtataaatttctgtctgagctctactttagatacattccacatgttttgatgtcacattttcattatgacttagtataaaatatattctaattttctcttttaatccatagattatttaatttcatgtgcttaatttgcaaaaatttggtggttttctacttctgtattctcattaatttttagtttaattccactgggactagaaaacattctctgtgatttcaaaacttggaaatttgttgagactttcattaaatccaagcatgtgatctattacgggaaacattttctgtgcacttaaaaataacattacttttgcaaaactgtagacattttgcagtgttgcaaaagtagtgacagcgttctctctatatatcaattaggtaaagaatttaaaatctacaatatctgtactaaatttttttgtgtgcttgtttctatcagttaccaagagagttgtgttaaaatcttcgactatgcttgatgattactatatttcttctggtaattatgtaagtttttgtcttataagtacagaatttttatatttttctattgaactgactctatcattatgaaactgctctctttatatctcacaaaactttatcccttaaagcttaatttgtccaatactaacataatgacactgattttctttttcttttttctttttttttttttgagatggagtctcgctctgtcatccaggctggagtgcagtggtgtgatctcagctcacgcaacctccaccttccaggttcaagtggttctcctgcctcagcttcccaagtaactgggatttacttttgcctgactaaattttgtatttttagtagagacggggtttcaccacgttggccaagctggtctcgaatgcctgacctcaagttatccacccacctcggcctcccaaagtgttgggattacaggtgtgagcaccatgcctggtctgactttcttttaattaaagtttgcatgatgtatatttttccattgtcttattgttttatattcttattgtttaaagtatgcctcaaaaataataaacagatggggtttttgtcagtctgacaacctttgctttcatttgggttctttagtctatttacatgtaaaacatacacatgaaatcgtataaaatgctcaattaaaaccagagaaggcagtaaagtgaaggaatacagagaaaaaaaaaacaatggcaacaaacaggaaacaattacaaatacaataaatatcgattgaactatatcaataactttaaatgtcaatgatctacatataccaattacaaagggcagatcagagactgtcagagcggataaaaaatcaagacccaactatatgttatccacaagcaacccactttaaatataaagacacagattaataacaaagaaaagaacaaagacgaacctgggcaatatagttagactctgactccacgcaaaaaattttaaaattagctgggtgtggtggcatgcaccagtagtcccagctacttcagaggctggggcgggaggatcacttgagcctggcaggtcaagggcggcagtgacccattatgacaccactgcactccaatctggacaacagagtgaggctttatcgaagaggaagaaagaagaaagaagaagaagaaagatatatgatactaacactaatagaacgaaagctgagctgctatattaatttcagacaaggccaaattaagatcaaggaaaactgtcaggactaaatggagcattacatgatgataatgtatgtacttaacaacaaagcagcaaaatatgtgaagcaaaaactgataaaactgcaagaaaaaatatagtaatttactaacataattggagatttcaatacccctctatcagtaattgacagattcagcaagtcagaaaaccagtaaggccataattgaactgaacagcagcataaattaactggatccaattgacatttataaaacacttcttcgaacaacagaatatatattcttctccagcacagacaaaatatttggcaagacagaccacgttctgggccataaaacacaccttaatacacttttttatttgtacaaatttgtgcagtatatgtgcaattttgttacatgcatagaatgcagagtggtcaagtcagggcttttagagtatccatcacccaattaatgtacattgtatccattaactaatttcccatcgtccacttccctccaaccagctcatccttccaactctccactgtctatcactccactctctacgttcatgtgtatacatttttagcatccacttctatgtgagaacatttgatatatatatataagatcatgtcaccagtagaaaaaagataatctgacttcttattttcccatttgaatgccttttatttctttctcttgcctgattgtgctggctaggacttcagtactgtcctgaacttgagtggtaataataagcatccttgtctttttccaattcttagaggaagcgctttcaacttttccccattccatacaatattagctgtggatttgtcatatatgggcctatcttaacaaatttaaaaggaatagaaatcatacaaagtatactctcacacctcaatagtattaaactagaaatcagtaacagagagataactggaaaaccccaaaacttgaaaattaaataacacacttctaaataacaagtaggtcaaataaagagtctcaagagaagttaaaaatactttgaaataaatgaaaacgaaaatacaacttactaaaatttgagggattcagcaaaaacagagcttacaggaaaatttatagtactgaatgtgtgtattagaaaacaaaaaatatctgaaagaaataatctaatgttctgccttgagggactagaaaagcaaagcaaattaaattcaaagcaagcagacgaaaataaataataaagattagagcagaaatcaatgaaattgataacaagaaatctataaagaaaataaaagaaacaaaaagctggtttgaaaagatcaataaaattgataagcttctggctagggtaactaagaaaaaaagacagatattacacattactaatatcagaaatggtccttgtcatttctgtctaattgaatactttattgtcatgatgatggttactcttcatggacatcttaatcttccacacacatcccctttttttggaataaaatttgtaaagaatgaaaatggtgaaggaaaaaaaaagaaacaaaatagaggtcatcattactgattgcatggacactaaaaaggataataaacaaattttatgagcacaaataactctatgccctcaaattttataacctagatgaaagagaccaattccctaaagacataatctaccaaaaatcacagaagtagtagataattttaataggcctatctctattaaagaaatagaatcaataattaaaacttttcaaaacagaaaaaaagcacaaggcccagatggattcactggtaaattctaccagacatttaaaaaagaaatttattttactatttacagtctcttccagaaaataaaatcaaagggaatacttcctaacacatttgatgaggccagcataaccctaatacaaaaaccacacagagacattacatgaaaggaaaattatagaccaatatctctcatgagcatagacttaaaaatcctcaaaaatttagtaagtcaaatccaacaatgtataaaaataattatacaccatgatcaagtgggatttattttgcaaggccactattatattgtatcaacaggctaaagaagaaaagtcatatgatcatattagcagatgtagaaaaagcatttgacaaaatccaacacccattcatgataacaactttggcaaactaggactagaggggaacttcctctaattaataatatctacaagaaacatacacctaatatcatacttaatggtgagaaactaaatgttttcctacaaagatgtcccctcaccttttctattcaacatcacactggaagtcctagctaatgcaataagacaagaaaaggaaatgaaaagtatacagattgagaagggagaaaaagaactgtctttgttctcagatgacatgattgtctatgttaaaaaatcccaatgaatcacaaggttaatatactaatcaactgctttattatataccagcaataagcaaccagaatttgaaattttaaaacacattgtcatttatatcagcacgcaaaaaagtaaaatacttaggtataaatctaacaaaatatataaaaatcgatatgagggaaactacaagaccgtgatgaaggaaatcaaagaagatttaaatgaatggagagatattccatacacccgaataggaagactcaatattgtcaagatgtctgttcttcccatctttctggatctatagattcaatgcaatctcaatcaaaatcccaggaacttattttgtgtataaggacaaactgattataaattttaagtggaaaggcaaaagacccagaatagccactataatatttcaggtgaacaacaaagttggagaattgacaccacccaacttcaagacttaccacgaaactacaataatcaagacactgtggtactggtgaaagaatacacaaataaatcaatgcaacagaagacagagcccagaaatagacccacacaaacagttaactattctctgacaaaggggcaaaggcaatttagtgacaaaagaatagtcttcaacaaatggtgctggaacaccatttggacattgcgggaatccacgttcaagaaaaaaaaaatctagacaaagatcttacacctttcacaaaacagtaactaaaactggatcataacttaaatgtaaaatgcaaaactatataactcttagaagataacataggaggaaatctaggtgagcttgggtttggtgatgactttttagatataacaccaaaagcataatagatatgacggacttcattaaaaagttgtactcaatgaaagacattaagataatgaaaagacaggtcataaactgggaagaaaatacttgcaaaacacatatctgataaagggctggtatttaaaatatacaaagaactctttaaccttcactataagaaaacaaacaacctgaattaaaaatgggcaaaggacctgtaaagctatcttcactaaagaagatatacagacgatacataagcatatgaaaagatggtcaacgttgtatgtcattaaggaattacaaattaaaacaacaatgagggcccgggcatggtggctcaagcctgcaatcacaacactttgggaggctgaggcaggtggatcacttgaggtcaggagtttgagaccagccatggctaacatggtgaaaccccgtctctactaaaaatacaaaaattagacgggcgtgatggggtgtgaattccagctactcgggacactgaggcaggagaatcacttgaacctgggaggcagaggttgcaatgagctgagattgtgacactgcactccagcctgggcgacagaaactccgtgtcaaaacaacaacaacaacaaaacaaaaacaatgagatacctctatacaccttttagaatgaccaaattcaaatactgacaacactagatgctagcaaggatgtggagtggtaattctttgctggtcggaatgcaaaatggcacagccactttggaaaaagtttggcagtttcttattgaactaaatgtactcttaccataagatccatcaatagagaatttaaaagaacaacagcaagaatataagtcaaaggggataatgagaaataagtgcattgtctgggagaagataaaaatgcaaatctatatatgatttcataagtcaaatatgcatgttgcaatctcttgaataagtttaaaagaatgataatatatagagaaaaatataaaaaactcattcccatagaaggccataacatgttgaaaaagaacgtagaacgtctgagacatacagagagtaaatagtaacagggtagatttaaatccccaaacatcagtaattacattacatgtgaatgaagtaaatgttctgacaaaagacaaagagtatcctactggataaaaaatgttagctaacaacctgctgccaggtcaggtgcggcggctcacacctgtaatcccagcactttgggaggccgaggcaggaggattgcctgagttcaggagtttgaaaccagcctgggcaacatggcaaaataccatctctactaaaaatacaaaaaattagccgggcgtggtggcacatgcctgtaattccaactactggggaggctggagcacaagaatgcttgaacccgggaggtggaggttgcagtgagctgagatagatagtgccacttcactctagcctgggcaacagaacgagactctgtctcaaaaaaacaaaaacaaacaaacaaaaaaaaacctgctgcctataaaaagacacagcaaaaatgtaaagattcagaatgttggaagtaaaatgacaggaaagatgtaccatgcaaataagagacagttggtgtgcgcatgttctcactcataatgggagttgaacaatgagaatgaacacatggacacagggaggggaacatcacactctggggcctgtcagcaggtggcgggctaggggagggacagcattaggagaaatacctaatgtagatgatgggttgatgagtgcagcaaaccaccatggcaagtgtatacctatgtaacaaacctgcacattctgcacaagtatctcaaaacttaaagtatgataataaaaaaaggaaacacaatattactgacagtaaaactttctgatttgttaaaaaaaaaaaaagagacagttggtgtggttgtattaataccagaaatttgagaccttaagggacacactttataatgataaaaggttcaattcaagaaagatacaataatctgaagtattcacttaataacatggtctcaaatatatacaaaccaccagaaaaatagacaaatcttcagtcatagtggaagcttttaatacatatctctcagtaactgatagtataactagacaaaaatattcagtaaggctatagaagatttgatcaacataactgaaaaatttgacctaattgacatctatgcaatactatgctcaataactaaaaaatatatattcttttcaagtacagataaaaatttataaaaaatagacaacagaggattgaaagtacagcacaatcaagataagggctgacaacaaaaagataactggctaatttccaaattaaataactgaaataaagtagaaattttaaaatattttgaactgaatttgatatgaaaatatgacatatcaaaacttgtaagctgcagctaagaccattcttagataaaaatttatgtccttaaatacatataccagaaaaggctacaagtcaataaattcagcatccatttcaaaaagttagaaaaataacagcaaacagaattcaaagaaaatataaagaaggaaataataaacagcagaaaatgatgaggtaggacacaaatgaacaacacaaagaaacaacaaagctaaaaattgtttttggaaaagaccaataaaagtaataaactccaaagagactgctcaagaaaaaaaagaggagatgcaaataaccaataccaggaataaaataaagataactattacagattctaaggcattagaaagatcataaaaagtattatgaataattttaagctaataaatttgaaaatttagatgaaaacttcctagaaaaatacaacttatcagagctagcacaagaagaaatacaaaatagaaatagaactataattctaaattgaatgtaatttaaaatcttttcatggaaaaaacttctggcacagatggtttcattagtaaatccttacaaagtacatttaaggatgaaaataacactcaatgtgaaaaagaaattcagaaaataaacagagtagaaacatttcccaatttgttttaggaggccagctaaatgtgataccaaaatctgacagagacagtaaattagacgttctgcaggaacacaggtgcaaatatttataccaaatattagcaaactaaattcagtgatattttaaagggataagataatcataaccaaaatgtacctattctaggaacgctaagacgatttaacattcaaacaaaaaataagaacaaaagaaaaattgtatctcaattaaagcaaaaaaggtctcataaaatttagcatctgttcttggatttctaaaaaactcttgtctgggcacagtggctcatgtctgtaatcctggcactttcaaaggccaaggcaggaggattgcttgaggacaagagtttgagaccagtctgggcaacataggaagactctgtctctacaaaaaaagttttaaaaaattagctgggcatggtggcccacacctgtggtcccagctacttgggaggctgaggtggaaggatcacttgagcccaggaggttgaggctgcagtgagctatgatggcaccaatgcactccagcctgggtaacagagtgagacctggcctctaaaaataaaatcaaaaaactcttttagttcaacaggaatagaaggaaacttccttaatcagataaaaggattctataacaaacaaacaaacaaaaatagcatacctcatacttaatgatgaaatattgatcctttccctctgaaatccagaataagacagtggttatcacttctattcaccattactgaaggctctagccagtgtataatggcaagaaaaagaaataaaatgtatcatgtttgaaaaggcaaaaacaaaactcattgaggatgacatgattgtttatattgaaaatccaaaataatcaatgtacacattattagaattaataaatgaggattgcaaagttgttgggaacaaagctaatgtgcaaaaattgattgtctttctacataatagcatcaaaaataagaaaataaaaattttgtaattaaccatttataggagcattaaaaagcaagttataaatctagcaaaagatatgtaagacctctctatagaaaactataaagcatttgttcagagaaaatttagaagaactaaataacatttcaaattaggttttccaaaagaagatgcttatatgaagtttgagtgccacaggtttattagggctcaatacctatggaagaaaggggagggaagaagaactgggcagaagaagagttggaactgcaatgtaagccacacaaagcctgggccaattctgcttggacctctaaagtgaatactgccacaatggcttctagacccatctcctcacccaccacattctgctcagtcactggacatgggttgacctagcatcactggaaagggttgacctagcatcaggcagttctttgcaattagggtagaaactgaagatcctcacagctggaggctgtctgtggactgcagtccctgagattgggtagtaaatccttcttaaagagggatctaacagcatatcccttatttcccacaaatgttcatgatttagagctctcagtattgtcatgataccagttttcctcaaattgagccaaatattcaatacaatctcgatcaacattccaacagacttttaatttaattttttatttttattttgtagagatggggtctcactatgttgccctggctggtgtcaaactcctgagctcaagtgatcctcctgcctcagcctcccaaagtgctgggattacaggtgtgagctaccgcacccggccaaaattccaatagactttaaaaatatgttttattttggtaaaaatccacacaacataaattaaccattagtgacatttagtactttcatattatacagccactacttccacaatattttcatcactccaaaaggaaaccccatatctatcaagcagtcacttccttcaccctagcccccaacacctggcaagcactagtcgtctttctcttttttgataatctctatttgttcagacatgtccatgtatctttctcctcagcttcattctacctagatttttaggtttgcctgttcctgccttgtctgctgtctattgcctgaggtggctgcaggttgtatatgattttaaatcctataagctggcccatccctgtgatggcatggagaggtgtgaaataaagggaaactctgtgcaggttcctcggggaactgccagacaaatcaaaatacacaaccaggccaggtgcgatagctcacgcctataatcccagaactttgggaggccgaggcgagcggatcacttgaggtcaggagttcgagaccagcctgaccaacatggtgaaaccctgtctctactaaaaatacaaaaaaaattagctgggcttggtggtggcgcctgtaatcccaactacttgggaggctgaagcaggagaatcacttgaatctgggaggcgaaggttgcagtgagccgagatcgtgccactgcactccagtctgggtgacagagcaagactccatctcaaaaacaaaaacaaacacacacactcaaacataaccacaatttttgagaacaagttctatattttacactctggccccaaaaagccacaccaggaataggggcctttgtttccacagctgctgccaagctggagaacaaggcatgtttgataggtaggcaaaaacaccaccctgctttcttcaagtttagtagcctttttctccattaaaagcattcccctggttgctctaagtttttaattagattccagagttccaataaagttgattctgatggttattctttttttttgagacgaagtctcacactgtcacccgggttggtgtgcagtggcgcaatctcggcttgctgcaacctctgcctccctggcccaagcgattctcctgtcaacctcccgagtagctgggactacaggcgcatgccaccatgcctggctaatttttgtatttttagtagagacggggtttcactatgttggccaggctggtctcgaactcctgacctcatgatccgcccgactcagcctcccaaagtgctgggattacaggcgtgagccaccgcgcctggccgacacttattcttagaattccttactctacaattttcacttccccaacagatttattttggtgtggaaattgaaaagctaattcaaacatttatgtggaaataaaaagcattcaagaatagcctggagtgttttcttgaaaaagaattgtaagattggaggtcttctctaccatttaataggactgttataaagctgtaatagttacgacaacagtagaaaaatagaccaatggaacagaccaatacataaatggccacctgatttaattattttaaaggtggcaccgcagagcagtagggacaggatagtattttcaataaatagcatttaatcacttggatatctgtagggaagaatgagaatgttgacctgggctgggcatggtggctcacacctgtaatcccagcactttgggaggccaaggtgggcggatcacgaggtcaggagatggagaccatcctggctaacatggtgaaaccccgtttctactaaaaatacaaaaattagcagggcatggtggcgggcacctgtagtcccagctactcgagaggctgaggcaggagcatcacttgaacctgggaggcggaggttgcagtgagccaagatcgcaccatgggactccagcctgggcgacagagcaagactctgtctcaaaaaaaaaaaaaaagctggcctgtacctcacaccatacacagaggtcagtcccaggtggactgcagatctaagtataaaatgcaaatcaataaatcttgtataatatgagaatatttttataaccttggagttggaaaaggttataaaaagcaccagctgtgcattctggccagatactatgcttttcgcacgatcttcccaacctgcacaccaggagattccctaggttgcctatgccaacagggccctgggtttcaagcacaaaattgagcagccctttgggcagacaccaagctagctgcagttttttttcataccccagtggcacctggaatgccagcgagacagacccattcactcccctagaaagggggctgaagccagggagccaagtggtctagctcagcggatcccacccccatggagcccagcaagctaagatccactggcttgaaatttttgctgccagcacaacagtctgaaatcgacctgggacactggagtttggtggggggagggacatctgcaattactgaggctagagtaggctgttttcccctcacagagcacctgggggaaggggtggctgtgggtgtagcttcagcagacttaaacgttcctgcctgccagctctgaagagagcagcagatctcccagcacagtgctcgagctctgctaagggacagactgcctcctcaagtggatccctgacccccatgcctcctgactgggagacatctcccagcaggggttgacagacacctcatataggagagctctggctggcatctggcaggtgcccctctgggacaaagcttccagaggaaggaacagtcagcaatctttgctgttctgcagcctccactggtgatacccaggcaaatagggtctggagtggaactccagcagactccagcagacctgcagcagaggggcctgttagaaggaaaactaacaaacagaaaggaatagcatcaacatcaacaaaaagaacatccacacagaaaccccattcgacggtcaccaacatcaaagaccaaaggtagagaaaaccacaaagatgaggaaaaacaggcactaaaaggcagaaaattccaaaaaccagaatacctcttctccttcaaagtatcacaactccttgccagcaagggaactaaactggacagagaatgagttagacgaattgacagaagtaggctttagaaggtggataacaaactcctccgagctaaaggagcatgttctagcccatgtaaggaagctaagaaccttaaaaagaggttagaggaattgctatctagaataaccagtttagagaagaatataaatgacctgatggagctgaaaaacacagcacaagaactttgtgaaggatacacaagtatcaatagctgaattgatcaagcggaagaaaggacatcagagattgaagatcaacttaatgaaataaagcatgaagacaagattagagaaaaaagaatgaaaaggagtgaacaaagcctccaagaaatatgggactatgtgaaaagaccaaacctacatttgattgatatacctgaaagtgatggggagaatggaaccaagttggaaaacactctcccaatacaggaacactcagattcataaagcaagttcttagagacctacaaggagacttagactcccacacaataattatgggagactttaacacccccctgtcaacattagacagatcaacgagacagaaaattaacaaggatattcaggacttgatctcagctctagaccaagcagacctaatagacatctacagaactctccaccccaaagcaacaaaagatacattcttctcaacatcacatcgcacttattctaaattgaccacataattggaagtaaacactcctcagcaaatgcaaaagaatggaaatcctaccagtctctcagaccacagtgcaatcaaattagaactccggattttaaaactcactcaaaactgcacaactacatggaaccttaacacctgctcctgaatgactactggataaataacgaaacgaaggcagaaataaataagttatttgaaaccaatgagaacaaagacacaatgtaccagacttcccaggaaacagctaaagcagtgtttagagggaaatttatagcactaaatggccataggagaaagcgggaaagatctaaaattgacaccctaatatcacaattaaaagaactagagaagcaagagcaaacacattcaaaatctagcagaagacaagaaatatctacgatcagagcagaactgaaggagataagagacacaaaaaaacctgcaaaaaatcagtgaatccaggagctgtttttttgaaaagattaacaaaatagaccactagccagactaacaaagaagagagaagaatcaaatagatacaataaaaaatgataaagatgatatcaccactgatcccagagaaatacaaactatcatcagagaatactatacacacctctatgcaaataaactagaaaatctagaagaaatggataaattcctggacacatacaccctcccaagactaaaccaggaagaagtcaaatccctgatagaccaataacaagttctgaaattgaggcagtaattaataggctaccaaccaaaaaaatcccaggaccagatggattcacagctgaattctaccagagatacaaagaggagctggtaccattccttctgaaactattccaaacaatagaaaaagaggggctactccctaactcattttatgaggccagcatcatcctgataccaaaccctggcagagacacaacaaaagaagaaaatttcaggccaatatacctgatgaacatcaatgtgaaaatcctccataaaatactggcaaaccgaatctagcagcacatcaaaaagcgtatccaccacgatcaagtcggcttcatccctgggatgcaaggctagttcaacatacacaaatcaataaatgtaatccatcacataaaaagaaccaattacaaaaaccacgtgattatctcaatagatgcagaaaaggcctttgataaaattcaacaccgcttcgtgctaaaaactttcaataaactaggtattcatggaacgtatctcaaaataataagagctatttatgacaaacccacagccaataccatactgaatgggcaaaagctggatgcattccctttgaaaaccggtataagacaaggatgccctctcttaccactccttttcaacatagtattggaagttctggccagggcaatcaggcaagagaaaaaaataaagagtattcaaatagaaagagaggaagtcaaattgtctctatttgcagatgacatgattgtatatttagaaagccccattgtctcagccccaaatcttcttaagctgataagcaacttcaacaaagtctcaggacacacaatcaatctgcaaaaatcacaagcattcctatacaccaataatagacaatcagagacccaaataatgagtgagctctcattcacaattgctacaaagagaataaaatacctaggaatacaactcacaagggatatgaaggacctcttcaaggagaactacacaccactgctcaaggaaataagagaggacacaaacaaatggaaaaacattccatgctcatgaataggaagaatcaatactgtgaaaatggccatactgcccaaagtaatttatagattctatgctatccccatcaagctaccattgactttcctcatagaattagaaaaaactactttaaatttcatatggaaccaaaaaaaaaacctgtatagccaagacaatcctaagcaaaaagaacaaagttggaggcatcatgctacctgacttcaaactatactacaaggccacagtaaccaaaacagcatggtactgataccaaaacagatatataaaccaatggaacagaacagaggcctcagaaataccaccacacatctcatccttgacaaacctgacaaaaacaaacacatctttgacactatctcatttttcacaaacctgacaaaaacaagcaatggggaaaagatttcctatttaataaatagtgctgggaaaaatggctagccatatgcagaaaactaaaactggaccccccttccttacaccttatacaaaaattaactctagatggattaaagacttaaacgtaagacctaaaaccataaaaatcctagaagaaaacctaggcaataccattcaggacctaggcatgggcaaagacttcatgattaaaacaccaaaagcaatggcaataaaagccaaaagtgacaaatgggatctaattaaactaaagagcttctgcacacaaaagaaactatcatcagaatgaacaggcaacctacagaatgggagaaaatttttgcaatctatccatctcacaaagggctaatatccagaatctataaggaacttaaacaaatttacaaaaaaaaaaaaaccccaccaaaaagggggtgaaggatatgaacagatgcttctcaaaagaagacaattatgtggtcaacaaacatattttaaaaagctcggccgggcgcgggctgacgcctgtaatcccagcactttgggaggccgagacaggcggatcacgaggtcaggagatcgagaccatcctggctaacacggtgaaaccccgtctctactaaaaaaaaatacaaaaattagccgggcatggtggcgcgcgtctgtagtcccagctacacgggaggctgaggcaggagaatggcgtgaacccgggaggcggagcttgcagtgagttgagatcgcgccactgcactccagcctgggcgacagagcgaaactccgcctcaaaaaaaaaaaaaaaaaaaaaaaagctcatcattactggtcattagagaaatgcaaatcaaaaccaaaatgagataccatctcacgccagttagaatggcaatctttttttttttttttttttttttgagacagagtctcgctctgttgcccaggctggagtgcagtggcgggatctcggctcactgcaagctccgcctcccgggttcacgccattctcctgcctcagcctcccaagtagctgggactacaggcgcccgccactacgaccggctaattttttgtatttttagtagagacgggtttcaccgttttagccgggatggtctcgatctcctgacctcgtgatccacccgcctcggcctcccaaagtgctgggattacaggcgtgagccaccgcgcccacccagaatggcaatcattaaaaagtcaggaaagaatagatgctggagaggatgtggagaaacaggaatgcttttacactgttggtgggagtgtaaattagttctaccagttgtggaagacagtgtgacaattcctcaaggatctagaaccagaagtaccatttgacccagcaaccccattactgggtatataccaaaaggattataaatcattctactataaagacacatgcacacgtatgtttattggagcagtgttcacaatagcaaagacttggaaccaacccaaacgcccatcaatgacagactggataaagaaaatgtgccacatatacaccatggaataccatgcagccataaaaaaggatgtgttcatgtcctttgcagggacatggatgaagctggaaaccatcattctcagcaaactaacacaggaacagaaaaccagacaccgcacattctcactcataagtgggagttgaacaatgagaacacatggacacagggaggggaacatcacatactggggtctgtagaggcgttggggggctagaggagggatagcgttaggagaaatacctaatgtagatgacaggttgatgggtgcagcaaatcaccatggtacatgtatacctatgtaacaaacctgcatgttctgcacatgtatcccagaacttaaagtattaaaaaacaaacaaacaaacaaaaataccaaaaaacgaaacaaaacaaaaaacaccagcttggtgtagtggctcatgcctgttatcccagcacattgggaggccaaggcataaggattgcttgagcccaggagtttgagacgagcctgcgtaacctagggagatcccatctctacaaaaaatgaaaaaattagctgggcatggtggcatgtgcctgttgctccagctacttgtgaggctgaggtgggaggatcgcttgggcccaggaggttgaggctgcagtgaactgtgatcacaccactatgctccagcctgggagacagaacgagaccctgtctcaaaaaaagaaaaagaaaaaagaaaaaaacaaattaaaaaggcaccaaccacataggaaaatattgataaattgaactacattaaaattaagaactttgttcatcaaaagacaccactgcttcaaaataacctagaggttgtagaaagtgggtagaggtatagatgaaataagattggttatgaattgctaactgttgaagctagatgatgggtacatggtggcttatgattttactctttctccttttgcatatatttgacatgttttataataaaaatcaaaggaaagactccattaagagagtgacaagccacagagtgaaaaaaagatgcaagtaacagataactgacaaagggcttctatgaagaatatataacccttgtgcattattggtgagagtacaaaatggtacagccactgtggaaaacagtatggttgttcctaaaaaacttaaaaatggaattaccatatgatccagcaattccacttctggatatatacccaaaagaattaaaagaagggtctcaaagagatatttgtataaccatttatagaagcattattcataatagctaaaacatggaagcaacccaagtgtccattggtggatgactgaacaagtacaatgtagtatatacacacaatggaatattattcagccttaagaaaggaaagaaatcccgcaataaactattacatgggtgaatcttgaggacactgtgctaagtgacataagccaatcacaaaaaggcaagtactgtataattccactcctatgaggtaattagtcaaattcatagggacaggaggtagaatgatagttgctgggagataggtggaagggaaaataaggagttactgtttaatgaggatagagttttggttttgtaagatgaaaagatttatggagatgggtggtggtgatggttggtgatggttacacacattataaatgtgtttagtactactgaactgtattctttttttttttttttttttgagacagagtcttgctctgtcgcccaggctggagtgcagtggtgtgatctctgctcactgaaagctccgcctcccacgttcatgccattctcctgcctcagcctcccgagtagctgggactacaggcacctgccaccacgcctggctaatttttttttttttttttgtatttttagtagagacagggtttcgccatgttagccagggtggtctcgatctcctgacctcgtgatccgcccgcctcggcctcccaaagtgctggaattacaggtgtgagccactgcgcccagcctgaactgtattcttaaaaatcgttaagatagtaaattttatattatgcgtactttaccacaaaaagtaaattgagaaaaaagtagttttaaaaaaatacaaagaactgatttttaaaagaccaataagggtacggtggtttacacctgtaatcccagcactttgggaggccaaggtaggcagatcacttgagtccaggagttcaagaccagcttgagcaacatggcaaaaccctgtctctactgaaaatacaaaaaattagctggacgcggtggcatgcgcctatagtcccagttattcatggggctgaagcaggaggattgcttgagtccaggaggttaacgctgcagtgagccctgatcgtgccactgcactctaacctgggtgacagagtgagaccctgtcttaaaaaaataaataaataaaacaaaaaaaaacccaaaacccataaggatagggaacacacacacacacacacacacacacacacacacacacacacacacacagaggagagttgaataagcactttccacatcacaaaagtatcagggaaatacaaattacaaactgacaatattatgtattggtgagaatgtaaagcactaagaataccaaagattgctagtgcaaatataaattagtacaatagctttgggaaataatctggcattatctcccagagttgtgataaggataatttgttgctcaccaattccatttctaggtgtagtataaacaaaaaaaaaatgtgtacacttatccatgaggagacatgaaaattcccagaaacagttattaaaatagccccaaactagaaaaaatacaaaagtcaatcaactgtagaatgaataaatagcaatatattcataaaagagaataatggctattaattaaaaatgaatgaattttagctacataaatgtattgttggatgaacaaatatataccccaaagcatactataggattctatttatatacagttcaaaaacaggaaattaaagtattatgttagaatataaaatagtggttaccttttggaagaagggagttggcaatgatttgcagggtacccaaagggagtgatttggagtatgaaaacattgatctgggtgacggttacataggtgtttgctttgtgatgattcattgagctatatatgttttatgaactttcaacatatgtgtaatactttaataaaaacagttttaaaaagaaacaaatatgatgagcacactgaattgataaagtaatcacattttatggaaaaatataggatgctatatcaataagtaatgtccttacctctttgggattaatatatttcactatctgacgtggttctccttgtcttcttaaatcaatcagacttttaaagtgttgaaatatagcgacattctaaaggttcaaacacaagatttcatgatcaaaactggattttctatttctacttcgctttttgtctaatcagggcaaaaacgaataaagtaccataaaatagatttttatgtatccacactagattttagaaatattatgcactcagggtttgctttgataaccctagtagtattagtataattctcacaaagagatttattcttaaatttgtaattgcatcactaccaactataaatgtaatatcccaaactttggtaaagtcatctcagtgtactctccagagtaatctagaaaaaaaccaaaatacagactactgattaagaaccactgagtatgggatactcttgtctgggttcagctgttagtatttagcagctgtgactgtcgacaagttgcttaacctctttgcactcagtttcttcaactataaagtgggaatgatagtagccatctcatacagctttggtgagaaatacatgaattaatatttgtagagcatgtaaagctttctgacacaagaaaacattcaataaatattagccattgttaccattgcagaatcctccttattcctatagtaatcccactgatgtattacaggattctgtaatggtaacaacgactaatatttattgagtgttcatctatttttcacattagtgcaaatttagctaaacaatccctaccaattagtccatcttggaaaattatttctttggtaactctcccctcaagccccatctccctaaaaatgctttaataactcttggtaaacaccccactccccatttgcttatgttaaagcaaataaaataaattcaaatttaagtaacccatagtaccaatataacaatctaaagccccactacaattgcctatggaagatggtacagcccatgtctatactaatagtattctttctgaaaggaggatataattttccccaaataaaactccaaattgagtatcaagaaatacttattatggtttaaaatctgaatagtatcttctaaataggtggttactatatcagttgtctactaatacataacaaaccaccctaaaacttagtggtttagagcaacaaccatttattatttctctcttcctgtgggttgacaggggagttctgctggtcttggttggactcatacatgtggccttagtcagctgccagatcagctggagttgagtgatttaatatggcctcacccacatatcagggtcttcagctgaaatttttggaatatctaggatagctgggcctctctttccaaacagaccttcagtttgagcttcttcatagtatggaggttttaaagtaccaaagagagactgggtgcaatggctcacgcctgtaatcccagcactttggaggggcgaggcattaaaaaaaaatttatatatatatatctctctctatatatatatagatatatatagatatatatatatgccgggctcagtggctcacgcctataatcccagcactttgggaggccaaggtgggtgggatcatgaggtcaggagatcgagaccaccccggctaacacagtgaaaccctgtctctactaaaaatacaaaaaaaattagttagatgtggtggcaggcgcctgcagtcccagctactcgggaggctgaggcaggaggatggtgtgaacccaggaggcggaacttgcagtgagcagagatcacgccactgcactccagcctgggtgacagagtgagactccgtctcaaaacaaaacaaaacaaaacaaaacaaaacaaaaaaagtaccaaagacagaaagtggaagttacaaggtttcttaaggccttatcttggaagtcacagcaacatttattctgcattccattggtcaaactcaagtcctaacagggcttgttaggcttggcccctaagggggtcaagtaaaaggtgggactcacaggaagttctatatacattacagcttcacttgcagtacagagaggaagggaaatccttctactgggacagaacctcaagtagcatacctggttgtatattgtgcctggaagaaaagatggccagaagtatagatctatagatggatggtgattgatggatggtttgactggatggtcagggatttggaaagaacatggttagaaaattggtgacaagtggtctggggaagaggtatgtgcagacttctccagatgggcaccaagtgagaagatgcttgtgtcgtatgtgaatgctcaccaaagaacaatctcaacagagaagaatcttaataatcaggtgagcaagatgactcattccttggaatcagtcagcctttccccctagccactgctatccttgcactatgtgctcatgaacaaagtggtcatagcagtaggaatggaggttatgtctgggtgtggtggctcatagctgtaatcccagcactttgggaggctaaggcaggtggatcacttgaggtcaggggttcgagatcagcctggccaacatggtgaaaccacatctctactaaaaatacaaaaattagctgggcatggtggtgtgtgcctgtaatcccagctactcaggaggctgaggcaggagaatcgcttgaatctggcaagcggaggttgcagtgagccgaaatggtgccactgcactccagcctgggtgacagagggagactctgtctcaaaaaaaaaaaaaaaggaatggaggttattcataggctcagcaacatgaatttctacccactagatctggctactgccaccactgagagagtccaacttgccaacacagagactaacactgagcccctggtatggcataattccttgggggaactacctagcttccttgagacaaaaattgattatttggaacacttccattatggaaagggcaacacttcttttctcactggaattgacatctgatccttccatgtgcacagtgtttccacaaaaaccttctgtgtactttgaaaatgctttattctctgtcatggtattccacacagcattgctcctgattagagaacttggttcacaacaagtgtagcacaccaatgggcccatgcttgtgaaattcataaatcttaccttgttcccaatcaccctgaagtaactggcctgatagaatagtggaatggcatgttaaagactcagttgcaatttagaattcagtgataacacttttcagactaggacgacatcctctatgttgtagtagatgctctgaatgaatatcgtgctatttctcacacagccagcatccatgaatttgggaattaagtggtagaaatggaagtggctccctctcaatattatctttaatgatccactagtgaaaattttgcttcctgtccttctttgtacctttgtgctctgcagatataatggtcttagtttccacaggaagaacgtttccaccaaagtacataccaatgttaaaatggaaactgatactgccacctgaccatcttgttctcctcataccaataaaccaacatgaaaaaaaaaagacaattaccatactggctggggtaattaatcctgattcttaggagaaaatgagctattactaccagtagaaattaaggaagatgtctagaattcaggagaacttttggggtgttttttagtaataccatattctgtaagaaaagttaatggaaaattataacaaccccaaacaggcagaattgttaaaggtctagcccctttaggaatgaagttttgcgtcattcccttcctccacccctgagcaaggaaccacaaccagctgaagtgcttgctgaaaaaaagagagaatatgaaatagctagtggaagaaaaaagttaaaaataccagctatgattcccataattagctgcagaaacaggtagtatctatgagtatttcttctatatatctgcatataaatattagccatttttttcttttgttttctcctgctcccattcccctaaaacaaatgtaaagtgtgttaatcatagtgtggtaggcagcataacgctccctaacaaaagatgttcacacctaatccctgtaatctgtaatgtgtaaatatgctgttacatggagagggtgaattaggattgcatttggaactaaggttgctaatcagctgactttgacacagggaaattatcctcattggcccaaggtaattgcaagggtccgtataaaggacatagaagagtcagcaagagtggtgtgatgagggaaagacttgacaggtcattgctggttttgaaaatagacaggggttgctccaggaaaggattttaggaggaaaaaaaaaaaaaagaaagaaaatagaagggcataatgagccaaggatgcgggcaacttctagaaggaggaaaaggcaggaaattcttccctagagcctccagagagaacacaagctctgctgacgcttgattttagcccagtgaagcccatttcagacttctgacctccagaaccgtaagataatacatttttgtggtttaaagcactaactttgtggcaatttttacagtagcattaggaaattaatacaagtacttaaccttccacctggtatttaaagtataagatatcataggtagagtatggttcagcaaaaagaggaataaaaatgatccaaaaagggataaaggtacttttgggaaggttgtgaatatgctttggcctgtatgaggaatgttaggtggaagcatggttttgattctatttggaagttaaatatggttaaaagggatttgtatggatgccaaggtgacaaggggtagactcagctgggttattctattgtcaacttgaccaaacaaggacaaatataaagaaaatgacatatagacacatcataatcaaactgctaaaaaccaaagacaaagacgcaatttaaaagcagccagaaaataaataccacaatactttcagagtagaaacggtaacactatttattgactttttaatagaaactatgggagacagaatacaatggaatgccatctgagtgctgaggggggaaaaatcccaataacatgccagtccagatttctatgaaatgtgataatattctttgaaaataaaaaggaaataaatatgcttttagacaaacaaaagctgaagggatttttcacaggaggtctggcatctaagaaatcttataagaaatactacagacacatctatagttccagaactttgggaggctgacatgggaagatcacttgaggctaggagtttgagacccaccaggtcaacatattaagaacccattacgacaaaaaaaaaaaaaaaagggggggggtggacaaaattttaaaaattatctaggtgtggtgatgcacacctgaagtcctagctactcagtagcttgaggtaggaggatcacttgagctcaggaattcgaggctacagtgagctatgattgcaccactgcactccagcctgggtgacagagcaagaacttgcctctcaaaaacaaaatcaaactacagagaattcttgagttggcagaaaattaataccataaggaagcaaataaggctgcaggaacaaatgaagggctctggaaatggtttgtatctggatagataaaaatagatactgaaggctgggtgcagtggctcacgcctgtaatcccagcactttgggaggctgaggcgggcagatcatgaggtcaagagatcgaaaccatcctggccaacatggtgaaaccccgtctctactaagcatacaaaaattagctgggcatggtggcgcatgtctgtagtcccagctactcgggaggctgaggcaggagaatcgcttgaatccgggaggcagaggcagaggttgcagtgagctgagatagcaccactgcactccagcctggtgacaggtgagactcagtcttaaaaaaaaaaaaaaaaaaaaaaaaaaaaaaaggataaggaaattaaacggaaaaacaccccacattcacagattggaagccttagtattgttaagatgacagtattacccaaagcaatgtacagattcaatgtaatcactatccaaaatcccaacggcactttttgaaaaaatagaaaagcccatcctaaaatctatgtggaacacaagggaccctgaatagccaaacagtcttgaaaaagaataaaataagtgaaaaagtgtgagttggagagccatacttccggatttcaaaacttactaaagctacaataatcaaaacagtttggtactggcctaaggacagatatataggccaatggaatagcatagagagcctccaaatagactcatatatatgtcgtcaactcatttttgacaagggtttcaaaaccattcaatgaagaggacagtattttcaacaaatgtatccgtgacaattatatacccacatgaaaaataatgaaattgggtccttaatttacaccatatgcaacattaaatcaaaatggatcaaagatttaggtggcatgcagtggctcacgcctataatttcagcaatttgggaggccgagacgggcagatcacttgaggtcaggagtttgagaccagcctggccaacgtggtgaaaccctgtctccactaaaaatacaaaaattagctgggcatgtggcgcactcctgtagtcccagctactcggtaggctgaggcaaaagaatccctcaaacctgggaggcggagttggcactgagctgagattgagtcactgcactccagcttgggcaacaaagcaagatttcgtctggaaaaaaaaaaaatcaaagatccaaatataagagttaaagccataaaactcctagaagaaaatatgggggaaaagcttcatgacgttggatttggtaatgatttcttggatataacaccaaaagcacaagaaacaaaatgaacaaaaagataaactggactacataaaaatcagactgggtgcagtggctcacgcttgtaatcctagcactttgggaggccaaggcgggcagatcacttgaggtcaggagtttgagaccagtctggccaacacagtgaaaccccatttctactaaaaatacaaaaattagccaggcatggtggtggtcgcctgtagtcccagctactcaggaggctgaggcagaagaatcatttgaacgcaggaggcagaggttgcagtgaaccgagactgtgccactgcactccagcctgggtgacagagcgagactccatctaaaaaaaaaaaattaaaactttttgtgcatcaaaggacactaacaagagagtaaaagggcaatccacaaaatgggagaaaatatttgcaaagcagatcttcgaaacataaagaactgctacatctcaacaacaaatgcaaaacaactcaatgtaaaaatgggcaaaggtcttgaatatatatttctccaaagaagacttacaagtggtcaataaggacaaaaaagatgatcaatatcactagtcataagggaaatgtaaatcaaaactgcaatgagatacgacttaacatccattagaatggctattaccaaaaaacttgaaaatagcaagtattggcaaggatatagagcaactggaaaccttgtgcattgctggtgggaatgtaaaatggtacagccactgtggtaaagtttggcagttcctcacaaagtcaaacattgaattacataatccagcaattccacttctagacatataccaaaaagaaagcaatggctcaaacagatatttttacatcaatttattagcagcattattcacagtaaccaaaaagtggaaatagcccaaatgtccattaacagatgaatggataaatacaatgtagcatatagatatataatggaatattatccatccttagaaaggaatgaaattctgatacatgctataaattggatgaacattgaaaatgttatgttgagtaaaataagccagatacaaaaagataaatccacttaaatgaggtacctaaaataggaaaattcacagagacacaaagtagaatagagataactggggtctggtggttaggaggtttttgtttaatgggtacatgaggttttgtttgggatgatgaaaaagctgtggaaatggatactggtgataggtgcacaacattatgaatatacttaatgtaattgagttatacacctaaaaacggttaaactggtaaattttatgttatgaacattttactacaataaaaaagtgaacactggctgtttaaaacaagaataataatgtctcctggtacttaaaacaaaagtgtaagtgaaatatctggaaataacaggacaaaggtgaagaggctaaagtgagttaacatgttatgagcttcttacattgttctgaaaagggtaaaagtactaatttaaggtagagactaactaatcaagggcaaatattgtaactttgccctttctagcttaaccctctaaaagaatatatagctgttctaatcatctattactgtgtagtaaagtacctcaaaacttagtagtgtaaaaacaaccaccattttattatgctcataattatgggttacgaattctggtagggaatagtagggaagtcttgtctcatctccacaatgactgaggcttcagcggggatgacttgaacagtagaaatggctgggatggctcaagtggggcccaatatcaaggacctgcattctagctgtcagctaggtctcttggttcttttccttattacacttattgggcatggaatataaaaaatggccttttcacttacgtatctgcttaagtgggctgtaatatctgttaaaacaggatagtcaatcatcaatctctggaggcaacctctccatgaggctagcctgggattcacttcagcatggcagtttcagggcagttatccttcctacatggtggctgttctcactcagaatgaacatttcaggacacagacttggacactgcaatgctttttatgacctagactaagaggttccagaatgtcatgtcctattttagtggttttaatggtaaagcaagttactaaaatagcctagatgaaagggaaaatatgaccgataggaagaggaggttccaagatggccaaataggaagagccccagtctacagctcccagcatgagcaacgcagaagacaggtgatttcggcatttccaagtgaggtaccgggttcatctcactggggcttgtcagacagtgggtgcagcccaaggagcatgagccaaagcagggcaacgcactgcctcacccaggaagtgcaaggggttggggaattccctttcctagccaagggaagccgtgacagatggtacctggaaaattaggacactcccaccctaatactgtgcttttccaacagtcttagcaaacagcacaccaggagattatatcctgcacctggctcagagggtcccacacccacggaaccttgctcactactaacacagcagtctgagattgaactgcaaggcggcagcgaggctggaggagaggcgtctgccattgctgaggcttgagtaggtaaacaaagcagccgggaagctcgaattgggtggagcccaccaacagttcaaggaggcctgcctgcctctgtagactccacctctgggggcagggcatagctgaacaaaaggcagcagaaacttctgcagacttaaacgtccctgtctgacagctttgaaaagagtagttgttatcccagcatggagtttgagatgagagaatgggcagactgcctcctcaagtgggtccctgacccccaagtagcctaactgggaggcaccccccagtaggggcagactgacacctcatacggccaggtgcccctctgagacaaagcttccggaggaaggattaggcagcaacaattgccattctgcaatatttgctgttctgcagcctccgctggtgatacccaggcaaacaaggtctggagtggacttccagcaaagtccaacagacctgcagctgcgggtcctattagaaggaaaactaacaaacagaaaggacacccacaccaaaatcccatctgtatgtcaccatcatcaaagaccaaaggtagagaaaaccacaaagacggggagaaaccagagcagaaaagctgaaaattctaaatatcagaatgcctcttctcctccaaaggaatgcagctccttgccagcaacagaacaaagctggatggaaaatgactttgatgagttgagagaagaaggcttcagatgatcagtaataacaaacttctccgagctaaaggaggatgttcaaacctatcacaaagaagctaaaaaccttgaaaaaagatgagatgaatggttaactagaagaaacagtgtagagaagaccttaaatcacttgatggagctgaaaaccatggcaagagaactaggtgatgcatgcacaagcttcagtacccgattcaatcaagtggaagaaagggtatcagtgattgaagatcaaaagaatgaaaggaagccagaagagaagtttagagaaaaaagaggaaaaagaacgaacaaagcctctaagaaatgtgggactatgtgaaaagatgaaacttacgtctgattggtgtacctgaaagtgatgtggagaatggaatcaagttggaaaacactcttaagaatactatccaggagaacttccccaacctagcaaaacaggccaaaattcaaattcaggaaatacagagaatgccacaaagatactcctcgagaagagcaatcccaagacacataattgtcagattcaccaaagttgaaatgaaggaaaaaatattaagggcagccagagagaaaggtcgggttacccacaaagggaaacccatcagaataacagcggatctctcagcagaaactctacaagccagaagacagtgggggccaatattcaacattcttaaagaaaagaattttcaacccagaatttcatatccagccaaactaagcttcatcagtgaaggaaaaataaaatactttacagacaagcaaatgctgagagattttgtcatcaccaggcctcccttacaacagctcctgaaggaagcactaaacatggaaaggaacaaccagtaccagccactgcaaaaacattgtaaagaccatcgatgctaggaagaaacaacatcaactaacgagaaaaataaccagctaacatcataatgacaggatcaaattcacatataataatattaactttaaatgtaaatgggctaaatgctccaactaaaagacacagactggcaaattggataaagattcaagacccatcactgtgctgtattcaggagacccatctcatgtgcagagacacacataggctcaaaataaagggatggaggaagatctaacaagcaaatggaaaacaaacaaacaaaaaaagcaggggctacaatcctagcctctgataaaacagacttacaccaacaaagatcaaaagagacaaagaaggccattacgtaattataaagggatcaattcaacaagaagagctaactatcctaaatatatatgcacccaatacaggagcacccagattcataaagcaagtcctgagtgacctacaaagagacttagactcccacacaataataataggagactttaacaccccactgtcaacatgagacagatcaacgaaacagaaggttaacaaggatatccaggaattgaactcagctctgcaccaagcagacctcatagacatctacagaactctccaccccaaatcaagagaatatacatttttacagcatcacacgacacctatcccaaaattgaccccatagttggaagcactcctcagcaaatgtaaaagaacagaaattataacaaactgtctctcagaccacagtgacatcaaactagaactcaggattaagaaactcactcaaaaccgctcaactacatggaaactgaacaacctgctcctgaatgactactgggtacataacaaaatgaaggcagaaataaagatgttctttgaaaccaaccagaacaaagacacaacataccagaatctctgggacacatttaaagtagtgtgtagacagaaatttatagcactaaattaccaccagagaaagcaggaaagatctacaattgacaccctaacatcacaattaaaagaactagagaagcaagagcaaaaacattcaaaagctagcagaaggcaagaaataactaagttcagagcggaactgaaagaaatagagacacaaaaaacccttcaaaaaatcaatgaatccaggagctgggtttttaaaaagatcaacaaaattgatagaccactagcaagactaataaagaagaaaagagagaagaatcaaatagacgcaataaaaaatgataaaggggatatcaccaccgatcccacagaaatacaaactaccatcagagaatactataaacacctctacgcaaataaactagaaaatctagaagaaatggataaattcctggatacatacaccctcccaagactaaaccatgaagatgaatccctgaatagaccaataacaggccctgaaattgaggcaataattaatagcctaccaaccaaaaaaaagtccaggaccagacggattcacagccgaattctaccagaggtacaaagaggagctgctaccattccttctgaaactatcccaatcaatagaaaaagaaggaatcctccctaactcattttatgaggccaacatcatcctgacaccaaagcctggcagagacacaacaaaaaaagagaattttagaccaatatccctgatgaacatcgatgcaaaaaccctccataaaatactggcaaaccgcatccagcagcacatcaaaaagcttatccacagggtggagccaagatggccgaataggaacagctccagtctacagctcccagcatgagcgacgcagaagacaggtgatttctgaatttccatctgaggtaccaggttcatctcactacggagtgccaggcagtgggtgtaggacactgggtacagcgcaccgtgcacgagctgaagcagggcaaggcattgcctcactccggcagcgcaaggggtcagggagttccctttcctagtcaaagaaaggggtgacagatggcacctggaaaatccagtcacttcccatcctaatactgcacttttgcaacgggcttaaaaaacggcacaccaggagattatatcccacacatggctcggagggtcctacgcccacggagtcttgctgattgctagcacagcagtctgagatcaaactgcaaggcagcagcaaggctggaggaggggtgcctgccattgcccaggcttgatttggtaaacaaagcagccgggaagctccaactggatggagcccaccacagctcaaggaggcctgcctgcctctgtaggctccacctctgggggaagggcacagacaaacaaaaagacagcagtaacctctgcagacttacatgtccctgtctgacagctttgaagagagtagtggttctcccagcatgcagctggagatctgagaatgggcagactgcctcctcaagtgggtccctgacccccgagcagcctaactgggaggcaccccccagtaagggcagactgacaactcacgcagcagggtactcctctgagacaaaacttccagaggaacgatcaggcagcagcatttgcaggtcaccaatatccactgttctatagccaccgctgttctgcagccaccactgctgatacccaggcaaacagggtctggagtggacctctagcaaactccaacggacctgtagctgagggtcctgtctgtcagaaggaaaactaacaaatagaaaggacatccacaccaaaaacccatctgtatgtcaccataatcaaacaccaaaagtagataaaaccacaaagatggggaaaaaacagagcagaaaaactggaaactctaaaaagcagagcacctctcctcctccaaaggaacgcagctcctcaccagcaatggaacaaagctggatggagaatgactttgacgagctgagagaagaaggcttcagacgatcaaacgactccgagctacaggaggaaattcaaaccaatggcaaagaagttaaaaactttgaaaaaaaaattagacgaatggataactagaataatcaatgcagagaagtgcttaaaggagctgatggagctgaaagccgaggctcgagaactacgtgaagaatgcagaagcctcaggagccgacgcgatcaactggaagaaagggtatcagtgatggaagatgaaatgaatgaaatgaatgaaatgaagtgagaagggaagtttagagaaaaaagaataaaaagaaacgaacaaagcctccaagaaatatgggactacgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacaccacaaagatactccttgagaagagcaactccaagacacataattgtcagattcaccaaagttgaaatgaaggaaaaaatgttaagggcagccagagagaaaggtcgggttacccacaaagggaagcccatcagactaacagcggatctctcagcagaaactctacaagccagaagacagtgggggccaatattcaacattcttaaagaaaagaattttcaacccagaatttcatatccagccaaactaagcttcatcagtgaaggagaaataaaatactttacagacaagcaaattctgagacattttgtcaccaccaggcctgccctaaaagagctcctgaaggaagcactaaacatggaaaggaacaaccggtaccagccactgcaaaatcatgccaaaatgtaaagaccatcaaggctaggaagaaactgcatcaactaacgagcaaaataaccagctaacatcataatgacaggaccaaatttacacataacaatattaactttaaatgtaaatgggctaaatgctccaattaaaagacacagactggcaaattggataaagagtcaagacccatcagtgtgctgtattcaggaaacccatctcatgtgcagagacacacataggctcaaaataaaaggatggaggaagatctgccaagcaaatggaaaacaaaaaaaggcaggggttgcaatcctagtctctgataaaacagactttaaaccaacaaagatcaaaagagacaaagaaggccattacgtaatgataaagggatcaattcaacaagaagagctaactatcctaaatatatatgcacccaatacaggagcaccaagattcataaagcaagtcctgagtgacctacaaagggacttagactcccacacaataataatgggagactttaacaccccactgtcaacattagacagatcaacgagacagaaagttaacaaggatacccagaaattgaactcagctctgcaccaagcggacctaatagacatctacagaactctccaccccaaatcaacagaatatacatttttttttagcaccacaccacacctattccaaaattgaccacatagttggaagtaaagctctcctcagcaaatgtaaaagaacagaaattataaaaaactgtctctcagaccacagtgacatcaaactagaactcaggattaagaatctcactcaaaaccgctcaactacatggaaactgaacaacctgctcctgaatgactactgggtacataacaaaatgaaggcagaaataaagacgttctttgaaaccaacgagaacaaaggcacaacataccagaatctctgggacacattcaaagcagtgtgtagagggaaatttatagcactaaatgcccacaagagaaagcaggaaagatccaaaattgacaccctaacatcacaattaaaacaactagaaaagcaagagcaaacacattcaaaagctagcagaaggcaagaaataactaaaatcagagcagaactgaaggaaatagagacacaaaaaacgcttcaaaaaattaatgaattcaggagctggttttttgaaaagatcaacaaaattgatagactgctagcaagactaataaagaaaaaagagagaagaatcaaatagatgcaataaaaaatgataaaggggatatcaccaccaatcccacagaaatacaaactaccatcagagaatactacacagacctctatgcaaataaactagaaaatctagaagaaatggataaattccttgacacatacaccctcccaagactaaaccaggaagaagttgaatctctgaatagaccaataacaggatctgaaattgtggcaataatcaatagcttaccaaccaaaaaaagtccaggaccagatggattcacagctgaattctaccagaggtacaaggaggaactggtaccattccttctgaaactattccaatcaatagaaaaagagggaatcctccctaactctttttatgaggccagcattatcctgatacgaaagccaggcagagacacaaccgaaaaagagaattttaggccaatatccttgatgaacattgatgcaaaaatcctcaataaaatactggccaaccaaatccagcagcacatcaaaaagcttatccaccatgagcaagtgggcttcatccctgggatgcaaggctgcttcaacatatgcaaatgaataaatgtaatccagcatataaacagaaccaaagacaaaaaacacatgattatctcaatagattcagaaaaggcctttgacaaaattcaacaacccttcatgctaaaaactctcaataatttaggtattgatgggacgtatctcaaaataataagagatatctatgacaatcccacagccaatatcatactgaatgggcaaaaactggaagcattccctttgaaaacgggcacaagacaggatgccctctctcaccactcctattcagcatagtgttggaagttctggccagggcaattaggcaggagaaggaaataaagggtattcaattaggaaaagaggaagtcaaattgtccctgtttgcagacgacatgattgtatatctagaaaaccccatcatttcagcccaaaatctccttaagctgataagcaacttcagtaaagtctcaggatacaaaatcaatgtacaaaaatcagaagcattcttatacaccaataacagacaaacagagagccaaatcatgagtgaactcccattcacaattgcttcaaagagaataaaatacctgggaatccaacttacaagggatgtgaaggacctcttcaaggagaactacaaaccactactcagtgatataaaagaggatacaaacaaatggaagaacattccatgctcatgggtaggaagaatcaatatcgtgaaaatggccctactgcccaaggtaatttatagattcaatgccatccccatcaagctaccaatgactttcttcacagaattggaaaagactactttaaggttcatatggaaccaaaaaaagagcccacatagccaagtgaatcctaagccaaaagaacaaagctggaggcatcacactacctgacttcaaactatactacaaggctacagtaaccaaaacagcatggtactggtaccaaaacagagatatagatcaatggagcagaacagagtcctcagaaataatgccgcatatctacaaccatctgctctttgacaaacctgagaaaaacaagcaatggggaaaggattccctatttaataaatggtgctgggaaaactggctagccataggtagaaagctgaaactggatcccttccttacacctgatacaaaaattaactcaagatggattaaagacttacatgttagacctaaaactataaaaaccctggaagaaaacctaggcaataccattcaggacataggcataggcaaggacttcatgtctgaaacaccaaaagcaatggcaacaaaagccaaaattgacaaatgggatctaattaaacttaagagcttctgcacagcaaaagaaactaccatcagagtgaacaggcgacctacaaaatgggagaatatttttgcaacctactcatctgacaaagggctaatatcaagaatctacaatgaactcaaacaaatttacaagagaaaaaaaaacccatcaaaaagtgggccaaggatatgaacagacactcctcaaaagaagacatttatgcagccaaaaaacacatgaaaaaatgctcatcatcactggctgtcagagaaatgcaaatcaaaaccacaatgagataccatctcataccagttagaatggcgatcattaaaaagtcaggaaacaacaggtgctggagaggatgtggagaaacaggaacacttttacactgttggtgggactgtaaactagttcaaccattgtggaagtcagcacggcaattcctcagggatctagaactagaaataccatttgacccagccatcccattactgggtatacacccaaaggattataaatataaagacacatgcacacgtatgtttattgcggcactattcacaatagcaaagacttggaactaacccaaatgcctaacaacgatagactggattaagaaaatgtggcacatatacaccatggaatactatgcagccataaaaaatgatgagttcatgacctttgtaggaacatggataaaactggaaaccgtcattcttagcaagctatggcaagaacaaaaaaccaaacaccacatgttgtcactcataggtgggaattgaacaatgagaacacataggcacaggaaggggaacatcacactccagggactgttgtggggtggggggaggggggagggatagcattaggagatatacctaatgctaaatgatgagttaatgggtgcagtacaccaacacggcacatgtatacatatgtaagaaacctgcacattgtgcacatgtaccctaaaacttaaagtataataataataaaattttaaaaaaaagccttatccaccatgatcaagtcggcttcatccctgggatgcaaggctggttcaacgtacacaaatcaataaatgtaatccagcatataaacagaaccaattacaaaaaccacatgattatctcaatagatgcagaaacggccttcaataaaattcaacagctcttcatgctaaaaactctcaataaactaggtactgatgggacgtgtttcaaaataataacagctatttatgacaaacccacagccaatatcatactgaatgggcaaaaactggaagcattccctttgaaaactggcacaagacagggatgccctctctcaccactcctattcaacatagtgttggaagttcgggcagggcaatcaggcaggagaaagaaataaagggtattcaattaggaagagaggaagtcaaattgtctctgtttgcagacgacatgattgtatatttagaaaaccccatcatctcagcccaaaatctccttaagctgataagcaacttcagcaaagtctcaagatacaaaatcaatgtgcaaaaatcacaagcattcctatacaccaataacagacaaacagagagccaaatcatgagtgaactcccattcacaattgctacagagaataaaatatctaggaatccaacttacaagggatgtgaaggacctcttcaaggagaactacaaaccactgctcaacaaaataaaagaggacacaaacaaatggaagaacattccatgctcatgggtaggaagaatcaatattgtgaaaatggccacactgcccaaggtaatttatagattcaatgccatccccatcaagctaccaatgactttcttcacagaattggaaaagactactttaaagttcacatggaaccaaaaaagagcctgcattgccaagacaatcctaagccaaaagaacaaagctggaggcatcacgctacctgacttcaaagtctactacaaggctacagtaaccaaaacagcatggtactggtaccaaaacagagatatagatcaatggaacagaacaaagttctcagaaataataccacacatctacaaccatctgatctttgacaaacctgagaaaaacaagcaatggggaaaggattccctatttaataaatggtgctgggaaaactggttagccataggtagaaagctgaaactggatcccttccttacaccttataaaaaattaattcaagatggattaaagacttaaacgttagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgcacagcaaaagaaactaccatcagagtgaacaggcaacctacagaatgggagaaaatttttccaatctacccatatgacaaagggctaatatcaagaatctacaaagaacttaaacaaatttacaagaaaaaaatcaaaccaccccatcaaaaagtgggcaaaggatatgtcttctcaaaagaagacatttatgcagccaacagacacatgaaaaaatgctcatcatcactggccatcagagaaatgcaaatcaaaaccacaatgagataccatctcacaccagtaagaatgggaatcactaaaaagtcaggaaacaacaggtgctggagaggatgtggagaaataggaacacttttacactgttggtgggactgtaaactagttcaaccattgtagaagacagtgtggcaattcctcaaggatctagaaccagaaataccatttgagccagccatcccattactgggtgtatatccaaaggattataaatcatgctgctataaagacacatgcacacgtatgtttactgcagcactattcacaataacaaagacttggaaccaacccaaatgtccatcaatgatagactggattaagaaaatgtggcacatacacaccatggaatactatgcagccatataaaaggatgagttcatgtccttcgtagggacatggatgaagctggaaaccatcattctgagcaaactatcacaaggacagaaaaccaaacaccgcatgtgctccctcataggtgggaattaaacaatgagaacacttggacacagggtggggaacatcacacaccagggcctgtcgtggggtggggggaggggggagggatagcattaggagatatacctaatgtaaacgatgagttaatgcgtgcagcacaccaacatggcacatgtatacatttgtaacaacctgcacgttgtgcatgtaccctagaacttaaagtataattaaaaaaaaaagaaaaaagaaaaaaaaaagaaagggaaaatattgccacctcctgtcaacaggagaaatagaaaacaacttatggcatctttaatcaatcaaaataactaaaaagttaatagagaagaaaataatgacaaactaacaatatttaattaccaccaagaaagggaaaagggaggggaaaatacaggaagaacagatcagataagtagaaaacaaacagcaagatggtagccttaagcccaatgaatacagtaattacaataaatataaatggtctaaacatgctaattaaaagacaaagattatttagaattatgcaaaattaaatccaactgtattttgtttacaagagacacaatttaaatataagggcacaaaaagatgaaaagtaaaagaataggaaaagatgtcatgtaggtactcaccaaaagaacactagggtagctataacaatataaaataaaatgttctttcagacaagaagtactgtaaaatatacgaaatatctattgaagtgatcacatgctttttgtcctttattctgttaatgtggtcatcgcatttattgatttgtatatgttgaaccaccttgcacacaaaggataaatctcacttgatcattattttaatgtgctgttaaattcagtttgctagtatttggttgaagatcctattcatctatgttcatcaggggcattagcctgtaattttatgatagcatcctcatctggctttggtatccaactcatgttggctttgtaaatgaggttagaagtatgctctcctctttaattttttgaaagagtttgaaaagggcagattattatttcttctttaaatatttagtagaattcaacagcaaggtcatcagtgaattcaacagtgaagccatcctgggcttttctttgacgggaggttttttattactgatccaattttcttactcattattggtctattcatattttctatttcttcatgattcagtcttgggaggttacatgtatctaagaatttgcccatttcttctaagttatcctatttattggcttataattgttcatagtagtttcttattatcttttgtatttctgtagtatcagttgtaatgtctcatctttcatttctgattttatttatttgagtcttctttttttttttttttgagacactttcactcttgttgcccaggctggggtgcaatggcatgatctcagctcactgcaacctctgccccctgggttcaagtgattctcctgcctcagccttccgagtagttgggattacaggcatgtgccaccatacctggctaattttgtatttttagtagagacgaggtttctccatgttggtcagtctggtcttgaactcccgacctcaggtgatccgcccaccttggcctcccaaagtgctgggattacaggcgtgagccactgcaccaggcctacttttacatttttgtttatttatttatttatttatttacttttagagatgtagtctcactatgctgccaaggctggactcaaactcttgggctaaagtgatctttctgcctcagtctcccaggtagctgagactacagacgtgtgccaccacacctgattttcttgtttttattagttagtctagttaaagatttgccaattttgtttatcttttcaaaaacccaactcctggttttgttgatcttttctattgtttttctagtttttatttcaatcatttctgctctaatctttatttccttccttctgataactttggtcttagtttgttcttctgtttctagttccttgaagtgtaacattaggttgtttgagatctttcttgttttgtgatgtaggcatttattgctatgaaattcccctttagaattgcctttgctgcatcccatacgttttggtatgttgtgtctccattttgtttgtctcaatatattccttaatttacctttaaaggtcacatatgacaagcccacagctaacatcatactcaatggtgaaaagttaaaagtttcttctctaagatcaggaacatggatgcccctgcttactacttgtattcaacatggcactggaagtctcagccagagaaattaggcaacagaaagaaataagacatacaaattgaaaaggaagatgttaaattgtctctgtttccagatgacatgatcttatatacagaagaccttaaagactcttatcaaaaaactgttaaaaataataagcaaatttagtaaagttacaaactcaacatacaaaaatcaatggtgtttctataaaccaaagatagaaagttcacaaaggaaaagtaaaactgtcatcattcaaagataacatgactaagaaaatccaaaggaatttataaaaaagcaattagaggccaggcacagtggctcatgcctgtaatcccagcactttgggaggtcgaggcgggcggatcacgaggtcaggagttcgagaccagactgaccaacatagtgaaatcccatctctactaaaaatacaaaaattagtcaggtgtggcggcacatgcctgtaatcccagctactcgggaggctgaggcaggagaatcgcttgaacccaggaagcggtggttgcagtgagctgagatcacatcactgcactccagcctgggtgacagagcaagactccacctcaaaaaaaaaaaaaaaaaaaaaaaaacatggagagaaatttaagatccaaagacatgggccagctgtggtggttcatgcctgtaatcccagaactttgggaggccaaggtgggtagatcacttgagctcaggagttaagagaccagcacgggcaacacggcaagacaccccatctacaaaaagtacagaaagtatccaggcatggtgacccatgcctgtagtcccagctatttgggaggctgaggcaggagaattgcttgaacctgggaggtggagatttcagtgagctgagattgtgccactgcactccagcctaggcaacagggtgagactctgtcttaaataaacaaataaatatacacaaatagaccaatgcaacagaatagacactatagaaacactttacatatatgattacatgatttaaacaatggcaccacagcaattcattgtgaaaaggatggtattttcaaaggtatttgatcagttggatatccataagaaaaaaatgaactttgtacctctaagtatacacaacaattaatttgagatggatactatatatcaatctgaaactaaagcaattaagcctctagaacaaacataaggaaaatatcttctgactaggttagacaaaatttcttaaacaggacccagaaagcactaaccatgaagaaaaagtggtggctgggcatggtggctcacctctgtaatctcagcactttcggaggccaaggtgggaggactgcttgaggccaggagttcaacaccagccttggcaacatacctagaccctgtctctacaaaaaattaaaaaattagccaggcatggtagtgcacacctgtagtccaaacaggaggctgaggcaggaggattgcttgagcccaggagttcaaggttacagtgaactgtgatcatgcaactgcactctagcatgggcaaaagagtgaaaccctatcaaagaaagaaaaaaaaaagaaagaaagaaaggaaagaaggaaagaaagagaaaaagtcacaaattggactttattaaaattaaagacttcttttcattaagaacatcttagaggaacgaggcaagcctgggagaagatattcaacacatatagtatttaacaaaggacttgcattcaggatgtatgaactcctccagagaatacttataacgtaatagtacaggtaatagatcttggcggtttgaagatggagaggagaggtaaagaaaagggtagggatactttgttctcatcatatataatgggaagtcaagtgattctatgtcagcctgatggaacaagaaactaagacttaaatattctttaaaccaataaggtaataaaatagaggaattaaaaaaaaacatgatgatactgggaggggagataagcagggctgtggagggtaagtaacctaccctctcaattatctttgcagaaagccaacagattacttctaaagttaataaaagataattgtacacgcacattatttagaagcatggaagtaactactagaagatctacaataaaaatagttaaaaatgggccaggcgcggtggctcacacctgtaatcccagcacttagggagggagaggtgggtggatcactaggtcaggagttcaagatcagcctggccaagatggtgaaacctcatctctactaaaaatacaaaaaactcagctgggtgtggtagtgggcgcctgtaatcccaggtactcgggaggctgaggcagagaactgattgaacctgggaggcgaaggttgcagtgagccgagattgcaccactgcattccagcctgggcaacagagcaagactccatctcaaaaaaagaaagttaaaaacggttgcttttagtgtatgagggtgaaagaaagtaggatggggtaaaatatttatttttcataataaattattctatattacttattaaagaagtactcatgttactttgattaaaatatttaattttttaaaatccctacatttacattactataactatgcaaataattcacttctacagccaagcaatgtgctaaaactatgcatcctttttttagaagtcacccacttgactgtatctagaatcaagatgctgtgtctagaatcaagagcaaatgtattctcttcacatcttagaacaattttaatctgtcatatctgaaccatgactttcacagttagctctttttcagagtttctaacctcttttttctaaatccagcctctgtcatactttctattgcatggggtaccattttcctcccatatataaccctcttagaggcactcaatatcctgatctaatttaaatttattactatttttgttttcttcaggttctatcttttttttctttctttttctttttgttttgacattattggttttccctaaaagtgaaccttgggtgtggtggcacgtgccggtatcccacctactcgggaggctgaggcacgagaatcacttgaactgggaggcgccaaaattacaccactgcattgcagcctgggagacagagcaagactctgtctcaaaaaaaaaaaaaaaaaaaaaaagaggtggttggagaagatcaccagacaggaagtctagcttctggtctttgttcagagtcagcatggtcttcaaagagggttagatgctcaggccagcctctcaggatcagcacaaatcatgcagtggtgaacagacttgggtgtcgtttcccccaggtgtgggtgaaattcctagactagaccagatatcattgggtaaaaggtgtgcctgtttaacatttggataaatatcactattgtccaacatacagaagtttctgtccacaccacctcctctcagaacaagaatgcctatttccccatgccctaaccaactcatatttttaagtattttattaattttttgactaggtaatgtttgcagatggcacaaaatttaaaaaagtagggaagggcatgcagtgagaggtctccacattcccgtcacagccatcccagtcctgtccccagaaccacaaactttgatctcagcctttctggtaaatggaaagtggtatctcactcaataaatctcacaattatgtgggaaaaaaaaagtgaaccttggttgtccattaatacttaagaatgaaagtctgtgtcagtttttctaggcgctagtacgagtatcttttgttagtattctgtctacccagtgttctcactcaggagtgggaaaattgcctgggggcttcatgacatgagtggagtaagtaattaccaggctttctctaatgggtatcgtcaagtagccagctattaagcagggtgtctctcaaataccaaaattaagaggcaacacaacaaaattaagagggtttcactgtggaatgccaaattcatgctagaactagctttctcagatagttcatttgatttttcatttttcatttttttttaaaaaagagataagactccagggtttctttgtgtcttttttgcctaatagtatgtatctgtctacaagcagatttgtgactagcagtaaacatccacctacctgcagctcttggtctgcaaaagactggagacaactggcacagctgccccatatacagaccttcaattaacccctgtcttcagtccttctccttccagctcttttaaattgttaactccaaattcatatcctctctggggttccaatggcaaaccaattccctcattggaacccctatgaaatgtgtctaggcaagtgtttctacagtttttccaaaggatgctatcatctatttttagttttccaaaaattagataaaatttttatctgctcatgaacccccttctctttgttatggattaaccttctacacagtgtcgtttcaatggggttctggagagatagaaggtgaaaatgtgtcctccgtctacacacacacacacacacacacacacacacacacacacacacacctctttatttacatggcttctctgctgaagctccttcaagggcaaggatgtattctgaaatgcctagcacaatgtcaggaacacaacagctagtcaaaggtgtgtggctggttggatgtgagagaaaatagctgcaaacgatagaaaagcttacgcctagatgatgtgtatgtcaatcaaaaccaactaaggaagaataagttttaaaagaagattagctgggtataacagtgctcggctatagggcaagttacttgggaagctgaggttggaggatcacttgagcccaggagtttgagaccatcctgggcaacatagtgagatccctgtatcttaaaaaaacacatattattttagtgttagaaatcaacatagttataccccagcataggttttatggccttggtagaggcaaataatgaagcaactttacaaaatgggattaactgatacaaaggtggtcttgtaagccataaaacctttgtatcagtgtgtgctagaaacagagccatattacttcacttaaaattaccaggcacagagtcctgctgctatcagagagaaaagagtgaggtcattttacctcttggctctcacccaaccagataattcaacttggaatattccttacacctataagaccagctctacccttataaaagcacaagtgaccacgacattaacccggatatagtgtattattaataaacttgaagctcctcgagaataagtactcaataaatatttaatgagtggctatattcctaacatctgctcacaatgctggttcctcagtcaagaaataaagtgttgagaggtgaaaggcaaataatcttattaatgatactttcattgatagccattataaaagtgcctggcccagatcaggaactcaataaatatttgtgcagctagtgaaataattgtaactttttgaaatgttaaaaaagtctgctttgttgttgttgttgttgttgttgttgctgctgctgctgcccaggctgaagtgcaatggcgtgatctcggctcatcacaacctccgcctcccaagttcaagtgattcttctgcctcagcctcccgtgtagctgggattacaggcatgcgccaccacacccagctaattttgtatttttagtagagacagggtctctccatgttcgtcaggctggtctcaaactcccgacctcagatgatccgcctgcctcagcctctcaaagtgctgggattacagtcgtgagccaccacgcccggccaaaaagtctgctttttaaagtgaagaatggcacacaattctgcaagtatactaaaagctactgaattgtacactttatataaaaagtattgaactggctgggtgcagtggctcacgcctgtaatcccagcactttgggaggccaaggagggtggatcacctgaagtcaggagttcgggaccagcctggccaacatggtgaaaccccgtctctactaaaaattcaaaaattagccaagcatggtggtgcacctgtaatcccagctactggggaggctgaggtgggagaattgctcaaacctgggaggcagaggctgcagtgacccaatatcatgccactgcactccagcctaggcaacagagagagattctgtcttaaaaaaaaaaattgaactgtacactttaaattttatgacataaaaattatatttcaataaaacttctaaataaactcacaaggaaacttttccaggcctgctgaatgactctggcagccttatcctgctttgtaaattctgattcctctttccaaggcatttgaaattcctaaaagaaaatgagcaaaaagggtacatttaaaataattttaatttactttcatttttatttatttattttttttagagacacattcttgctctgtcacccaagctggagtgcagtggtgcgatgatagctcactgtagcctcaaactgctgggctcaagtgatcctcttgccttaacctcctaagtagctgggattgtaggcgtgcaccatcacacctggctttctttttttaattattatttttttgtagagatggggtcttgctatgttgcccaggctggtgtcaaacaccttctggcttggcctcccaaagtgctgggattgtaagcgtgagccaccgcgcccagcctaaaattattttatatgctctattataaaactaccactagaactcaatgaaaattaaatagagttgtataaataaaacaattaaaataagattttgtatcaaaataataaaaataaaaatagtcaccttcttattttttaagagacagagtctttctctgttgccttggctagaatgccatggcaggatcataggtcactgcagccttgaactcttaggctcgattgctcctcctgcctcaccctcctgagtagctgggactacaggcacatgctacgatgcctagctaatttttaaaattttttgtagagacaggttcttgctatgtttcccaggctggtcttgaattcttgtactcaagcgatcctcccacctctgcctctgaaagtgcttggattacaggcatgagccactgcaccaaaagtagtcagcaattattggtgatttaatatgttctaatttgtatatttttttctagttccagcaacaaccctgcataacagattttgctaatatgcttgtgttagagatgaggagcctaggctttaaggcctaaggtcaaatagtgagtaactaaaccagttattgaattcaagtttatcttgaaagtccatgacttttacataccctgttgtatgacttcaaataaacctttcttaacgtgcatagagacagagttgcatccacaaaattgcgcaggtccctaacctaaaattagaccttatgtggtcaaatataaaaggaaaaaaaggtcatgcactgaatacagggagaaacatggatttttacttagtcttaagagttattaatacttcacagaataatgtcactcattacatttacagtagcaatatggttctgacatgctttatcataatccaaagtgaacaaattttgcttaaaagcttaaaattctgggctgaatatagtgactcatgcctgtaatcccatggttttgggaggccaaggcaggaggatttcttgaggccaggagttcaacaccagcctgggcaatatagcgagacccccatctctacaacaacagcaacaacaacaaaaagctgggcaggttggcacatactgtagtcctagctacttgggaggctgaaacaggaggatggcttgagcccaggagttcaaaactgcagtgagctatgattgcaccactgcactccagcctgggccacaaaatgagaccatgtctctaaaaataataaaaatgtaaactctgaattggtgcatgtaaaatgcaaaacgtgtaaggatttacaaatcccaaagccctgacctatttaaacatataacatacatctactaatgtttagaaagacagaggctaaacagaaaactttcaaaaaggatacgccattcataagaaaaatgtatttatatatttctcaacttgccatttttcccttttgacgtttaaagttattcagatgcttaaaactaaaggtgttttcttcctaatttggtaaattgttgttttttaaattcacatttttaagagttgggagaaggttcgctatgaaaaaaacttatgtcttttttgctttccctacaaatagccttattaatataggaggcatgggaagacaggttaagtctttggactctgaggcaagatagaccagggtttaaatctcaacaaattctacctcattcttagctgcatgattttgccgaagttacttaactcactcaaacttcaagttactcatctgtaaaatatggggactcattgtacctaactcatagaattgttaggattaagtcagataacacaggtaaagcatttagtatagtttctgacccaccatagccactcaataaatcatattattataatacaaactattttccaaaataaaaactattcatgtgcattattccagttaggaaactgagataacattttaagtacaattattctcttaatttacaaataactgttagcacaaatgagattaaggaatgatatttcaggcctaaaagatttgttaattttttttttttttttttttgagacagaattttgctctgtcacccaggctggagtgcagagacatcatctcagctcactgcaacctccacctcccgggttcaagtgattctcatgtctcagcctcctgagtagctgggattacaggtgtgtgccaccacgcctggctaatttttgtatttttagtagagacagagtttcaccctgttggccagggtgggctcgaactgctggcctcaagaaatccacccgccttggcctcccaaagtgctagcattacaggcataagccattgcgctcagcggcaacaatttttgtaggatagtttttacaagtggaattgctatgacaaaaggtatgcacatatatatttctgttttttgtttgttttctgagacggagtctcgctctgtcgccaggctggaatgcagtggagcgattttggtgcactgcaacctccgcctcctgggttcaagcgattctcctgccttagcctccccgcgatttccactcactgcaacctccgcctcccgggttcaagtgattctcctgcctcagcctcccaagtagctggcactacaggtgtgcaccaccgtgcccagttaatttttgtattttaagtagagatggggtttcaccatgttggtcagaatggtctccatctcttgacctcgtgatccacccacctcggcctcccaaagcgctgggattacaggcatgagccactgcgcctggtgcacatatatatttgaattgactctctctggaaagggatatgagaaattactaagaatgattgtctctaggaagggacctgtggactgaggagcctgggttcggaaagggaagagatgtttttgttccagtatactcttttatgctgttggtatttttccacaatgtgcatttagttcagatatatacaatataacttcattaaaaaaaacagcgtgcatattgaaacctaacactgccaaactgtcctcaaaaatggtgtctaatttatgcccataaacattctatgggaatgcttgactctaaattttagaaaagtaaaaaactaaacgtaaattagatattaggattaaaatgggtcttttaatactttccaagaactaaactgtgagattttttacctgttatcaatgtagtgtgtgtgttatttaacgtgacagcattagcattaattcatcacaatttcatcattttcccaaatacattcccaattttgtaggtggaaatttaacactggatcttaaaaatcccttgaaaatcctgaaccagtttattgaatactttgatctaaataattttacacgggctttctgcatacacctgcttcctgcttctctagtgacataggctaaagggtgtttagaagctgccaaaaaagtatgtcataaatgccaccattatatgtttatgaatacacaaaatatagaggaaatatattccagcattcaaaattatctgattcagaaataaacaatgaagttccacaatttcaagaaagaacatattcaattgtgtcaaatattgttgcaagggcaagtaaatacagaggaaaaaaagggagatttggccagataaagtcactagtgactgtacaggcactgcttcagtggagtaagcagggaaggaagtttgggttgggttgaggaagtgggaaagttgagacagtaagtacagtagtaattctttggagtgctgtaagggagcagaaaaatggggtgtagctagagagtgagaatggattaaaggtttttttttaaaaaaaaaaggctgggcgcggtggctcacgcctgtaatcccagcactttgggaggccaaggtgggcggatcatctgaggttgggagtttgagaccagcctgaccaaaatggagaaatcccgtctctactaaaaatacaaaattagctgggtgtggtggcgcatgcctgtaatcccagctactcaggaaggctgaggcaggagaattgcttgaacctggcaggcggaggttgcggtgagtcgagatcatgccactactccagcctgggcaacaagagtgaaactcggtctaaaaaaaaaaaaaaacaacaacaacaacaaaaaacgacagattctaaagcatgttaaaatgtaccatccagtagtgagggagaaattaaagtgacggagaacttaaaggggcaaaaaaagggataagttaaatggtaaaacctttgagtaggtgtaagaggacaccatctggagcagaaaggagggtgggaccgttgctggctttagataagaaataagatcgactttatatggttattatgatgctccagataaaataaccattgtgaaaacccttcataagttttaagatactaaaatgtactaccaggccgggtctggtggctcaggcctgtaatcctaacattttgggaggccaaggtgggcagatcaccttaagtcaggggtttgagaccagcctggccaatatggtgaaaccctgtctctagtaaaaatacaaaaataaactgggtgtggtggcgcacacttgcagtcacagctactcggaaggctgaggcaggagaataacttgaacccaggaggcagaggttgcagtgaactgagatcacgccactgcactcagcctgggcaacacagcgagatgccttctcaaaaacaaacaacaacaaaaaactaaccaaataaaatgtactatcaaacaactgctcaggcaatgaagtattttactacacccatgtgccacttgtagattcacagataagtattttccaagcttattatatccctaatcaataaaattttttatcataatagatgatgttttcacttatttatttttacgcttcgtggaaaaaagcccacaagacgtgtttggattcttggtttcacttttaaagcagcaaacaatctttactttgcttgaattggaacctgtatacgtcctattttgtttcctctactaaatttattgaataaacaaatgattcgcgtggcctttataagtttcgtaatttcgcttttcctttttacctgtggtccttgatgctaggggcaggagaagaaaaactaacctattctttaaaaacgcgtttcccttttccatctctaaaaaaactgaaaagacgtaaaacaaatgggagggggcaaaggaaagaaatgaggaaaaatctaaggaagattaatgtgtacttcccggtcagcgggaaggtggacggagtaatatctttgcggaggattggggtgtggggatctgtgaaggcgcagtatgagcagtaaggacttgtcaaccagcccgacgcaacttcaccgagggcgaggaaaggagctctgaggaaggggttactcccgggcaggactgtaaaccagctggaggcctcgctgggagggctttagaggaatgaaacgtccttaagaggggcggatggggaatggtatcaagggtatgggttctttagggccttgaaacaacgaaggctcaaaccagtgggcacaaaggctaccggaacagtagtacgcgctgagagaagggacactattcccttcacctaccaatcgctgctggcccgggcgccgctggactcctaggtaacgtcgcaggcggaaatgacgt

SEQ ID NO: 1557 - DNA, 3058 bp, Homo sapiens
  source 1..3058: mol_type = genomic DNA
gccactcctgctgggcagcccacagggtccctgggcggagggcaggagcatccagttggagttgacaacaggaggcaggtgaggccagagtcccagagggagggggctgcagagttctgggacccaggggagctggcccaggaggctgggcagctgaggcagggagggagggaaataactgtgcctgattctaggacagggatgggggtgcagcactgatccaggacccagaatgggtgagtggagggaccttaactccttgagccagggcttgggggagggtgagaggcgatgagttagacctaacaactgaagggtaagaccagggttcctgggtcctggccccataacacataagaaaccaggaaaagcctggggtgctagagctggcagtgggacccagcagaggggactgtaggggcagccagtcacccatgctcaggtggatgctgaaaggcgctgagcatgcagaagagtgagcaggtgtcgctttgggcgtttgtgaattcctgtgtgtatgcagagctccaccatctgggtgagccagtgttaattaaataaggagcaggcgctcaatacatatttgttcaatgaaatcgattacctgtgggagtgtatgaatgtgtgtgtccgtgcaagtgagggacagggtctatttgggtatcagttgtgtgtctaggggggtatagtggatttctgagtttgcctactgtgttttgtaggtgcgtggatgagagctgtgtttgtgtgagtgtgtgaagatgtgggtgtgctctgttgcatgtgtggatgtgtgtgagtttgtggttctgtgtatatgcgtggggtcctggggctggattgagagtggacattgagagccccagagggtgcatgtgcacttggggaggactgtgcatatatcattgtgtgcatgggactcaagggtgggagctgggtgtgagtgtgatgtccaacctgcccaggccctcccgtgtctccacagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggtaagcacccttcctcgggacccagccccttggaccttggcctgacttggcctccagggtgaaggcttggggtggcactgagaatcaggagtccgtctgcccccagtgccccatgaatcctctccagtttgtacttggccacaggggctaagggaggcctagccttctcgggccatgtcctcaggcctctccactccctgtgtactgcctgggccctctttcttcggcttcaccttccccctctggagaatgacttgctttgaccagtgaaagtgaaagttctggcagcaatgctgagtccttgttcatgtttctcttgccagaaaaacgaggactcagagtttagactcaggagccactgccttgctgtgtgacctcaagcaagttattggccctctctgagcctaagtgggctcatctgtaaaatggaaaaataacactgcctggcacatagagagggatcaaataactgaatctgtcccttcacttccttccagcacccccaacactgtccctgcttccccctccccagccccttcaggcttcagagactcacattctagaagaaaggccaggggtaatggaaaagggaagaggtcctgaccaaagtagaaagggagtctcatggaatcaccctgggcctcctagtccaaagcagaccagaaggatcacatagacatttgcagtaatttgcatccgggcatcctacatgtggtacctgaacctgaagccaagtcaaggtcagtgccccagaggggtatgaagtcctcagccttgggcaggaacacagcagagcagccagagttccatgcatttcccagaacctgacactttcccaagtgcctgttcacacttctctccactttacagatgaagtggaggctcagagaggttgagacacttgcccaaagtcacacagccaatcagaatcgatgtcctgaaggcccaggtgcttcattgccctttatcccatagactcagggggtccagctctctccctgaggaccagtaggcattggactctcacttccaatctggcatttctccccacaggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaacatgagcttcagttgctactcggagcattgagagggaggcctaagaataataacaatccagtgcttaagagtca

SEQ ID NO: 1558 - DNA, 8348 bp, Homo sapiens
  source 1..8348: mol_type = genomic DNA
gcccttcccgcctctggggaagggaacttccgcttcggaccgagggcagtaggctctcggctcctggtcccactgctgctcagcccagtggcctcacaggacaccagcttcccaggtgaggacggggcttggcgcctgggggaggctggcagggccaatatggcagaaagtggtgattccgtaagtgtgagctttgcgtcacctgcctcggagccagttaggctgtttaacagtgcaggtagctgggcccaatcccagacctatgggacccagatctctggggtgagttggggagtctgctgctacccagggcctagcggatgggcaggccacctaaagcgggagcctggcacataggagctttggcatcgcagagacttgagctgagtctggctctgcaccttatgtattggttatcttgggcaagtcacctaacctctctcagcccggcccccctacagagaacagaatctttcagcactgctgtgccttacaggagatcaagcttgcaaaagcttagtgcatgccctggctcaaaatttatcagtaaaccagaggcaggagtgggattataagccagtcgctcctgcccggcccagcatttccccaacaccttgcttatttcctcatactcgctgagaaagctcagcttgactcttccaaagaaataaggggatgtgcaggtagagttacgatgagttctcagctagtactgagtgagcgcaatgtttgtgcagctggggagtgggatgtggcactgcacggggcaggggggaccttatttcttctaagcgccttctcctgtcatccttctggcagccctgtcaggttgaaatcagcattgccaagaggctcagagaggttaaggcacttgcctgaggttatgcagccggtagcagatggggctttaaagtcaagtgggcctgactccatgttgcggaaagggactgctggaccgaaggagatggaaaggtcagagcctggggggaggacaggagaaaccgcgctggcaatgatgatgggctggcacaggcaggaggcagttaaaccagatgagttgtaagccctaacccaaggctgaaactcggtggcttttgaaatgggctagaaccagcactttcccactccccctgcccctggcttccccaggaagcccaagtcctgtcagtaccctgctccccaccctctctccccaccaactggtcacagctctccaccccttgctgcctccaactgacagagcccctccctctaaacacagtctttcaaagggattgtctttttttacttctccaaccatcttcccttctgttcaaccactcaggaattcttggatgacagtgataataataaaatagctaatattcattaagaatttccaacatgccaggctctgttggaagctgtaactcatgtcctcgcacataccctatgagggagagagtagcattatccccactttataggagggtaaactgtggccagagagaaggagtgatttcccaagtcccttagctaagaagcagtagagaccttatgtgaacgctgagtgttgctttccttgtgacactacaggctcccgccaccaggtgaatgtgtgctgcctaacaagagcagcaatcatcgtggtggtaaaaagccactttcaccgaacactgaccatgtgcctaccactacccttggtgtgtcccatgcattagtccttttatcaggctgtctggcttcaaagtttatgtttttaccaccaggtacagtggcctcttaacataacattgagttttaagatccagtggatgtgggtttgactcccagccacacaggagctgtgtgacttttatcaaggtgcttgccctctctgatcccgttgcctcatctgtaaaataagaaagcaagagtgcattctcaggggctgaatatcaaattacaggggataatggcatgcaagccatctggctcagagcctggcctatacgtacccaacttattaaagttgttaaattgccattttgtaaaacctttagcaagagcaagagtgagagctgatgcttattcatggataagcaggaccatgcccctgagccaccctgtcttcagagcatagagcctgacagaacctaaagctgtcaccagcattccctggccacactcatctttacagcttcctttccttggtgcacagtgtctggcataactcagggctttcagcaagaaattgatcaggactaggctgaggggctgaggctggtttgcagagcataggagccaaatatcagtaggccttgtctggtcccagggagccctccacatgccagactctggggttgggacagccagcatgtggcagagagggtaggagtttggccacaaccctgctgttagaatagtttgctgggtgatttttgggtaggttgctttctaagttccgatcctcagtttcctcatctgcaagatgggaaattaatcacaacccacttccccagggtgttgagaggatcagagaacagcagcaatagcagtagcagccacaagtcccaatgagagcttggggctcaaggctttatgactctttcccatccatggtctcacctgggtccctgtggccactctgggaagtaggcagagaccactctgctcccccattttaagagaggatacagttcagcctctgaggaaaggtttcctggaggaagaaggctttgacccaagcttcgaatgaagaaaaaacatttggatctgggcaaaggtggaatgggctgcctcgagaggtaatgagctgcccatcactgaaacggtgcaaactatggatggaagagcccttggcagagatgtcatttcctcacactctgctgagaaagttcagcttgactcttccaaggaaataatgtgatgtgcagctagcgttgtgattagttcttagggctgagtgaacacaacgtttgtgcagcaggggagtgcgttgaggcaccacacgggggaccttggcagaggtgtcattgaggaaacttaagaataggctgaagggtcctcaggaacttaaacatggaattgccataagcggtaattcctctcctgggtataaaccccaaagaattaaaaacagatactcaaatccttgttcacaaatgttcatagcagcactcttcacaatagccaaaaggtggaaacttcccaaatgtccaccaatgatgagtggataaacaaatagccaagcgagatggtgcgtgcctgtaatcccagctactcaggaggctgaggcaggaggatggcttgagctccagagttcgagaccagcctgggcaacagagtgagaccccatctcaaaaaaaaccaaaaaccccaaaaccaaattgtagtgtgtaagtggaaggtctgtaagtggaaagacacaaacggtattttcctctgctctcacaccacaacaatcaacacagaagacttctgtgaccaaatgtggggggtttctccccacacaccaagcaagcaatcaaatctgctgggtgtctttccactcagttctgacactgtctaggaatagcatcagaccccacaggctgagagctcagtcccacaagactgctccccctcagacaccatttgcaagtccaggcccccagaacttctgaccaatcagcttcaagttggggttctcacaaccccctgcttgggtttggattctttgctagagtggcccacagaagtcggggaaacacgtttacaagtttattataaacaatactataaaggatacagatgagatgctcagggtgaggtatgagggaagaggcgtgccactgtcatgcccaggtccctgggcatgctgcccccgaggaacctcctcgtgttcagctatttggaagctctctaaacctagttctttgggatttttatggaggctttattatgtaggcacgattgattaagccattgaccattggtaatcaatttaaccttcagccccactcccctccccagaggttggggggtggggctgagagtagaccctctaagcctgccttggtcttcctggtgacgagccccatcctgaagctacctaggggctggcagccatcaatcaatcattagcatacaaaaatacctcactttggaaattctaaggattttaggagttgtctgccaggaaagaggtagaagaccaaatatatactttgcaatatcacatgtacccatacaatggagtattattcagttataaaaaggaatgaagtactgatacatgctacaacatagaaacatggatgaaccttgaaaacattaccctaaatgaaatgagtcagacacaaaaggtcacacgttgtataattccatttatatgaaataataggaataggtaaatccatagggacagaaagcagattcatggttgtcaggggctgggggaaggaggattgagaagaaactgcttaacgggcatagagttttattttggggtgatgaaaagtcttggaactagatggaagtgagggttgcacaagactgtgaatgtattcaataccactaaaatgcttgctttaaattggttaattttatgttgtaggaatgttgcctcagttaaaaatatataggctgagggttaaactagatgaacttaaaggccactttgtcctgagagctaatggcatggaacactggccatgctgaccagtttgagacagcccaccggcttcttcctagttctttgggattaaaaaggggccatcactgccctcttgccagagtcacagctctgagaatattctaccagcagaaacagcctggtatgctggcagggacatcggcttcattccttcctgtatgactctgagcaagtgacttggcctccctgagcctcagtgtcccctttggtgtaggaatcacagtagatgcagggatgctctaagcatgcaaggtggcccgttcataagcagcatcataccctgaattcagaagctctactgaataagagctttcggggaataaaaccccaaactcatagtagcttagttgcctctccactcttgcttcctgtcacttgaactcttgctcccctctgtcatactggcctcctgctgatcctcaacatcctaacctctgtcctgcctctgggccttctccatattctctgtcctcctggaacattcttgcccccaccttttctggaccttcaggtctcagcctaatcatcacttccaagagtggcttccccttggagaagactttcctggtgggaggacttccctcacaaaacccaccacctcccacctccagcccagttactctgcctcccagcatccttctctttctttcagagcaccaatcacggtctatcactatttctatttactttatgctgacccatttatatctacctgtttatatctgtccccactaggggcacaagtccaggagggcagggactgtatccgtcttgttcttcactgaatccccagcaccttgcacagagtctggtagataggggacaatcagtgaacatatggatggaggaatggatggatggagggacagatggaggaatagagggatggatggatgaacggatggatggatagatggacagagggatggagggatgcaggggcagaaggatggatggatggatggatggagggtggatggatggacagatggacagagggatgcagggatggaaggatggagggatggatggatggacagcaggatggagggatggatggatggatggatgcagggatggaggggtagagagatggatggatggatggagaggaggatggatggatggatgcagggatggacagagggatgcatgggtggatgaatggatgcagggatggagggatagagagacagatggatggatggatggatggatggatggatggatggatggacagggggatggagggatggatgcagggatggaggatagagagatagatggatggatggatgaatggatggatgcagatagagggatagagagatggatggatggatggttggatgcaggaatggagggatagagagatggatggatggatgcagggatggagggatagagagatggatggatggatggacggatgcagatggagggatagagagatggatggatggatggatggatggatggatggatgcagatggaggaatagagagatggatggatggatggatggatggatggatggatggatggatggatgataggatcaccacggtggtaacctctcacattgtcttctccacaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaaggtaccatgggatttagcaggacactggtaatactgaccaaatttcccgtctcctgcctcccaagtcacagttgcctacctttgagactgcaaaagcactggcaaatccagcagcttgctgaacccttgcagtaactttgcaaggagggaattctgattcccattttacagagaggaaaactagcatctagaaagtctgctgacttactcaaggtagcccagtaaatgttgaggctaagaccagaccacggatctcttaccattaaattcaggtggagagggagtgccgctgtggccacagagtcctgtgtttaaacttacctcctgggcaaatgacttctctctgaattgctatttcctcacctgtaagatgggggcaatggtacttttttggggttgtcatggggttcaaatgagactcccagccttgaaaacccctctgtaaaatttggtttattcattcatttaacctaccgttatagagcaactgtctgtgccagtcactctcctcacataatctcatctaatccttacaatcccacaaaatatcttcatccccatttcacagatgaggaggctgtcctcaggaaatgtgactcagtcaaggtgacaccactactaatggcagatgtgacacgcaaagcacatctctctgtccccagatcccatcttctcaggccctattctctgccactctactggaaaatcggtcttatcttgtgttgtgccaaaccaaggggtagtggctgcttggggggtggagtgagaaggagtctaaagtccatttccaggagcagcaagagtgaaggccatggttgattagggatgtctgccaggggtgagggatagagggagacagcactcattatccctgctctagctgaagaaggacccccacacaagctggggaggagggccggcctagcaccttccttagcaaggagccattcccctccccacgatcagcagcccccaagaaggtcaagcatatcacagactcaggaagctgggctggagggagacccagagcccctgcctgacactgcctccttcgttttacagatgggagactgaggctcagagagaggcagggccctgcccaaggttccagcgcaggcctccttcttttggtctcagtgatctcacttctttggtctctgcttttccagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccaaccaatgcacacagtagggcttggtgaatgctgctgagtgaatgagtaaataaactcttcaaggccaaggga

SEQ ID NO: 1559 - DNA, 4486 bp, Homo sapiens
  source 1..4486: mol_type = genomic DNA
gaccactcagacaccgtgtcctcttgcctgggagaggggaagcagatctgaggacatctctgtgccaggccagaaaccgcccacctgcaggtgaggcccggacccctgcccaggtatgggcagatggccgtttcctccaccttccgccaccttcctgaaatgtggtgccaggggcagcttggtgtgtgaggggaaggagggttcccactcctgctgggccccggggcctgggctgaagaaaaggccccaccatccatccatggtgaggctcctgggggaggaaggaaggcgagctcccgagggctgaggaggacgggccctggggaatgagagggttgggggcaggtgaggggctggcggggacagctcagctctctccctcccagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggtgagtctgctggcctggtttgggggtttgggtctggggcagggatcagagtgtctgtctggggctgaccaagggggcgggggacagcaggaagtgcttgccttgctgccacgcctgccccagggcagaggtggactctcacggtgtgtctggctcctctatcctcagagcccaggcttcaggccaccccagaggtgaccttgggcccagcgcacttccatcttccttctcctccttacccgattatagggagggaataagagcgcctgcccccaaaggtggccaggaggctcacaggagacagtgcagggaaagtcttcttgccctgcaacatgggcacctggggaagctggggcccacacagtgaatatatccaatgcacgactgccagggttcaaatcccagcccctactgattccctctatgtgaacccgcacaagttacttaacctcgcagtgcctcagtttcctcatctgtaaaacgaggagatggtagcacctgcttcacaaggttgctgtgaggattaagttaacttaaatataaaacagccctgagcacctgggaggtctatacaggtgtaggctattttatcattggttttatcagatatccatgctcacctccctccttaggattctggatagttggaggggtggggagtaggaggtcaggatcgcagccagagaaacttctgttggaggtccacaggcaatccttggcataagagaagggggctgaggctatgaatgggtgactggggctggaactggagccctggggggtatgagtgccttgtctgtgagtgagctgggcacgtctcagatgctaggcatgcctggagccggcctggggtgacactgagcggaggtgatggggtgacagaggcagtggaaaggagggaggccagttgagaggaatgtccttaggagtggtcccaccatcatcttccctcctggatagagggaatggcaccaacattccagaaggaattctccaatttagggtgagcttagggtgagctcaaagctcaatgaggcctccaggtctgccattttccaggagcttgtacttcacagctgcctctgaccacctccctgcccagggtagctgatggccacccgtgattgagcccccaagtcccaggtgtggtctcagttttaggaaatgataaaaccgaggccacaatcccttgaaaaagtgattgaccctcattttgcaaatgtcaaagctggggttcagagagattgagcaacttgtccaaagtcacacagtgggatcctgtccaactctcaagtccacattctccaccactgccctcagctgcctctcaagtcccctctgtattgctgtttcctggccccctctcaattggtggtttgaagacatcacgaaggatgagacgctgctctgctcagcatcactggcagccatcacgaggaccagacactccagagcacgcttcctatggtgtgcctggcacagtgcctgtcccactccaccctttcagggactccctcttctattatgcccgtatctcaactgagcaaatacaggctcagggagggaggtcacccacccagggtcacagatgtgaaggccaggtctgctgggtcccgaccccacactcctaatgctgaggcctaagaggttcataagccatagaggatctgtcataaatgggtctgcacagtcacccagcctgacggaagtcagaggaggaaaggaaacatgagggctgatgggagcggtcaaggagggcttcttggaagaagaaactggagtcagcccttaaaagatgagtatgatttagataaggggagaagaatctcacagaggctcagatcatcagggctggaacagagtgagacactgggattctccagacttgagttagagacctgactccacctcaaactggctgcacggccttgggcaagtctctaactcggcttcctcatcggcaacatgagggaagttgaaccaggccagctgtcatgggggctgacgtgggctgaatggggctggggtgagctggagagagcaggccctgcagtggggcggcttctattcggctccttccagtggttcccatgtgctaacctggggaatccatctcaggagcagatataggttttgtgggactctgaagcttgtaaaatgttgagggtcttctttatgaaaaataatacaaactgaaagatgcgcttgattgcagaggtgagagtggttacaaaaatttacacatgtagcaaaattatattggaaccacacacacagtgtatataaaactggtgaagtctacataagctttgtgaattctaggaatgtcagcttcctggttttgacattatactttagtcatacaagctgtgtcactggggaaaactgggtgaagagtccctgttcttttgtttcttcaactttctttgactctatatttcaaaataaaaaagttgaaaaaaatcagaaatacaaaattaggcaaaaggtcttgaaggggctgatgcaagtggacagaacctgaaacttaagctgcctctgaccaaccttctgattttttgtcaagaaggtctgagaatttcaaattttaaataagttctgaatttgttcatgttgggctccaattaaaaattttaaaaaacattgtgcaggccaaacaagatacttgtggccacatgccatctgtccgtgggctgacagtcatggcatctgtgatcccgcccagctctgagctccctacttgcttcatcacaaatgtggaaactgaggccaagagacagggaagtgccttagacaaggtcagagggcaggtcagtggagaagcaggacttgaaccagactctctctctcccctccagccaaagcctaactccctgcaccctgctcctagggagatagcccatctatgagaaggagattctagagaccaaatgccagcgctgtgttccctggaagacaccctcagggtccctcctccctgtcccccaccctatcactttctctctgccttctccatctccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagccccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaatacata

SEQ ID NO: 1560 - DNA, 4486 bp, Homo sapiens; identical to SEQ ID NO: 1559
  source 1..4486: mol_type = genomic DNA

SEQ ID NO: 1561 - DNA, 12224 bp, Homo sapiens
  source 1..12224: mol_type = genomic DNA
cttgggcaggagggaccttcgatcctcggggagcccaggagaccagaacatggtgagtctcgaaggggaatgggagcaggaaactttgtcctgggtccctcccatctttgctccagtgggtccttctctctccccaactctcgccgtcaactctgtctgtctctccctttccttctctctccctgtcttccacctcccaccttccctctctcctgcatcccaggctctcacactccagggctgggatgtggccatgggaataagattgtcaagattgtgggagcaacagcaacctcgtggggctggggcccgagaagattccccaggggaggggacccttgagttgggtctagtaaggtgactaagaattccacaagcagccgagcgcagtgggtcacacctgtgatcccagcacattggggattgtgccaaggcgggaggattgcttgaggccaggagttcaagaccagcctggccaacatagtgagaccctgtctgtatttttttttttatttaaagaattccacaagtgaagaaatctagaacaggccttccaggcagtgggaatggcagagaaaatgttgggaggctggaaagaaccagtttggaggaatggtcaagttactcagatgctcttgcagatagatgttcttttctttttcgacttggggtcttgcactgttgcccaggctggagtgcagtggcaccatcatagctcactgcagtcttgaactcttgggctcaagtgatcctccctctttagcctcctgagtatctgggaccacaggcatgcaccactatgtccggctaatttttaaaatttttattcttgtagagatgggttcttgctatgttgtcagggctggtctcaaattcctggcctcaagccatcctcccaccttggtctcccaaagctctgggattactggcatgaggccattatgcctggtcgtttgagatgttctgcatgacagagatggggaaactgaggcccaggcaggagcagagatggatggggaccctccatggttggtggcagaagcaggttatgccatggattctgtgagtgtcagaaggaatgcaccccaggctaaatgagggtccctgtcatccctgcgtctggaggcctgggcactgagccagcagagctgcgattcagcacctgctgtaacacaggcattgccttgcttcatctgtgtcaaagaggaaacggaagatggtttggatggaccagggaggggtctgatgttgcttcattcctgcattccacccttgagatccgacttgggcaaacgggactctctgattcttcttcttctttttttttttctttccaaaacattttccaaagtaccaaatgatacttggtaaaaactcattctcggccaggcgcggtggctcatgcgtgtaatcccagcactttgggagactgaggcgggcggatcacaaggtcaggagattgagaccatcctggccaacatggtgaaactccgtctctaccaaaactacaaaaattagctgggcatataagcgggcgcctgtagtcccagcacttgagaggctgaggcacgacaatcgcttgaacccatgaggcagaggttgcagtgagccgagattgctctactgcactccagcctggcaacagggccatctcaaaaaacaaacatagaaaaaaaaaaactcattctccctgcctaccccagagcctctgactccttttctttccttttattttgagacagagtttcactcttgtcgcccaggctggagtgcaatggcacgatcttggctcaccacaacctctgcctcgcggcttcaagcaattctcctgcctcagcctcccgactaggtgggattacaggcatgcgccaccacgcctggctaattttttgtctttttagtagagacggagtttcaccatgttggccaggctggtcttgaactcctgacctcacgtgatccacccacattggtctcccaaagtgctgggattacaggtatgagccaccctacctggccctctgactccttttcattgcctcctaccctacctggggcaaccatgggatgccagtttgtggtggatccttccagaaacagtttacagatgcctgagagcacagatgcttagggaacaaagtaaggactagtgtgatgcggggaaccccaaaaccgagctcagcttctgtctctactatgaaatagttgcggagatctgtcctctccgtgcttctgtctccttatctttttgttttttgagacagtgtcttgctctgttgcccaggctagagtgcagtggtgtgatctcagctcactgtaacctccacctcctgggttcaagtgattctcctgcctcagcctcccaggtagctgggactacaggtgcctgccaccatgcctggctaatttttgtatttttagtagagacggggtttcaccgtgttggccaggctggtcttgaactcctggccccaagcaatcttcccgccttggcctcccaaagtgctgggattacaggcgtgagccatcgcacccagcctccttctccttatctttaaggtgaagataatactagaatctacatcataggctagttgagagaattgactgagtgaatgcatgaaaagttcttgtagcagtgcctggtatacagttggcgctcaatgtgggtgacatttctatcctttcccagccttataaatggcagtatgttttgtacagtactctacatctggcttttttaaatgaataacatatagtattattaactagcatttattgagtgcttactgcataccaggcgttgtattaggcattcattaatttccccttaaccttgaggaaggtacttcattcccgtgtagttcaagggagttgcctcctcctcctcctcctttttttcttttttctagacagggtctactgaggtcttccacctcagcctcctgagtaggtgggactacaggtgcatgccaccacacccagctagatttaaaattttttgtagaggtggggtcttgctatgttgcccagcctggtgcttctttctttcttttatcagctgagtaatatgctagtaggaggtttcatccccttcaatggaaatttagtttgcttctaatatttggtctgttttgttttgttttgagacagagtctcgctctgtcacccagcctggagggcagtggtgcagtcttggctcactgcacctctgcctcctggattctggtgattctcctgcctcggcctcccaagtagctggtatcacaggtgcgtgccaccacacacggctaatttttgtattttattttagtagagacgggatttcaccatgttggccaggctggtctcgaactcctgacctcgtgatccacccgcctcagcctcccaaagtgctgggattataggcgtgagccaccgcgcctggcgtccagccacattctttaactcagcatctgcagaccttccagtcctatcttggccgcctgccagccatgctgacctttcgtttctgctgtgcaccacctgcccttcctctctcctttctgcctagaatgcatgcccccccactcccaatgcactttaggcctgcctggtagccactcaaacagagggctctgggctgggcgcggtggctcatgcctgtaatcccagcactttgggaggctgaggtgggtggatcacgaggtcaggagatcaagactatcctggctaacacggtgaaaccctgtctctactaaaaataaaattagccaggcatggtggcgggcacctgtagtcccagctactcgggaggctgaggctagcaaatggtgtgaatccaggaggcggagcttgcagtgagctgagatcgcgccactgcactccagcctggggacagagcgagattccgtctcataaaaaaaaaaaagagagagagggctctggggctcagctctcaggagtttctctcctgtctctgttcttgctaaccgagaagacttggagaggtctgttcatttctctgtagcctcatttttctcttctggaaaatgagtgttgctgttgcaacaagtaagtctcctagggttgctttgtgggttcaatgagataatacacgagaaaggctcaggacagcctggcaatgattatggctgttcttgtaggtactgcgccttctccttcaccctgttctcatccgatcgttcacatcttgcggccagcacccttgtctaagccaccgtcatgcctcacgtcacctggacagttccaatctccgtttcctcccagcttctgctctctgcccctttctccatgcaacagacaagggttgttcctctaatgagcatgtgaatttaggaagaataatagtaccctgccctttgtgctattgtcacatagatatgcactgtgattaggaaattactaagccaacacctgggaagcacatggaatagtgccgggcaattagaacccccagagtggccctggacctgcactgcccaatatgtgggccacgtgccacaatgcagctacctacgtttatttttcactattttattttattttactttatttattttatttttgagatggagttttgctcttgttgcccaggctggagtatagtgaagcgatctcggctcactgtagcctccacctcccgggttccagtgattcttctgcctcagcctcccagatagctgggattacaggcgcacgccaccactcctggctaatttttgtatttttagtagagacagggtttcaccatgttggtcaggctggtcttgaactgctgacctcaggtgatccacccgcctgggcctcccaaattgctggaattacaggcgtgaaccaccgtgtccagcctattttattttttagagatggagtctcgctatgttgcccaggctggagtgcagtggcacgatctcggctcactacaacctccacctcctgggttcaagtgtttttcctgcctcagtctactgagtagctggaattacaggtgcctgccatcacacccagctaatttttgtatttttagtagagacggggtttcactatgttggccagtctgggcttgaactcctgacttcaagtgatccaccttccttggcctcccaaagtgctgggattacaggcgtgagccaccacgcctggcctcaccctagatcttggaggtctttccacatcattatataaacattctttttgtctgtttttttcctttttgtagggatagggtcttgctaggttacccaggctgatcttgaactcctgggctcaagcaatccccctgcttcagcctcccaaagtgctaggattacaggcatgagccactgcacctggccaacttttccattctttttgatagctgtgtagtattctgttgcctggatgtaccatcattaatttagccagtcccctcttgctggacatgtcagttatttccagtctttggagaggtgctgcagtggcaaactttgcaagccgtttgcgtctgaagatcccggaaaccacaggacgttggaatcagcgtattttttctgcctttctgaagtcaaccagaggaaaggactgagtgagctcatggcaggaacggagctttgtcagctgatgagggagtgacaaggcgatgtcagagcagagggtggggaggctccccttacgagggtctgagtcattctgcagtcaaggattgctgggagcttgcgaaaccagcagaggcaaaatttaccttcatgcgtcacagccaaagggaacattcaaaatatttaacaatgtgctaaagtgcagaggtcccctgggcagggtctagggcctcctgctgcacctagcattaactctttagtgacatgaacatggcgacctggagtgggggtgtcccagagtaggaaacaggaacttagggtgctgggagcgggcaatagaagaagtgggtggctgagggcaggggctgtttaccagtgaaaatatttttaaaaatgttaaccttctatttggaaatattttcaaacttacggaaaaatgacaagaatggaacaggctcatatacatatacattttacctagactctccaaatttactgtatctgtctctccattatccatccatccatccatccatctgtccatcgattcatccatccatccatccatccatccatccgttatctagctattttttttttttagacagagtcttgttctgttgcccaggctggagggcagtggcgcaatcttgactcactgcaacctccacctcccaggttcaagcgattctcctgcctcagcctcccaagtagctgggactacaggcacacaccactgggcccagctaatttttttgtacttttagtggagatggggtttcactatgttggccaggctggtcttgatcttctggcctcaagtgattacaggcatgagccaccatgcccagcccattatctatgtatctatcatctatctatctatcatctatctctcaatcatatctccatgtatccattgtctgtccatcagtcatctatctgtccatcatccatgcatccactcattcacccattcgttatctatccatccgtttatttatatccatccatctttctatcacctttttttttttttgagacagagtcttgctcagtcaaggctggagtgcattggcatgatctcagcttactgcaacctccgcctcccaggttcaagtgattctcctgcctcagtctctggagtagctgggattacaggtgcgcgccaacactctggctaatttttgtatttttaatggccttttgtgactggcttctttcacttagcatcatgttttcaagattcatccacattgcagcatgtgtcagcacttccttttcatagctgagtaatattccaccacgtggctaaaccccacctttttcattcactcattagcagatactgacatcttatctttcaataatttactcatggatatgattccaccagtaaatgcccactgcccatagcctggctaaccttgggcaggtgcaatgtaagggaactagaaaaaaaaaaacaaaactatccaggcatggtggcttacatctgtaatctcagcactttgggagttcaaggcaggagggttgcttgaagttaggagtttgagaccagcctgtgcaacaaagcgagacccatctctaccaaaaaaaaaaaagaaaaaaaatacaaaaattagctgggtgtggtggtgcacaattgtagtcctagctactcaagaggctgaggcaggaggattgcttgagccagaggggctggggtgacagtgatccatgattgcaccactgcacataagcctgggtgacagatcaagaccccgtctcaaaaaaaaaaaaaaaaaaaaaatataaaacggggctgggcgtggtggttcatgcctgtaatcccagcactttgggagaccaaggccggaggattgcttgaacccaggagttcgagaccagcctgggcaatacagtgagaccctcctctttaaaaaaacattaaaaattagctgggcacagtagtatgcacctgtagtcccagctgcttgggaggctgaggcaagaggatcacttgagcctgagaagtcaaggctgcagtgagccaagatcacacccctgagctacagcctgggtgacagagtgagactcagtctcaaaaaaaaaaaaatatatatatatatatagtggttcagggatgtggatctgagctcttcaataactgacaaataataataccaatggctgccacttcttgtcctcttctctgtgtcaggcgctgtgctaggtgcttaggcatttttcatcttatttaatctttgaggtgagtgttttaaaggtagaaaaaccaggccgggtgtggtggctcatgcctgtaatcccagcattttgggaggccaaggcaggcagatcacgaggtcaggagttcgagaccagcctgaccaacatggtggaaccctgtctctactaaaaatacaaaaattagcagggtgtggtggcaggtgcctttagtcccagctactcaggaggctgaggcaggagaatcgcttgaacctgggaggcagaggttgcagtgacccgagatcgtgccactgcagtccagcgtggcgacagagtgagactccatctcaaaaaaaaaaaaaaaatgtacaaaactccatctgcaaattcaaatatttagagctgcaaatacagctctcagtatttccagaatgatttctatttcttgctgtccccttttctctgggttggtgtcaaagtggccttcaggactgggctagctccataggtcacaaaactcacctcttggaaatggtcaggggcagcctgtctggtttgcattccagcccgtatgggttcacatcctctctgagtgacctggaacagcctacttcaccttctggtgcctcgtgcttcttcatcagcgaaatgggcatttttttttctttcttttttttttttgaggtggagtctcactctgtcgcccaggctggagtgcagtgtcgctatctcagctcattgcaacttccacctcccaggttcaagtgattctcctgcctcagcctcccgagtagctgggattacaggtgcccgccaccacgcctggctaatttttgtatttttagtagagacggggtttcaccatgttggccaggctggtctcgaacccctgacctcaggtgatctgcccaccttggcttcccaaagtgcttgggttataggtgtgcaccaccacacctggcctgaaatgggcatattaacagaacctccttgtaggttgtggtcaggatggaaagagcaaattccatgccgcatgcatagtaggtgctcagtaagtactggctgctttcgggtgatcactcagtgccctgatgggtgctttactgcagtgtctggtgcctctggacacagatttcacctacaaggctttctccagtccagctgccatggactgcagcctttctttcttgggtgcatgacagcttccttcagctctgtctgggaagaagtgatcaggacctttttgttctatttttttttttttttttttttttagatggagtctcactctgttacccaggctggagtgcaatggggctgtttcggctcactgcaacctctgcctcctgggttcaagcaagtcttctgcctcagcctcccaagtagctgggattacaggcgcccactaccacgcctggctaatttttgtatttttagtagaggcggggtttcactacattggtcaggctgatcttcaactcctgacctcgtgatccacccacctcggcctcccaaagtgctggattacaggtgtgagccaccgtgcccggccagtagggctagactttgacgttaggctgctggatcgtggggaagcccaggggcttcgcaggatgggactgaggggagaggtggcagactggcaaggggtccaactagcatggaatcatttcattttttttttttttttttttttgagacagggtctcactctgtcacctaagctggagtgcaatggtatgatctcggctcactctaacctctgcctcctggggtcaggtgatcctcctacctcagcctccggagtagctgggactacaggcaagtgcaaccacgcctggctaatttttgtattttcagtagagacggggttttgccatgttgcccaggctattctcaaactcctgggctcaagcagtccgcccgcctcggcctcccaaagtgctgggatgacaggcgtgagctacggcatctgcctcaatattttaataagtggtgtgacaccctagttgactctcagccctcagcatccccatttcctagtgagaaaaagccacacaggggaaaagccacatgcctgagccaggatgccccctacccgggcacatgtctgcagactcatcctctctgctctctccgattccccttaggactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggctggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacggggataatgatgtccttcctggagccatcgtcacccaccttcctgctgctgaagaagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtaggcgacagcctcatgggccactgtggcccgatgtccccttccttcccggccattctccctcttgttttcacttcacttttcgtgggatggtgttaccttagctaactaactctcctccatgttgcctgtctttcccagacttgtccctccttttccagcgggactcttctcatccttcctcatttgcaaggtgaacacttccttctagggagcaccctcccaccccccaccccccccacacacaccatctttccatcccaggcttttgaaaaacaaacagaaacccgtgtatctgggatatttccatatggcaataggtgtgaacagggaactcagaatacagacaagtagaaagattctcgcttaaaaaaaatgtatttattttatggcaagttggaaaatatgtaactggaatctcaaaagttctttgggacaaaacagaagtccatggagttatctaagctcttgtaagtgagttaatttaaaaaagaaaattaggctgagagcagtggctcacgcctgtaatcccagaactttgggaggctaaggtgggtggatcacctgaggtcaagagttccagaccaggctggccagcatggtgaaaccccgtctgtactaaaaatacaaaaaattaactgggcatggtagtgggtgcctgtaatcccagctacttgggaggctgaggtgggagaattgctcgaacttggaggtggaggttgtggtgagccatgatcgcaccactgcactctagcctgggtgaccgagggaggctctgtctcaaaagcaaagcaaaaacaaaaacaaaaacacctaaaaaacctgcagttttgtttgtactttgtttttaaattatgctttctattttgagatcattgcaaactcaacacaattgtaagtaatgatacagagggatcttgtgtacccttcacccagcctcccccaatggcaacatcttgcaaaactacaatgtagtctcataaccaggatattgacattgatacagtgaagatacaggacattctcatcaccacagggatccccaggatgcccacttccctccacccccacaccccagccgtgtccctaacccctggcaaccaggaatccactctccatttctataatgttgtcatttcaagaatgttattcaatggaatcatatagtatgtaacctgttttgagcttaaaaaaaaagtatacatgactttaatgaggaaaataaaaatgaatattgaaatgtt

SEQ ID NO: 1562 - DNA, 137800 bp, Homo sapiens
  source 1..137800: mol_type = genomic DNA
ttcaggttaggaaggcggcaagggctcaaggcctggcaagctgttcacaaacaaagggtcgaaacaaagaaataataatacattttaatgcaagagaaatcatagcctggtacacaccccttccccgatctgtcctgcctggggatgtgtttatggtgagtgtgtccccaggactggtagtcacctggctgtccgggtccccgccctactggcggcagcatgcctgtccccagcattacattcaactgctgctctggctctcgagaggccggctggcctcgggcctccggcttggcgttctttgctcccctgtctccctgctaaggccagcagggccaaactgctaggccaggtcagccagggctgggggaatgggctgtaccctgctcctccccaggcacgactgtccccccggggctccatcaccgggtggggcggagcgtctgctggggcagctctgtgggccacaggatccccccgcacccactgcatctctctgcccagggtgcctgcctcataggatgccccgcgccacagagtctctctgcccagggcgcccgcctcacagctggtcctcgtccacccagatggtcttgcgctgctcctcgccgatcttgtccttgacaacgcggagcagctcctctacgctgccccacatgtcaggttccaccgtggcgtacaggcacggcagggcctccagctccttctccttcagccggcacacgcgcaggaactcctcctccgtctcaggtcggggcagcagctttctgggaggagacacgcaggggctgtggggaggctgcaaggccgtggcgctggtgtggcaccacctgtccggccacccctgactgccgtggtccccaccccttccctgccttgcttctccctatagcgtccgtgcctcttaacgctagggaccgtgccccttcatgctgttcatcggaaattccaaatacatccttattgattgattgattgattgagatggagtcttgctctgttgcccaggcttgagtgcagtggcactttcttggctcactgcaacctccacctcccgggttcaagtgattctcctgcctcagcctcctgagtagctgggactacaggcatatgctatcatgcctggctaatttttatatttttagtagagatggggtttcaccctgttggccaggctggtcttgaactctcgacctcaaatgacctgcctgccttggcctcccaaggtgctgggattatgggcgtgagccaccgctcccggccacatcctttttatttttaattgtgctaaggtacgcataaaataaaatcaaccatgttacctattctttaagtgagtaattcagtagcatgaggtatattcacaccgctgtgcaaccaatctccagaactttctcaacttcccaaactgcaactctgggcccattaaatactcactccccatcttccctccggcagcccctgagaaccacccttctacttgctgtctctaggaatctgactgctctagagacctcacagaagcggaatcacatacagcatgtgtgtttttgtaactggcttatttaactgagaatgacaccctcaaggttcatccatgttggagtgggtgtgagaatctccttccttttcaaggctgaataatactccactctatgggccgggtgcggtggctcaggcctgtaatcccagcactctgggaggccgaggcaggaggatcacttgaagtcaggagttcgagaccagctggccaacatggtgaaacccaatctctagtaaaaatacacaaattagccaggcatggtggtgggcacctgtaatcccagctactcgggaggctgaggtaggagaatctcttgaacctgggaggtggaggctgcagtgagccgagatcgtgccactgcacttcagcctgggtgacagagtgagactccgtctcaaaaaaaaaaaaatactccatacagtatttttgttgtgatacacactgcaccataaacacattcccaggcaggacagatcagggaagggggtatgtaccatgctagtatttctcatgcattaaatgtattattgtttctttgtttcaactctttttttgttaacagtttgcaaggttttcagctcttgccaccttcctagcctgtatggatgggccctattgtgtgtattcactccccacagaccgacccttaggtgacgtctacgttttggctattgggagtaacgctgctgtgaacacgggcgtgtatatgtctcttacagaccctgctctcaattctcttggggatatgcccgcaggtggggttgctggattatatagtattctatttttaatttttgggggcatcgccatgctgtcctccacagtggccgctctcttttgcatttccagcagctgtgcaccgggttccgacgtctaccctcctcgtcaacacttgtcagtttctgtccttttggtcctggccagcctaacgggtgtgaggtatcgagggggatgcccgtctcttttgctcactgctgcgttccccagagcctaacccttcacaatggctcagtgagtatctggtgaaaaggaatgaatgggcctaaactctcagtctgtgattccctctgcaaaatggtggcaggacatttattttgcaggtgcgtgcgaggaggggcggggatccgagatgaagccacttaagggccagtctgtcctcatcacccaggccccaaacctcagcgccgtcctttcgtttttttttttttgtttttttttttctgagatggagtctcactctgtcgcccaggctggagtgcagtggctcgatctcagctcactgcaacctgcccctcccacgttcaagcgattctcctgcttctgcctcctgagtagctgggactacaggtgcccgccaccacgcccagctaattttttttgtatttttagtagagatggggtttcaccatgttggccaagctggtctcaaactaccaacttcagctgatgtgcccaccttggcctcccaaagtgtggggattataggcgtgagccaccgcgcccagcctctggttctctggaaccccagagtgaaccctttcccgaatcctgcaggctcgaccctgaacacggattcggagtcagactgcctctcatcgcctctcagacagaagcccggcccacaccgccaccctgcccgtgtccagaggtgagaggtgcgtttataccctaaagtggaccatgccaccttcagtggcctccagatgcacccagaacaagatgtcgcagcctcccgtggccctgcatggcctggacccgctgcccctcacccctcagcctctcactctccgtccctcaccctccgcccctcactcctcagcctctcacccctctgtccctcaccctctgcccctcactccccagcctctcacccctccgcccctcacccctgcgcccctcacccctccacccctcaccctctgcctctcacccctgcgcccctcacccctcagcctctcactctccgtccctcaccctccgcccctcactcctcagcctctcacccctctgtccctcaccactccgcccctcacccctccgtccctcaccattccgcccaaacatctgtctcagggtctgagcaccagctgttcccctgctgcccagattgcgtcttctttctcatctcctaggcccccctcactgccatgggtctcgctgatggataccccaggccttcccggaccaccctgggtgatgggcactccgccccgtccctcccagctcttgtcccctgggatgcgccccatatgtgagtcaccatctcggccgctgtccttggcatcagctctgcaaggtcagtcccgtacttggtgagggtttacaaaaggggtgcatgaggtgggggcacacaggcctcctgcgatccatggaggcttggtggggtgctagggacaggaggggacagcccttaggggtctgggagccctacctgaacctcttgatgttcttctcacacacccggatgaagagcacgatggggtagatgttggacttgatcaagtctcttgtgcagccgatcccagcctccagcaggcagtgcttgttctgcgggcacagcggctttggtcagcagcagcccacccacctcccgctcctgtgaaggtgcctgcagcggggcctggatgcagggttggggtctatagcggggcgggagccctgaaagccacctgccgctgatccaggagatgagacccccacatgagtctggacactccaggactctgctgaccacagtgatgttcatgggcagagatgaggccccggacggggtgaaccaggtggcgtgaatgagtttgaatgaaacacctgctaccagccgggcgtggtggctcacgcctgtaatcccagcactttgggaggcccaggcgggccgatcacttggggtcaggagttcgagaccagcctggccaacacggcaaaaccctgtctctactaaaagtataaaaattagctgggtgcggtggcccacgcctgtaatcccagctactcgggaggctgaggcaggagaatcacttgaacccgggaggtggaggttgcggtgagccgagatggtgccactgcattccagcctgggtgacagagtgagacactgtctcaaacacacacacacacacatacacacacacgcacacacacacacaccccaaaacacctgctaccctagccagccttcaagtaagagggtagggaacacatgaagggtgaggcggcgaggctggcaggtcccaggagtatctgcaaggttctcaaccatgagctcatcattttgagaaagggcaatttctgctttgctgaaggcatcacttaaaaaaaaattccaccaaatgttggcatggtggctcatgccagcaatcccagcactttgggaggtgggaggattgcttgacgctaggagttcgagaccagcctgggcaatataacaagaccctatctctaaaaaaattagaaaatcattagctgggcatggtggtgagtaactgtagtcccagctactcgggaggcagaggcgggagagttgcttcagcctagaagtcgcggctgcagtaagccgggatcatgccctgcactccaggctgggcaacagagcgagccccagtctctaaataaataaaacatcaaactttgcattggaatagaacataaacacagcattctaagcatgcagctcagtgaatttcacaaactgaacgcagtctagcactcgtgtctggaggtgggaatgacccccctcgcccagggtctccttgggcctcctgcggggccactgctccccattccccaccaataggaccatggcccacatttctacagcacagatctgctggaaggcttcttcttttcagctaaaaacaatctcagctccaaccctgtctgctcactttctatccacgccagctatcagaatttcctaaactgctgtggcccagacttaaaaaaaacaaaaacaccaccatctgctcttgccatccccaaggtcagcgtccaccacggagccagcccccggcagctgggggagccctccagtgacgcggacagagagccttttcttcatccagtgctgggacgaggaagagctcaacgcttaggtcacattgtctggctccaaagactccacattgcacacagacaacctttttgcatcgttgccaataacccttgtgatgccccgttttcccctcgtttggtgaatgcaatacctgtcaccttcatgttcatcctgtctctcgccctgatgagctcgttctctatctctggcccttgttatcacaaccagacacacacactcctaaataatgcgaacacacaccagctccaggaagccaacacaaatagaaagctccaaaataaaaactcacttcagagcccagggaacaagggtgcagagagggagttaacacggggcagctgctgggacaaggggaaaaggagaggtctggccacggggaggtgaaaacaactcttcatcccacccttgtccctggcccaggtggcctcatgaggatcatcacggagggtcctggccccatccaacctcccagtccccgcctcaccttggcggccacagcttcaatgttggcaggggcgatgcattcgaacgcgttggggttcttctctcgggagtagatgatggtctccgtcttctgccttctgaggaactcatctcttgtgacgatatctgcagagagaggggccagtcctgagggcagcacgaggtggccttgggttgaccatcccactcaggccctgcctgccaccttctgggctctacagaactcgatgtccgatccccttccagccatgtttaaatgaatctcgtctcccctcgactagactgtgaagctccttgagggcagggctaaggttaaccttctccatactccccatggcagcccatagagcaggtgcttggcacctcagcaatacctttcactggacaaagcagctcaggcaccgtggtgcaaggctgatcaccagtctaaataaatctcctgttccacccacccacccacctacccatccatccacccacccatctaccgacccctcacccacccacccatctgtccacctacctatccacccatccacccatccccttatccatccatccatccatccatccatccatccatccatccactcatccatccatccacccacctatccatccatccatccatccatccatccatccatccatccatccaccaatccatccacccactcacccatccacccacccatccttccatccatccatccacccacccatttatctatcaatctgtccacccacccagtcacccatcatccattcagccatccttccatccatccatccacctatccagggggaggaggggtgatggggaggaggaggagggaagaagagggaggagggaggggaggatgaggaagaagaaaaggaggggaggaaaggggaggagggaagtgaggagggggaggggaggagtgagaagttggaggagggagaagagaagagggagaagggaggaggaaggaaaggaaagagggaagaggaggaaagagggaagagaagaggggaggagggaagagaagaggggaggagggaagagaagaggggaagtcgtcctggttcatggctcccgcggggctccccaggtggccgtggctcgccgctcacctgacttgcagatggtgaactccatggcacctcccgagttgagcagcctctgcaccagcgtcttggccagcacggtgggtgtgaagagcacgggccggcggcgctcgcagtagaaggcgcgtaccaggctgtaggggatgaggctgaggttcttgcccagctcgctctcagggtccagctctggcaggggcaggagagggtggcggtcagacccctggggctccgaagaccttccacggaggacggggcccctgggctgggtcctggaagccaccgtcagtgtgaaggcctggctgctgccccgggcatccagtgtctgaggtcacctcgggctggcactgcttggggcttgtgtgccagggaggggaggtgtggtggggggcaggcagagtgtgtgacaaatgcaggaaccttggctgagctctggagggaaagtttgccttgtcagacgatcaaggagggcttcttggaggaagggtagggactgggtacagcccagcggaggggagggcgagggcaaggaaagcaagtgccggcaggcacccacgagacaccaggaccagcggccaaggccttgggtgtctcccaggagcactgggagggacgacttggcctcagttctgctttctcagtccctctgtggctggagtggcagagccacacagaagcccggggttctgatgaagccacccccaggcagcccgaggaaacagctcccagaaacgggcagcctgtcccttgtcccttgtgccttttcttgtaccctggcctggccactccaacgtccaaagggccagcccgggaagccgccccaaggcctcctttgagatccagccagggctgtgtggcttccctttccctgagcagggccagccagggccagcggggtgggggacggtggaccgggaggcccctcgccgggttgataaatggcaagtggcactcagtgggtagagaaatcaataaaacgaacacttcacagcaaacagccccaattaacacgggtacccgggagcgaagcaaccacacgagagcgtcgttattgggtgagcttggcgggatgtcaccccgaggcagcatggtcctcacagccaaggccaggctccctcaccgttttaatttctttttgtcttttatttttatttttagagctaggagtcttgctgtatggcccaggccagagtgactgcagtgatgttatcttggttcactgcagcctcaaactcctgctcaagtgatcctcccacctcagcctcccaagtggctgggaccataggcacgtgacaccatgcctagctatttacatattttaagatttatttttaatgctttatgtttttattttaatgtttttatatattttatagttatatatatatatatttatttatttattttattttatttttttttctgagacggagtctcgctctgtcacccaggctggagtgcagtggcgggatctcggctcactgcaagctccacctcccaggttcacgccattcttccgcctcagcctccagtgtagctgggactacaggcgcccgccaccgcgcccggctaactttttgtatttttagtagagacggggtttcaccattcacaggatggtctcgatctcctgaccttgtgatctgcccgcctcggcctcccaaagtgctgggattacaggcgtgagccactgcgcccggccatagttatatttttttgtagagatgggggtcttactatgttgcccaggctggtcttgaactcctggcctcaagcgatcctccagccttggcctcccaaaacactgggattgcaggcgtgagccacctgtgtccaccctcctctccctttggaggacttccaggccccctcacaaggaccgatgttcctccaggtgagggtgaggcatgtgtgactgtggctgggagtggtgggaggggccaggcggtccccatgtaccttcctgcttctcagtcaagagcttggtggcgtccagcgaggaccgggccaggctccctagcggactccccgagatgatgcggacccgctcgttgctgttcatccgcttatacttgttctcggacctgctgacgaactggaggagaagagggagggtcgggggaggactgttttgcttccacttctaaacagacagggtgctgccctcaacccggcaaagccagaccttgttcaaatccctgctctgcccctgggggttcctgggccagtcatttcccctataaaagcaggagactcccagcaggtggctcgagccctttagccactggagagatgttctcagtaggtaaatgagtgaatcggtgcccacgctgtcttccgcagccggatgagtctcgggtcaagctcatgtgcatccccgtgggaacctcaggtgcagctctgcaggcactgtgggacctgagccgccccagccatgaagacccctggctggaaacccctgtgggcagggactgtccccctgctgggcatgtgctggacaatgccacctccctctgacactgtgctcaccatgcctttctgcttcggtatccctaagtttaatgggggcacccacttttttctacaattcacagagttgagtcctggagggcagaaacggatgccctggcaatgggcccagaagcaggttcacaccatattctatgggctactttgagtctctccacactcttccttctgcaggaaggaaaacgcatggcatctggggtgtcagccggctctctgttaactggctacagggctctggatgagactcccaaggtttcacttttttttttttttgagatggagtgttgcactctcacccaggctggagtgcagtggtgcgatcttggctcactgcaacctctgcctcccgggttcaagtgattctcctgtttcagcctcctgagtagctgggatgacaggtatctgtcactgcacctagctactttttgtatttttagtagagacggggtttcaccacgttggccaggctggtctcgaactcctgacctcaagttatccacccgcctcagtctcccaaagtgttgggattacaggcgtgagccactgtgcctggccccaaggttccactcttgcatgtcatgcgggtgtaaaaatgcgtcatctcaaatggttctgcctttgtgaacccctcagactttgccaggtttcctttccacctgggtgtctctccgccacttgtttgtgtctacctggattttagggtcacactgctcacaatttccctgggtttccctgttccaaggttgagatggagcagcggaacataacactgtctccgttggggtctaatgagtgaggcagccacacaggaacacgctcatggggtcacattttcatattacccccttggcttttgtccacgggcgatacaagaaacgatcccaaagagtgtttctgcatttacgagaaaccatttctgaagataccacacacgatgctagtcaatgttctttgtataatgatccacgccagaaaaaaaaaaatcccttttagaattaagtagaagggaaaagtcctttctggtcttgattgctaaaatgtttcccaagacagataagattgaaagactctgctgggttcccttttttccttggctgccgggatgctcagataagttgaatgctcaattaatgaggacctgatctggcctagatatttaggatgtttgttttcatctcctgatacactgcttctgatctttctattagtatctgaacagctaacttcagtttcttttcaccataaggttcctcaatcttttatgaaagtgggatttgcttcccgcaggcacagagattgtctacccacctgtcactgagaggataaaacgggacaggagatgtgaggcactgtgaagagttgcaagtggtgtacaaacacaaagcatggttattttgattcgggtgtctcttctcagtggggagagggcagggccacagcagaatatgattgaaaaatcggtaggtgctccggagagccttacctgaaggagctggccaaaaaggaagcttgctcgcgagagacgggggctgacccgggggtcgcttgttgaaagcgcttcttctggctgcagggtgttctgaaatgaatttatcaatcagtcaggccctgctgggcttggcaggaggggagaacacaatgatgctggtgagaactggagacctgtcctcaagcccctccatgctaacgctttcttagggaaatcaaaaggctgcaggcaaggggcgggggcaggcaggggcaggcggggtaggggagaggagtcctggagacttgggagagaggtgatttgcttcaacagagaccagggatggtagagcaaaggcctgcagtccagctggagccagaaacctaggctcatcttctttttttttgagacagagtctcgctctgtcaccaggctgcagttcagtggcatgatctctgctcactgcaacttccacctcccaggttcaagcgattctcctgcctcagcctcccgagaagctgggactacaggcgcaccaccaaacccagctaatttttgtatttttagtagagatggggtttcaccatgttggccaggatggtctcgatctcttgacctcatgatcctcccgcctctgcctcccaaggtgctgggatgacaggcgtcagccactgtgcccagccttgttcttgttttgagacagggtcttgctctgccgcccaggctggagtgcagtggcacgatcttggctcactgcaacctctgcctcccaggttcaagtgattcttctgtctcagcctcctgagtagctgagattataggcgcccaccaccatgcctggctaatttttgtgtttttagtagagacaaggtttcaccatgttggccaggctggtcttgaactcctgacctcaagtgatctgcccaccttggtctcccaaagtgctgggattacaggcgtgagccactgtgcccggccagacaccaaccccttgtcctggaaagtcaggacctgtgggagggcatgagaggatggggctccttctatagggagcgtctcattcctaaggaaccaaggaaccaagttccctagaattcatcatcccaatacggatggattgcatttgttactgcctctaaaaaagacccgggagttaggtttgaagctggcgagatccctgcccctgctgcccccacagggtgcttggcagacctacccggagtgcccgcagggtgtggtgggtgccgtctacctcctcccggctgcctcggtgcatcaggcgctgcagtttcaccaggaggagctgctgggctctggggagcgaagagaggagcctcagaggctgaaattcaggggccaagcaccgggaagccagcggggccgcagcaccgcactggcatgggtggggcgcgtgtccgactctgcgtagggatggccctgtggctggtgtgcgctctgagcccagggggcgcccggggagaagatgtggctccttgtatctgtgtttggatcccacctccagcactggcttgctgtgaggctgcagcaaagtggccgaacccctctgagccacggtctcctcctctgtaaatctggtgtgatgatgcttgccttcgaggactggcctgaggtgtggtgttatggtctcatagatgctgtggtatggatgtgtagtgttacagtcttacagatgcttccagatgcctgctgtgtgcccgacacactacctgtgctcagtccttgggggctagtgctgttataatgacaacgtcgttgtcgggatgaggtctatggaaaagaaatgactagtgaacccagcaagacagcatagaattgagtggtctggtcactaccagatggaaaaggattctacaggattctagtgaaggttgagagaaacatctctgaggaggcaggaagggcttcctggaggaggagggcctgggggacctcactgtgaaacagggaaagcagtggccttctttggcctgggcttctctataagcccctctgctgatgttcgtggcatccgcagcctcctgcctggtcctccatagactcagggaaatggaggccccgccctgattctggcctcaccggctgtagctgggtatggtgcccatatccaggtcatggtctgtgaaagggtcgacccgcgcgcacagccactcgtgcctgtcctggtacatggtgtcacggacgtgcacaacatcgtcacacttcagggacatggtgcaggcgtccagctggctggagatgttcaggttcagccggatgtagaacgagtcccccgatgtgatcaggccgtcctccatgtccttcaccagcttccggtaccctgcggagggaaagatgctccagctgtctatcagtatggggtcccccgaccatcagagctgctcctacagcagctttcctcaccaccaacgtgcctgtgcaatatgctgctcttagagctcatagccaggggaaagttctacctccccagtgaaggtagccatgttgtttaccagtttccctttttgtcttggctgccaggaagctcaaagctgaaatttttgccaagttgcagtgatcacctttactagcattcccgctacactcttcatatttccccaccattatacagcacttgtttgttttttatttttttcactgatgcacaactcgcatacagtaaactgcataaattcttaagtactcagttcaatgaatttccacaaatgtatatgtgtgggcagcaacaaccagaaccctctctgtcagtacctttcctaaggggaaccaccttcctaaccgatgttgctataaataggctgaatctcacttcatgtaagtggaaccaaacagtatatgttctcttcacttccagcttccacttttcaacattacgcctgtgagatttgtctgtgatgctgcaatgtagctggagggcgctctttttcactggtgtatagtactccatggtatgtggatgtatccattctcccatgtgcaatttgcattgtttgcagttttgggctattgtgaacaactctgctatgagttattcacacacactgctgtctgtggatatacgtgctcatttctcttgggtatatatacagaagtggaattacttggtcatagaatatctatctattcatctatctattatctttctacctattatctgtctatctatggatatgtgtgcccatttctcttgggtacatacacagaagtggaattacttggtcatagaatatctatctatctatctatcatctatctacttatccatccatcatccatctacgtatccattatcatctatctatctatcgtctatctatctatctatctatctatctatctatctatctatctaatcatctatctacttatccatccatcatctatgtatccattatctatcatctatctatctatctatctatctatctatctatctatctatctatcttctacctatcttctatctctgtatcttctatctatttatctatcttctacttctatctatcttctatctatctatctatctatctatctatctatctatctatctatctgcctatctatcttctatctatctttagaagatactgccaaatggtttcccaaagagaccatggcacatgtcgttttaaccttatttaaatgtcatcaacctcccaagtaaagttttgcaaatactttgtgagggagcggggcataaaccatgaatgcaacaaatgcagcaagctctgctatgatatcaaaccataatataaacccccacatcagccccacctgctgagggctgtataatactgcggaagctaaaatggttctaataaccagagtagcctgtcgaatgtccacgcccacattccagggccgtgccagccagctggattatctgatgaatgttcccaccactgtgcatggagaaacaagggttccctgtcaggtccgtccgggggatcttggccttgtccagcacatctcagaattctgcccatccacctggccaggggccactgtgatcgctatctgagttctctgcctcctgtgaaaacggaacctgcacacaggaccctgccggaatgaactttctttccctggaattccagacttgcagggctgtgctgctgcgcagctccgggctttggaggtgctgcccacatcatattctgcaggcccacggattttctgctgggctggaagatcagggtgcaccatcggagagaagcctgtcctgcatgtagggacagagcatcactattgtctttgcacgggcagggcactgccgggaaggagctcaagcaggcggctctggggagtggatagagagaaactggctatttattctctactgaaacattcatgagccctggcggttaaaaataagatccagctgcagagataatcatgtagaaaaacccagaggtgagaacaagaactcagacttgttcagagcggaaaacaaagctcagagctcacagcccaggagtcttggccgagaaggaggagatcccattcaaaggatgctgggggccccgtgaaaagggagggtgaggcccgcctgccccggagctgggggatcacagagcaagaatcctggggcccaggatgtggttcagtggtcttggtcctgggtagagaaatctctgggccccctggccagcagtgccacagaatatgatgtgagcagcgccccccagggttgggaagcagcacagccctgcagtctggaattccagggaaagaaagttcactccaacagggtcctctttgtaggttctgttctcataggaggcagagagctcaggtagccattgctatggcccccggcctggtgggtgagcaggcttctgagatacgctgaacaaagccaggaatcccccagcaggacctgacagggaacctctgtttctccatgcccagtccgtgggcagactgaccctagagctgctgcctacggacatcaggaatgggaagcccgagagaggaggaaacttccacttaccagggagagggctgagctgggccagccggggctccaacaggtgtgcctgaggctggggatgccgtgtccactgtgacccggcgggcagcccgagacacctgggcaggtgagtgcagacgtggccaaagagccagtgcaagacagcaaagccccgctcacggctgttgccgtccctgtgtgctctcccagacctgcccctgcacctcgtgatgctgccaggaagtgcccatgccttccactgaacagacgagcaagcagaggctctaggcggcgaggtcacttgtccaggtcagagactcgcctccctggccaagggtcgctccagacggtggagggaggtctcaccttcgtggttgaccttgtagtgcagcgtgacggggccgctgcacctctggatggtccagtgggcttcctctttggtgcatgtgtccaacgggacactctgcctctcgcctcggatgcagccttctagctggagagcagagacagcgtttgtctcctggccccacaggcagcagagctgcgggagcgagaccgctctctgtacattgggaaaaaaaccatctctccctgaacaaagactagctcagtgccaacagggggaaaaagcatcttgttcaggggggtgcacctgcctcctgcctgcaccctgggagcttgcaggatgcagaagcatgggcggggagctggggagagaagggcccaacaatgccgacggtctgaccaccttccagctccctcctcctgcccggggatccatggctgaatgcaaggcttaggggctcctaaatgtcaccactgacactacagttgcagccacctcccttgccgccatcccctcaccagcagcagctggtggccctcacggaggccggctttctcggccagagagccaggcttgaccgagtgcacgaagctccctcgcgcgttgccccccagcagggtgagctgggaggtgaggctgtcgccattcagcgtcgtgtgctgcaccgagggccctgggccccgcacgtgccccacagaggtgaccgaaggccggaagggtctgcagcaggaaacagaatgtcagttaggcagctgggctgaaaagagaaaagccctactgggacacaccgggggttggtggtgggcgccaggaccccggtggcatggcctcctgtggtcatcaggcgcctgggtgtcctggctccgagaaggcccttaatggctaagggaagtgagagctcacaagtggctcctgctgcgagaaatgcagatgaggagaggagctgaggcaccctctgtggccgcagcggccgtgctgggactggcaagggccatgttaggagggtccccttgagcgcggcccaccgggctccactgtgtcatggatggggactgctgggtatctgggtcccacttctttgcctctgccatgctgcatggccttgggcaagccccttcctctgtgggcctcggtttctgcacctggacacttgggaggtcagaggaagtgatttcttttttttgagacagggtcttgctccgtcgcccaggttggagtacagtggtgcaatcatagctcactgcaggctcaacctcctgggctcaagtgatccgcctgcctcagcctcctgagtagctgagactacaggtgtgtgccaccatgcctggctaatgtttaaattattttgtagagatggggtcttgcgtgttgcccaggctggtctggagctcctgggctcaagcagtcctcccgccttggcctcccaaagtcctgggattataggtgtgagcaatgcgcccagccaggaagtgatttctgactcgggaatgctacaattctggttctggctctaggagaacaaagcccacatgaatggtcccctttgtaagagagcgagggggcaaggggtctttatcccatccccaccctcaaccccggcttccccttcactggggtacctttccagagagaacttcctgaacatgaggttgacctgctccaggtcgtaggcatccaggccctcggattggtgggaggaggaggaggagtggatggaggagggtccgaaggagtagcgttcgtgactgtcatctgcagagggacgagggcccatcagtaccaggggtggcggggagctctggagacagccctgggacctgctgggctggtcccggcactgggggcaggctcggagccctccttccctactcttcccgggcagcctcccaggagatgggtctctgaggttccctggcacagatggctgagtcctgcattgaatgtctccaacacagatgttctccagcctccaggagcttcctcttagtgggaagctttatcaggtatctggtttttaagattttttttttttgagagagggtcttgttctgttgcccaggctgcagtgtgatggtgtaatcatagctcactgcagcttcaacctcctgggctcaagtgatcctcctgcctcagcctctggagtagctgggactacaggtgtgcaccaccatgtctggataattaaaaaaaaatttttttttatagagacggggtctcactatgctgtccaggctggtttttaatttctgggctcaagccatcctcctctcttggctttccaaggagctgggactacaggcatatgccaccatgcctggctaattaattatttttttgtagagacagggtcttgctatgtcacccctcctggcctccagtgatccaccagccttggcctctcagaacgctggtattacaggcgtgaggcaccgcggctggcttcattctgttcttgaattgggcccccacattttcattttgggaccctaaggcctcaccatcatccatcagcttcccggcccgcaggggcctgaagcagggcaggaagaggagggtctggccccgataggagcccctccctatcttctcaccccaggtggacccagaacacctggaggaaagacacccactgcccagagctctgggtggctgggatggagagaactacaaatctgctcggggctgataacaaaggcttctctgcaaatggaatttttcccgacactgcaaaatactttggacggttgcccgggattctctcccctttccaaaactctttcaattcttctcattacccagcctcgattaggggctaacctctctttaacacttggtagcgctgatgcttccccattaaggaggaccactcatctttcgtttcatcggttggcagccttagctggcaaaggctgggggagccctggaagagagggggctggcagggcacacctggaggactctgagccacagtctcccctgctgccagctctgtcggggccaggggatgctgccaccctccctcggtgctgagacaggcttgaaggtggtgatcctgcaagcccgccttcaccctccctacttctccccatcctgccttgcccctccaatgtcgacctgttcccctggccttgcccttccaatgtcggcctctctccccacagccttgcacctccaaggtcggcctctctccctggccttgccttccaatgtcggcctctctccccacagccttgcacctccaatgttggcctctcccttcagacttgtacctccaaggtcggcctctcttcctggccttgcccttccaatgttggcctctctccccacagccttgtacctccaaggtcggcctctctccctggccttgcccttccaatgctggcctctccccacagccttgcacctccaatgttggcctctccccacagtcttgcacctccaatgttggcctctccccacagccttgcacctccaatgttggcctctccccacagccttgcacctccaatgttggcctctccccacagtcttgcacctccaatgttggcctctcccctcagccttgcacctccaatttcggcctctccccctggccttgcccctccaatgtcggcctctccatctgcattctgtattccttttgcagaggctggttaacagctcaacacatgaatttcgcatgagaactccctgctcccagcccactctctgccctcctgttctttcctgtctctgaggctcctgtctttatctataaaatgagggtaacaatagcatttctgagagcggctgttgagattaaactggatcaggtatgcaggtcgagcccctccatggtgcctggctagagtatgtgagagctacgctttttaaaagcccagacctagctcgcaccctctgcacagcagccggatgggcccccattacctacaagacaaagaacaagctcacagggcatctctcagccatgggcaagcccaatgggggacagaggcttatcttttgtgttcaagagcgactctgagtccattccacatagtaggtcttaaggacctgtgaccctccacctgtgaccctctgtgacccgtcctacccaggaccctcccggatctgagaggcacgtaccatccagatctaaggcgtcaaacccgccgctgtcattgtcttcttcgactgtgctgcaagacacaagggaggtgggggaaagcatgcatgtgagtgtgtgtgtgtgtgcacacgcaggcaagggagagagaagcttctggaaggttccaggcttccgagtggccttgcttctgagagggcagtgtgggtggaggaggttgggacaaggaagggtggagtaggcaggaggctccctggaagggtgggtggcctggaggtcttggagattgcctcctccagcaggggaggaggaaagccagggcaggtgaacagaggccctgccggccccacctgctgttcacgtctctctcactcttctccgacatggtacaggacagagatccatctgccctgtgtgatgggtttgggagctgagcgcccttcagccggagtggacacagcaagcttgctgtgctctggagttctcaattgtctgcatgtggtttttgcaatagtgcttcaaggtgcaggtgctttcatgcagacgccacatgtggcttctgaaagctgctttcaacacctgcccccggctggccagagggtgcccccgcaacacagctgctggtggaggggctggtgtgggtctgatttttttttttttttaatttttgagatggagttttgctcctgtcacccaggctgaagtgcaatggtgcgatcttggctcactgcaacctctgcctcccgggttcaagcgattctcctgcctcagcctccccagtagctaggattacaggtgcatgccaccatgcccagctatttttattttttatttttttaatttttagtagagatggggttttgccatgttggccagtctggtcttgaactcctgacctcaggtgatccacccgcctcagcctcccaaagtgttgggattacaggcgtaagccactgtgcccggcctagtgcaggtctttgctgctgatctctggagccagccagggaaggccatgctaagaggcccaaacccaggccccagtgggaccgggggtgtggatccagcctccaaggccactgcttgctctctgcccttctggaaaccgcccaacaacctctgactttgtaggtgacgtgccaaaccctggcaggctggaaacacccgttgcccaggcatacttctactgtggttctctttgtgaggacactaatggtttttaggaagtaaggaaggtgggagaggagattggagaagccattcatgagtttcttttttttttttttttgagatggagtctcgctctgtcacccaggctggagtgcaggggcatgatctcggctcactgcaacctccacctgccggattcaagcgattctcctgcctcagcctcccgagtagctgggattacaggcacatgccaccacacccagctaattttttgtaattttaccagagatggggtttcaccatattggtcaggctggtctcgaactcctgacctcaggtgatccacccgcctcggcctcccaaagtgctgggattacaggtgtgagccaccatgcccagctgtgagtttcttattctttggcagaaaaagccaagccctggggctgtggggcccgggaacctgatttctgggcagcatggagccacgggtcataggttttgtccttggacaggcagctgggtgaacccagggaggccgcttccctcctctgagcctcagcctcctcatctgtacaatgagcagtaccctgcctttcagggttgcttcgaggacagctgggtcagcaagcgtggactggcccagagacggggtaaggaggcttggcatggtggcacggggcaaaagcccagtcctccctcacctgccacccacctgcgatggggcgcgtcctccttgtagcgtctgacgatggagtcgtttcccgggggctcggcggtgattgacatgatgctgctgcggctccgggggggctgcttcagacacagacacacacacgttacgggtgcataaatattacacacgcagggactcaattcaatgcaaaatcgtgcccgcctcctactcaggcggcatggaggcagcgagccggctatcagcggcgaccttggctggaggaggcttgtgctgagcccggagcggccgcagccgccgagcttgaagcacatctgctcgcacatctgctcacagggaggacgcaggcgggagccggccggctgggggactggggcgctgcctcgccatggtgcacaggctgagctcaaggcccccgggctgcacctgctgtgggcacctgctctaaacatggtgaacagtgtgggcctggggcgtggggagggcagtggtgccccggacggcacagctgctggagggcaacctttgaaaccaggcctgctggctcctggccagagccgctcttaataagagcctgggattctgccacccagggcagccatcagacaggaatcattcattatcaaatatctgcctcccccagggcctgattttggaagctgagctgacaagcttcccagggcttccccttggggttagaatctctaatcttgggccttctgctgcctgtcagggggtgggcagtgctggatgcagtggctgggaccctgcccggctctgcccgggtaggggttctgggctggggatggggccccaagcctcagctctgcggcggctccagctgctcacagctccctgccctgcctgccgcccgttccccaggctgcgggagttgccaggggctgagaagttgcggcagaattttcacggcctgtgccatgcgcgacagcccctgggaggcccagctcctcctcccaccaagtgttaaattgggaaaggaggcggcaagaaggtgtaaatacattgcgaggctgtggaaacctctctaaataaacataagggaggctggggctgcagcccagagcaggcagcagcgctgctcagaggctgggtcttggggaggaaggcgaggtgggtcagggctggtggggtggatgaggctggggccccgggacggtgctctgcagcaggagagggtgttgggggatgagctggtgccccggatggcactctggagggagagagggtggtggggataagctgggtccctggatggcattctgcagggggagagggtggtggggatgagctctggagggagagtgggtggtgggcatgaactggggtcccagacactcttctgcagggggagacaatggaggggacctgcagatcgggcagaggctgcagctcaccatcttggtgaaggagttggtgatgggcagagatccgcaggagctagggctggcgtccgtgccttcttcctcgtgccccttggctgtcctcacgggagacgagatgggagagacagagaaaggagaagggggccggggagggtttgaggtggaagagagagaggggaggaagagaaaaggtggggaaagggaagtcagagcctcatggcccataggcacatggggctctctggcatcatccccaacctccttctaacgaggtgggtctggggcctcttctctcccttgagggctcactccactctctgtggcatctgctggagaaagagccctcaaaaacctcctcttgctttttatcaaattttttatagagatggtgtcttgctatgctgcccaggctggtcttgaactcccggcctcaagcaattctcctgccttggcctcccaaagcgctggtatcacaggcataaaaccatctcttcttttcctgtctccccccaccacagtaggctcctggcggggagggggtggtgggtctcatttgccaacatatcgcagctcccagcgagggtcaccccctgggcagcctgggtcaaagctggacaacgccatgtgtctctgaggactggtgtggggtccccggctggcattttctgtgaacaatggacaaccggggcatgagtcttcctgtccaattctctgccatcaacatggactctgcctctccccgacaagcagggctggctgatggggatgaggacaaactgggggccaagtccgtcacctcctcagtgaagcctcccttgatgtccctgccccaacccctggctctgtggtgggttgcctggggaccatgtgcacatcctctcagccctcctaagacggctttgctctctgtgtcccctccttgctcccacccttgctgtgtgtgcccgtgttgtgtgcacagagagatatacgtacatgcacccccatcagtggatgccttgtggggaggaaccatatgctgtccttccctgggcccccagcacctggcactgggcagcctattaaggtctgatgaggagccccatggccactgcatcctgtcccttccctgtgatgcaacccccttctctgcttcctgcaggccccaggccctttgcacctcccttctgatacagaaggccactgagacaccggatgtggccgtgagggagctggacggggccccccgccctggcctccctctgctgccctccgtgtccagagagaacggccttaagcacaggtctgcactcttcactctcctgcccaccccaaagccacctgggggaggcttcatccttgccatgcaggatgaagtccatatcttcagtgaggcgcccacagtctcagcccagtgctctcctgctttacgctctggggtggcagggcggcttctgcctgtgcacctcctggtctccacacctctgtttatgggcccctctctgagctgaggagtacttctggacactgtgtccctccaccaaaaggctcccttttccagccccagtttaaatgtccaccccgcccccacatttttctttctttcttttttttgagacagcgtctcactgtgtcacccaggctggagtgcagtggtgccatcttggctcactgcaacctctgcctcctgggctcaagtgattctcctgcctcagcctcccgggctcaagtgattctcctgcctcagcctcccaagtagctgggattacaggcatctgccaccacgcccggctaatttttgtatttttagtagagacagggtttcaccatgttgaccaggctggtctcaaactcctgacctcaggtgatctgcccgccttggcctcccagagtgctgggattataggtgtgagccaccccacccggccaaatgtgcccttcttgatggatccttctctgacctttgtccagccactctcaggacccatgcactttccacctcctggctgtggccctgcctgagtgtgtggggtctatggacatctacttgggccttccagcacctggcacatagtaggtgcttgatttgcttaggcaaacccttctagccgatctgtcactcccagagacatggtgaggacaaaagagaagattctgaaggcagtgtgtctcggagaaccagggactgacgaatgaaccagcctcctgtgaagtcctgtgggggaacacccggccaaaagtcttggaagagggtcaaagagtcctttcgctgagaagccacgggcaaaacgcacagttcagctaacgcaccagggattccggacagacccaccgggagaggcggggaagcgtggagggaaccacagaggggacctttcagcagttgggctcctgcctgctttgaatgacgatgaacattaattgctatttggatggacccccaccactccgagacccccgagaacccgccacgtttaccacgcaggattgttcgttacagtgggagaaacagatggaccgagagagacagagtgacagatgagacaggccaagagagatttgggcgtctcactaaccttgaaaatctgatgttcgcttcaggctgatgggggatttggctctctgcagctaaaagggaggggaggggaagaaacaagacacaagacacaaatcaaacagggacctagacacatgtcactggggcttagaaaaaaatagagagaggccagccatcgtgtccctcgtcatacggccaccaggttcagcccggaacgcacacggaccgatgctcatctcccgcggccgggacgacaagacacagcggctcccctgggcttgaatcaggcagctgctggtatagacaagctctcctcccagggcggccgtgtaatatggctcatggcagaagacaggacaggagccaagagcggcagaggggaccaagtgatgtgcggggagtgtgaagctgagcagagctgggtacatgacacagagcaggtttcagaagagggtgaggctgccaggcaggtgccctggccacccccggcccggagtgctaatggggtctcagtcagctcagatgtgctgcctcaggccttctggcttggcgtgtggaaggctgggagaggcagaggcattgtcaggccctgctgtggcatctcattcattcactcattccctccccatcgagagccagccgtgggcttcgggttgcccgagattctgaacacagtgacaggattactgctaactccagctcctgggatggtgcctgacatgtgacgggcatgtgattggcactcagtacatatactcaatacatatgtgatgaataaacaaatgaattggttttttttttttttttttttttttgagacagagtcttgctttattgcccaggctggagtgcagtggtgcgatctcggctgactgcaacctccgccctactgggttcaagtgattctcctgcctcagcctcctgagtagctgggactacaggtatccaccaacacgcccggctaatttttgtatttttagtagagatgggatttcgccatgttggccaggctgctcccgaactcctgacctcaggtgatccgtccacctcagcttcccaaagtgctgggattacaggcgtgagcgactgcaccaagactgaatttggaaatgatgctcatttcattctctttccctccttccatctttctttctttctttctttctttctttctttctttctttctttctttctttctttctttctttttctttcttccctccttccatctttctctttttctttctttctttcttttctttctttctctctctttctttccttccttccttctttctttcttttctttttcttttctttcctttctttctttctctttctttcgtttctgtttctttcctttctctctctctctcttattattgagacagggtcttgctctctcacccaggctggagtatagtagtgcgatcatagctcacagcagcctccaactcctgggctcaagtgatcctcctgcctcagcttcctgagtagctgggactacaggtatgtaccacaatgcctggctgttttttttcttttcttttcttttcttttttttgagacacttgatcttcctatgttgcccaggctggtctggaactcctgacctcaagtgatcctcccgcattggcctcccaaagtgctggggttacaggcgtgagctaccatgcccagcctgtctttctttctctctcttttaatgtctattacatttataagagtgaggaaatcagtaaaaatgtacaaatgagtaagaagcgagtcgcaggatttccagcttacagggttgaaatagggtgagtcacagtctgggcacccaagacccacccagaagcaggcgtggctgtgctgccccatcgccgcctgcaggggcccccggctcacagaccctctgccctgcacctgcgccccctccctccacacccatgcacctggatgcccttcaggttcatcctgcgctggggcggatggtagggcaggaagtacttgctgtcttcaggtgactcctccgaggtggaagaatcgtcagcttcttgaccattggtcctggggctggcatccccaaagtcctgagagatgatggttactggcaggttcctgggcagactctggggacagagaaaaagctggcgttagtggtggggcttggcgatgcgccaccagtgggcaagatggctgggctgatggcatcatcattccctcggccacccgaacatgaagctcactttggccattcttctttcctgaccccaaccgtaaccccagacactgagcccccatcagtccagcctaatgatgcatcctcctcccaggcttctggtccagtctcccaaacaagccccggtcttcttgtacaatggtaaaggcattgcctcctaactggcctcagccccttccatctcatctgccaccatgaaatttccaatttctagccctgtgcctgagctaaaaatataaaaaatattcagaatgactgaatgatgttaaaaaaaaaacacacacacacagtcctaggtactgtcttgtctggagcgcttcatagctgtcacctcattgaatccttcctgacaagtagaggttgttgttgataattgctttttacaaaataggaagcggagtgctgtagcatgaaggaactacgtggcccacaaagccacatggcacccgcatgctgcgctgcctccagactcaaagcgtcttgttccactccctgtgcaaaatcttccaggggctcaaaacagcagtagagctcctgggtgtgcacagcccaccttggcgtgccccgttaaccccctgctgctccttgactcccactctgcagacggatggaagcgccggtcatgccctgctgacagcacagtgggctaatgccaggcctgtgttcacgctgtaactgcagccgggagcacgggtcctcccaaagtgctgggattacaggcctgagccaccgcgcctggtcagggtcccttcctttgtaaatgaggacactgagcatgctttccatgcaggacagttccgtggggtaaatgaggtaatgcacagagggcacattgcgtggcacctgcacgtgacagcactcggtaaacccagagctataatagtggtaacatttaccctggaggaggcattccttcatttctcagtgcctggagccctgctgggaaatgcactctgcaattcacatagtccataaatgagggtttactcacaagcactaggaaccgtaacgaccacagggtgtcttaaacccagtgacggttcaggtgtgcgggggaaccccagtgggaggccagcagctggctgtggtcactgagagggcactgaggctcctaaggcagaggctgcccagcaaggaagtggccaggtcaagcttgccttttttttttttgagatggagtcttgctctgtcaccaggctggagtgcagtggcgtgatctcggctcactgcaacctccgcctcctgggctcaagcgattctcctgcctcagcctcccgagtagctgggactatgggcacgcaccaccacgcctggctaatttttttgtatttttagtagagacagggtttcaccatgctggtcaggctggtcttgaactcctgacctcgtgatccacctgcctcgacatcccaaagtgctgagattacaggcgtgaaccctcgcacctggcgccctgcatcttcttatttatgtttttaattttaattttttaaatttttaaaaattttcgctctgttgcccagactggtcttgaactcctgccctaaagcgatcctcccacctcagcctcccaaaatgctgagattacaggcatgagccactgtgcccagccctaccctgcatcttctaacttcaaaatgagtggcttccactcatcactaaacagacacaaacacaacagtaaaagatgtggattatgctgggcgtgggagggaacttccggcttcaaatatatgaagagccaaccgggcacagtggcaaacggctgtaattccagctctttgggaggctgaggcgggaggatcgcttgaggataggagtttaagaccagcctgggaaacagtgagacctcgtctgtacaaaaaaattacaaaattagtcaggaattgtggtgtgtgcctttagttccgctacccaggaggctgaagtgggaggactgcttgagcccaggagtttgaggctgcagtgagctgtgatagtgccactgcattccagcctgggcgacagagtgagaccctgtctcaaaagcaaaacaaaactaaacaaaggacaaggagccattcattgcacagggaagcggcgactggtcacagccctcagtgggtgccagggggcacctggcttctggtttggggccccacagggaggtggcgactggtcacagccctcagtgggtgccagggggcacctggcttcaggtgtgggtctccacggggaggtggggactggccacagccctcagtgggcaccagggcccacctggcttcaggcgtggggtcctgcccgtcccgccccacctggtccaggttgttgctgtccttggagaggcgccgcagcttgctctccaggttgacgatgcaggcctcccgccgcaccatctcgatcctcatctcgtcgttcttctcctccagctcgcggatctgcttcctgtacttgtccttttcgattaagcactgcgagtactgtgtctgagcttcatctcgggagtggaaggcctgccagggagaagcgggacgaaggctgctttgggggttgcaccccagccaaatccagctgggcccagggacaggcatcatcccaacccaggggccagccacatcgtctgtggctctcgtctgcagtctgacccctgggcgtgtcagtcactaccttcttcattaacgcgatcacagagccgatggtccgacccttgctagtggcaggctctgtgttgagagctttgatgcagtgtccctggaaggccacagcctgtccctatgaggcggtgctaccgtaattatccccattttacagatgagggcactgaggtcaggggtggcagcttgcctatgggcatacaccttatgaatgacagggctggatctgaacccatcctctcacccgagagaacacacaacatttaagaaccatgcttggtcgtgggagctgctggagcccagctcggatccccctgctacccaaacgcctgtgacttccaaaaaagccttttggaattcatcttttagaattcatctttggaacagaaatgggaaagatggattcaggagtgatccctgcattgtcagtgatgttgcactggacaaaacactctgaaggagccggtggtctggggtgcgggccccgctgtgcagcctcgccgccctgcacgctgcaggtggtgcctgtacctggtcccgctcccgctccacctcctccagctgcagcatgaccgtgttcatgcggtgcttgtacatttcacagtcctttcccagggtcgagcacttgagctccaggtcctccttctcctccaggtactgtgaaccacacagagaaatcaatatgcgcatcgagcaatcaataggtcaggactgaaagctgttctctgctcgtgccttcccgccagctggctggagctggcctgtccctccctaagctggcatggtcaggacatggcctgcccttctgggaaccgactatctgactgttggggctcaaggtaggagaccaatcaacccagcattgttgtgaacccactacagaccaggtaacataggggaggacaatgtgatctcagtcaggagggggacacaggtgctaagctggtgcaatagcttgtacatgcccaagggtggccggcacatctgggatcctgcaatccgcaaggtgtgggtgaggctctgagactcacaccttggcaggtatgtgggttcccccaatcccaagccctcaccctcccctctgcccacattgctcccacccccaggccctcatctggttgataaactgcagcttctgccaggggctgaatactgggaggtacaggggatttatgccaggggtctgatctagtccctggaaaggagtgtggggtcagggaggtcctgctgacacacaccactgccccctggtgtgaagggggccggccgagggcaccgctgggcgggcgatccccactcccaccttgtctcgcagctcctctgcctggcgggcctcctcctgcaggttgtagatcctgttgaccagctcctgcctgtcctccagggcctccttgcggtcgtgttccaagatgtccaggatggccttgtctgagtctggcaggctgcgcttcccggcctgggtgggagggaggaggtttcagagggtcagggtcggggtggggagccaggtggtcctggagggcaggggacagaagaaccagcaacagatacggacagagcagaaggttttgtgcctggaaggtagaggcaagaagagatgtatgtcccctggggtctctaagaagcttagcatttaagaagtttattgcctggaaagaagcagaaaactggcttttgcttgggcgtatcctgggccttttgttctccctggcgcttatcggagcgcagagaagcagttgctgcacccgaaacactttttagatgctgcccctgaaatatcaaggaatctgttctggagaagctgggttcatcctcggctctgaaacagagcctcatataccaggcagccactcctggggggactgttctggagggagcaggaggatgcatgttttttttcttgccctgtagatatgttttgggatgtcactcctcagcaacttcctcctctgtgcccacaagtgactcggcgatgacaagtgtggggaggcatttgaggttggaacaagaggcacggagcttacagttgagtttcttggaatctttaagggcacgtaggtttcctagatgtccttgtctcttcccacagtgcccagggcattgatttccacgtggttggtgattttcctggagtgcttcaaataagcacatgttttcccaagtatgatatcctatctctgacaaatgggtggtgggggtcaccgctttacagaggaggagacaaaggtgcccaaggatggcacgcatgcctgtgatcctgcagtcagcatgggtgaggcttggggactcacaccctggcaggttcatcgtttcccccaaccccaagccctcaccctcccactgcccgcgctggccccgcccccaggccctcacctggatgatggactgcagctcctggtttttggtcttcagcatttcattctcccgctccagttccagaacctgctccttcttgggccgattttcaatgtcattcttcagttttagagactgatttctctccagcttacattcctcctccatcttattcaaccggtgctttagctgatcgatctgaaataccccaagggtgcccaggggagaaggcaggtggcaagaaacactcagaaaaggcaacgcttcccccgatcccactgggctggcagcataacctgagttatgcccctctctccttcttccacgggcagagaagggctccaagaaaccttctccagtaaaacaaactgtcatcaccctgttgatggagagttcctgattagtctatttagaatagctccaaaggggctacaggcctcagagaaaattccctcaacctttgtcaggtgggacaggttatggattttgggataaaagagatccaagttggtgtttcccacttcaacgcccttctctgatgggtttcaaattctgatcctcggaactcaaggattcccctgaggaatccaggggttacccagggggaaggaggagatggttgacaagttggggttctgggcatccacactgacttcacatcccagaacagctctgcttgtgtggtttgttcttctgggtttcacacaagattttatttggataaatagcactgttgctaaaaaggaagaggaagaggaggaggaagaggaaaaagaagaaaaaacaggagaaggaggagaagaagaaaagtagaggaagaagaagaggaaggggaagaagagaaaagagaagaagaggaagagaaagaagaagaggaagaggaggaatgagaaggagaaggagaggaggaggaagaagaggaaaaagaggaagaagaggagggggagaagaaggaagaggaggaggagaggaggaggaggaaggaggagaggaagaggaagagaaaggggaagaaggagaaggagaagaagaaagaagaagaaggaagaggaggaggagaagaaagaagaataataggaagaaggaggagaagaaggaggaggaggagaggaagaggaggaggaggagaaggagaaggaaaaggagaaggagaagaagacagcctgaaattcactgaattgtaatttcacaggatctccaccctaaagaacctccctagacttagtggcagaaagagtagcttcctggaggaggcagctattgcatctggaaatgagacaagtggagatgtgctgattttcacactcaagagtttagtgtcaggaactgggaccagcagaagacttcttcaacctgtgagactaacctgtgttcctccccaaacacatcggctttgctaaagtatcccaaacaagaaggttgcattcgagggctataaagaaaggaggcaccaaaggggagagtgtcatttttcaaatctagtcttggaaggagaatcatctcaaggaatctggcaggtagagagcagtggctttagcaagaaaagaccagctcctgcaccccagtgattaacctgagacgatgaagaaaggggcgtgcaggaagcagcccgaggccaagaaaaccagccagggactctgctggccagatgttcttccaaattctacttacactttctcactattaatgtatctccagggaaacataacacaggaggaagttccgggagagaaacttgtaagtctctgccacagggtaacttccccaaatcctaggtaaaaacagcatagaaatctctcctgctcatgcaaaaaaaaaaaaaaaaaaaaaaagctcctcagcatcttcaaagcttaacccaagtgtcctgtggtaagtcccgggtcccacacgagcaggcatggggcgctagcattgtggggtgcttacagggtcagccgctccgccaaagacctacggttcagtatcccagcaatcctagggcacacgtattactttcattattgacatctgcaaatgaggaaactgaggccaatagctaagtaagtcgtaaagcataaagccagaatttgaactcaaagctacaggacttacaaagctcatgcttctaaccaaaacactattgcctgctatgccactgactcaattcacctgaattcccggtggattgtttacggatctgtctgcttcactaaattgtaagtgacctgagcacagctcacgttatttatccccatgtctcccacagtgcttagcacagtgcctcacacgtggcaggtgcttaataaatattctgtgagtctattttccatccagcagccagagtgatccttctcagacataaatcaattgtcactcttcagctctcaatccttcagagggttctcatcacaactagaataaatcccaaagttcttaccatgcccccatgatctggaccccgccatcccttccactcccttctgcaccatttgtttatttggctctggccccactgactctcctgccatttcttttctctttcatttgtttctcttccttccttccttcctccctccctcttcctccctccctccctccctcttccttcctccctcttccttccttcctccctccctccccttccttactccctccctcttccttccttcctccctcccttcctccctttccttccttcctcccttcctttcttccttccttccttccctccctcccttcctgtctttttccttcctttttctttctctttctctctctctcccttccttccttccttccttccttctagttctttcttttgacaggcatggctcactgcagcctcgacctcccaggctcaggtaatcgtcctgccttatcacccctagtagctgggactacaggtgcataccaccatgcctggcttatttttgtagagatggggttttgccatgttgcccatgctggtctcaaactcctggactgaagcaatcctcccgccttggcctccccaaatgctgggattacaggtgtgggccatcaagctcagccttcctgctgtttcttcaaaaacaaaaacaaaaacaaaaacaaaatgccccctacttatgggctttgcgagtgctttcccctgagacttgcatggttggctcctttcatcccttcagatctctcttcatgtgtctccttctcagagacctttcctggacaccctagttaaagtagcaatcctcatgttctgtcctcacgccctgtcttctcttcttgatagcactcatttctaccaagtatctatgcatttgttttctgattacaatgttagttccacgacagaagggttttagtcttcagctatgtatccctggaaaagagcctgggggccaggtgtggtggcttatacctgtaatcccagcactttgggaggccaagtgtgcagattgcccgagcccaggagttcaagaccagcctgggcaacatggtgaaaccctgtctttactaaaaatagaaaaaggggggtgggtaggataaaaatagaaaaaaattagctggcatagcatgtacctgtagtcccagctacttgggaggctaaggtgggaggatcacctgagcctgcaaggccaaagctacagtgagctgtgatcacaccactgcactccagcctgggtgacagagtgagactctgtccaaaaaactcctccaaaaaacccaaaaacaaaaagcctggtacccgatggaactcaataaacagaaagaatgaacgaggccgggtgcagtggctcatacctgtaatcccaccactttgtaaggccaagggaggcagatcacttgagcccaggagttgcagatcagcctgggcaaaatagcgagaccccttttctacaaaaaaattgaaagaatagcctggcgtgatggtgggcacctgtagtcccagctactttggaggctgagacaggaggatcacttgagtctaggaggtcaaggcttcagtgagccatgatcacaccactgcagcctgggcagtggaagaccctgtctcaaaaaaaaaaaaaaaaaaaaaaaaaaaaaagaaaagaaaaagaaagaaagaaaagaaggaaaggaaaataaaagaaaagaaaaaagaagatgtaaatctccttaattcatttgcggagtgagccattctgggtctgcatgcgcatgtgcaaggtggatctgggactgagccggtggtggaaagctgcgcactgggtcggtccttgtgcgcatgtctgcccatgcgcacaggggatgtaggccgcttacccggtagcgctaagcactatgggtacacgtgcaggtgcatagtggacctagaactcccagaggccctgtgtcctccattcccccacacctggctggcaggaagctccggcagaccacgtgcatgtgcctgcacctgctttatgggagaattgagccctggtgacatttgtttcccccgggtcaccctggcggagtagcccttgggcacccctcacctcgagttggaggtctcggctcctcatgaccgccatgttcttctcctcactgagctgtgcgtagcgcatggctaagttgtagttgtcgtccttcaccttgaccagctcgtcattgtagctgtcccgctcttccttcatcttgtagtaccgctcctggaaggttagcagctccacgcgcgtcagcgtcatctgcttcttctcatcctccagctgccgcaacctggccagcagctcgcagcgttgcaggtccttggccttcatctgctgctgcagcttgatgacctcgttcatcaggaagtgcgtgaggccctcgtggccttcctccactgtggagagggggcacccagtcaggcctgaggactgggaagtggaaaaaggaggttccagacgcagggcaggtgccattcattcactcactcaccaacgttgtgccaagctctttactcactctgcccacgaggcactggggattcagagtgagcgagactcacagccttggccccgggagagcttagggtgtaataagagaaacacatttaaaaaaatcaaatgataccacaaatagaattacagaccgtgaggatttcacaaagtaaaggtagatggggctatgagagtgtgtagcaggggcccagatccagccttgtgggcagagggggttggagaaggctcctgatggttgaggtaaaatgttaagttcgggtgggaaaaggcattctaggaaaggggaacaacattgccaaggccatatggggaggagggaggaacttggcatatttcaggaactgaacgaagaccaaagtggccgaaggagagagagagaagagaaaggcgaggctggtggtgtcagcagggactggatcatgaagggtccttgtgggctgcattaaagacctgggactttttttatattttaaaacagggtctcgctctattacccaggctggagtgcaggggcatgatcatagcttattgcagcctggaactcctgggctcaagcaattctatggctgcagcctccaaaagtgttggaatttcaggcatgagccactgtgcctggccaagacctgggtctttacaaagaagcaatgaaaaaccaccaaagggttttaaataggggaggaagaatggagaaagcactggaacagatcgggaatggatatggagagttaatggggttgtgggagtctggactgtgggaagtgttggggcgggcgagaagactgattcaagaatgtttagaaaggaagattaagaaggcaagatgctcaagggctctggcccatgagacactagaaagaatgcaggcaaggcaaggacaagatctacggggtagaatgaacttgtgttccacctggcgccattcatgggggatggtccgtgaacacccacttctcttggttcctgcttccctttgcccctgttaacctttcatcatcaagcaaaataagtggttgacagaccccagttctatatgtcatagattcacagcttaagaaccatgccactactgaggacacacacacacacacacacacacacagacacacacacacacacgcccctcctcttagagtccagatgttcccaatggcaaaagcacttacccacaatggtggagaatctccgagtgggctctttcccagtcaccagtttgtacagttctgggtaataaaattctaggctctccaagaagaccacatagcccctttgccccttggtatgtagaatgtccaacagccggcctaggggaaagaccagatcactctgtgagaatacatatctgatggaacgcaagtctctgtggctggtctcatcctggacttgtgtccttcaatcaactctaagaagacagtctccccacattctatcacttctgagttgtatcttggagcccagatgacgtaaatcaaggtgccaggccctccgcagggatttggtgagcgttagttttctgtttctaataaactggtagaaccaggataaatggaattgccgccccagttttgaagagtttcccaactgaccagggccaaaatgaaccacgtaggcaccaggtcttctatgactgaaggaggttggaagcacgataaaaattatggaataatatatggttctctgggattgagagcaggaagacaaatctttgggtgagaggctaggaaaaatcataggaagtagggatagttctaggtttttctttgggattattacacaacctggaaacaccttaaatgtaatttccccagcaggtcccagtttctatactattgattccacttattgcttacatttctgggcccttccttaaacattttattttcagatattcttctgagatatagaagaagaaaggtaggtcttaaaactcgaccttttccctaggacggacagaagaaataaatttgatggtatgtcaaccccgattgtttggtgaagccgcctgcagtactgtttcgagaaacattccaaagttacatccaagctcagtgggaaagcatgctgattactgatgtctgccatggatgccagagagtcgcagctgatgagccacttaccaccagccacgctgggggacagtgattatcaaaccttctaaactgatccatagaaagaaaaacatttaacattgtggtctagtgaccatagacaaagataactctacaagtacatgtgtatacacatgtacataatgtaaaattaaaacaagcttcacaaaccatatttattacctttactgaatatgataaaccccccctccagaagtcaggctagaaaagcttgtggaacccttctcggaatatttttaaacagataaagtacatcagattacaaaagaaaccaattataataaaatccagttatcaaatattaaataaatttgtgtttcagtaacatacttctttattaatgcattaaataacaagacctctcggcaggtctaataagtactgtaattttgaaagagagatgagtgtaagtggcattttgagagatttgcagtaactgtagtgataggaagagatctgtaattttcattgttgcctaagtcacaagaattactaatcactcctgtaatttgtggcttcctgacatttgcaattgagggcaatgctgaattgcagttgaggttggtaaaataaagatggcatttcttcccccctcccagtttatggatcctttgagttccatacacagacagcttgagttctatacacaaatgagtaggtgatggactgcggaccccagtttaaaaatccctgacctagagcaacttcattttggtacagctaccaaagggtatgtctggaagttgccgtgtgcggtagccctccctctcccgcaaagaggtcctaaggttacctgctcggttgatcttggatggcagcataggggcattaagcacttcatcttcatcctgctcatcaatgaccttacactgacgcaggtagggcgtgagcttggcagggttgatatagcggctgagcatgtgccggttacactccacattctcccacaaggcgtcctcttcatccttcagcgtctccatgtagtcatccatctctggccctcctccttttagacataaaccccaacaagcttaataaagcagtctcactggaacagctctatcaactcctctggagtgacctctagaatatattaagttaaaaaaaagtcctgtacactaaagtatatatagcattttaccttttgtctaagaaaggggttatgaatataaaaatatatatttccttatatgctaaacataaacaatggaagtttaagccatcaattttaaaaaagattatttatagggcagagagggaaaatcctgcggttgagtctaccctttccatccaagtttttatgtcttactaaaaatgtatagttccctaaacaatatatactattggcttttgttttaaaatttcacataaatggtgtcatactgtacgtttcctttttcagcatgtttttctccctctacatttttttttgagatttatctagatggatacatatagatctaagtcattcgtttttaaaaatagctttattgtgatgtaattcacatagcatacaagttacctttttaatatgttcaattcaatgattttagtatattcacagagctgtgcaaccaccaccacaatcaatttaaaatcatttccgtcatttcaaaaagaagctcctcaccctttattagccactctcaatttccctctaatccctgctcctccagccctgtgtaaccactcgttcaccttctgtctgtatagatttgtcttttccgtacattttatacaagtgaaatcctacaatttatggtctttcatgtctggcttctttcactcagcaacttttcaaggtttgttcctgttgtagcatgtatcaggacttcacttattttaaattgctcagtgattttttcattgcatggacatgccccattttgcttgtctgttcatccactaatggacatttgagttatttctaccttttgtctattatgaacaatgctgctatgaacattcatgtaaaagtttttgtgtgactgtatgtttttatttcccttgggtagatacgtaagagtggattgttaggccatatggcaactctatatttaacattttgaggaattgccaaattgttttccaaagcagctgcatcattttacattgccaccaacaagccatgagggttttaattcctccatattcttgctaacaacttgttattgtctgtcttttttattacagctctcctactgagtgtgaagtagcatctcattgtggttttgatttgcatttccctaatgactaacgatgttgagcatcttttcatgtgcatattggccatttgtgtgcattgagaaatgtctattcaaatcctttgcccattttaaaattgtgttgtttgtctttttattattgggttgtaggattttgttatgtattctggatgcaagccacttatcagatatatgacttgcaaatattttctcccactctgtcagttgtcttttcactttcttaaaagcattgtttgtagcacaaaagtttcaaattttgaggtagtccaatttatttattttttctttttttcacttgtgctcttggcatgtatccgaaacaccattgtctaactcaagatgatgaagacttactcctgttttttgcctttgaatattataccttagttcttacattgaggatgatccattttgagttaatttttgtgtatggtgtgaggtaggggtccagttgcattcttttatgtgtggatgtccagttgtccaagcacagtttgtttgaaaagactactctttccccattgaatgatcttgctacccttgttgacaatcaactgaccataaaagtaaacatttgtttttgcactattgattctattccattgatctatatgtgtatccttatgccagtactacattgtcttgattaccgaagatttgtagatttgtagtaggccttgaaattgggagtatgggtctcccaaccttgttctttttcaagattgttttggctattaggtgccttttacctaattttaggattaggatgtcaatttctgcaaaaaaggcagttggcattttggtagtgaatctgctgaatatgtagatcaatttggagagtactgctacctaacaatattaaatcttctgatctatgaacagggggatgtctttctttaaatcttctttaatttctttcagcaatgtttcatagttctcagtgtacaagtcttgcacttcttttgttaaatatattcctaagtatttcattaatttgatgacattataaatgggagtttttttcttaatttcatttgtgggatattcattgctggtctatagatatataatttatttttgtatattgaccttgtattctgcaaccttgtgaaatcatttattagttctgttagtttgttagagacatcttatgatagcctatatataagatcatgtcatttgcagataaaggtagttttacttctgtttttccaatctgggtgccttttatttctcttctttgcctaattgctctggctaaaatacctccagtacaatgttagatagaaatgttaacagcaggaatccttgctttgttactgatgttagcggacagcatccaatctttcactgtcaagtatgacattagctgtaggcttttgcttttgtttttaagatagatgtcctttatcaggttgaggaagttttcttaccttcttggtttattgaatgtttttatcctgaaagggttgtcgattttgtcagatgctttttctgcatttattgaggctgccatgtggtttttgttttttattgtattgatagggttacactacctgactttcagatgttaaaccaaccttgtattcctggcataaatcccacacagtcagggtgtataattctttttatatgttgctttttatatgttgctggatttaacttgttttttaaaataggatttttgcattcatattcataagagatattggtctgtagttttcttttcctgtgatgtcattgtctggttttgatattggcctcagaatgatttaggaagtgtttcttcctcttctgctttttggaagaggcttttaagaattgatattaatttttcttttgtttggtagaacttacaagtaaagacatctgggcatgggtttttctttgtggattatttttacaaattcagcctccttacttattacaggtctgttcatattttctgtttgtcttgagccagtttcagtagtttgtgtctttctaggaatttgtccattatatctaagttatctaatttattggcagcaattgctcacagttcccttcataattctttttatctctataagttcagttataatttcccccctttcatttctgattctagtaatttgcatcttctctcttattttgtcgatatatcaaagaaccaacttttggtttcattaattctctgtattccttttctattctcaggttcatttgcttctgccctagtcctgattatttcctttcttttccttgctttaggtttagttagctcttctttttctacttttgcaagggaggaggtaaaactgcctttgcaaaagttataacagaaaattctgacagtgaaagagatctgacctaaccaattccatcttgcttctaacctccaagcagtcctcgttcattcctgggcagaggccaaactaactttgggaggaacttagttcatagattaatgtattattctgctgctgtcagatggagtggactacagatgtctgttaggtctagttttttttttttttttttttttttttttttttttgataaagagcctccctctgtcaccaaggctggagtgcagtggtgcaatcttggcttactccaacttctgcttcctgggttccagccagcatgtctggctaatttttgtatttttagtagagacagggttttgccatgttggccaggctggtctcgaattcctgacctcaagtgatccacctgctttggcctcccaaaatgctgggattacaggtgtaagccaccacgcccagccaggtctggtttgtttatagtgttgtacaagtttcttatttgttgatcttctgcctagttgttctatccattattcaaagtaaagtaataacgtcttcaactcttttttttgagacagaatctcactctgttgcccaggctggagtgcaatggcgtgatctcagttcaccgcaacctctgcctgccgggttcaagtgattctcctgcctcagcctcctgagtagctgggattacaggcacctgtcaccatgcttggctaattttgtatttttagtagagacggggtttctccatgttggccaggctggtctcgaactcctgacctcaggtgatctgcctgcctcggcctcccaaagtgctgggactacaggcatgagccactgcgcctggccaacgtcttcaactcttattgttgaattgtgtatctctccctccagctctgtccatctttgcttcatgtatctggggctctgataggtgcatatgcttataactcttatagcttctcagtggattgaccattttatcattatgagatgttcttctttagccacagccaaattcctggacctggggatttcacagtggtgggatgggtgagtgtgctgggggcaattgagctagaaggtggcattggtgtagccatggaggttggagctcagccagggtgaggagacatgcaggcaggtcaaggctatgagggcagagaagaaaccagcaagcagaggaagctggtctaccgagtggtgccatggtgagcccatgaggttccatgagaagcggatggccggggtcatctctcttgctgcataactcagttcccaacctcatgagccttggccttctgtggtgtctggtccttgttgtaggctttcagtatccttccaccttccccgttaatttgagctattaaatttgttttaaaaattatcatttttagagacagggttttgctctgccacccaggctggaatgcagtggggcaatcctagctcatggcagcctcaaactcctgggctcaagcaatcctcccacctcagcctcctgagtggttaggactacaggtgtgtgcctccacccctggctgttttgaacattttttgtagagacagggtctcactacaggcatgcaccaccatgctgtagtttgcccaggctagtctcaaactcctggcctcaaatgaccctcctacctcagcctcccaaagtgctgggattacagtcatgagccaccactcttggccaatttgagatatttcaagtgggattttgttccctgcaaccaaagtgccttgagtaaaaatatctattttctgtcatgagcaaaagttggatttaaagtaattaaaaatgaggatttggtctccattgaatccaatgaactttgtatagatgacaacctccatagttcactgccttaagttctgacctctatgagccttttgctaacacatggcactggctacctgggtcaaagccagcaacaccatagacacgcctacaacaatggctcattctgacaacatgaccacgtgatcatttgcattcacaaaggaaaatgtacttgcttttattattttcaagaagtggacagcctaagaattttattcaacgaattatttattgactaggtggcaggcactgctggtgtctctccacacgacccccgacttcctgctaacagaatccttttttttttttccccaaaagccaggcagtctgatgcttcagggaggctgaatatcttttgagctgcaaagagtggcccttgtttggtctctaccagtagcgtagaaacaagcaggtgaagtgcttttggccatgcaacctgcaggaacatgcactgggagcggttctggaggttttccttgatctttaacagggacaccttgtccttgggcttttggctatgagtgtgtaaaggtgaatgtgatggtttgggtcactgcacctcagcctgtatccctcaggtgacatcaaggaccgagggtctttccagctctctgctctgccatcctgagcccctcccacctctggactcctgtaagatataaatgctctttgtcccaagccttgtgaagttgggtctactgtgatttgcagcccaaagcctcctaactaataaagacatctacttagtacaaagacttgctcagcaccatgaatgcacaagagagctgaaaggcaggtgttaagaagcttataccttttgcggggtcagaaggcacaggcctaggaattaaacagcagctcaaggcaagaagacaggcaggtctggatagaccaaccagcatttcttaccagctttcatgaacaaggaggttgtagttggcacatgccaaccacgtgttacaagagtgctcagtgacatagaaagccttcctcccgggaccccgggtgacccggtgcagccacctcagcggcctgtcagctaagcaggaaataactagggccaaatcttctttccagagcagagatgaaagggaccctcctacctcattgtagctctctgcagccttgagctcccaggctccagcaatcctcccacctcagcctcctaagtagctgggactataggcgcacaccaccatgcccggccaagggacccttctacctcagatgcagtgaaatcacagaccctggatctcgttgaaacctgtcccatcgttaatgcccctttgcagcacagttgcttagcaaccaggggtgaagttgaacttgggaaagtggaccagtttgtgagtgcctggactgaaagggcctcttcaacctcagccgacttgagtgagaactggctctgtgctgagcactgtgctgggaacagagggtgcaaagacgtttcgcacacagaccctgggttgcaagctgctcagaggttggtggtaagtgtcagccgcccacacaagccccggtgggaggaacagcatcctctggaaccctgcagagagggcagccacacgccctgctggcagaacaggaagtgcttccccactgggctgcccgcgtgccaggcaccgtgcctgaccctttatagaaattatctcatttggctgggcatggtgattacacctgtaatcccagcactttgggaggccgaggtgggcagatcacttgaggtcaggagttcgagaccaggctggctaacatagcgaaaccccgtctcttctaaaaatacaaaacatcagctgagcatggtggcaggtgcctgtagtcccagctactcaggaggcagaggcaagagaatcacttgaacccaggaggcagagtttgcagtgaacccagattgttccactgcactccagccctggcaacagagcaagactctgtctccaaaaaaaaaaaaaaagaaatcatctcatttaacgaccacagcggctctgagagatggatgtgctcacccttgttttgtagacaaggaaaccaagaaccagagagccctagcaacttgctgagggtcacatagcaaatctaactggggttccagcccacgcctccttcatgtgaagacctccctgaggttccccctccttagagagctgggagcattttgagtgggagtttgctaggcagagggacaggcaagataaagtagcctggtgaagggtgagttcatatcacaaacacccggagccatgatctgggggcatctgttctcactggagtgacagagtaaggacgctattgcacctctgctcccagcaggggctcacctgcagacatttgttactgtatgaaaaaaacctgcaagggctggaaaacaagttggtttcacctagtagggttgaacatgcagaacatacatgccaggagtcccttctagatatcatccctagagaaattctacccgtgtgcatccagagacctgtgcaagaatgttcaacagcagcaccgtgtatccaaaaccagaaaccacacacagacatcgtccaacagcgtggataaatacactgtgtattcaacgctggagcactccccagcagtgaacatggaaagaaatatgaccatgtgcataagcacaggtggacctcaggaacatgatgctgagtgaaaaagcaagccacagaagatgcatggtataaaactgtctataagtacttcaaaaacaggctgggcacagtggctcacgcctataatctcagcactttgggaggcccaggtgggaggattgcttgaggccagaagtttgagaccagcctggaaaacacagcgagacaccatctctacaaaaaataaaaacaaagtagctgggcatggtggtacacgcctgtagtcccagctgcttgggaggtgggaggatcacttgagcctaggagatcgaggctgcaatgaactacgatggcaccactacattccagcctgggaaaaagtgagaccctgtctctaaaaaattaaaaaaatatatacatatatataaaacaaggctgagtgagatggctcatgcctgaaatcccagcactttgggaggccgagacgggagactgggagtttgaggccagcctggacgatatagcaagaccccatctctacaaaaaaataaaaacttagctgggtgtggggttgcgtgcttgtagtcccagctacccagaaggctgagatggaaggattgcttaagccaggaggttgaggctgcagggagctatcatcataccactgtactccagcctgggagacagagcaaaatcctgtcttaaaaataattttttttttaaacatacaaaacaaaaccctactgttaaggatatacggcaaaactataccaagaaacaaggggactgataaaaatcagaatggtggcttcccatggggaggggcagccagacagatgtgacctcggaaggtcccctgaggacattggtgacacaaggaattatgttatgcttcaactggggacatgagtgtctgtttcattgttctctgcctcatagatacacattatatatacatatttatatgtatgaaatatttcatggaaaaaatctatggagagtgtagctagcctcaaaagaaaaaaaatgtctcagacgcaattcgaaatgtattttcccttctaacacttccctctaactcagcatgactcagcctcatcaccggggatgaacccagtgactctgtcaagctctgggcagtttctttgaaggcagttttctcagaaatgtgcccagaggccccgaggctctgaactttaacagcatggcaggttggatggcccgtccctacctaagtcttagctggagcttgtcgcaactcgcaactcaaacccaacctttggcagggtttgacttccagtgtgagacaggtcctaggccacaccaatctctttgcaaatggctgaaaagcaagtgccagacccccaggctaggctccacagaaagggctgtgttgctcaccttccctgggaagcaaaggaccaggaggtgacccacctgaggacgaattccatgagagttgctggcctcacgtcctgacttactcattcaagacctctactgtggcttcctcttgctgttatgataaagttccaatcttttttttttttttttcttgagatagggtcctgcgctgttgcccaggctggagtgccgtggcgtgatctcagctcacagcagcctctgcctcctgagctcaagcaatcctcctgcctccacctactgagtagctgggaccacaggcaaacaccaccgtggccagctaatattttaaaaattatttttgtagagatggggtcttgctatgttgcccaggctggtctcaaactcctgggctcgagtgatcttcccaccttggactcccaaagtgctgggattacaggcatgaccaccatgccaagccatgttcaacttttttttttttttttttttttgagatagagtcttgctctttcacccaggctggagtgcagtggcaccatctgggctcactgcagcctcggcctcctgggtccaaggattctcctgcctcagcctcctgagtagctggggttacagatgcccaccaccatgcctggctaatttttgtattttttgtagagacggggtttcaccatgttggccaggctggtctcgaactcttgacctcagatgatccacttgcctcggcctcccaaagtgctgggatttacaggtgtaagccactgtgcctggcccatgttcagcatcttgatcttgatcttcaggccctgcaaggtttgctttctgccagcccctcaatcttatcacaactacatccccggcctgccagccttttctctgatggtctcccaagctccggctggtgtcacagcctgatctctgcccctctctcccttcactactcccgcccctccgccaagtctcaggtcaccatcacttgcgttttttccaatataaaggaacggccaggcacagtgtctcctgcctgtaatcagtgctttgggaggcagagacagggagatcgcttgaggccaggagtttgagaccagtctgggcaacggagcaaggccctgtctctacaaaaaatttaaaaaattcaccagatttggttgtgtgtgcctgtggtcccagctacttgggaggctaaaatgggaggatcacttgagccaaggaggtggagggctgcagtatgttatgatcacatcactgcactccagccgcagtgatagaacaagaccctgtctctccataatatatagagaggtatagaggggataacagatgccgagtacctggcatggaggggtgctcacacacaggggctgctatcccgccattggggtgtgacttctacactttccggctggatcttgtcgtcccttgagccaggctcccgttgcatctggacttgcagtgcttgggatctgaaaaggaagagataatcagccttggagcaggaggcggaggatggagagaaagggaatcgttctgggatcaaagagatgttctgctttggaagaaaaggccaggaagtcctgaggggcgtgtcaccctcgatgacactggcagagtggaccacaccaggggctgcagggggagaggggcttctgttccaccctggggagtggacagcctgggaggccactgacacaggtcctgacacccctggagatggggaggagggaagatggcagccttgggcatgctcgtggccagtgtggaagatctttgatggaaaaggctttgatggaaacctctgcagactggagccgctctaatcagctgctaattcattaggtcaaaagcagcaaaccccgttcccaaaccccgaagagttcccgtcactgtgaattatgtctttagcctccagcctgccatgggtttgggcaggaacacgcggtagcccacacacgctgtaatttcccaagggcagtgttccttatggtgactgacgaggccaccgctaatgccccactcagccatccaggagcccagctgggggtttgggttttttggggaagggtcagttctccttctggagaaaggaggccaggatctcactctgttgcccaggctggagtgcagtgggacaatcatggtaagagggaaaggtggggttcaaacccttgtacggtggaaagagccttatgcctgtccccaaagctgcttggaacctggtggggggcaggctttaggcagctgctctaggacagttccattcaggagtgacagggaccctcggccgctgatgtttaatcaaggacttccttggttttggctttgaagactaaccacaggtgacatgagatctcccggggctgacagaagctgttcctgtcgggcaacggctgggcttggagtgaactgtcagaggccctcagccccggggaggtggtggcgacaggcatcgctgcaggacaccatctccctggtctcctcacggcctccctgctctgtggctgggacagggccaggggttggggctgggtggggaagggaatgagagaaccaagggcctctgcaaaggcagcaaagcagtccacaggccagtcagcaaacacaaagggaaatgacactgtctgcatttcttaaaaaagagaatgtgtttatcatcagaaaaaaaaaggctttaaaaaattgtaaggaaggctttaattgtggccaggcatggtggcttatgcctgtaatcccagcactttgaaaagctgaagtgggaggattgcttgaggtcaggggttcaagaccagcttgggggaacatagcgagaccctatctctacaaaaaaaaaaaaattatctggcctgtacacctacagtctcagctactcaagaggctgaggtgggaagatcgcttgagcccaggaggttgaggctgcagtgagccatgattgcgccactgtactccagctggggtgacagagcaagaccctgtctcaaagagaaaaaaaagaaaggttttaattacaagaaaggagaaacaaggctgggtgctgtggctcacgcctgtaatcccagcagtttgggaggccgaggtgggcagatcagctgaggtcgggagtttgagaccagcctgaccaacatggcgaagctccgtctctactaaaaatacagaaattagctgggtgtggcgcatgcctgttgtcccagctactggggaggttaaggcaggagaatcgcttgagctgggggcagaggttgcagtgagccgagatcgcacagtcgcactccagcctgggctgcaagagtgaaactctgtctcaaaaaaaaaaaaaaaaaaaaaaaggagaaacaggcttgaacaactacccttgctgttctacccctaccccctacccactatgtcaacgtaggttgggaaaactgaggcacaagaaaaccagtactgaggctgggctgtttctgactttagaattttgatgacagcatttgggaacttggtcctcaggtcagggaagatttctaggattaaaagtcaatctcttgaccacttgcaagactggctcataggtgtaacatgcaactgaccaaacaccatccctcgtgcttacagactatccggtgtgtgccagacactttgttaggcgtcactgatgaacctccagaacactttgaggtaggtggtatcatcatcaccaccaccaccaccaccttacaaccaagaacacaaaagcttagagagggctgggcatggtggctcacgcctataatcccagcactttgggaggctgacgcgggtggatcatgaggtcaggagatcgagaccaacctatcctggctaacatggtgaaaccccgtctctactaaaagtgcaaaaaaattagccgggtatggtggtgggcgcctgtaatcccagcactttgggaagccgaggcgggaggatcacaaggtcaggatatagagacagtcctggctaatatggtgaaagcctgtctctactaaaaatacgaaaaattagccaggcatggtggtgggtgcccgtagtcccagctactcgagtggctgaggcaggagaatggtgggaaaccgggaggcggagctttcagtgagtcgaaatcgcgccactgcactccagcctgggcaacagagcaagactccgtctcaaaacaaacaaacaaacaactattgcttctcaaaagaggaatcaattgcttaatgcactgtagattcctcatggtggtgttttccaagtacaatcaatgcccattcaccccactatgaagcctgctagttgacaaacgaaatgttagtttttcttttttttccttttttttgagatggagtgttgctctcgttgcccaggctggagtgcagtggtgtgatctctgctcactgcaacctctgcctcctgggttcaagtgattctcctgcctcagcctcctgagtaactgggattacaggcatgcgccaccatgcccggctaatttttgtatttttagtagagatggggttttaccatgttggccaggctggtctcgaactcctgacctcaggtgatccaacagccttggcctcccaaaatgctgggattacaggtgtgagccaccgtgcctggctgggaaatgctggggtttttgtggcctctcacttaagaataaatagaggcaaggatcacttgatggttgaggaaagtctccacatgaaaggcagagatcaaaagggtcacacagacacaaggaacctgctaggagcagacaatgcacagaataagagaaaattttaaaaaaacataacctggccggtgcagtggctcacacctctaatcccagtactttgggaagctgaggtgggaggattgcttgagcccagggattcgaggccagtttgaacaatatagcgagacactgtctccacaaaaaatcaaaaaattagctgggcatggttatatgtacctgtagtcttggctacacaggagggtgagtcaggaggattgctcgaccccaggagattgaggctgcagtgagccatgtttgcaccactgcattccagcctgagcaacacagcgataccctgtctcaaaagaaacccccaaaacataacctgataattaagaatcatttagagatgagatgaagcactgcatccataaagcaatggtagggtgctaagaagaggaacaatcaaagaacaagaagttcttggcaattaaaaataaggcagcagaaatttaaaatcaatagaaggcttggaagataaagttgaggaaatttcctgaaaagttaaataaaaaattaaagagaaggaagataagaggggagggaatgagatcaatttaggaggtctaatatccaataaatagaaatcctaaaaagagatgacaaagactgtgtcttcttgttatatatcttctggggatagactataaatcaagggatgaaattatcagagaaataaagttagagaattctctgagtgtaaaaacatgagacttcagacttaataggctctttgaatattagtacaatcagttgaaaagaaccttctcagtgcacattgttgcaaaaattctggccaccagggaataagaaacgaccctagaagtttccagagagaaaacctcaggtcacatgaagaagaatggaagcaaatataccatcaaactcctcaatacaaatactggaagctcggagaaaatgaggcaatgccttcacatttttgatggaaaattcttttttacctgggatcctatatccacccaaactattatgtgtgaaaatagaataaaaattattttcagaaaagcaggaactccaaatatttgctcctgggcaccttttcattggaagctactagaggatatgatgcagcaaaatgaggaagtaaacaataaagaggaaggtgtggagctcacaaagcaaggaatctacttggggaagcatcaaggaaagtcccagggtgaaagtaaagcggccaggagcaattggccaagattgcaacaggatcatggagtgtccacaagggagaggttgccaggggaaaaacagaatgattttctgatatatttgataattcaggaaatcatattgttaggcgaatgacagatctgagagtcagatggggaaacaatgaagaataagtatatttaaaagaaaccctgcgcaaaagcaaaggaaaaaaaaaagaggcaatattaactccaggaaaaaaacaaaagtgcagacaagaaagaaaatcagagcacacaacttgccttaacatgaacaatatttacctagttataataatataaccaccacagatgaatcaacacaacagattgtggcctaatataatgagaaaatggaggaaggggaagtgctttgaatgggttattagtaaaagagagctaaattctcatctatctaacaatatgtcagttgataatgtcttaaaactaacatatcaacaaatagcaaggcaaacattatttagacctagtgaaaaagaacagaagaaataacagaagaaaacaaagtgaaaaagaggtttttttgttttgttttttgtttttaggtggagtcgcactctgtcacccaggatggagtgcagtggcacgattttggctcactgcaacctccacctcccaggttcatgcgattctcctgcctcagcctcccaagtagctgggattacaggtatgctctatgtctggctaatttttgtatatttagtagagacggggtttcaccatgttggccaggctggtctcaaactcctgatcttaagtgatccacctgcctgggcctcccaaagtgctgggattataggcatgagccactgtgcttggcctgaagaagagtttgaggtgattgcctctggggatcaggactaggggatgatgatggctgggttggggagtgatgtttttcttacatgcctattttactttcttattttcaattttttaattaaaaatataatagagatggggttttgtcatattgcccaggctggtcttgaattcctggactcaagtgatccacccgccttggcctcccaaagtgctggaattacggacgtagccaccatgcctggtgtattttgctcctttgcatgactcatgtatgacttcgataaaaaataaaactaacttaaaaaaacacatgtcagtcattggaaatatggataatgcatttaagtatgaagaacaaaatagttatcttcagtctttgcacacacaccacgttccatcttttgcaatgcttgtgagtcagctcaccccttcctaaactgaaactgctgactgtgtacctggctcttcatggctatcaccttgattaatcttcacagaagctcaattaggtggttttattactcccattttatggatgagaaggtaggatctgagagttcaataacagagtgagatctcacagctaataagtggaagagcagagattcctactgagcctccctgaactccacatcatctgagcttaattaaactagcaatcatcccagctaatgtttatttagcatagcatctaatcgaaccaattatattcttttcttcctgagctccaaatcttcctctttattactgtgtgtgtgtgtgtctgtgtgtagagacagggcctcactatgctctggaattataggtgtgagccaccgtgcccagcctctttattaatttaagccctcattttgctggaatgtatactcgaatagctgcctctgaaaaggcatatggagttgctatttgccagatatcatgctaaatgctctatgtcgattatctcatttaatacacaaaacaaccctatgaggtagatactcctacgctccttattttatagaagaggaaactgaggcactcaaagagagttccagcaatttgccacatgtctgtctcatctctgtatccccaggagaaattagcatggagctatattcttagtaggtgttcaatatatatatttgttgagtggataaatacaaataaatatcaaatcttgaataaaataaacattaagtttcccattgcttcaaacccagggagccctctggaaatgagctgtcttgggggggcagacacctcttttttccaagagctgccccagtgcaaaagctctggaaacaggaggagataaacagttagttagatgaatgcatctctggttaattgatttgcctgcatgattggagtgaatggcttaatatgcagggtttaattattccaatgaaacctccacttaattgaaagggcttctagcaaaaaaagggaaagagattatttaaaaggatgatctactgcccatgagaaaggattgaagagacatggatacatgcccggactccagctatactcagtgtttacagccttgaaatgaaagcttgatggaaaagagccagaatcatcccttcatgtaccacctgccccatccccttcattcctacaaagagggcacttgcagaagcagctagaaaattccccctgcaagactattccctggtatcccagttaactttttaacctctgtctatctcagctcattcaaccaaaatcctgagatgataatatttcccatcaattaacatgcgttgagcaatcagcagagcttcactgatacatattttgaaagtagcaattatcattttaaatttgcagtggtgtggcagacattgccagctgctggcccaatagccattctctcttacttattaagagatcaccagttttgtttgggaacattactgtgcccaaccaaaaacctgttatttccagcatcccttgcagctaggtggctatttgacacgactctggccagtgagatgtaggtggaagtttctggatgagtcatatgggaaggctctttaaaaggaggcagatttcagatgagaagagccctttacttgtccttctcttcctacctggaatgtgggtgtgatgcctggaggcatagcagctattttgtgacagtgaagactaggccaggctctaaggatgtctgactaggatgctataagaacctcaggtcattgatgacaaccctggacagctaacctttgaattcttggtccatgagaagagtaaaacccctagtaggcagaaaatctgattctgtttctattatttgcagctgcaaacagtcctaacagatacaagtgccacatacaacgcacactttctaagttatattggtcctggccacagacccctgatccctgaaatcagagcaacccgcttatcgatctattccttcccattcttttttcctagagacaaaaccaaagttggcaagtggtcaataagaactaagtatttaatactatccgtgtctaaagtgctgcggcggacagaaacaaatggtgcagctctgaggggtgagcagtaccatgaggagataaggatcgcccaggaaattgtaactcacggacgacaccctcagccattggtttaaccactcccagctttcagtgtgtaggcaggatgatttatctcacccgccttctgtggccctgctttgtatccccagcatgcccctcactgtgcagtcaatgctgtcacttctccagcctctgccttatcccctgggctgcatctccccttgcatcagctctcactcttccataggcaccctacctcctccccatgtcacattacagccgagcttcccggccaccatccccggcaaggcctagtcccttggtccagagcactgcccgccaccccaagcatcccctcaggcaccagactgcctctaatattcatacctgaagctccccaagaggccacatcatttttagctgactcaggcaaagggccaatggctcctgaagataaaaatgtctcatcttgattcctttttagggaaggcgagagcatcagtaggaagttaggaggggctggtgtgccctgaacccagagaccaagggcaccaccacatatcatcccccagccccccggaatatatccacacttattctgcagtggcttcagatttgtaccaagacgatgaagtgtggaagggcacgcacccctagtattcccaaaggaccctgcttcctgggtctccttttttctaacgccaccgcagaaaagcttttgatagaagcccaattaggagtgacagatttaaattgttctgaaatgcacatcaattcatcacgtccactttttatgagcattggccccacctggatttcaggtccgtgcacagggctgattgacagctctgatggcgaccaggagccatgatgggaccactcagccagacccaaatcccagagtgaggtcaccctctcggactcctgtcaagtcagacttgctacaggactggctagggggaaaccctggccttgataacgaaatactcttctctcctgctgttgcctctgaagcctggtcagcaaatccgccttccccacaggagactgataagcagttgcgaccaccagctgattccaattcaagacctctctgtgctttcaaagatgggctcttggcttcacctgtgcactggatggaatttgtttcattgctgtgttcttcagtgtcctggctggcattttattgcctgggttggaagcaacttggggagcccattgtccctctttgagttctctatgtcagtgtcgtgatttgcttgggccacgctatccggtatggagtgggtttttaataaatatttgccgaattgagtgctctgatgttttatgataaaaacattctgttgtcacagaattacattcagtgtcagtccaccaaggagaatgcagtgagcttaagtgctgtgacgggcccgggacggctactctgcagttttgtctgactgctccagtggagtgaggacccttccttcatgccacctgtgcactgggcacagaacaaatttttgtaccacttcttttttaaattaaaaattttatttttacagatggggtcttgctctgtcatccaggctggagtgcagtggcatgatcatagctcactgcagcctccaactcctgggctcaagtgatcctcccatcacagcctcccagagcactggtattacaggggcacaccaccacccctggataactttgttttttaagagatgggggggcggggggttcttgctatgttgcccagtctggtcttgaactcttggcttcaagggatcctcttgccttggcctcccaaagtgctgggatttcaggcatgaggcagcctgctgggcccagtttctgcttcttaccctcttttgccattgctggttcatacacctgtcgtgaattccttggaggaggcctcacgtgcacccatcggtgcctttccagcacagcacctggccctcctttgtagcgtgacggaataaacaagtctcctgtagcgtttagcctggagacttgacacgaaagcaacagcaaggtgggatacagagcctgtgtttttgtgcatacattaaattcgggaggaggagaggtgggaggaaattgtgttactctttggttttgggaagttgagagacagtgtggaaggtgcaaaatcagacatgggacaggcactgccagagacttgggcattagaaagcaaaatcctgcccctgggagcccttggggctggcatgtgaatgtgtggggtgggctcagcagccccgagaatcttctcagtgaaagagttgggcccttgagttttgtagaaaaggtgaccagtatcatcaaatgagtcccactcggagagtggccaagaaccagaggtggaagagtctgtgggagccacagtcagaccttaaatcttcctcattatcttcttctcatcttactcggctgccactagaacccccaaggagcccgcgacagggttaggccaggccaggccagatgcctttggagtcaactccgggaaagtgtgcaaagcgtggtaatgaggatattccagacagactgcggggacgggggtcccactcactcacttgcacattcactcactcgcgcattcactcccactcactcattcactcattcattcactcattcatttactcactcatccactcattcactcatttactcactcatccactcactcattcatttactcactcatccactcgctcactctcccatgcactcactcatttactcactcatccactcattcactcactcactcattcactcactcatccactcattcactcactcatccactcattcactcactcatttactcgctcatctactcattcattcactcacacatccattcactcattcatccattcactgactgactcactcatccattcactcactcattcactcactcatccattcactcattcactcattcattcactcactcactcatccactcactcactcattcatttactcactcatccactcgctcactctcccatgcactcactcattcacccactcattcatccacccacacatccactcgctcgcacattcactcactcattcactcactcatttactcactcatccactcattcactcactcattcactcactcactcattcactcatttactcactcatttactcgctcacccactcattcattcactcacacatccattcactcattcatccattcactcactcactcattcaatcactcttccattcactcactcactcttccactcactcacacatctactcacttatccactgactcactcatgcattcactcacttattcactcactcatccattaactcattcactcactcatccactcatccattcactcactcatccactcactcagccattcactcattcactcactcacacatccactcactcatccactcattcatctattcactcattcattcactcactcatccacttattcactcatgcattcactcatccattcactcattcactcactcatccattcactcattcactcactcatccactcactcatccactcactcatccattcactcattcactcatccactcactcacgcatctactcacttatccactgactcactcatgcaatcactcacttattcactcactcatccattaactcattcactcactcatccactcatccattcattcactcatccattcactcactcactcggccacttacccagccattcactcattcactcactcacacatccactcactcatccactcattcatccactcactcactcatccactcactcatgcattcactcatccattcactcgttcattcactcattcactcactctcactcaatcactcattcactcactcatccactcattcattcactcactcatccattcactgattcactcactcatgcactcactcactcatgcattcactcatccattcactcactcattcacccctcagtcactcattcactcactcactcacggattcacgtgttcgttctctcactcacacattcactcattcatttattcactcaatcatttactcactaatgcacacattcattcactcaatcactcatccactcattcactcactcatctgctcattaattaattcatttactcattcattcatgtgctcactcactcactgactcactcattagattcaaaaagcattcctagatgcagaagtcaaaaaaatcgaagaaactttgactatgagaagactcagggaatgaaaaataagtaagaatatgccacacatgacaaatatgggaggttcagagccgagaaaaagaggcagggaaagagaaactcagaggaaagatggtcaaaagggcccccagactcattggaagaagaaagaagtggcaagaaagatcggggctgaggagcagtgagaaggagattggagggaagaaagaaacctggatcccagcccagtctggcccgtattttaaagtcaagcattagctcagagaatgcaaatcagagctacagcagagtgatttaccaagggaacgcagcgtgatcactcgggtcactacctgcagctcaaatgaagttatctccagggcccagagctggccccgaccgcatcacaaccttcctttgaggagtcagcaggcagcgggacacacaccaggcacccgtcgctgccttctgcatttataagacacgctggaaatacacttagaatagacgcagcgatcaatttaaaatgcatttctagttgtggggccatctattttatgaaataccctgcaaatggataaatgcagcagtgcttcgaaacacattcccaggtgtttgaaagtaactttgccaactttttccattggctagaaggtcagtatttttttttgaaatgcagatttcaggttttcttccatggtgacagggatgtggtggtggaggcttctgcctctagctttctaatcctcccattcttgtcccaggatccaccaagaggtgcagtcagggcaagtcgcctcaaccacagcagaagagcccaaggaggggtctgtgtgtctttccctggagcttcacagggctcccagctcttccttctagaaaggccttcaggtctggtcaacccaaggttcaggaagcagctttttttttttggccaggcatggtggctcatgcctgtaatcccagcactctgggaggccgaggcgagtggatcacttgaggtcaggagttcacgaccagcctggctaacacggtgaaaccccgtttctactaaaaatacgaaatattagctgggtgtggtggtgggtgcctgtaatcccagctacgagggaggctgaggcaggagaatcgcttgaacctggcaggtggaggttgcagtgagccgagattgcaccattgcactccagcttgggcgacaagagcaaaactccttttcaaagaaaaaaagacactttaaattttgtgtgtgtgtgacaaggtcttactctgccactcaggctggagtgcaggggtgcaatcagagcccactgcagccttgacttcctgggccccagtgatcctcccacctcaagcctccccaggagctgggaccgcagatgtacaccaccacacccagctactttttaaatgtttctattttaaagatgggggtcttactacattgtcgaggttggtgttgaactcctggcctcaagcctcagcttccccagatgctgggattgcaggcatgagccaccatgccctgccagatctgggttttatttaggtcttggacttccttattttaacccaaggtgttcaaggcttgaggtcaacactgcattttctcatctatcaggctcagtgggcagatttccaggcagcagaagaaaaagaagtagggtggtttttgagggctaggcttgagtgactttaacctcctgcactcaggaggttaaaatattgtaagttgtacttgctgctgtgaagtgacatcgttccctccaaaaagggcaggggttgtaggggaaaggattgcaggaattctaattaaacaaaaagaaagtcaaaccaaaaaaaaaaaaaaaaaacctttgcatgaagagataaaaacggcagttcccctctgtgttcttagtgggaaggatgtggtcctgcagtcagagagtcctgggtttaaacttcagttgtgccatttgttgctgtgtggccttgggcatgttgcttaccctctctgagcccccttttattggctgagtagcactaacatcgttttttgttgttgttgttgttgtttttttgaggtggagtctgcttctgttgcccaggctggaatgcagtggccctatcttgactcactgcaacctccgcctcctgagctcaagcgatcctcccacttcagcctccggagtagctgggatgacaggcatgtgccactgcgcttgcttatttatttatttatttatttgtatttttagtagagatggggttttgccatgatggccaggctggtcttgaactcctggccgcaagtgatccactggcctcggcctcctaaagtgctgggattccaggcgtgagccaccgctcctggccacgagtagcactaacatcttaaggctactgtggcacgtacagtgggcaatgctacttagctactcagcccacccccgtcggaagctagcagcaaactcaggacagaaacaagaagtcactacctactcgtcctgtgtaattacctccattccaagcagaatttagagaaaaactttaaacatttaccctcaaaccttctgtctgagcttccgattggaaactcacccagccggtggtgttggcatctttctgtgtcttccacgttcctctgggcagggacacacttcatatttccttgtgtaccctggcttagcaagtgtgttccataaatcggcatttcatatttatcaagtgagtggtgtccagtggctaaacgctggctttctttcgctcattacagcttcttcccttcagccgatcagacctctacctccccatgtgtggggagagctttcactgtgactgctttccggtgcctgctgttcccacctagatggttccactgtgcctgcagtttggaggtatgcaccaatccatcttgtactctcaatcactcacgggttagaagcctagaatagatggccctctgatttctgacctgcagggcgcaaactgtctttacctggtgaaatgcagacaggccagctggtcctatgtcccaccaggagagctcttcatttgccagtgtccccaaacatcagtgttacggaaacaacaaacatatctgccacctgctcccaccctgggcaatttccagaatctgaagggccttcttcactatcaaagccagtctattctgctgggcaccatggctcatgcttgtaatcccagcactttggggaggctgaggcaggaggattgcttgagcccaggaattcgagaccagcttgggcaacatagtgagactccgtctctataaaactataaaaaaattagctgggtgtggtggcatgtgcctgtagttgtagctatttgggaggctaaggcagggggatcacttgagactgggagtttgagaccagcctgggcaacatagtgagaccttgtctctacaaaaaaattaaaaaagtaggcaggcatggcggtgtgtgcctgtggtctcagctactcaggaggctgaggtgggaggatcacttgggcccaggaggtagaggctgcagtgagccatgattgcatcactagacttcagcctgggtgacagagcgagatcctatctcaaaaacaagaaagtccattctgtccactgggctgtttctggagttcagttatgtttgtgggatattgataaccccatatcagccatcattttttggattatactcgtccctctctcattgtttaagggaatgaggggtgtatgggaacttctttaccagttgaccttcagaggacatattcccagacaaccagggcacaatgtctctgtgcggtgggtgtctgcacacagtgggcattcagtcaacctcagagcaggacgacagaatgtctcagttaccaaacccacatgacagacgcgcaggcggacgctgacagcctctaaggggagactgctgtggtgtaggagacctgggaagcccccatcccgtgttctggacgttcatgcttgggctgtctgtaacctcaccaggattactgtaggctgtggctgggcttccgggaaggaaaatgaataattaagacgctggagatggaaaacttcaggacacaatagagatttttagtcttaactagacaggaaaataagtgtctcaggccaggcacagtggctcacacctataatcccagcactttgggaggccaaggtgggtggatagcttgagtccaggagtttgagaccagcctgagcaacatagggagaccccgtctctaccaaaaatacaaaaacaagccgggtgtggtggtgcacacctgtagtcccagctacttgaggaggcggaggcgcgaggatcgcctgagcccaggaggttaaagctgcagtgagccgtgattgcgccactgcactccagcctgggtgacagagcaagagcttgtctcaataaaatacaataaaaataaaataaaataaagcagcatctcaatatttaagcacatttgaccattcaggaaagggctctcaagagacctccaaagagtaacctcaccacctcttaatccccaggaactgacgacccagtggggcaggttccagattcctcatttgtctgattttgctttctactatgtgttttttgtttttgtttttgtttttttgttgagatggagttcacccaggctggagtgcagtggtgccatctcggctcactgcaacctctgcctcctgggttcaagcgattctcctgcctcagcctccctagtagctgggattacagacgcccaccaccacacctggctaattttcgtatttttagtagagacagggtttccccatgttggccaggctgttcttgaactcctgacctcaagtgacccacctgcctcagcctcccaaagttctgggactacaggcgtgagccagcacgcctggcctctgctgtgtgtcttacagtaacatcaccatttacaggaggcatttctagaagaataaagcatgaaacctacatccggtgctcttattatcacaattattataacaatgagtgtctccatctgaggttaggtgggcacagaaacggaattcaaaccagtcggattttctgtctcggagaattctgccaacaagatgccaggggagctcgtgcgttgaaatgcattaattgagtaccactattttgggagcaaaataggtttgtgcatccaattaaatgtggggcatctgagagggagaaagacggagagagagcggggattcagaaagggtctctttacttataattaactacaaaataaacagctctttcatggaatggggccctctctgttcccgccacccctgcagcccacgtttcaattagctctgtgttattcgggtcccctattactccagataacccaggactggctgtaattaattgttataatacactcaggagcagagccaagctgcagctcgggaaggctggttgaaactgctctgttcctctaaccggcctcctggaagggctggcttggagctccaccttcaccaataagtcagagctcctccatgggatgacgagggagaggggctgagatacttggagtctgctttgtttgctgcatttggtgctgagcaaggtgctggcccttttctctctgccccgctcccttcacagtccctgaagccctgaacccttcactccagcgacatttaaaataaagacatcaggccaggcacggtggctcacgcctgtaatcccagaactttgggaggtggaggtgggcctatcacttaaggtcaggagtttgagaccagcctggccaacacggtgaaaccccgtctctattaaaaatacaaaaattagccggtcgtggtggcatgtgtctgtaatcccagttactctggaggccgaggcaggagaattgcttgaacccgggaggcagaggttgcagtgagccgagatggcgccactgcactccagcctgggcgacaagagcaaagctccgtctcaaacaaacaaacaaacaaacaatcacaaaaatcagccgggcgtggtggcaggcccctgtaatcccagttacttgggaggctgaggcaggaaaatcacttgaatccgggaggcggaggttgtagtgagctgagattgcactactgcactccagtctgggcgacagagtaaaactgtcaaaaaaaaaaaaaaaaaaaaaaagacatcttatccatagaatggaatattattcatccatacaaaggcacgaagaagcattgctgcttgctgtggcacagatgagccttgcagacactaagctcagtgaaagaagccagacacaaaaggccacacatcataagatgccatttagatgaaacgcccagaataggcaaatccatagattcagaaggcaggttcgtgggtaccagggactggggggaggcagggatggaggagggggtgggtattaatggggatgaggtttccttttggggtgatgaaactgtcctggggctggatagaggtggttgttacatagcactatgaatgtactagacgccaccaggttattgattttaaaatggtgacttttatgttatatgaatcttacctcaataaataaatagcaacaggctgggtgcagtggctcacacctgtagtcccagcactttgggaggctgaggcaggaggattacttgagcccaggagtctgagaccagtctgggcaacatagcaagaccccatctgggcaaaaaaataaaaagattaggcaggcgtggtggggtatgtctgtagtctcagctactcaggagactgaggcaggaggattgcttgacccaggagtttgaggctgcagtgagctatgatcacaccattgcactctagcctgggtgacagaggaagaccctgtctcaaaaataaactaaactaaaataaaaacagctacaattttttgagccgaggtgagcaggggctaggccccaaaccctcagtgactccaagccccagacagcctgggcaggaagctctgatcatctctggtgaagacctgagacttcccagtcttggggaggggacaccaagggatgagacaggttgtggggaagctgggacttgagcgctgtagggaggccgtgtgcttgtcatgggaggcaacagtccacgtgggaattgcaggaatgccttttttttttttgagatggatctcactctgttgccaggctggagtgcaatggcgtgatcttggctcactgcaacctctgcctcccgggttcaagcgattctctcgcctcagcctcccaagtagctgggattacaggcgtgcaccaccatgcctggctaatttttttgtatttttagtagagacggagtttcaccgtgttagccaggatggtctcaatctcctgatctcgcgatccacctgcctcggcctcccaaagtggtgggattacaggcgtaagccaccgtgcctggccttttttttttttttctgagacagagtctcactctgtcgccaggctggagtgcagtggcgcgatcttggctcactaaaacctctgcctcctgggctcaagcgattctgctgcctcagcctcctgagtagctgagattacaggcacccgccaccgtgccctaatttttgtatttttagtagagacggggtttcaccgtgttggccaggatggtctccatctcctgacattgtgatctgcacttacaggaggcagggtcaaggaaaggacaagatagaagcagaggtggagaaagagggtgaggtgagtgggagaagaggggacggcgggacagaggccttgtgacagaaaagggaacaagaactcagggttttacgttgtacccacaggtgcagagctgagaaaaggaaagagaaatgaagaacggcaactcggagggaggagacggtgggggtggcgcgggcaccgggtgcaggctgagaaagcgagagggcggtccggccagggggtgggggtgctgcaaccagctctggtcacgccccttctcctgagagctcccaggactgcaggcaacttgctgaagaacttgggtaatttcccggaggccggctcacctgtttccagcccatcagtgatcttgaaacttacaaatactcagactcacactttccgcctatccgtgcaaggtaagaggagccaaacacatctcgaaatgcaccgatttttcttcttctaagggggcagactctcgtggtgtgcccccaccctctctgttaatgcctctattgtgtaaaaacgtctttagataaatttgtcgggcttggagcctggggtggccatttctttgcactttatctactacaatccaagaccagcaaacatgaggccacgtttttccagtggtttctgcctcccccaccacagtggtgacggaaatacgctccccagcaacagtgagaagaccctgggattctgcaggctcagagatcatctgtaccctcccgccgtgtaactgcaagacgacaaatgagatgcaaacagggaagtctttcttacgtttgtgccaaatgatacaatcaccaataatgaaataaggcacctgtgaaaactgcacccagaaacggtcgatcagtatggacatgaggttgttaagaatgcgtttccttagcatcgaagagggggtaactggctgctctctgatcatctgtctcttcttccctgtgtgcagggagctatgaaggagcccacttaggaagccaggatttaaggtgacaggagcatattgcaggtggggctccacctgccgggcagtgacggctgggggtcaccccgaaatctctgcactcagggctgtcagacggacgttacgcggtatgtgaactagagacactaagagcctattattctgttttgcattttaaaggaggtctctgaggaccagctgatgctttcaaaccacttaagtcagcgaagccccaaaaaggctgtagtctcttgcaagcaaaagttaccaaggggctgccgagggtcttcaagcccgcaggacttaagaaattcccgagtgtttcaccaggaattgaggaatctactcggatccctttcagggatcccggggggaggggaacttcccctttggggtccccagtcctactgtctctttgggaagctccttgtcccacagtcgcctggtttgtcctccggtgtttgtgggcaggggctgggcctttggtgccccggtggacaccagcgagccacagcctcatttcttagcatttgcaatctcaagagatcccagaggaaccgtctggaaggtgcttgcggggttgaggggtggggaacacgaacccttcccagacctggggagggccaggctgcaaggccccacgttttggaaacagaccctgtacacacttcctctccacccagctgggggccacgggcaactcaggccttgagacacactctgcgcactgagccccactccccggcccctggcactgtcccagtcagaagaaaataagacccagtgccacatgacaacgggagcatcctggcctgtgtgggtcaccgggcatgtatggagagcgtctacgggctggatccatggagctctgtgcaatccaagccacggcatgagacagtcgccccagcacctgctgctgagactccacatctggtttaggaaattaggagatgcaaagaggtgtgcatgaagccatgaaaacacatgggcacggacaggacaagggggccaggtgctggggagagggggtcccatggcagccccccagggacagggcttcaccagcgctgcacccgcgggcctcagtcacgggaccggccagttgggaaacgtactcacgcggttgtgagccagctgggtcctgggggttcctcgtgttcctctcaaattctctctcctcctgttgattccccagaaaacaccaaggctgtgggagagcagccacctcccccggaagcctacaccgacgccccactcagatgctgcctctatttttagcgggggcagaagtggggactgggggtgggctgccttacttccctctttttttttttttgttccgagcagaatctgtgggtgactttccattcatgggagtggggaggctcggagagcagaaagggacccaggccgtgcagggcaggcagaaactgcagggaacagggtgcgtctgtcatcagggccaggagggcggtggggcagggaggcaagggcaggaacccggcgtcgtcagtcactgttcgcacctctgctctgctctcaccgctgggccccgggccacgccagacctcacccaggggacctctctggcctcctctgcctctgaattccacagaggaggaagactggccagcagaagtgcggggccttggacattccagggaacactcttctatgagcgtgcatcccatgatgcatacccttttcccctctgtctctttgaagtttgttagtgggtgtggagcccaaagtactttggactggaacatcatggctggaacatcgtgtctttaccagagaatggagggcaaccagagttgtgggaatgaatggaggcaatgcatgaacaccgcccaccccagcgacctgtggatgcaggcgatcaattccttccccaaagctgtcaacgtcccctccgctcctatacaagcaaacaccagtttctcggccattgcttcctggccctggccctgtgtgcaacagcacccaagtctactatcttagcaggcttcctccctatttcccagcctataccaatcacaagaatactcgctgtttcccttcttttcttccaaaaagttgaggtgtaatcagtgagctgcatgggtcttcagtacacagttcgatgagttaggaagatgcccacgcaaccaagatctcagtcgtgatacagagcatggtgacccccactaagaagttctccagggccctttccatccccctgtggcccccaaaggcaaccgctcctgtgatttccatcagctttgcctttgcttgaaccttaggagagtagaataatgtgttgttctactcagacgtcccctccttgggtctccaggaagctctgggcaccgcagctgtgtactccatgcaatggttaattttctgtgtcaacttgactgggctaagggatgcccagatagctggtaaaacatttctgggtgtgttgttgaggttgtttctcagcattggaatcagaggactgggtcaataagacccgtcctcctcattgtggaagggtgccatccaatctgccgaggacccctgatagaacagaaagtcggaggagggaagaatttgccattttgagctagggcatccatcttctttagggtctggctgctttcacgcagcgtgtgaggctggtgtcagtcacgcattcctgtttgtcactgggcagtattccatcgaaaatgtcccacattttcctgacttgtgtatctttcgctggacatgtgggttgtttcctgtttgcctgggaccttcctgtacagatcttcatgtggacgtgctgtcatttcttttgagtaaacgccctggagtaggactgtctgggggaggaagacacggtgcccccagccagggccgccatggagaattgggggagcagcagggactgaccatgatctcctcacacctccgctctctgatcattccagcgctagcactttctgggaaggctgggaagctcactgattacacctcaagtttttggaagaaacgaaggggaacagcaagtattcttgtgatcgatgtaggctgggaaatagggaggaagccggctacgatagtagatttgggtgctgttgcacagggaaaggaagcaacggctgagaaactagtgttcacttgcataggagcggagtggacgttgacctcatccttcccggcttaggcgggagagacagtgatgatgatatcgggaggcctgaaacccaccaaaaagagtcagaaggaagctgattcaatatgggactggcaatttcagggggaaaagatgtcaacaccttcaaaggtggggccagaccccctggaggtaaaagtcccttccaattggattcttaaacacaccccatcggagagaccaaaacatggctggtggaattcaggcttgattcccatttccccgggagagggtgaaaaggttcctactgggctgctccagggagcacgccaaggatcaccagcgccatggggcagaagaagctgagtccccccatgagcagcacggaaaagagggggtcacctgaggccacagaggagagggactccttggaggaggcagcagtaactaagtcacacacataaaggaagtggcatctgagagcttccggcacgcacgcccagggaggtgggagcctaagcttgtgggtgaggagtgatttttctagtatgacaagaaacataaaatacaaaacaggtggttctgccaataagtcagccccagaggagcctggtgaccctggaaatggggccgacctgatgtggacttaggggctttggggtttgagccccagcctggactcctgagcttcaacaagggggctgggaggcagccctctttccctttttttttttttgagacggaatcttactgtgttgtccaggctagagtgcagtggtacaatctcggctcactgcaacctctgcctcttgggttcaagcaatttctcccacctcagcctcctgagtagctgagatgacaggcgtgcaccaccacgctcagctaatttttgtatttttagtagagacggggtttcaccatgttggccaggctggtctcgaactcccaacctcaggtgatccacccgtctcggcctcccaaagtgctgggataacaggcgtgagccaccgcacctggccaggaggcttctttcctgatgctgctcctccagtggagccaggtctgtccttctgaggcccccaaagcagttcaggcctaggcctgtgcaagcactcaggatcccacctcctccctggcactatttgttttctttatctccgccttgaagctgtagttccaaacaggcaggcccttgactgctgattcagctgccggagccaaaactcataaaatcctatttcaaaaaggtccaatgattttcttttctgatcataaatatgaaatttaattagcagcctgctgctaatgaagtcaccgtggaagccagcctggagaggcggagggaacgtgaacacctgcaggcaacagaacctactgcctgattaacccttcctctcctgctgcccctcactgggccctttctagggccccatgggccccgctgcagaggggcagcctctggcctggaaggacaaggagggactgctcgttcaggcagagttggaggtggctcagatgtcgcttccttgggtctccaggaagctctgggcacagcagcggggtactcgatgtgctggttaattttatgtgtccacctgattgggctaagggatgtccagatagctggtaaaacatctgggtgtgtcagtgaggatgtttgtggaggagctcagcatttgaatcagtagactgagttaagaagatccgccctccccaacgtggttgggtgccatcccatctgtccagggcccctgatagaacaaacagtcagaggaaggaaaaattctcgtttgagctgggacatctgtcttctcctgtcctctgacactggagctcttggttctgggccttcaaactctgggactgacaccatggactcccttgttttcggaccttcaaactgggactgaattatatactagctttctttctttttctctctccgtttttctttctctttccttctttctttctctctccctccctccctccctccctccctccctccctcccttccctccctcccttccttcctttcttcttttctgagacagggtcttgctctgttgccaaggctggagtgcagtgtcatgatcatggcccactgcagccttgaactcctggactcaagttattcatctgcctcagcctcccgagtagctgggactacaggtgtgcatcaccatgcttggctaagtttttaaattttttttagagatggggactccctatgttgctcaggctggtcttgaattcctaggctcaagtgatcctcctgccttggcctctggaagtgttggaactataggtgggagccaccacgcccggccgtggcttctgtgattctccagcttgcatagagcatgtcatggggcttcttggcctccatagtcatgtaatccaattcccataattaaatccccttttatatatgtctctatgtatcctactgtttccatgtctctgactaatacactgtgctgcagatcagagacccagcttctgtcttctctttaaaaccctctggtaggctgggcccggtagctgacacctgtagtctcagcaatttgggaggctgaggtaggaggatcacttgagcccgagagttcgagaccagcctgggatagtcagacctctctacaaaagattttataacattagccaggcatggtggtgtgcccctgtggtcccagctactcgggaggctaaggtgggaggatcacttgagcccaggagttcaagaagcggtgagccataatcgtgtcactgcactccagcctgggtgacagagcgagaccctgtctttaataataataataataaaaccctctgatggaacattgtccacagcaaaagggaggcactgggaataatacacagctcggcataggagcttaagggaaggccaccggagctcagaaagtgcccagggcctctgctcaatgctgtgcgtgagctgggggcacacagcatagtccattctgccttacaacggactggatggtgcggagtccttctcgccaccagccagccttcctggtagtgacttccagataccttctgcccacaacccaaaaagatcagaggaaccctatagttcctccttcatactccacagaacacatgaaacccaggaccaccctattcctcccactactcctggcttcattttctcctcctataatgcaggaataataatgcccatagtttgcaggattttagggatgattcaacaaatgtctaaagaacatgcctggcatacaggaggagctccataaatgggagactttataatcatcatcttgcatgagtttatgagttaaatccccaatccagaactcactactatctgaagtcctacggaggagacacggactatttcaaacatgattcaggaagctgaagtgagaatgtgaccattaatttcccaaacatgttcggaaaaacccaatccatctggtcggtgccgacatcacgctaatatctactcaagcgtgtccgtgtgtggaacacagggtctgcagtcccagcgtgtgtggatcgtgtggggatgtgtcatttccctgcacacaggtcacgcctgtgcagacagcctgcatgggcactgcacacaggacctggtacacagacccctccctgcaaaatgcaaatactcatcagaagtgagaaggagccgtgctccccccgatagagcctgcaacgtaaaactttagatttagtctgtggtcaaggcacacaggattatattctagtaaaaagtttatgacagaaggtaatagagtttttgagggattttttttctcgccggattttttttttttaaacagaagcgtattgcaattctgcaggtatttgggtcccagctcctgaacgagtaggaacagctcaggttttgctccctgcacctctgcagggaaccctcctagggtcatggctgaggttgttgggatgctggagccggaacccctcaggtatcacggtcagcaccaacaggtgcagctggcttccaggattaaatgttaccggtaagctgagtttgtgtaaatcaaactctcttctccccattgactggatttagagctgactcctcacctatgcaactgccctccacagcccctgctcacagcctcaaattcctcactcaaagtgtcgcccatcggccgcagcgtcagcaggtgcttcacctgccgcattttgagcctcacctcagcccttcggaacggagcctgcggtttaacaggctccccaggtgacgctcacacacactgataaacgccgctccaactcacccctccctgtgcgcagagacgtgggtccccgactcttggttcactccctgcctgacccctccccgtgcgcagagatgtgggtcaccgactgccggttcactccctgcctgagtctttcaggactttggtttgaagcactatagaattcgtccatgtaactaaaaaccactagtaccccaaaagtgatagaaaattttaaaaaatctgttaaaaaaaccccaaacaagttaaatatttaaaaatcagataatatttcatataagttttttcagtgcacttgaagtcttctttggggacagggtgcctagtgaatccgaccctccacaaatcccacctcatggccaaccttggtccactgcaacctccgcctcccaggttcacatgattctcgtgcctcagccgcctgagcagctgggattacaggcacccaccaccatgcctggctattttttaaagaactgagcacttcaatgaaaaggcagaggtgatcggggtggattaaagaggattcaattctatgccgtcgataacaggcacacttgaaacataaagatgtagagaaggtaacagtaaaaagatggaaacgctattcataaaaactgaaatggcaatattaatatcagaagagtagacttcaggaagaggtgtattaccagggataaagagggacatttcataatgaaaacagagtcaattcatcaagaagatacaatcttaaatgtgtatgcaccagttctaaagcttcaaaacacgtgaggccaaaagaaagaaaactgaaaggagaattggacaaaatctacaatgatggttgttgatttcaacagtctttttcactaattgttcgagccaatagataaaaatgaaggctatagaagatttgaataatagtatcaaccaacttgacctaattaatgtttaaaacactacaattaacagctgcagaatacatactcttttttttttttgggactgagtgtcacactgtcgctcgggctggagtgcagtggcaccatcttggctcactgcaacctccgcctcccaggttcaagcgattctcctgcctcagcctcctgagtagctgggattacaggtgcccgccaccacacccagctaattttttgtatttttagtagagacagggtttcaccatcttggccagactggtctcgaactcctgacctcgtgatttgcccgcctcggcctcccaaagtgctgggattacaggtgcgagctactgcacccagccatacatactcttttcaagtgtacgtggaacattcaccaagatcttttgttggtctataaaacaagtctcaactttaaaaggactaaaattatatagagtatgttctctgacacaatgaaactaaagtagaaacttatgataaaaaggaacctagaagttttctagatgtttggaaatgaaatgacacagtcctaaataactcattggttaaataagaaaccaaaagaaacttttgaagatgttttgaactgaatggaaataaaaacaaaacatcaaaatgtgtggaatgctgctaaagcaatgcttagggaggactttataactttaaatgatcatatcagaaaagaagaataatttaaaattaatggtctaagtttctgcattaagaagccaggctgggagtggtggttcacgcctgtaatctcagcaccttgggaggctgaggcaggaggatcacttgatgccaggagtttaagaccagcctgggcagcttagtgagacctcattgctataaaaataaaaataaaaggtggtgtgcacctgtggtctcaggtacttgagagaattaggcaggatgatcacttgagcccaggagcttgaggctgcagtgagctatgattgcaccaatgcaatccagcctgggtgacagtgagaccctgtctcaaaacaaaacaaaacaacaacaacaacaacaacaacaaaacccccagaaaaaaaacaaaagaaagaaagaagaggaaagaagataatgaaaataaagataagagtgaaaaacagtaagttagaaagcttaaaaacagtttagaaaaccaaaagctgggtctttaaaaagagcaacaaaatggataaacctctagctatacactaagaaaaaaagagaaaaaacaggcctggtgcggtggctcacacctgtaatcccagcactttgggaggctgaggtgggtggatcacgaggtcaggggttcgggaccagcctgaccaacatggtgaaaccctgtctctactaaaaatataaaaattagttgagcgtggtggcacatgcctgtaatcccagctactcaggaggctgaggcaggagaattgcttgaacctgggaggcagaggttgcagtgagccgagatcgcgccactgcactccagcctgggcgacagagcgagactctgtctcaaaaaaaaaaaaaaaaaaaaaagagaaaaaacaaaatgaccaatatcaggaatgaaagaggagctatcactaccagtgcaacagacattaagaatatattaggaatattgttttaaaaacattatgcccacaattctataatatgaatgataagaacagaaattactcaaaagatatacattcccaaaattgacttaagaagaaatagacagtctgaattagccctatatctatttgaaaagttgaagtcattatcagaaactctcccacaaagaaaattccagactcatacagcttcactggtgaattctgtcaaacatttaaggaagaaataacacaaatcttacataaatactttcagaaaacagaggaaaaagcaacacttcccacccattttatgtggccaatattatgctgattccagaatcaaccaaaaaacattacaggaatagaaaactaggaaccagcatacttcatgaacatagatacgaaaatccttaatgggattagcaataacttcaaaaatatatagagaggataacacatcatgagcaagtgagatttattccagaaatgctagtccattcaacattaaaaaatctaccaatgtggccaggcacagtggctcatgcctgcaatcccagcactttgggaggcagacgcaggcagatcatgaggtcaggagttcgagaccagcctgaccaacacggtgaaaccccctgcatctactaaaagtacaaaaattagccaggcgtggtggcgggcccctgtaatcccagctactcaggaggctgaggcaggagaattgcttgaacctgggaggcagtggttgcagtgagccaagatcatgccactgcactccagcctaggcaacagagcgagactccatctcaaagaaaaaaaaataaatcaaccaatgtgcatcaccatattaagagaataaagaacggaaaaatcatctgattacttcaatctatgcagaaaagtcattgggcaaatttcagcatccattcatattaaaaacttccacaaattagaatagaagggactgttccccaaagactgggaccaaggcaaggatattcacactgaccacttctattcaacattgtgttgaagtttctagttaatccaataagacagaaaataaaaaggacgaagactggaaaggaagaggtaacctgccattatttgcagaaaacatgattgtctaaaagaaatccaaagtaatctacagaaaaatctgctagaattaataatattcaattaacaatgattaataattatttgctaaattagcaaagccacagaaggtcaatatacaaaagccaaaaaccctaatatccagaaacataacacacgtaggatttaagataaggaaagctttgtaaagtgtctgcaccaagaactacaaagcattgctaagaaaaattaaggaagccctaagtcaaacagagagatatatcatgttcattgattggaagattccttaatattggtttttggtgttttttttcttttgttgttgtttgtttgtttttttgtttttatttatttattttttttgaggcagggttgtgctgtgttgtccaggctggagtgcagtggtgcaatcatagttcactgcagcctcagactcttggttcaagcgatcttcctgcctcagcctcccaagtagctggaattacaggcacacatcaccacacccagctaatttttgtattttttgtagagacagggtttcaccatgttggcccaggctgagctcaggcaatcctcccacctcggcctctcagacagtgctgggattacaggcataagccaccatgcctggcctggaactctcatacatagctggtgagggtgtaaaataggacaaccactttagaaaacggtttggtaaattaaatatatacctattctgatgacttagcaaatacctagggttctaggacccaggacccctatgtatttactcaaggaaaatgaaaatatgtccacacaaagacttgtgtgtggttaaactgataacaacttcattcataatagcctcaagctggaaaccaccccagttacccaacaggaggaaggataaacaaattgtggtaataaaaataaacaggaaagagacatgcaacaacgtggaagaatccgaaaacatgcagagtgaaagaaaccagacacgaaaaggtacacactgtgtgattccaggtatgtgaagcccccggacagacaaagctacccaacgtgaaagaaatcagaacagtgattgtcccaacagcttctggtgggaaggatggaaactgagcaggaggggcatgaggaaactcttgagagcactgaagatgttctgtatcttgatggattatgggttacgttcgtcaaaaacggttgaactatctaccgtgcacttaagatctgtgcatttcacggtgtacaaattatatctcaatttagaaaaaagaaatgagaatggatctgaagtgatccctccaatacaatactgtgctttcacacctctgaaatcttttatttgatttttaattttcattttttatgtccataggtttttgggggtacaggtggtattgggttacatgagtaagttcttcagtggtgatttgtgagattttggtgaacccatcacccaagcagtatacactgaacccaatatgtaatcctttatccctctccccatcccaccctttccccactaagttccccaaatccactgtgtcattcttatgcctttgcatcctcttagcttaactcccacttatgagccagaacatacgatgtttggttttccattcctgagttacttcacttagaataatagtctccaatctcatccagggccctgcaaatgccactaattcatgcctttttatgactaagtagtattccatcgtatagatataccacagtttctttatccacttgttgactgatgggcatttgggctggttccatatttttgcaattttgaattgtgctgctatacacaagcgtacacccttgaaatctgaaatgatagctcagtgggcctggggagaggggtagaattccagcagatactccaggaataaaccagatcccaatgggcccttggtgttgtttgcacctgtgatccccatgcacacaggtgatgggggatggctaagttagacgacatctgtgtttcctagagctgcagtaaaaaattatcacaaatttagcagcttaaaacaatggaaatgtattctctcccagttctggaggccagaagtccaaaatcagggtgtcggccagaggggctccttctggaagctcagagggagagttttttccaagcctctttcccagattctagtgatttctgatgatctctggcatttcttgacttgtagatacctcactccaatctctgcctccgtcatcacacggctttccctgtgcatctctgcacagcctctcttctttttatttctttttaaaaaatatttatttattcagagacagggtctcactctgttgtccagctggagtgcaatggcacaaacacgggtcactgcagccttgacctcccaggctcaagtgatcctctcacctcagcctcctaagaagctgagactacaggtgcatgccaccatgcccagctaattaaaaacttttgtgtggggggtagagatggggtcttgctgtgtttctcaggctgatcttgaactcctgggctcaagtgaccctcccatgttggcctcccaaagtgttttgattacaggtgtcagccaccaggcctggccagtctgtctgtctctctcctctcgttctcctttttgtaaggaggccagtcattagattcagcccccacctccttatccagtataatctgtttttaacttaactaaccccatgtgcagagaccccatttccaagttaggccacactctgaggttccaggtgggcaggaaatctgggagacattatttcctccactgcagtccatgctctggccaaagtacaggcaagtttcaatgaaggtgaaaatacagcacagggcctgggtcttcataggggccttcaacaacccatgtgtgggtttgggacatggaagcccaggccatggaaagcagatcatgaattagaatttgaaagagcacgatgtgtgggtgtgcggggccatgatcgcaccagaggagggatggagaaggcatttctgggggttcttgggaagaaagtgcatttctagtgaccccaccctggcatctgatccacccagaggcattgctaaaatttgaaggccccgaaaagctttgagaacacacccgtgacacgtgcgaagtctacgggaaagagaggcggcggactcgccaggggaaagctcatatccagggacgcagcagaaggtgggccccgtgatccgggtcggagctgcttttaattgcctttgcttttcctgcacaaaggagtctgggccatttggctttctctgcagaagaattaacctttagcaggatggataattgatcctcagcaggggaaacgtcccgtgggttttgacgcagaaccggctctcggtaaacctgtccctgccacaccctgcaaagctcccgcccctgcctcctcttgtctggagctgtctcccttctagctcgccaaatgctcagggttcctatattttaaaaaatcttgtcccatcaaactctgctttcaggaatggcacgaagagccgacacgcacggtgagcagctgccttctgcagatggaacgcctcacctgggacgcctcacctgggacgcctcacctgggacgcaggcgttcctgttcctagtcacgccctgagccctggattcctgcccaagctcacatagcagggactggcccagccccattcactcatgcatgtctgaccccaaggcagggctggtggcctctaaatcctcccgctagggtttcagcgcctggctgcgttgaaggtatcaccttttctacgaacacctgttctgaacagtgaaaatagctattcctaacagaggagttgcaagctccagggatctgtgtgtgcgttggggagagtggagtacatcatttctggaaaacggggcctcaaaacgtagcgccgtttacagatgagaaaagatgcatttagaggcttgaactggaatgggctgtacacaggactgccttgccagacagcggctcagaagtcttcaaaaacgtttgaagatgccccgttaaaagcgtttggttatctgttggtaacagtgctggtctgctcagcctgccttaacagaataccacagactgggtggcctaagcaagagaaattcactttctcacagtgctggacactggaagtctgagatcaaggtgccagcagggttggtttctggtgaggctcttctaccttccttgcaggtggccacctcctggctgtgtcctcaaatggcctttacttccatgcacgtgaacctggtgtctcttcctcttcttacaaggacaccagtgctgtgggatcaggtccccaccctcatggtcttatttaaaattgcctccttaagattcctcaaataaataaaaattgagctaccatttgacccagcaatcccactacttggtgtctacacaaaggaaaacgaatcattgtactaaaaagatacccacgcccttatgttcatggcagcgctagtcacaaagcgaagatggaatcaatctaggtgcccatcaacggtggattggataaagaaaatgtggcatatatacaccatggaataccacacagccataaaaaggaacaaaatcgtgtcctttgcagcaacatggatacagctggaggccataatcctaagtgaattaacagatgaacagaaaaccaaatactgcatgttctcacttaaaagtgggagctgaatgaggagaacacatggacataaagatgggaacaacacacactgaggtctgcaagatcagggagtgaaggaagtgggcaagggttgaaaaactactgattgatatggtttgcctctgtgtccccacccaaatctcaccttgaattgtaataatccccttgtgtcaagggcgggaccaggtggtggtaattgaattacagggctagtttccaccatgctgttctcctgacagtgagtgagttctcacgagatctgatggtttataagcatctggcatttcccctgcttgcactcattctctctcctgccgccatgtgaagaggtgccttctgccatgactgtaagtttcctgaggcctctccagccatgtagatctgtgagtcaattaaacgtcctttctttataaattacccagtcttgggtatttctgcttagcagcatgagaacagactaatacaaccacctatttgatgttcactatttgggtgatgggttcagtagaattccaaacctgagcattatgcaatgtccctatgtcacacacaaacctgcacatgtacccccggaatctaaaatttccaaaaagagaaacaataactaaaaagaaaaaccaatcactccctgcttaaaggccccatctccaaatacaatcacattgggagtttgggcttcaacatgtgaatttgggggacaccattcggtccatcacagtaaccaagcctgctatccctccccgtcctgatgggatgtgtgaacgaaagtggacttttttaagaaaggaggcttgacttgacaacacccaaacgaacagtcctttaagacagtgtttccggcaatttcccaattgctccacatgttttctggaatttcttcctctgaactgctgcaattctaaagcttgagaaacagttgcagagggtgagaatctgcattcttccctgtgcagtgacaccatcgctgggataggcacagagaccaaacagcggccacatcgaatgacctcacatttcccagcctctgtgcacacgcccatgctgttccatgcaccgggaacacccttcccatcatgtccatgtacaaggcacaccccttagggctcagggccactgttgcctgaactccatggcagttccatgcctgcttcctccaccgctcccaagctgcaactttcagactcacacttgtcacatgggattgtgctttttggcctccttcacttggcaatttgccctggaaaccagcagacctgtcttgtcaccaggagggcctcagtcatcaaggcactctgcagatgtctgtctaatcttgtggaggtgacgtcctagccagctccccccaaccccacccacaccaaaagctgccactgcctggttttgtcacaaagaaaaacagggaataaagtgacaccagcagacctactgccactattcccagctctgtgcctgaggcctttctttcaactgttttttttttgaggcagagtcttgctctgttgccccgtctggagtgcagtggcacaatctcagctcactgcaacctctacctcctgggttcaagcaattctcttgcctcagcctcccaagtagctgagattacaggcgtgcactaccatgcccggctaatttttatatttttagtagcaacagggtttccctgtattggccaggctggtcttgaactcctgacctcaagtgatctgcccacctcagcctcccaagcgctgggattacaggcatgagccaccgcacctgtccttccgggactatcttagaccaccaagcccagagtgtaacaattaagggtgtttgggttgaataaccccccaggtacctcagtctcaggaggaatccctgggcgtgagttctgcccatctgcccagcctccccatgggatggagtccctgtcattcaccgtagtgacaggctccataacattccctttatcagctgcccctcgacgctgtaccacttccccaccccaagatcctcatccccggcaactcccagatgaactagttgcattcaaaccctcatctcagagactgctttgcgggggcacgcaaatgatgatgcagtccgggatggcagatgttgctctggacaggtggcatggagctcagatcccagctccgataaaggctcgttggagctggccagattcaaagcaaacaacaagcaaaaatgcctgccctcccctacccaccccaacaaatctcagatgagaacctcagatggtgcagatggacagggcaccatttttcaggagagggaaagccggggtcatcctgaaactcccttcagctcagcccacaggggaggcagggcgaggatggaggctgatggttgtgggtgagtggccctaggcatggctcagttctgagtcttcttgtgggcctgacttagctgagaggcagtcctgagatgctcaggcccacagcagggacagcagcggctgctaccacctccgtgctgagaaaaaaacaacaagctgcccagaactgagacaccccacccagcagcaaccaggggctccggggacaggatggtggtctgggccctgggctctcagctcacattctacagtgaaaagatggacgtctttttatttttatgcagaatcaagctgacagggtctaattctttcccccaaggaaagattaagtggggaggttgaacttgggatggtagaacgagctctgtgctggaaaatctacgtttagatcccatttctcttaaagtctatctgtggcaattttaaaacctgacccccaaattctctgccactcttcccattgttagatggggcttgtgtccccaccccttgaacccgagctctgtaactgcttgacctacagaaaaagctggaagtgatactgtaccagtgtctggactgaggctctaagaaactgcagcttcctggtcgggcgtggtggctcacatctataatcccagcactttgggaggccaaggtgggcggatcacctgaggtcaagagttcgagacaagcctggccaacatggtgaaaccccatctctactaaaaatacaaaaattagcagggtgtggtggctcatgcctgtaatcccagctactctggaggctgaggcaggagaattacttgaacccaggaggcggaggttgcagtgagccaagatcacaccaccacactccagtctgggtgacagagtgagactctgtctcaaaaaaaaaaaaaaaaaaaaagaaaaagaaatatatacatagctttcattgtctgtgtcctgggacactcactcttaaagcccagacatgcctgggcatggtggctcgtgcctgtaatcccagcactttgggaggccgaggtgggaggatcacttgaactcaggagttgcctgggcaacatagcaagacccaatctgtaaaaacaaaacaaaacaaaacaaaattatctgggtatggtgatacacacctgtagtcccagctacttaggaggctgaggcaggggatcacttgagcctgggaggttgaggctgcagtgagccgtgattgcaccactgcactccagcctgggcaacagagcaagaccctgtctcttaaaaaaaaagaagcccagacagcaagcagcccatgcagagtccacgtggacaaggatcaaggttcccagccctccctggctgagatcccagccaatagccggcagcactttgcagccacatgagagcactgtctgggaagtggatcctgcggccccagctgagctgcccgagttgaccccgcgtggagcagagacaagctttctctcccaggctctgcccgaactacagaatccatgagctcaagaaattgttgttgtttgaagtcattaagttttggggtggcttttacacaacacacaaccagaataacgtctctgtggcctggggcaaatgcttaacctctcccgacctcggtttcctcgtctgtaaagggaataggattcaaagccttccaaagtgcatttcaggatgtgagggtaatctggctgcaacagctgtcacccccattgatcaccagagttgatttggctgatctggttggctaggcgggtgtccccttcctccctcaccgctccacatgtgtccctcctgaggctgcatacttggtcaaagaggatgaccatccccgagagaggaagaccggtcttccatcaagggtacagaagtagccgcgctcccctgctagaacctccaaacaaactctcaaggtgcaaagtgcatttcagctcaaatagtcaatgcactctttcaacaatagtgaatcagtttcctggttttatcataacacgtaacgccctttctccagtttatcaaaaaattccctaaaaggaccagaatgctttgtcagtccttcttaaacatcaatgtctacatgactcagctggagatcctgttcaatgcaggaggtcacagatggggcctagaaatctgcattttaatgtgatttttcttttttctttgactcaggacagagtctcactttgttgcccaggctggagtgctgtagtggtgccatcatagctcactgcagcctcagcctccctgggttcaagtgaccctcccacctcagccacccaagtagctgggactacaggtgcacacctaccatacctagctaattcaaaaaaaattatttgtagaaacgaggtctcactatgctactgaggctgttcttgaattcctgggctcaagcagtcttcttgcctcagcctcccaaagttctgcgattacaggtgtgtgccaccagcccagattttttgcttttttttttttttaacaagatgggatctcacttgcttgtccaggctggagtgcagtggtgcaatcatatctcaccacagccttgaacacctgagcttgtgatcttcctgtctcagcctcctaagtagctaggactacaggtgtgctccaccacaaccagctaagtttttttgtatgaagaaatgaggtctcactgttgcccaggctggtcctgaactggcctcaagcaatccttctgcttggcctctcaaagcgctgggatcccagacatgagccactgcacccagccactgattgcttttttcttttttcctgagacagagtctcacactgtcacccaggctggagtgcagtggtatgatctcagctcactgcaacctctgcctccagggttcgagcaattctcctgcctcagcctcctgagtagcactgatagcattttgagtagcaagggcccctttgtttgtctgttaccagcaaccacccttacccacaggattaaacatggaaaggcagtatcttttttttttttttttaagacagggtctcactctgtcacccaggctggagtgcagtggtgtgatcatggctcactgcagcctcaacctcctgggttcaagcgatcctcccgcctcggcctcctgagtagctgggactacagtcatgtaccaccaggcctagctaattttttgtatttttagtcgagatgggatttcaccatgttgcccaggctgatctcgaactcctgggcttgctcaagtgatctgcccgccttggcctcccaaggtgctgggactacaagtgtgagccactgcgcctggccggcagtatctcatttaatcctagaacaactcccaaggaaggctctagaatcacgtgcactttacagattggagacacagcatctggagaggtctggggatgtgcccacggccacagctggtgagtggtaatggccaggacttgcactgaagtcagctcctccatgctcaatcccctgccgccctcttctgagcaccaggtgatgtgagatcaaccatgtttttaaaaatctcaccccttcatgcctgcagcaaggcagctggggatgaagatctatcacagaaggacagaaatggggactcagttacactcaggaataacaaaacagagttaataaagatagaggtgactttttcaggttccccagctccagccgtgattaatttacagctttttacatgctaatgttttcctgccttctgctcataataaataaccaatatgctttaatacctagttattattcatccctttcagatacttggattttgattctttgctgcagctcaatcacattgaatttctttaaccaggacagctccattaagagtcccttgcaaggacaccctggcggggcggtgacagtaacaggtaacgggtgacgagagagtgaggagctgccacacgaaatattggcagccatggggaaagaaaggggaggccgtaataaaaaacaccaccaaactacatttaagtaacgcggaggtgataacacagaccaataaaaccagggaacgcacagtgaaggttgacacgccatccttaacgcgcctccccggcttgtttctgcaatagaaactcacatccatttaatcacctttctgacatggagcgttcccttatattgggataagaatggctcgtcatccctcccaccccctccacctgccgggctgtgtatttcagaaagttccttggaactttctccatcttctctccctcccagtggttttcaagcagagaaggccagctcatcaagagacatgcatgcgagttaatagaattgcttccttctaacgaagctgttccttctcctgcaatccaagagctctctggcaatcctgttccccatttgacacacggcgactcacgttcctccaggcccactgaggactgaacgtggcaatcctcatcctgctctgcggctgccccaagaacagcagcctcactcctggggcttctgggcagccactttccttggccacctggaccctcgtaggtcagtcctctgcctcccatgctgggccactccttccactgtaggaaccacccaaggtgtttccaatacaggaagccctttctcagggacagcactttgtatctttcttgaactcatctgggactacttcccgtataatgtggtgtttttttgtttttaagagatggggtcttgctatgttgcccaggctgaagtacactggccattcacaggcgtgatcacagcacactacagtctgaaactcctaggctcaagcaatccacctgcctcagcctcctgaatagctggaacaatgggtgtgtgccactgtgcccagctcagaataatgtttttaaatacatagaataacatataggccgcgtacagtggctcatgcctgtaatcccagcactttgggaggccgaggcgggtggatcacttgaggtcaagagttcgagaccagccgggccaacatggtgaaaccctgtctactaaaaatacaaaaattagccgggcgtggtggtgcgggcctgtagtaccagctactcaggagactgacggaggagaatcgcttgaacccaggaggtggaggttgcagtgagctgagatcgtgacattgcactccagacagtaaacaaatgaaactgcatctcaaaaacaaacaaacaaacaaaaagcttctgcggaggcctcaggagacttataatcatggtggaagggcaaaggggaagccagcacatttatgtcaggagcgggaggaagagagagagaagggaaaggtgccacatccttttaaacaaccagatctggtgagagctcactcactgtcaggaaaacagcaagggggatgtccatccctccccatgatccagtcgcctcccaccaggaccctcctccaacactcagtcacaactggacatgagatttgggtggggacacagagtcaaaccgtatcactcggcctcccaaaatgcgaggatttacagatgtgagccaccacacctggcaaattgggtcattcttatcacacccacctaaaacagagttgggaggggtggaggtaaaaagcacccgggacacataacatggctccagaaatgaaattctctgcaagcccgggctgcggacactgccagccgtaacctgaaaccagttttctctaacagctactgaaacaatctgctatgactgtaaggttagttttacccaccgctgtcactcaccaatcggggcttgccagctccccaaaacttcactggtgacggtcaacttaaagaacaatacgtaacacttctgttttaaaaataaaacctcaaacctttgttctttggacataacgaagaccacccaggtctgtgtgtacgtcaaaaattgtaattctttgttttttttgaggggtcttgttctgttgcccaggctctagtgcagtggccccatcatagctcactgcagccttgacctcccaggctcaagagagcctcccacctcagcctcctgagtaactaggacgacaggcgtgtgccaccactcgcggctaatttaattttttttttttttttttgtagagatagggtttcacaatgttgcccaggctggtctcaaattcctgggcccaagcaatcctcccccctcggcctcacaaagtgctgggattacaggtgtgagccaccgtgcccagcccaaattgctgttcttacttctcaagtaaaacttctgaattgcagagattcgtctctacagtttatttgatgtcaacaactcctatatatccagtgcctggcccagagctcaataacaaccaccaactgtgtggaagagtccgatctgattctaactctacagtaaaggacgccccacagtcattgagaggccacgaacactgcagcagatggcacaaggtggtctgctagtctcctgcctaactcatcatcacagcctggcctattaagaacaattccttgccagaagggcctctctctagccttaccccattgcagcatcagcttactggtgggttttggcaagaacccgaagttaagacgggcacgggaatgatgcctccacgtccgatcagcgccagaaggtgctgctgcgacctcttcttccccgctccccccagtcatttcttccctgcctggactcactctgtgggaagtgatggtatctgaggactgcaatatgctccacgccaggcccccatccatcaccagcttcctgctggttaccatggagacggaatgtggggtccccactgggatggcacattcagagtccctgggcgagggagtatttgtgggcaaagggacactgtgagatccaggaccacccagagtggggccacgcagaggtccacgcaggcaagagaggccaagggggaaggaggcagctgagaaaaactgctggatgtgcacagaactaagggcagcatccatgaacgtctggaagaccagaccaaccgcacgtggaactctggtgagctgaagaaaccagaccctgactatggcacagaggtctgggcgagctaagaggtcagcagcttcttaagtccacagcccaccgtgaagataccacgtgccttcccaggtagggaaacactggataatctcaatagtcacttctgcagctatctaagacacgccttcatatatatatatatgtgtgtgtgtgtgtatacacatatacacacacacacacatatataggagcaaatgatagcatccataggaaagcttagttcacagcctgccacatagaaactcaatatatatctctctcatatattatatatgtaacaatatatattattgatatatgatagatatataattatatgtaatatcatataaatatacattattgtatataatatacaattatatattatatatttatatgaaatatgttatatatgatatataattaagtatatatttgcatttttaatttattatattttattatatattatacataatgtatatcatatatatttataattttaaattaaaatatatatttcaataaatatatatttaaatatataatatataaaaataaatataaatttaacatatattttactatatatttataattataaatatttatatataatatatataatttatatataatataatataaatttatttataaatataaatatataatatataatataataaaaatttatatacaatataaatttatgaatatttataatttattgtaattattgttttttatgagacggtctcgctgtgttgcccaggctggtcttaaaccccggggctcaagcgatccttctgcctcagcctcccaaatagctggagttacaggaaggcacccctgcccctggcttagcgcaggcctctaatgagcctagcagcatgctggatttcttttgacaacggaggctggccataggaaggtaaggagagagtctaggaagagaccaggaacctggctacaccttagtggggtcaccctacactcaggatatggggctccgttttgtaagctcaaggaatttactatttcctccttcattctggtcactgaatgcttaagaggctgactcataaaccataatgcttatttatttgggacagggtcttgctctgtcacccaagctggagtgcagtggcacaatcacagctcactgcagccttgacctgggctccagcaatcctcccacctcagcctcctgagtagctactactacaggagcttgccaccatgcctggctaattaaagaaaaattattattattatttttttttgtagagatagggtctcgttatgttgcctaggctggccttgaacacctgggctcaaatgatcctcttgccttggtctcccaaagctctgggattacaggcgggagccactgcacctggccctaatttacctttttattataagtggccattttcttctggggaagcatgataaagtggactttggagggaggcaggcctgggtttgaacctggctctaccacttactggctgagtgaggagggaaagtggcttgaactctccaagcctcgaatgctttacctgtcgaatgggagtgatgacaatatataaatttcacagggttgctttaaggagcaaatgaaatcatacaaaagaaagcttagttcagggcctgccacatagaaactcaataaatatttcctgttaactacacagaactgtgtccctaggagacagtgtgtttagtcaaaaaaaaaaaaaaaaaaccaaaaaacagtgaggagtggggtgtgtgatgtgaccaaatggattggtaagcctggtatcacaggacttctcagatcctttgcacatgaatcttgctaaggaaggtgcagcacgcagcatttcccagcttatctgaccatggcacccttggttcatggagcaactcacgaactagtgttctgtgtggcatacactttgagaaacatcatcacaggccatgtgtccatcaacctggagaagctgatgaactcacgtgcactctggggatgcatctgttcagagaatgtggactggtcggtagcatcaggccattccctccccaggaaagtggaggggaaaagcacatgcacaagtcttactcttggacaagaacaccgtcttcagtcatggcaccaatatccatgatggataagctcagtgaatgagatcactttgcattcatttacattctggcttggagtctactgatgaggtgtgggaaggacccagtcactgcggaaactcggctcaattcatcttttagggcaagtgatccctgctgggaatcgctcattcatttctcttcaattcctatcaggtggaatttcagggcatggcattttctgagcctgctcccaaattctggaaagagggagggagtgggtggaagtgcagagggcttgggacaagatagtcaaacaagctctactgcaaccagcagggtggcctggcccagagcacgataaaccatcaagatacttccctgcctatgaaatcaaaaccataacagctcctccaactgtgggtggtgagttaatatttatacactctatagatttattctagaagaggaaactgaggaactctcctagaatccagcagaaaaaggtggtggtgggtggagctggacaggataaaagaaaagctaagtggaagacagattgagaagttgcaacggttgtcttacaggtgatacagatggagaaaattaaaagaatggagaggaagagaaattcaaagaaactctagaaaaaaaatcccagaattgaaaaaatataggaatcctaagctcaaataatgcaatggtttccatgccagtgagtgcatgtgcacagctgtacggtaagtcctcagtcggcattgcccactcgttcttagaaactgcaattttaagcaaaatgacctgtaaggcaatgaattttaccataggctaatgattacaaacaggaattaagtttctactcacaaaaacatcaccaaacaacagcaacaactactactacaacttcttctttttcctcctcctcttcctcctcttcctcctcctcctcctcctcctcctcttcttcttcttctttcttctttcttcttctgtctcactctgttacccaggctggaatgcggtgctggaatcatggcatactcactgtagctttgacctcccaggctcaagtgatcctcctgccttagcctcaaaaagtgctgggatttcaggcatcagccattgtacctggcctaccaaacttctcaagaccaaaacacttctagtattaaacatggaaataaatgtgcactatacatagaataaatatgagcttaagaaagattcattaagaacagcaaataattatttacccatttattgcagttaagggtcttgggtggtcagagcccatcccagcagctcaggacacaagatgggcaccagcccaggataggacaccatcgcggggcatctctcacaccccacactcactcagactgcagccatgtagacgcaccaatgaacctaatatgcacacctttgggatacgagaggaaaccgcaatacccagagaaaacccacacagacgtagggagactcacagactccacacaggcagtggtcccagccaggaatcaactttttttcccattgacattataatgaaacaacattgaatgaaatgacatcaataccctcctctgaaaaactcagacttcagcttggaagacaaaccaatacaccagagaatcagaaaacaagaagacaattgtacatcttgattttagcttctgaccaattttctatgataaccttgagaacaagatgatagaattgggactgactggttttcctcataggtgaacgcacaggtggttgaacagcattacctaaatagtattgataatagtgttttctttgtgctgaatacattttagaccttggagaatgtctaaggggttagacgaaagagctcatttctggaccctgttttgttcaacacctttggcaatgatgtgtgtgatgacatacaggagaaccttatcagatttgcaggtcacataaagttgggaaaaatggttaatatgataaatgcactcatcaatattcaaaaagacttgacaggcaagaagatagggcccaaaccacaagatggaattcaacagaaattaacgtaaagtgctgaattttgccttaaaattttgcccaagggcaggatgggggagaattggcttggcagaggcttaggaaggaaggaaggaaggaaggaaggagggagggagggagggagggaaggaaggaaggaaggaaagaaggacggaaggaaggaaggaaggaaggaaggaaggactgactttatcagattttagctggtcacacaaagttgggaaagatggttaatataacaaaggaggaaggaaaacaggaaggaaaaaaaaagaaagaaaaaggaaggaaagaaggaaagggaagaaaaacactgtgggcttttaattaactaaatgttcaatgtgacccggtaatgtaataagtgacacttaaaccataagggcagattatacgaagaaggcaaactgtagatgctgtaatttctcccttctctcccactcccaacccagtggatacaaaattatgagaaatcattttatcgctagcagacaggatcgagctgaaagagaaaacccaagtccggaggctgcaggaaagaccaactccaagaccgcagacaccagatacaaaggatagctctagggtgacaagttagagctctgcctgagacagggacagctgcccgggttgaacctcctgcaaactcccctcaccccattccatggccaggcagcaccccagggagatgtcttccctcctgcaggcagactgcgggcctggcggtcagagaggcacgacggtgcttgcggggagggttgggctgtgcaggtgagacccaggaggaacaggaagcctcagattctagaaaaggagtccctacaacgcagcagggatcatctcgtgctcaccaaaaggccgcaggcacagatacagtcagagctgaccatttggagaggatgcccaatgtgaacgtggtcctctccccaggaaacactagacactggaggaaagccaacgccgtaagagaaacaaccaagcacggtcaaggaaagcgttcacagggccagcagaacaagccattagattgtgcgtgcttcatgtcctcagaaagacgcaagagagcattggctccacaaatagaaattaaaacaaaacatcaccgctgggtgcggtggctcacgcctgtaatcccgtcactttgggaggccgaggcgggcggatcacgaggtcaggagatcgagatcatcctggccaacatagtgaaaccccatctctactaaaaatacaaaaaattagctgggcgtggtggcaggtgcctgtagtcccagctactcgggaggctgaggcaggagaatggcgtgaacctgggaggcggagcttgcagtgatctgagatcgtgccactgcactccagcctgggtgatagagtgagactccgtctcaaaaaaaaaaaacccagaaaacccccccaaaacatcaccaaaacaacaacaacaacaaaaccaaacagtagatggactgaatttacagaatggacacagctcatgaccaaatcactgacttagcagatggaattgaggaattctcccacaatccagagaaaaaaggcattgggggtggcctggataggataaaagaaaagttaaagagatgtgggagatagatccggaagttcccacgtttgtcttacaggtgacctagcaggagaaaatgaaaagaacagagaggaagataaactcaacaaaactctagaagaaaagctcccagaattgaaaaaagatatgaatcctgagctcagaaagatgcacaaagtgcccggaagaacgaaggggaaaaaaaaaaaaccacagcaattcacgtgatgctgaagtctcagatgccaggcttgcgagaaaaagtcttgaaagcttgcagggatctgttacctgcaaagctatagaatcagatggatcaattggcaatacctggtccaagaagacagtatctttaacattctaaggaaaaacaattttgaaactagaattctatatttagctcgacaatgatttcaagtataaacatagaaaaaaaaatttcacacatgcaaggactgaaaaagtttcccatccatagacgttcaatgaaaccatcaccaaaagcagtacatcggcaaggaggaagaaagactccaaggggaagaaataggatataaggaacaatggtagttgcctgttatggactgcacagcatccccccgaaggcataagttgaagtcctaaccttccgtagctcagaatgtgactgtatttggagataagttctttaaagaggtaactaagctgaaatgagagttaagtggagccctaatccaatctgcctgctgtccttatatgagaatacgttaggttcgtgcaaaagtaattccaatccttgccattatataatggtaagaaccacaattacttttgcaccaacctaatataatttgaggaaaaaagcatgaaaagtaactaggaagatttttatgctatttttgagacagggtcttgctctgttgcccaggctggagtgcagtggggccagcagagctcactgcagccttgatctcccaggctcaagtgatcctcctgcctcagctcctgagtagctgagactacaagtgtgcaccaccatgcccagctaattttttaatcttttgtagagacagggtcttactatgttgcccaggctggtctcaaactcctgggcttaagagatcctcctgcctcagcttcccaaagtgctgggattacagatgtgagccactgtgcctggccacttttcatgctattaagcatgaatgcttgcatgcctcacaatctggcttcacagcacataaagcaaaactgatagaaatacaggaagaaatcggtaaagacattgccacagtaaagagacttcctgcagtcctctgagacggggacggcaagtacagggagagatgattcaaatagttagcatgtttgctctaatagagctacagaactctgtacccaacaaatagaagaaaaaaaactcttttcaattacacatggaaattctacaaaaattcaacacagattagccacaaaggaaatttcaagtaataatgaaacgcagaaatagcatatggcatatttgctgacaaagacataataaaatttttaaaatgacaaaagaataccccctctaatctataaaccagaatatttacaattatttaaaaatgaaccataacgagagcagaaactgctagaatcaatatgagagtgcaataaggtggctaaatccaaagtcaacttgcatctctccagatattaaaacatattataagactacaggccacagtggcacagaaacagataattagatgaatgaacaaaagtctagcagacagccagtgtaggtgtaaaaatttagtgtatgattagggtgacatttcaaaccaaggtagaaattcaagtgctgatggataattggctaacgattcagaaaaaattacgttcctacctgcccctttgcataatttgcagatagatgaatgatttataaatgaaataataaattccaaagtattagaagaaaaaaaactgttaaatacgccgataaccttcatataggaaaggccttcctaaagaaggcatggtatgctaatgtcatttaggaaaagattgatgccttcgcgtacattgtaatttataacttctatgtggtgagaaacagcacgacgaagttaaagtgtaagttatggtccaggaaaacatctgtaatatatgaaatagagattaatgtgcagactgtcaataagaaagagacaaggcacgtggtgggaaagaaaaggaggaaactgagcaggaattcacagaactttacacaaccaatgaacatggcagtggtaattaggctcactaacaaagaaaaaaattggaacattgagattccattctgcgcttgagctggagctgcaaaagaggagtgagaaaagagctcacctccaccaggcactgtggctcatgcctgtaatcccagcactttgggaggccgaggcagaggatcgcttgagcccaggagctcaagaccagcctgggcaacatagtgggacccccccatctctacaaaaaagagtcaaaaaatgagatgagaagatggtttgagactgggaggttgaggctgcaatgagcagtgatatccattcacttaatcccacaacaaccctgtgaagtgattttttttatttttaattttgagatgggtctcactccgatcacccaggcaggctggagtgcaatggtgcaatcactgctcgttggtactagcagtttctgctctcattatggtacagtacctgggacaggatcggcggccagtaagcataggcagttgctatcattatcatcagcatgtttccaccatctgagtggctaacattttcaagctggataatacacagttttggcaagggtgcagggaaaaaaaaggactctcccgctgtcttgaggggaatctaaatgggtccggccagtttttgagggcaatttggcaatatccatgaacacatgccaccacacatctgacactgggtgctgctgtgtgattgtgtctccctgaaatcctatgttgagatcctaatcccaaggagatggtattaggagatgagggagagtacctcacccttgggagtcggttaggtcagggggtgctgaatccttggggatgggattaggacacttataagagagtccccagagaaatatcctagagagaccccttgcccgtttcaccatgggaggacatggccagaaggcaccgtctatgacgaagcaggccctcaccagacactaaatgccttgttcttggacttctcatcctccagaaccataagaaataaatgtttgttgtttgtaagctgcccagtctataatattctgttatagcagcctgaatgaactaagatgcccaggaattcctatttggcgcccaacctagagaaatattcaaccctctgcacatccatggacacacaaaggacagcaaaaggttggaagccatcttaaatgcccattagagaaaccacacttttttgttttttttgagacggagtcttgctctgtcacctaggctggagtgcagttgtgcgatcttggctcaccgcaacctccgcctcctgggttccagcgattctcctgcctcagcctcttgagtagttgggactacaggtgcccaccaccacacctggctaatttttgtatttttagtacagatggggtttcaccatgttggccaggctgttctcgaactcctgacctcaggtgatgcacccacctcggcctcccaaagtgctgggattacaggtctgagcctctgtgcccagcctcatatggtaattttgtgtttaacttttgccaaaactgcccagctgttttccatggcagctgcaccatattacattcacaccatgatttcttctttaatcacaaaatgcaagagaaattctgggaagggagtgggaatgccagagggagcagctaggaaaggaaaggtttgttgggcatcagtgagtgtgcaggagggtagaatctgcccaggccaagaggaaggcaggcaggcaggccagtgttcagacaggagcagagccaggcagggcctggagagggagtgggctgggcctatgtctgggcaaagagctgggcttgagtgcataaagtcacggggaagtctatttaacagcagtggccgggaaggggtgttgaagtcttttatgcagaggccggcctcaagcacgggcccagcccaccatctggtcacctgcagaaggacccctttgccccttcccttttaggtgcatcctggaatctactggaagacgcaggagggtgagagggcagtggcaggctggataatgaggtcgctggtcctcctgaccctgcggtgcaaaggcagggcgcccggaactgtcatcatctgcttccaactgtcataaaagagatgtggcgagtggggaggacatcaaactaagtttaacatgcaattgaaccagggactgagctggctcctgcgtcttctctctctgactttaaaatgaactcccggaagctccagcggtggagctcagcaccgtgcccacagaggagctcaataataggggggatgacagcggcggtggtgagggcacaggacggaacggcaggcccttcagtgctgccctggagacccgcgggctgcacacacatcagaaacatctctgtggagcccccgaggcctgcattgccgcaagcgggaaaatggattgttgcaccagcatttctggtggccagcgacagggtctgcctcccatcctgtggacggaagcccaggagttcaaggctccagacttggaggcaggagtcactccagagcagggagggaccagcaagcctctgtatgagtttcctgggattcatgtgttaagaataaactgccatagacagggcggcttcaacaacagacatttagcatctcagggtcctggaggctgctgtccgagatcaaggtgacagcagggtaggcgtctcctgaggcctctctcccgggcctgtagacggcatcttctccctatgacctcacaaggttgtcgttctgtgagcatctctctctgatctctctctctcttttttttttttcttgagatggagtctcactttgttgcccagtctagagtgcaatggcgtgatcttggctcactgcggcctctgcctccctggttccagtgattctcctgcttcagcctcctgagtagctgggactataggcatgcaccaccctgcctggctaatttttgtatttttagtagagacagggtttcactatattggccaggctggttttgaactcctgacctcaggtgatctgcccgcctccgcctctcaaagtgctgagataataggcgtgagccaccaggccagacctcatttcctcttcttataaggacaccagtcacatgggattagggctcacccccatgacctcatttaacttaatcacctctttaaagaccccatctccaaatacagtcacattgtgaggtcctggaggttaggcctgcaacatatggatgtggggggacacaacagcccatgatcccccagcaacatatggatctggggggagacagcagcccatgatcccccacgggggctttggcactggagtggccccaggcctgccttctcctcacctggctgcatcaggtaactctggctggcaacacttccagactctcattccagaaccaccccagggaaataacagaatgtgttgagactcttactgttgatagcagccggctgggtatggtggcccacacctgtgaactttgggaggctgaggaaggaggatcgcttaggccaggagttcgagaccagcttgggcaacaaagtgagacctcatctctaccaaatattttaaaattagccggggatggtggcacacatctgtagtcccagctactcaggaggctgatgtgggaggatcgcttgaacccaggagttcaaggctgcagtaggctgtgatcaagccactgcactctagcctgggtgacagagcaagaccctgtctctaataaaagaaaagatagcagtattagccacttgacccttcccgtggggctgtgtccaggaatcgcaaactctcagaggcatttgaacaagagcaattccatcttgaataggagctgggtaaaataaggctgaaaactactgggctgcattcccagatggtcaggcattctaagtcacaggatgagatgggaggttggcataaagaccttgctgataaaacaggttgcagtaaagaagccggctaaaacccaccaaaaccaacatggcgacgagagtgacctgtggtcatcctcattgctatactcccaccagtgccatgacactttacaaatgctacggcaacgtcaagaagtatggtctaaaaaggggaggcatgaataatccaccccttgtttagcatatcatcaagaaataatcataaaaatgggcaaccagcagccctcagggctgctttgtctatggactagccattcttttattcctctaccttttttttttttttgagatggagtttcactcttattgcccaggctggagtgcaatggtgtgatctcagctcactgcaacctctgcctcctggattcaagcgattctccaacttcagcttcctgagtattacaggagcccaccatcacacccagctaattttttgtatttctagtagagaaagggtttcaccatgttgtccaggctggtctcgaactcctgacctcaagcaatccacccaccttggcctcccaaagtgctgggattacaggtgtgagccactgcacccgtctggtctattcctctattttcttaataaacttgctttaactttattctatggactcaccctgaattccttcttgcatgagattcaagaaccctctcttggggtctggatccgggtccctttccagtaacaaaatcaccctcaccgcaccctccatgaaatctcacagcatctcagtggaaatttaggtgagcatccaattggcaggtaagaaacggtcctggagaaccagactcagagcatcctccatcttccacgtgtttattggacaccacaaggttcatagaaaaaggtagaaattggatgcacagccagcaggatgggcatggcggccagtggggtcctgctttacctccaagggggatgggctgcccagctcaggctgcccaggagggagagtgtggacaacctggaccctgtagatcaaacaggacgctggaggtgccaagccatgagtgcctgcgagaaacatcaggaggaaacagggcttttgtatttctttccacatcagtcctgggtcccactaaggctactggaatgattgatttttggtttggcagtactgttgtctgaggcgttcaaaccacagcgactccatcctgagtgaggctgaggaaaataaggctgggacttggtgggctgcattcccagaaagttaggcactcctggcctctagatgttaacggttaagagaacagactgataacgtttaccaaacagacccagacttgtgagtgtcctgatattctgacatcttttttttttttttgagacagactcttgctctgccgcccaggctggaatgcagtggagcaatctcagctccctgcaacctccacctcccggattcaagtgattctcctgcctcaacctcctgagtagctgggactacagcatatgccaccatgcctggctaatctttatgtttttagtagagacggggtttcatcatgttggccaggctggtctcgatctcctgggctcaggtgatcctcctgccttggcctcccaaagtactgggattacaggcttgagccaccccacccggccccgatatcttgagaacaaaagcattcctaatttgctttaaagatagtaatatcaattcttgcaaaatatagtaattaagaaaattaatcctccatcacaaatccttgtagcaaagtatatttccccatgattttctttttttctttatcctatatataaacaagtattgtacctaggtagacgcgtccctcctcttactttcaggaccaccctactctgtctatagaggtaactgttctttcaccctttttttttttttgagacggagtcttgctctgtcaccaggctagagtgcagtagcgcaatctcggctcactgcaacctccgccttctgggttcaaatgattttcctgcctcagcctcccaagtagctggaaccacaggcacacgccaccatgcccagctaatttttgcatttttagtagagacgggatttcaccacgttggtcagcctggtctcgaactcctgacctcaggtgatccacccgcctcggcctcccaaagtgctgggattgcaggcatgggccaccgtgcctgacccacctcactttcttaataaaccggattttactttgcactgtggactcgccctgaattctttcttgcacaagatccaagaaccatcttttgcaacatagtcaccctgcaacatcgtcaccctgggcctgagcttgccagcaaagatggcggcgtgggaggaaatggacgttgtgaccagtgcgggctcctggctgagaacacagcccggccttcctcagacactgtgactcaggtgcacactaaacacagggggagaactggtgtggggcacagcggagacccttcctctctgagcaccatgaaatcatgtcaaacctggaaacttctggcaacccatcagatgacgcaaaacattgagagcttcaactgaatccaaggtcccaggaaaacaaggttctgggacattaaccagaagtccaagtatttgaatgcaaaataattctgtgcagccagacatggtggctcatgcctgtaatcccagcactttgagaggccaaagcgggtggatcacctgaggtcaggagttcaagaccagccgggccaacatggtgaaaccctgtctctactaaaaatacaaaaattagccaggtgtggtggtgggcgcctgtaattccagccagcctgggcaacaagagcgaaactccatctcaaaaaaaaaaaaaaaaatctgtgctcttggaactacatgtcatttacgttacatgtgcagaaatctactcattgccctgaagggctgtttcctaatctccagaatgttctcccacgttcaggctgggaactttttaagggcagggcctgttttgtgctgtctttgcatctctttggcatgtgttaggatcacttgtggagtttttaaaaatccattaccccaaataatgaagcaattagttgtggtagggcctaggcaatggcaattttaaaagaggattctgaccggcagccagggctgggaaccattgcaccagagcccctggctttaacaaggacccacatgaagtgtgagaggagaggcagcagaggagaaagggggcccaggtgaagcttgtggactgagcagagcttctccaggtttactgtgtgtaggaaccctctgggctcttgttgaagtcattcacaaggtctgcggtggggcctgagagtctgcatttccaacacaggcccaagagacgtcagtgctgctgctctgaggaccacactttgaggagtaagagaaaggggcaccaggagaaaatgcttccagctggatttccagtgaaatgcatatacatttctctctgctccctcctgaaaatggagcaattcacctgttaagaaatgaaatgtgtgtgtgttttcatatgaacataaagaacagagaagatgacagtagatgagagatgctgagaaaattttggaagatggaaagcagatagagactaccatttctggggagactactgctatggtctcaatgtgtgtgtcttcccccaaattcataggcttgaattcctctcccgtaaggcgatggtgttaggtggtgaggcctttgagaggtgattacgtcatgagggtggggcccttgcaatgagattagtgcctttatagaaggtattccagagagttctttcaccccttccaccatgtgaggacacggctctgaaacacaggcccattaaaacaattaaatgtaatcagagattatagaacatttcccctcccccacacttcaccactacactgacagggctccagtgtaatcacagtggattagagctgaaagagctgcaaatcacagacttgctctaaggaggaatatacagggaatccccaagtcaagagactagacaaaagcaaggacatttgaggagtctgaagctcctagtaccttgaaatacaacaaacattaaacagaacctgaatcttagcaagattcacagaatcttcacactaacggctcatttttctcagttcctattacctaatacagcatgtatggctgtcaacaaaaaagtacaaggtataccaaaaggcaagagaaaacactctgaaaagacaaattgatgatcagaaccagactcagataggacatagacagggaatttaaagaagaagacattgatgcagccaagaaacaggaaacaaagctcaacatcactgatcattagagaaatgcaaatcaaaaccaccgtgagataccatgtgttgagggcccaaatggaaaaaaaatagacagtatgtaagaacagatggataaagtaagcagacaaatggaaactgtatgaaggaatcagaaggacatgctagaaataaaaatcacagagtagaaaggaagaatgccttcaatgagttcatcagtagactgcacatggccaaggagagaatcagtgagcttgaatacagatgaatataatgtcccaaactgaaatgtaaagagaaaaaggaattaaaaaaaatctgaatccagaatctacagtgaactcaaacaaattcacaacaagaaaaaatcaaacaaccccattaaaaggtaggcaaagaacatgaacagacacttctccaaagaagacatttatgtggccaacaaacatgaaacaaagctcaacatcactgactattagagaaatgcaaatcaaaaccacagtgagataccatctcataccagtcagaatggccattattgaaaagtcaagaaacaacagatgctggtgaggttgtggagaaataggaacgcttttacactgttggtgggaatgtaaattagttcacccattgtggagatggtgtgacgattcctcagagacatagaaccggaataccatttgacccagcaatcccattaccgggtatatacccaaagtaacataaatcatgctattacaaagatacatgcatgtgtatgttcattgcagcactgttcacaatagcaaagacacagaatcaacctaaatgcccatcaatgatagaccggataaagaaaatgtggtacatatatacaccatggaatactatgcagccataaaaaggaacgagatcatatcctttacaggaacatcgacgaagatggaggggaagttgaacaatgaaaacgcatggacacagggaggggaacaacacacagtggggcctgctgggtggtggggttgggggagggagagcattagaacaaatagctaatgcatgctaggcttaatacctaggtgatgggtggatagggcagcaaaccaccatggtacatgtttacctatgtaacaaacctgcacatcctgcacatgtaccccagaactaaaaataaaaattaaaaaaaaaaatcagggcagaacatccaagaagtatcgaataatatcaaaagtgtgtaaggcatacttggataagcagagggagacgaaaagagaaggaagcaaaagaaatatttcaagtggtaacgaccaagaattttgcaaaatgaatgacacaaatccaggaagttcagagaacactaagcaggacaaataacaaaacaccccaaggcatatcctgtccagctgcagaaaaccaaagataaggagaaaaatctcaaaaggaataaaagagggaaaaaaaccctaccttatctgtaagtgaacaatgataagaattactgcagacatctcatcagaaaccaagtgagcaagaagaaaatggagtaaaatagtgacagaaagaaaccactgacttagaatagaattctgtgaagtagtcctcaaacgtgaaggagaaataaagactttcttaaataagcaaaaacagagagaattcatagcagacttgctctgcaagaaatgttaaaagaaggtcttcagaagaagaaaaatgatacagaggaagaacaatggagaagaaataactaaaagtaaaataagatctttttaaaaactcttaattgatctaaaagataactgtttttaaagaataacagtaattatgtatcaggtaattctagcaaatggatcagtgaagtgattgacagccatctcacggagtcaggaagaaggaattgggaattctgttacaaggtatcttcactgcatatgaaacagtacagtgttatttgaaggtgaatttggattagctaaaaatgcattttctaaattctaggacaaccactaaaaatatttaaaaagaaatgtggttgatatgctaagacagaacataaaatgctcaattaaaacctgagaagttggccgggcacagtagctcacatctgtaatcccaatgttttagaaggctgaggcgggaggattgcttgaggccaggagtttgagaccagcctgggtaatatactgagactgtgtctctacaaacaaatacaaaaattaggtgggtgtggtgttgtgtgcctgtagtcccagttatttgggaggttaaggtggtaggatggcttgagtccgggaggttgaggctacagtgagctgtgatggcaccactgcacttcagcctgggtgacagagtgagaccctgcctcaaaaaaaaaaaaaaaaatttatatatatatatatatatatatatatgaaaaaacaacaagaagacacctgagaagtcagaaaaggaggccgggggaagagagcttggtatttattcagagaaggacaagtagatctaagaaacaaaacagagtttgggttcagatttgaagccatgattatttgaaaattttgatatatcagaagcttagcattgcaaatcagtggggaaaagatgctgcaaaaacaaatggatatttctttggaaataaatttaactggatttctcccataagccatccacataaataaataccatgtactttagtgtgaaatcttattgctagcatttcttatgatatattgatctatacagatcatccccgatttacgatggctcgacttacaattttttgactttacaatggtgcaaaagtgataggcatttagtaaaaactctatctcaggcacccaaacaaccattttgtttttcacttttcgtatggtattcaataaatgccatgagatattcaacacttttttagaaaataggctttgtgtgagaggattttgcccaattgtaggctaatgtaagtgttttgaccatatttaaggtatcccagcctatgctaggatgttcagcaggtttgcactaaacgtaatttcttttttttttttttttgagttggagctttgctcttgtcacccatgctggagtgcagtggcgcgatcttggctcactgcaacctctgcctcccgcgttcaacaattctcctgtctcagcctcctgagtagctgggattacaggtgcccgccaccatgcccggctaatttttgtatttttcagtagagacggggtttcaccatgttggccaggctagtcctgaactcctgacctcaggtgatccacctgcctcggtctcccaaagtgctgggattacaggttttaggcaccatgcccagcctactaaatgcatttttgactcacatattttcaacttatgatgggttcatcgggatgtagccttatcataagccaaggagtatctgtatatccttttgtctgaaattttcaagaaatctaacttataatttcaaaacgtttacagactttacattagagaaggatgaaacccgagttcctaatggtggaagagctggcgaggagagagacagttttctctgcagagccccagaagagctcagaaaatggaagcaccttgtactgcaagaggtggtgtgcagggcagggctggggccagcagatgagtggaggaaatgtaaaaagagcaggtgagcccccagattccctccccaactgataggagaaggtaggtttactcgctggaaaattatggggacaacaggtgtggggataaggtgccatctggaagggtagatgattaaaatgttggaagaatgggattcagaagtggggaggggcaggctacaggactgctattttttattttaagtcatgtgatagtatttgatgttttatttctatttctagttttagacaaggtctcactctgttgcttgggctagagtaaagtggcatgatcatggctcactgcagcctcgacttcctgggctcaggctatcctctcacctcagcctcccgagtaactgggactacaggtgcgtgccaccatgcctggataattttttatttttatttttggtagaaacagggttttgccatgttgcccacgctggtctcaaactcctgggctcaggcgatccgcctgccttggcctcccaaagtgctgggattacaggcaggagccaccacacctggctgtgtttgacttttgtaaaccaagtacacatattgtttagataaaaatagaaagcaagcttaaaaacaaagaaaacaaccgcaacctaaaattaaggtctcttctggatgtggtcattggaatggctttctccactgtggtacagaatgaagaccaggaagcagctacccagggaacgcatagtctcaccagtggaaaatcctgcccctcaaatctgcaggtgtcatgccctgccataatgtcagtggggccaggcctcagggagaataggtgtttggtccaggaaaataaagggtgttcttgtaatgacttcacaatttcttcccaacttggttcttctctcatttttccccctaaactcaatcatccatcatttacctcggacttgcttcaggccacactatttataacaatagaagcagcatttttggcttgtcacctttctccaatggagcccagattgtctctaaacctttaatgggcatacagagtacctgggaaccttgttaaaatgcagtaggtctggggtggggcctgggagtctgcctcatgggagcagccccaaggggaggctaacgctggtccctggaacacactctgagtagcaaaaggacttgaggcaactttttgggggtgatggaaatgctctaaatcttgattgtggttacatggagtatatacattgatcaaaatgcactgagtttattgtatgtaaattatacctcaataaagttgattttaaaggaaaaaacccattctagatgaattacagatataaatgtgaaagatgaaacaataaggcttttagaaggaaacataaactttaggataggtgaatgcttcttaaacaggactcaaaacaaattaactataagaaaaaaatacacacatgaattggactgcattaaaactaaaaacttctgttcatcagcagactattgagagtaaaaagctgagctgtaaactgaaaaaaaatccacaatacatatatctgacaaagaactcacgtctatcatatataaagaactactacaattcaataagtaaaagacaactcaatagaaaaatgggcaaaacactttaacaggcactttgcaaaggaggctatctgaaacggacaataaacacatgaaaatgtatgctaattagtcataagcaaaatgcaaattaaagatacgaaattatttattttgcctaaacacccacaagaatggctataatgaagacacagacaattccatgtgtgagtaagagtgtggagcaactggaactctcatacactactaatgggagtgcagactgaaatgacatccttaaaaactatttggtagtatttattagagcagaacaaaaacatagtctaagatccagcaaatccactcttgagtggccaaacacatgtttccaaaaacacataagaatgaatgcctggctgggcatggtggctcatacctttaatctcagcactttgggagtccaaggcaggaggatcacctgagcccaggaagtcgagaccagcctgggcaacaaagtgagaccacccaattctaccaaaaaagaacgcttgtagcagcattattcaatgcagccaaaaattggaaacaactcaaatatccatcagcagtagtataaataaaacgttatactactcattggcaataaaaaatgaattattggcaataaaaaatgaatgagcgaccgccgcaagcaacaacatggattaagctaaggttgccagataaaatagaggacattcaattacatttaaattttgaattaaaaacaaatgattttttttttttgagacggaatctcactctgttgcccaggtcaggctggagtgcaagtggcatgatctcggctcacttcaacctccgcctcccgggttcaagcgattctcctgcctcagcctcctgagtagctgggattacaagcacccaccaccacacctggctaatttttgtattttcagtagagacggggtttcaccatgttggccaggctggtctcagacacccaacctcaggtgatctgcccgccttggcctcccaaagccctgggattacaggtgtgagccattgcgcccagcccaaatgatttttatttttatttttttttagcataagaatgtcctatgcagtatttgggacatacttacactacaaaattcttattctattaaatgttattatattacaatattattttttagctggtcatgttctgtttcttgatctgggtgtcactgggcgacctgggtgtgttcactttgtgaaaatccgctgagttacacacttaggatgagtgcaggtctctggtgtgcatttgctacttcaatacaaagtttatctgaaatcacaataaaacgatccctggcccgtggcccattaaatgagggcctgcctcttgccttgagggacccatctgttgtcgtctctgctgtctgtgatctctgtaacccgtgcatccatcctggcttgtagccgctgctcagaacgccccggtgacgcacccttgcccacaggacagcatctgccctccttggcacagcaccccagggctcctgtggcctcccctgccccatttccacgtcctcacatcttttttccagcgctgacactaaccacaccaccacggctctgtgcctgccgcttcgcctgctgctctgccaggcaaaaacctatttattttcccagtctcatttcagcttctgtcggctctgggaggtctttcctgactccttcaggcagacctgtctgttcctgtccccaaggtctgtcttcatttcaagcatccattagagcaactccattacttcgcaactgactgtttatatatctgtctcctccccggacaacaggcttgctggggcagggactctgtctttttgtctttttatccctagcaactcacagagtgtctgtgcgtgttaggctctgcgtatgtgttaagtgggtcatgacagtaatgggtgttaatgaatggggaccagcagagagatcgaagggctctgtaaagcgttcacacttaattttagaattagagatggcaaaaccctgtctctacaaaacaaaacaaaaaccaaaaattagctgggcatggtggtgcatgcctgtagtcccagctactcaggaggctgtgttgggaggatcacttgagcctgggaggtggaggctgtagtgagccatgatcctatcactgcactccagcctggaagacagagcgagaccctgtctcaaaaaaaaaaaaaaaaaaaaaaaaaagagaaagaattggaaaatgatgctgtaagtcactctgctaatgagtggccagtgtctcatttaacttcccaggagaagggtgctggtcttgtctcccatgtcacagataggaagaaaagtgctgagcagttcaatggtttgcccaaggtcacatggccggtagggagcagaccacacactcatggcactggctgttccgtgaatcacagcagacgctgaatcactaaaatgtccttctgggacaggcaagtcaacagaggaagtgcccagtctgccccgggccaccttttgactcaagcaagctttctggcacctctcaaatcagtccctgtgggtggccaccccctctcccatggaatggctcgccgggaacgggttaacacctcaaacacctaaacacagcgttcagctctgtccagacactctcgactcctgcctgagattttcaggttttaaacaaaacaaaaatctgattcactgtttccagtcctacaggaaactcaggtcctttatttatctgccactaaaaaaaaaaaaaaaaaaaagaagaagaagaaggaaaaaaaaatcaaaccagaaaaaaagccctttatgtcttaaaagggttttgaatgcatctcgtttcatacagcaccaaacatcgttcatgacgggggctccaggatgaagcccagactaaaagacagaaggaaatgaaacgcattgcaataaaacacacatgctaataaataagggcctgggcaatgaatccagctcggaatataccactggcaagaagaaatgccccaaagctttacttaaaccaaataatagaagaacagatggctcccctgggtctctgggaaaagttaatagatccaggaggctgcagatagaggctttgtttgggatttgggcagaaaacacaaggcattcacaagattcaaggtgaaagaaagagggcttgtagatttagggacagggacattttcatcagataacgaaaatagatatgtctggatatctctgctgggtttccacaggctgcagggcacgtgccctctccagaaattaaccagggctgcgctcggcagcatgctagggagaccgactgcttctagctgcccaactggagaattaatttaactccagagatttggataataagaaagaacccttaaaggagataaaaatttactttgggaagatttttgtccccacccattgtacagcagcatccttaagtggtgggaacagtgggtgggaactggaagctctgggttctatgatgcaagacccccctggtcactgattagctgagtgaccctgaagaaaaccttcaggctgccacctgcccagcggctgttaagaatgctgagatccgtggacacagggaggggaacatcacacacccggccctgtcgggggttggggggaaggggcgggagagcattaggacaaatagctaatgcatgcggggcttaaaacctagatgacgggttgatgggtgcagcaaaccaccatggcacatgtatacctatgtaacgaacctgcacgtcctgcaaatgtaccccagaacttagagtgaaaaaaaaaaaaaaagaaagaaagaaaaaaaaaagaatgctgagatccggttgggcgcggtggctcaggcctgtaatcccagcactttgggggcggaggtgggcggatcatgaggtcggaagatctagaccatcctggccaacacggtgaaactccgtctctactaaaaaaaaaaaaatacaaaaaattcgcctggcgtggtggcgggtgcctgtagtcccagctactcgggaggctgaggcaggagaatggagtgaacccaggaggcagagcttgcagtgagcgagatggcgccactgcactccagcctgggagacacagcgagactccgtctcaaaaaaaaaaaaaaaaaaagaagaatgctgagatctgtggacacagggaggggaatattacacagtgggccctgtcgggggttggggggcaaggggagggagagcattaggacaaatacctaatgcatgtggggcttaaaacctagatgacaggttgatgggtgcagcaaaccaccatggcgcatgtatacctgtgtaacaaacctgcatgctctgcacatgtatcccagaacttagagtttttaaaaaaaaaagagagagagaaaaaagaatgctgagatcttctaagcacggaaggatcacacccgcatccaacccccatattaatcccctttctcctccgcaccagggaaatccaaatgaccttgtcttcccagagtggggggcagcaaactgaatccattaacagggaaagaaagggctttcaacccaaccggtgagatggttcagaggagtgcgtgaccgacaggaatccacaactggagaggtcaattaataaaaaataaaacttcccctttataccacggtgcataaaaacctccagcaccatttttcatctacttacattgtcttgagagcaattttgtgtagtggcaaggcaggaattatttatctccatcttattcatgaagaaataaaatcttgggacagtgaagcgatttgttcaaggtcacgaggtcatcacggatttttttttttttagcttttattttaggctctggggtatacctgcaggtttgctatataggtaaactagtgtcatggggatttggtgtatagattatttcatcacccagatactaagcccagtacccagtagttccttttttttttttttctcccgagatggagtcttgctctgtcacccaggctggagtgcagtggcacaatctcggctcactgcaacctcgacctcccgggttcaagtgattctcctgcctcagcctcctgagtagctgggattacaggcgcctgcaaccacacctggctaatttttgtatttttagtagagacgggtttttgccatgttggccaggctggtcttgaactcctgacctcaagtgatctgcctgccttggccacccaaagtgctggcattacaggtgtaagtcaccgtgcccagcccccatagttactttttttcagatcctcttcctcttcccaccctccaccctcagggaggccccactgtgtgttgttcctgtctttgtgtccatgtgctctcatcatttagctcccacttataagtgagaacatgaggtatttggttttctatacctgcattaattcacttaggataatggcctccagctgtatccatgttcctgcagaagacatgatctcattcttttttaaagctgcatagtattccatggtgtgtatgtaccaactttctgtatccaatctgtcattgatgggcatttaggttgatttcatgtctttgctactgtgaatagtgctgcagtgaacattcacaggcatgtgtctttatatcgtggattttcaaggctggaagggctctgggtcatgcagggcaagtgcagatgacggatggggcagcccagcttccacgttcagattcacacccatgggcaaacgtcagtgattgatcactgagcttgggtcctcaatgcggtgctccagcaagccattactagttgattggaattggcttgctagatgcaacccatttactgccccaagtcctgtacagtcttctcatttgacttacgaggaaactgagccccagaggtgaaagggaacttggcccagaccatccaatgggtcagtgtctgaaaaccaaatccctctttctgagcccagtggcctctccagtgcactgtgcggtgccctatctactgcagaaagaattcccccatcaaggtggggcaagatggctcatgcctataataccagcactttgggaggccaaggggggcagatcacttgaatccaggagttcgagaccagcctgggtgacatggaaaaaccctgtctctacaaaaaataccaaaattagctgggcatggtggtgcatgcctatagtctcagctacttggggaggcggaggcaggaggatcgcttgagcccaggaggcagaagttgcagtgagccgagatcatgctactgcattccagcctgggtgagagtgagacgtgtctcaaaaaaaaaaaaaaaaaaaaaaaaagatttccctatcaaaagacgcatgagaatgacattcttcatgacctagcctgagcaaattttcttttctgtgcccagcaagcggacaaactaccaacagagaagtgaaggactgttccaaggatcttaagtccgagtcccaggcaggatgggatggaagagagagtttggaaaatcacaagtttgattttggattcactccatgtccaggcagacgtgtgaagacagttggatattaaagtctaaagttcaagaggagaccctgggcggaagatataaacttgggagtcattggcctatagatgacttttaaagcaagaggtgggaggagaccacccaggggaagaggcccacggactgagctccgggcagtttgacctcagaggtgagggagacagaagagtcagaaaagaggccaggagggagtagccagtaaagagggaaagaaacaagatggagaggccccaaagccaaaggaacctgtgtttcaaagaggagagaagaatgggcttcagatgctgctgaggtcaagatctataaggacagagaatgagccatcagataagggcattggtgactttgtgtttttgttttttgagacagggtcttactctgtcatgcaggctggaatgcagtggtgtgatcatagctcgctacagcgtcgacctcctgggctcaagtgatcctcccacttcagcctgccaagtagctgggaccacaggtgcacaccacaatacatggctttttttttttttttttccaatagagacggggtctcctatgttgcccagactggtctcaaattcatagcctcaagtgatcctcctgccttggcctcccaaagtgctgagattacaggcgtgagcccacacctgaccacatgggtggctttggctagagctgtttaaattgagtactggggcaaaagcctgaagaaagtgggctcaagatggaaggggaggagaagaattaggacagggagtacagacaacactttgctataaaggtgttacgggctgaatcctgtccctccaaattcctattatggacatcctaacccccaggacctcagaatgggactgtatttgaagacggggtctttaaagaggtgctgaaattaaagtggaactattggagtgggccctaatccaatctgacctgtgtctttataccaagaggaaactggaggcacagagacccaggggacacacactcaagagaaaaggccaggcgaggacacagggagaagacggcacctgggagccgcagagagaggcctcagaaggaaccagcccgcccggcaccttgatccaggacttccagcctccagaaatgccaggcaataaatgtctattgctgcagctgcccagtctgtgggattttgttatgacagccccagcaaattaatacaaagggggtgcagagaaatgcggcaaaggctggaggggaatgtaaaatcaagacaggtttgtcatttgtttgttttaaagtgggtgaaattgcagtagatcagtcgcacttggataggaacggtccccgtagagagggaatacagaatggaagatgcagcagagagagaagacagttgctcgagaagcgtctttgattggagagaggtgggctctggtgcctgtgcagagtgggccttggcaggtggcaggatcatcatctcaggcacagggcagggcgaagtgccaggcgcagaggcaggaggccctaggcaggcggaagggggaagtagggccaccagtgcagtgggaggagggcctccgaggcccattagtctgactgccacaagacataaggttgatctttaaaatatattttaaaattacagctgggcacggtggctcatgcctgtcatcctagcactttgggaggctgaggcgggcggatcccctgaggtcaggggttcgagaccagcctggccaacatggtgaaaccctatctctactaaaaatacaaaattagctgggcatggtggcacacacctgttattccagctactcagcaggctgaggcaggagaattgcctgaacccgcgaggtggaggttgcagcgagttgagatcacactactgcactccagcctgggcaacaagagtgagactctgtgtcaaagaaaatagaactgtatatatataattactaaattatatatataaattatataaatagatattatacaaatataattatacatattatatacaattatatataaatatataattatacatataattacatatataattttttaaaaataatatgtatatatgtacaaattacttaagaaagatacagggctgggcacggtggctcacatctgtaatcccagaactttgggaggctgaggctggaggatagtttgagtctaggagttcgagaccagcctgggcaacatagcaagaccctcatctctacaaaaaataaaaaaattagccggtcatggtgtcacatgcctgtagtcgcagctacttgggaggctgaggtgacaggattgcttgaacccaggaggctgaggctgcagtgagctatgatggcaccattgcactccagcctgggcaacagagcaagacaaaattacagcaaacttccacataaaatgagtgaggagacacggtgacccgtccccggcgcacagacggccttctgcttgtaccggagctgggtcctttccccactaggtcatgctcttcgccagtctaagacctccccgggctcagaacactcggaacagggcccggtaaaaggccgtcctttaagaaggaggagaaacatttttcaaagatcgagaactctcctacgaagagccaagagcctctgcgtgcctcagggactcaaacggggatcacggtgcctgttcactggcaaacagggacccccatgtcagctcgcagaggctctccgcagggtatcaagctgcttcttgaaacgcgtctgagaattgaagtcaggagtcttggaaggcggtgtgaggtatcgttattattctgctgaacgtttcccccggaaccaacgatacctgaatccctttaaaaataggccatttcttcttagaagatttccacgaatcacataatccttacgcagaggcaggcaacgaagcactaatgtcaataacgttacagttttacttcacagcagcatttatccactgacatagcaatttactaaaccgcagaaaacgccggcacagggcctctgcttgcccttggatttttttttttttttttttttttttttgagatggagtctcactctgtcacccaggctggagtgcagcggcgcgatctcggctcactgcagcctccgcctcccgggttcacgccactctcctgcctcagcctcccgagtagctgggactacaggtgcccaccaccacgcctggctaatttttttgtatttttagtagagagagggtttcaccgtgttagccaggatggtctcgatctcctgacctcttgatccgcctgcctcggcctcccaaagtggtgggattacaggcgtgagccaccgcgcccagccctccttggattttttaaatttcagagacaaggtctccttctgtcgcccaggctggagtgcagtggtgcaatcacagctcactgcagcctctacctcctgagctcaagtgatcctcccacctcagcctcctgaggagctaggcccacaggcatgaccactacaccagctaacttttacattttttgtagagatggggtcttactatgttgcccaggctggtctcaaacaactaggctcaagccatcctcctgcctcagcctcccaaagtgctgggatgatagacatgagccactgtgcccaggctgcttccagatttttttttttaaagggccatcaccaccaagacacgtataagaatgttcacagtggtttcatcataacagccccaaactgcaagcaacagaaacatttatcaacggtcaggtggataagtaaattgtggtaatttttttttttttttttttgagacaggtctcactctgtcacccaggctggagtgcagtggtgcgatcttggctcactgcaacctctgctttcttgggctcaagcaattctccagcctcagcctcccgagtagctgggattataggcgcaagccaccaatgcttggctaatttttgaatttttgtagagacggttacatcctgttgcccaggctggtcttgaactcctgagctcaaagcaatctgcctgccttggcctcccaaagtgctgggattacaggcatgagacacagcgcctgcccctattgcggtaaatttatgccatgaaatactgtgtagcaatgaaaaagaaacattgaatgtgactccgtccacgtcaagttcaaggacagggatggtgatagaggttggaagggtcctcccttaggggacaggggaggggtaacgactgggaggggatatggcacttccccagaacctagaaaggacccaaatcttgatctgggtgattggctccagaagggcatgtgaaggcccgtcaagctgtttgtacgcttaagactgtactgtgtgtgtgttataccttaatttttaaaaattattattattattattactgatgggcaatcagttttacctttcttttttattttatttttagagatggggtcttgttctactgcccaggctggagtacagtagtgcaatcctagctcactgcagcctcaaactcctgggctcaagtgatcctcccatctcagcctctggaggagctgggactactacaggtgtgtgtcaccatgcctggctaattttttaaagtttttttgtagaggtgggatctcactatgttgcccaggctggtctcgaactcctaggctgaagtgatccttccacctgggcttcccaaagtgttgggatcacaggtgagaggtgccacgcctggcctatcaaactttttgatgtttgccagtctgacaggtggaaaacgctatgtccctgttgtattacttcacatggatttaattacaaacgaagcatgctgactgacctgctcatattccgtgtgtttgtaccctttcaccattttttccattggttgaattctctaattttggggtctggacactcccactgagggtccagtcctgtgccatccactgtgccgaaggtggccatactcactcccaactgcagccgcctccaccccgcaaggacagagttgctagcttcgacagagaccctctggctcacaaggcctaaaatatttactatttggagctttcgagaaaaagtgtgccagttcccatgtctcattggtttacaagagttcttagtaaattaaggaaatagctctttgccacatatactctgttttgcatttagctcatctctctctgttctccctcctggcctctgaataagcaagtcagaagtaaaacttaaaagcagaagcctgcagaaccccttgacacatttggtgcgtttggaaacactttggtctatgctaatctaggggtggtatcattattattattaatttgtgatagagtcttgctctgttggccaggctggagtacagtggcacaatcgtggctcactgcaacctctacttcccgggttcaagtgattctcccgcctcagcttcccgagtagctgggattacaggtgctcacccccatgcctggctaatttttgtacttttagtagagacggggttttgccatatctcaaactcctgacctcagatgatctgcccgcctcggcctcccaaagtgctgggattacaggtgtgacccactgtgcccagctaggggtggtaattttatacccattttacacgtgcagcaattgaggctcaaaatcatcatgtgactttgttggggtcaccgagattgcaggcagtggagccggaatgggcaccttgtctgtcaggctctaagtctgtagatctctccagaaagcaggtttgcctttttttttttttttttttgagacaggttcttactctgctgcccatgctggagtgcagtggtgcaatcacggctccctgcagcctcaacttcctgggctctagcaatcctcccacctcagcctcctgagtagctggaaccacaggcgcatacctccatacctgcctcatttttaaattttttgtagagatggggtctcgctatgttgcccaggctggtctcgaactcctgagttcaagcaatcctccgctttggcctcccaaagtgctggagtgctgggattataggcatgagccctcgtgcctggctttttatttttttttaatcttgcctcttaaggaatgaggccagtcccaggggacggcagaaatcataaccagcattgtcctggcaggtgttgcctttgataccaccatgaccgaggacatggcatggggcagcccccattctgctgctgtgatacttgggtataaagacagcaaattcctcagttgcagaggggcaggaaggaagatgacatgctagacacagaaaccacacaaaggaggatggagccctgtttgtgagcatggatactacacatgcccctctctggctctcacacttgcaagaataatgcccactaaggaatggccccggctgggccaggaggaacccagcactttggaggaatgactgtgcttggagtagcaggacaggggaagaagaagtgacagccacacagatgggactggaaggacttttatcaccctctggctctcggccaccaacacctattacagaaatgtgacagcaaccattataatctctgagcccttgaacaaatcacaacccaaaaggttaccctcccgaaaataatcaccccattaaaaccactgacccagagagcggcagtccctcaaggagagaacgcagacaaggcatggggcgtgttctttgtatggagcgtgcagtgccctggccgtgattttcttatgtggcctgccacaggaagaggctggcatctggaatctgtgccttctaatttttattcttttctttttttttttttttttgagtcggagtctcgctctgttgcccaggctggagtgcagtggcacgatctcggctcgctgcaaactccgcctccgtggttcaagcaatacccctgcctcagcctcccgaatagctaggattacaggcgcccgccaccaccctggcataattttttttgtatttttagtagagacagagtttcaccatgttggccaggctggtctcgaactcctgaacacaggcaatctgcccacctcggcctcccaaagtgctgggattacaggcgtgagccaccacgcccagctgccttctaatttttctttggcagaagagcatgtttaaggggctccctcgaaggttctcttttccttctctttttgtttctgtatttcaatcaatcgatcaaaatatttcctttctttttttcgtttttttttgtttgagacagggtctcgctctgtcgcccaagttggagcgcagtggtgtgatctcggctcactgcaacttctgcatcccagacccaaatgatcctcctgcctcagcttcccaagtaaggagagacccctatgcctggctaattttttagtattttttttgtagagacatggtctcatcacgttgcccaggctggctggtctggaactcctggactcaagcgatcctcctccttggcctcccgaagtgctgggattacagccatgagccaccgtgcccagccaatcaagctattttctagactgattgggtactgccaccaccaagagtgagggtttttctacagggtagattgacggagcatcagctcggtctgtgatttccttgggcctcataattcccccgtaagattgagattgcagataaggaatctgaggttgcaccagaaaaaagtaacgaggtccatccagctggtgtttgcggggataccggcactgcagccctgggtctggactccagggtccaacctctgatctgctccagaccttagtcatcacggcaaaggtagtcctagctcatatgccgcattttctcattttatgcttggtgtaactgacaatactgaaaataaccagtattgatatcctgatttcattagagaaatgactctcagagagcttaggtgacgggaagcctgtctaaggtcacacggctagcacagatcagtagtcatgcctcaaacccatgccttcatgggctccaacccaaaagacggaatgctgctggaggcgctgcctgcaaagcagatagtgcagggcctggccaagagggaatggaaagtgtttttttgttttttttgttttttttttttttttccttttttggagacagagtctcactctgttgcccaggctagagtgcagtggggcaatctcagctcactgcaacctctgcctcctaggttcatgcgattctcctgcctcagcatcccgagtagctggaattacaggcgcctgcccaatttttgtatttttagtagagatggggtttcaccatggtgcccaggctggtctcagactcctgacctcaagcgatccgcctgcctccgcctcccaaagtgctgggattacaggtgtgagccaccgtgcctaaaggcggtttttaaaatggattcgaagaggctccatttttcagcatttgacacgccttttcatcatcatcatctgaaaatcgggaccctatttggcctttcatgcccgacatgctatgaggagctacaatcacaagtgcgtcttcaactccacggcctctgccagccaccaccaagccacagtcacacagcccctcagtcccaggaagcaagccttttatcggaagggtccagaatcactgcataggataaagaagtccagacactgcccctctttttttttttttttttttttttgatacagggccttgctctgtagcccaagctggactgcagtggcgccatcttagctcacggcaacttccgcatcccaggctcaaatgatcctcctgcctcagcctcccaagtagctgggactacagctgcacaccaccatgtctggctaattttttggtattttttgtagagacaaggtcccgccatgttgcccaggctggtctcgaacccctggactcctagaacctgggcgccctcttgtgaccctgccaaccccttcctagtacagtgtccacaggtggctgtcctgtcccatctcccagctccacacccccttttggtggggatgcccttcctccctgagattttcagcaccatctcggcctggaaccttccaggaatccctggaccttctgagtcctaccatcacccaagctcactccctgctgcccttcccactcctcctaattctttaccatctcatgtgtgtctcagccacactctgaccacggtatacacagactgtgtgatgaacctactcagggtggagcgctgcttctcacatccctcctgagccccctgcggcaccaagtacaaagccactcacacacgcccactgatggatttaaacaagcgtgtcatctttagaagagcttggtttagaagtcttttttttgagacagagtcacgctctgtcacccaggctggagtgcagtggtacgatctcagctcactgcaacctccgcctccccagttcaaacggattctcctgcctcagcctcctaagtagctgggactacaggtgtgcgccaccacgccgggctaattttttgtgggtatttttagtagagatagtgtttctccactttagctaggctggtctggaactcctgtcctcgggtgatctgcccgccttggcctcccaaagtgctgggattacaggcatgagccaccgcgcccgtccagaagtcattttttaaaatcacataaaggatgagcggatacacaaaatatggtctatctgcacaatagaatattattcatcctgaaaagggaaggagattcagtcacagactacaacacagatgaaccgtgaggacgtgaggctcagagaaataagccaggcacaggaaggacataggttgtatgagcccccttatatggggtcccgaaagtcatcagattcctagagacagaacggggaagggtggctgccaggggctacggagggggccaggaagctgctgtttaacgggggacacagtttcagtttgggaagagctggatggtggtgatggccgcaagataacatggacgggcttaacagcactcaactctgcgcttcaaagtggttcagcgagctcattttatgtcacatgtatttcaccacgatttttaaaaaaatcacatcaaggaccattcatgcattaacagaagactgctggggccagtggagccacggcctgcctatctgatacccaggcaagtaacatccacacgggtccaagcattccctggccttgaattacgctgagtcctggtcactgttgcgctcctcagggcagccctggcctgaggcaggggtgtcatctctttacagatgccttgctggggagagaaccggagtttccgcgaaagcgcagaagtggacacttacggagaaattcctgtcctcatatcaattcccggctcccgggatttccggcacgcattatgcacaggctgagcgctcaataaatgtggaatgaacgatcgactatttttctcccctttctggtaggttggtaaccttataccttcaagacgagtcataaatattaggagaaaatgttttgaactacaaatcaaaggctttgagagcaggccaggcagagagaggtcagtttggtccaagaccaagtttgtgtgggcagccccgaagctcacagctgagaccactgtccatgaacctgggtccccgtgacagcctccagcggtgctcagagcccccgagggacagaaacaccctctctgcccctatctgcagagggggctcagcagaaggcctggtggccccatcgggcctggaggggcctcctgggggaggtggctttcaggcctgaggccgctaggacctgctccgggtttcagtcgggaacctgggccctctcctgtgcccccgccaccccctttctagtacagtccccgcggggggctgtcctctcccatctcccagctccacacccacttttggtgcggctgcccttcctccctgagccaggccccaccttcccaggagcctctgagtcaggctgggctgtggtctgcaaacttccgggcctttcaggtgtcagaaaagtttctcttcctccctctggggcaggtgcaccaaggggctgcagcctcctgacccccgattttttcctgtccagtaggaggaggtgggggctttgctgggcggtgatactcagagacgctcaaagagacacggaggagaggcacacgaggtggaaagtgagggagaaaaagggttggaagggaaaaaggggagaggagagtgagagagagaaggggggcagggggacagagatggagagggaaggatacccccagcatcgcgggaccagcgggagccactcccatcccccgacgccccccccgccaccgtgtcatctcactgatgccccccatctcctccccgtgccctcttctcttcccccaactccccgcctcgtgctccccctccgccagctcccccatccccgctgcgcctacctggggcgctcatgctccgccagccagctgcgcggggcgcctcctccacgcaggcctccggcttcctccaggcgaccaggccctccgtccccccgggcccggagccgtcctccgaggggcgccgcccgcccaggggctgcagggccgggagggggctgcgggcggcgcgggcaggagtccgaaggccagaggaggcaggagagaaaaaa

SEQ ID NO: 1563 - DNA, 9726 bp, Homo sapiens
  source 1..9726: mol_type = genomic DNA
tgcgggtcacccgtgctgtttatttacgcagctgtgttttctaacactaatacaatgcatgcatgtattgtgtgttacatggtgaaacagaacagatcctgaagttacacagatggcgtgtgcatgggggtggtgagcacccgcatggcctccgcaaaatgagtgccgcttaacaaacggccccaatgcccggcagtccggctgggcctttcagggcaccagattcctcgttccaggccaagtcagcgacggctcggggaagtctgcgccccagggcgtcggcacccccgggtggcaggaggccgggccggtgggtgtgccctggtcggggcctgcgctgctgcggctaggagccctcagtgtcggtgttgtcgctgcccgtggtgttctcccggtcctcctccccctgccgccatcctttctgcatcttcctgagggcgcgcttcctgtgaagacaggtgtctcaggcgcgacccggctgccgctccccagcccgttttggagaagcctgggggccgcccgcctacctgcggtagttctcaaaactctctttgaggcgccgccgctccttctcgggcggctccccgctgctcaggcctgcgtcctggagaagggggaaggctcgggctccggccggctcccctgagggaacccgtccttctcacccgccccccactggcccctgtaactgcagactggttgggaggcgaggagcccagacagcctcagctcagcgccaagctctccctgtgggacctgcctgtacccctggaggtgagccggtgtgggtagcctgcatttcagatgccaagacacacccaggaggccaagccacggctccagcctggggtccgggccattgtttctacaacaaagcccgaggtggtgcttgctctcaggactcctgtgttcacctcctcatccactgtaaaggccctcggaaaaccaggaccaggcacatccacgtccaaaaagccccccaagctgctgcagtgcccaagaaagggggatccacttcgcagcccagacaccgcaccccgagcactgtgggcagagaccttgtggtcactcctcagctgtcgtcggggccaccgcagggggtgcccagggcagggagccactctccctgtgatcggtcaccctgaggcccacggctgggaggaccccaccccggggaagccttacatgggggttccgcaaaacctgctcctggtgcagagctgcaaagggctgtttcgggctccccccgccggcaaggcagcctggaaaggagagtcgtgcctgtgggacctgcccatctgctgggccacgtatagcacggctgccccacccctccccggcattgcagtggggctgtcttccaaggcctggtgggatccccacatgggtccagtgtagactctgctttctgtagatgagactgaggccttatggcctcgcttgcctgttcattgctccaggaggccgccagatgccagcccaggcccaacgctcccgccagtgaccatccctcccccgagctggctgcctgccagggaggaacgcctcccagacctcgggggaacttaaaccctgggcctgagcagcaccgtcccccatcactccaaagcatctgtgggcatggcggccctggggagagagttggggacagctacagtggctgtctgggtcctcctgaagtgggggcaggggtactgcagcaattgggagagaaccttcaggcggctggaccccctcagaaaccgccaggacctgggcagaccagggatcaggacccttgggcagaaaccacgcacgtccagtctcagccccactgcggtgagggccaggccagggctgtcctggccattggcagccccttagagccagcccctcccctgctcaccctccaaccttcacacctgcccctgctcctgccacagccacccagggggatgggggcagtgcctgagccggactcctgggtcctgctcgcctctgtgcctacatgggggcttggcatccccatgttcaagtgttctgagctgcagccaaaggcgctggtcttcacttccccgtctgcggctcctccttccccttccgcctctgcttggaggccacggcctggtactcaggaagcttgtccaactccggtgcagcctcccaggacccctctgctgggccctccccaacccctacctgacagcaccttcagtgcaaacacctacctcatcaccactgcccactcctggacactcgggagctgctcccagctagccacccagtccttcccccagacaggcagagggggcctgccctgcccgctagaagcccctgccactgccttacccccactgcaccgggacacagcaggcccttggccacccctgcattcagccctttccctcaagccacgtggggccccatctcgccccatcttctagcttcatgcacctggtcgttcgctcgttaccacctccctctgtccaggaggaagcttggagcagccaggactgggcctgctcacctctgcaccccgtgggggctgcccagaggggccccacactctcaggacggtgggcctgctcacctctgcagcccatgggggctgcccagacccccacactctccaccccaggggacacttgtcccactagctggggccctgggttccagctgggctctgtagtttgttctctaggtgaccttgaccattttacttatccccagccccagtttccctgtctgtggagtgggggttgtgggggttgacacaggcattgcggcacgggctgcctgtgctgaagatgggcctcacttggggaagctgggaggcctctgggtgtactgctgtccccacctcacctttgtctgagagctgggtgtcctccaggtcctgggggagtgagagcttccaaagagagtcaagatgtcccattaggccacttcgccaaggactggacccggccacactgcccaccccagcccttggccctcagctgggtgcagccattgccgtcaccccctgcacagagcttctcagagactcaggtgcccagcagacggacattgggcggccaggaggtgggcactgtccgtgccttaccttaccccttgagccatcagaggccttagcatttggccacctgctcttcctccacccagcccagcccaccgagcagggccatgtgacgggcagtgtggggctatgcctggtggcagctcagccaggaccccaggtgaaggaaggccagcctcgtgctggctggggtctcactcacctcctgggacctcctgggtgagccatcttccaggtcggagctctgtggtcatagaaaatggggtgggtgggctgtgagggcagagggctccccaggcacagggtgggcagggcacagagcgggatcctccagggagccctgggcatgccctcagccacaccaggccccctccatgcccagaacaacctgctaggctgcctgatggccaggcccaggacccaccccggccctgcagccccacttcctgctgggaccctgaactgctcgtgtgccctcaccccactgccaggaggggtttggttaggttggggcccgtcacagagaagggttgggtcgggaaggccggggctgaggctccgtgctcccctggccctgcatcccacgcgccggctcccctccctgccgcaggccccaggcccaccaggacgagcgtctccagctgctgccgcctgagcctgccctccacggccagtagctgcgcctcacactggaacacctgcagctgcagctcatccgccttctcgcccagctcccgcacctgcttgcgcagcgcgtccttctcctgcaggccccgggcgtgctgtgcgtgcagctcctcccgcgtggctatggcctgacgggacagcacaaggccgaccctcagtgagggccccaagcttgccctgggccctcggcccggccgcccaactccaagcagaggctccggaggacgtcaagccgctgggcgcggaggctggtcacagcccctccatttgtgtgctctgcggacacgaagtcagcacgtgggggattgtaaatgtgacagttgtccctgctgcccttctgtctcctcccaagcctgcacccccggtggacacagcgtgtgctatgtacccccacacgtgcacatttgataaattttggacgcggcttgatatggagaccctgactgtccatagctaagcgtccttcgtgaccgcagcactctttaccacccctgtcctcactgcggacactgagacgcaggagcgaatgtgcaaacacgacggcttgaccacccctgcagccgaggctgggaggccctcacctaaccccttctgcccagactggagcaacggctggcagcttccctaatccctggccaacgcgctcccgggaagtcccgtgggagcccccgccctgggagccacaccaacccccatgggggcacagctggatctgcccttttcccctgccttggcgtgggccaggcgcgagtgaggctgaggtggggctgagacaggagctctgagcctgggctgctctcatgggggccggggcttcctttgtagccccaggggtctcgttttaaggctcctgatgtggacaaagtgccatccagcatttagccgaagcagcaatggtgtccattggaaacaacctccaggatgggacttgggacggggcatgggaagcagacacagccctgccccgcgacgctccatccggctcacagcacgtagcactggaggccttgcaggcctcactcccgtggcccaggctggagtgcaatagcgcaatggtgacttgctgcagcctcagcctcctaaatagctgggaccacaggcatgcgccaccacgaccagttaattttttttttttttgagacggagtctcgctctgtcacccaggctggagtacagtagcgtgatctcagctcactgcaacctctgcctcctgggttcaagcaattctcctgcctcagcctcctgagtagctgggattacaggcgcccggaaccacaccaggctaatttttgtgtttttagtagagacggggtttccccatactggccaggctggtctcgaactcctgacctcaagtgagccgcctgcctcgccctcctagagtgctgggattataggcgtgagccaccgcgccaggccaatttttgcatttttttgtagagcagggatctcaccgtgttgcccaggctgctctggaactcctgggctcaagtgatccgcccgcctcagcctcccaaagtgctgggatgacaggcgagagacaccacgtccagccaagctttttttaagattaaaaaaagctactggtaaaacaagacagaatgtttccatttttgtaaaacaaaaccaaatatataaatagatagataggtgatagatgatagacagatggatacatggatagatgacaggtaagtctgtaaggtggagcgggaaggttgaacacggttttccctgacagtaggctggggtggggaagtattgacttcatcatcgtttacttttttttagtgttaagtattgcttctgtcatttaaaaaacagaccaggtgtggcagctcagcttgcaatcccagcactttgggaggctgaggccggaggattgcttgaggccagtagtttgaggccaccctgggtgacatagcaagaccccatctcaaaaacaaataacaaagattaaaaatcctctgacaactgccctcaagggccgtggccctggtgcacccacccgcgagtggggtgctttgtcctgcccctgcgagtgcccacctggtcccgctcaatggcgacctcctccatctgcagcaggatggcctcgatgcggtccttgtacatcttggagtccttacgtagtgccaggcactgcagctcgaacatctccttctcctccatgcactgcagggggcggcagctcagcccccacaggcctgaggccccccattctggcccttggggtatactccgggcaggggctcagaagcatgtggtcaggccagttgggatgtcgggggaggccataggagtccccaggcccctaccagccctgcacttccagaccgcggcaggacagggccctccggcaggcctcagacactgctgtgcctcaggcaccatgagcccagaggttggcctttgccatggggggcaggcgggcaaggagagggcaccgtccactgtgcctccaggagtgggtgagtggaggcgctgcactggggtctccacaccccaccttccaggcacggagtgggcggagctcagcccgtccagcctggcttggaccccaggggccatgtctccccgcctgccctcctacccggaggcgtcgggcctcgccctggcggaggtccttgcgcagggagaagatggtgttggcctgctcctggtggtcccgcagcgcctgccgccagtcctcctccagtacctggatgtaggggctgctcctgtccagcttcccctcctgaagggggcaaaaggcaatggcctggctgggaaggcccccactgccctgcctgggctgcacctgccctgcctacggccccacctggacggaggcctccagctcctgcacccgggcctggagcagggccttctcctgctgcagctcccacagcagctcctggctgggccgctgctccatggcgtgcctgagcttcagcgtgtgcttgcgctccaccttgcagtcgtcctcggccttcatgaggctgtgcttgagctggtcaatctgcagaaggtccagtgagcctggctgtcccctccaggcggtgaccgcagacccgtggggccacccccgaccgccccggcctgcagaccccgccaggccaggcgagggtggcctggtttcccgggggcagcgggcgcacctccagctgcaggtcacggttccgcatgagcgcggcgcccttctcctcactctggtgcgccaggcgcatggccaggtcgtagttctcctccttgcagcgcttgagctcgcggctgccggcctcgcactcctccttgagcctctgcacacgctcctggtgcttgcgcagcaggctgtccttcacccgcagctccttgatgaagtcatctttggagctcagcagcgcggtcaggtcctgcaccttcttctgcagcttcatgacctcagtcatcagcagctgagtcaggcctgactccccggacgcgtctgtgggccaggccagtgtcagatggtgccgtgttccccggtggcccagctccatcacgccctgcgctgtggcaggagctcagggctcctagggatgggggccaggcagaggacccaacaccactgcccgctccccgccagcgcctcccctgtcggccccgcctcccccgtcactcaccgatgatcatggagaagacgcgggccggctccttgcctgtgaccttcttgtacagctgcgggtagtagagctccaggctctcgaggaaggccacgtagcccttgtggccggtccgctgcaggatgtccaggagcacacctgcgggccagagaggcctaactgggggcggggcacaggcgaggcagagggctggggtgggtgggcctgggggcagggacaggtggaggctggcatgcagatgaggtgtgccgtggtctgggtcttggatgaggtaccctgcgggtcttggtactaggctggggaccaagtgctgcccacccgccccttggctgtctcaggagcccccgctgcggtgggagccccgctgcccctcttggcagcaccaagccggcaggagaggctgggggacgggccacgtgccagggttgaggttgggcctcagtcagaggccaggggcaaagccaggcggggctctcctggggttgagggtcagggtggcagagcgtgcagccacctccgagctgactctgtggttgggtttggggcctggggcccgcggggcaacactgacccactttccgtttgcggatgaccaggttggggtcgctgagcacctgctcctcatcatcggggttcaggaccttgcactgccgcaggtaaggtgtgatgcgtgaggggtcgatgaccgaggtgagcgtcacccggaagccctccaggacgctccagcactcgtcatcgttctcgtagtccgacatggcctcagcaggcaggctggggagtgtggggcagtgctgagagcgatgccggctcctgcccccacccgggcccagctcccactccttctcagacgctgggccagggctctcgtcagggcatcgagggggatcagcccaggggcatccaggagaggtgcccagctccatgtcccatccccacgctggatcccccagggaggcagcagagacacagtgaccccgctccccaccagaccagccgagggcccctccgcagcctttcccagcccttgctcctgcccgttggcatccatgtcacccagatacgcagcgggggaggcacagatggggtctgagagaggaactccccctacagcatgaccccctctggcctctgcctcctggacactcccatcacgccctggagcctgcaaggttagccacctccatggctggaatgggcagaggagctgagggcaactgcctggcactatggccagcccaagctgggtgagagcaggttggccagtggccctcccaccagcacagcagctgggggagccggttcttgtgggacttcctcattcccctgaccgacgcctgctcacatccctggctgtgccctccctcctccacggccggctgctgatgatgcaagagtggccacccagccctgctgcagctgcggggtcgctgcactggccgggaagagctgcccacaggagcgtgtctctgtcaccccctgccggccccgcaaccctgggaggggctgtcagtgttgcccttggctggccaggagtgctgctgcggtgttttctccaggttgaggtgccgggcaccagtgaatccctggactcttctcctgccccagatgaggcccggcccccatcccagtggctgcaacagaactacccatgttgggaccagccactgctgtccctttctgccagcatggtgggggcctcagccgctgaaagccactccctctgagactgggactgcggcaaggctgggagcagccacgtggtcctcagacagcctccagccccgctgggaaacgctggtttccagcccagaggagctgggtcactgctcctggagacatagttgccccaggcttggtcttttgaggcatttctcaacttcccgctgcactttgtcaccccattcaggacagttttgacagacaagggactgaataaaaacactggccacacggtagacagtcctgggaacactgggcccctttcctgcttccccagcttgaaatgcagggtcccatctgccaccgtaattccactgaaatgaacacatctccgcccaggggccgtgaaagggacggggccgcatggcggaggctgcctggctgcctgtgggaagcctcaggctgctctgggggatcagtgccaggatcctgaactaggccaacgccaaccttcctggccacctttcagaaagcaccagacccacccacctgagggtcttccaggagccacctgcactgcagacacaccaggagcctgggccgcggagcctctgggagatgctgcccggggctgcagggagggaggagcacgccggacgcctgtgcacttcctgatgggttctgcttaactccacagtc

SEQ ID NO: 1564 - DNA, 9726 bp, Homo sapiens; identical to SEQ ID NO: 1563
  source 1..9726: mol_type = genomic DNA

SEQ ID NO: 1565 - DNA, 54269 bp, Homo sapiens
  source 1..54269: mol_type = genomic DNA
gtgctctgagtttttggtttctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgtgagattaagcactatgtatattgctttattcactccccacagcaaccttaccaagcagttcttttccacgtgaaaagatggaggctgggtggagcaaaaggaggtatttagagtcctcagcaagtgagaggcagagctgggatttgaatccagatctgcctgatactgaagtctaggctggttccacctctccggactgctttccagggagtagaagacagatattttaccttagctggctgcttctagaagtctgaccctgctggctcaaaacgactttagttccttgcccagaggctgcgggctgcgggtcaagacatcagtagaaggagggcccagccagagaggctgacatgggcttctactcaccgtcatctctccttccttccaggagcagcccctgggtgcgtccactttctgggcacgtgaggttgggccttggccgcctgagcccttgagttggtcacttgaaccttgggaatattgaggtaagcctgggatttccagaggaggtttgggggaaagagaagtggtgaacgctattactgttccctatctagacaccagtgggccgagtggagcagatgccagttgggaccttcccgccctctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatctccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaaagcaatatacttaggcttttatttcttggttaagttcctacttattatgaatttactctgcatgccaggaattctaagaatttgcatgtattaactcatttgattctcgtaataaccttcacatgcaggagtcactattacagtgactgtatgaatgaggaaagaaaggcactaacagaattgattttatgttacttaggtcaagattttatgttatttaggtcaaggttaattgtgttgttcaaatcttgtataactctactgcttgtctgtctttcttacccattatcgagaagggaacataaaaatcttacactatgactgtagattgtcaatttctcattttaaattaggatcatttttcctttatgtctgccttatgtgatattagtataatgatatcagttggtacatctttttccatccttatactttcagtgtttcggtgttcttatacttgaaatgtgtctgccgtaagtggtgtattgttcaagtttttcttttattatagaaaaatgtattctggaaggtacttttcttaaaattacagtatttagtccattttcatttaatgtaattgtcaatataattgggctaaaatctactatatttccagttgttttttattcgtggcatcaattcacttttctctactttcttgatttcttttagacgaattaagtaattttagaaagttcaccttactcctttattagcttgttaattatgcatgcttttagtattctcttagtaattgcacttgagttgtactacctaatagtacagccacatgttgtttaaaacagctttactgagatatgattgatatacaacaaatggcatataaagtatataatttgataagttttgacatatgtatgacatatatgacagtcatatagacacactcatatatatattcatgtgccatttcagtcaatgaccgaccacatatatgatggtggtctcataagattataatacggtatttttactgtaccatttctatgtttagatatatttagatatgcaaatacttaccattgtgttacaattgcctacaatattcaatacagtaacatgctttgtaggtctgcatcttaggagtaatagtctagaccatatagcctaggtgtgtagtaggctataccatctaggttttgcataagtacattctatgatgttggcataatgacgaaatcactgacgatgcttttcttggaacttatgcctgtcattaagtgacgtatgactgtatatatttgagtggaactatcactgcagtcaggatagtgaacatatatattacctccaaaatatttcgtatgccctcttgaatcctgtcctcctgcccctccccacccctgctccttttaggcatttagttctgtaaattttctcctagccttgctttagcggcatcccatgcattttgatattttgttttgattttaatttaattcaatactacataatttccttttgatttcttttttgacccatggattatttagagttgtgttatttcatttccaaatatttggggattttccagacatgtttctgttgtccaggccaataacaaattcctgacgccatgaagtcaaagatctaactccccagggggagagttatgcccaagaaccatcggtattttgtgttagtggtcattgccagagtgaattccacagtgtttgtgataaaccctaataattccaccagagggcagcaagccaacatgaaaattctattaaaaagtctttttttagagacaagagtttggctctgccgcccaggctggagtgcagtggtgtgacctcggcttaccgaaccctggccccaccgcagactcaacctcccaggctcaagtgattctcccacttcagctccccatctgcgagtagctggaatataggtgcgcaccaccgcacctagttaatttttgcattttttgtagagatggagtttcatcatgtttcccaggcttgtcttgaactcctgggctcaagctatccatctgcctcggctgcccaaagtgccgagatgacaggcgtgggccactgtgcctggccagacagaagttttcaagtaaagaataaatttagctgaagagcagtgtcaaattatttctatccccaccctcctgaattaaatcttcgtagtctctgattctctttgtcatattcttaaccatttggattcttttcagtgcgtctgtgtttgttccttttccccagtatgacccctttctatttttttttttttttttttttttgagacagagtcttgctgtgtcgcccaggctggagtgcagtggcacgttcttggctcactgcaacctccgcctcccaggttcaaaagattctcccacctcagcctcctgagtagctgggattacagatgcctgccaccttgcccagataatttttgtatttttagtagagatggggtttcaacatgttagccaggctggtctcaaacttttgacctcaagtgatctgcccgcctcggcttcccaaagtgctgggattacaggcgtgagccaccttgtccagacccttttctctatctttatgaaaacatctctccagtagatcttcagagtaaaaaaaaaaaaaaaaaaaggaaaaaagaaaagaaaaaagaaaaagaaaagaaaacatccagcaaggtctcggaggaaaaatagaaaattagaagactggagtgagtcatgttgattttctggtgtaaaatttgtatcgaaaccttacataaatactgaagaattcacaagttgtaaatatacagcttggtgactgattttgatatccagacagtttttttcccacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacaacctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgtggagcaagtggggaacttgctctgtttgagagaatatgcctggaatatatgggatatcatttaaattttctaaaggttatctacaagataatttcagagaatattcgctcccacctcagcgtaggaaacaatgaaaccctgaaacatttatttatttattttccttgcttttcttttttctttcttttttttttcttgagatggagtcttactctgtcactcaggctggagtgcagtggcgtaatcttggctcactgcaacctccgcctcctgggttcaagcaattctcctgcctcagcctcccgagtagctgggacaataggcatgtgccgctatgcctggctaattttttgtatttttagtagagacggggtttcatcatgttggccagactggtcttgaactcctggcctcaagtaatctgcccgctttgggcttcaaaagtgctaggattacaggtgtgagccactgcacccagtcttttccttactttttattttatttatttatttatttattttttaattgatcattcttgggtgtttctcacagaggaggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtatagaacaaaatgaaaagtctcccatgtctacctctctctacacagacacggcaaccatccaatttctcaatcttttccccacctttcccccctttctgttccacaaaaccgccattgtcatcatggcccgttctcaatgagctgctgggtacacctcccagacggggtggtggccgggcagaggggctcctcacctcccagtaggggcggccgggcagaggcgcccctcatctcccagacggggcggctggccgggcggggggctgaccccccacctccctcccggacggggcggcttccttactttttaaaaatacgtttgtcttcaactattggatatcttcatctaatttctagtgttttttttggttgttgttggcttatttgatttttactttttggttaataacaaaccttttaaggagttacatagactcttatcagtttacttttctaatttgttttctcctgaattctcagttaccttggattgattgtgctttgggttcatcttgctttttcttagtggctactttcagtttccttcctcttcagtttggcaattttttcccttttcaagcaaggagctcctccctgttgaggcgtcacgggtggcgggcaatccttacccggatcctcccacagcttgctctctggaagctcacactgcaccgtaattatgaaacttttgatattgtccctgatggcttctgatgcaagctgggacagcatttgtctgttgataagtgaaaccaagttcctgagatctggctctcttttgcccttctatccaataccagcaaggccctagtttcagagcattttggggacttatgatcccttctagttacctctgcatctgtgccccttttcccctcaaattagttcatagagatttttgaagcacccatgttactcaaataggcccatttttagcatgtgggaggtaaggcctagatgtgaatccctcataagccaggcagatcaaactgtgtgtatgcatgcagatttggcccaggaacactcttctccttcagggcccattgtctacaaggacagaaaagaattcttaaggccattcactatctcacattttctgttatttttctgtcttttccttttccccctacccacagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactggataatctagaagaaatgaataaattcacaaaaccttccaatctacgatgactgaatcatgaagaaatacaaagtctgaacagacttataactaatgtggaggtttagtcaataatcaaaaatgttccccaaacgaagaagtccaggaccagatggcttcacaggtgaattcttccaaacatctcaagaagaattaatgccagttcttcttaaactatttttaaaaattgaagaagagggcacacttccaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaactggaaatagagtctcaacatcatcaagaccatatataagaaaattttcactgttgagtattatattagatgtgagcttttcatatatgggattcataatatgtttcaaatatattacaaagctatagtaattgaaacagcatgggaatagcataaagacaaacacataggccatcagaagagaagagagagctcagaaataaatccatgcatatacagtgccttagtccattcagcctgctaaaacaaaataccatagactggtggcttataaaacacagaaatttatttttcacagttctggaggctaggaaattcaagatcaagtagctagcagatttgctatctagtgagggcctgcttcttggttcataaatggccatcttctccatgtgtcctcatggaattagggtgatggagcgctctgggatttcttttataaggcactagtcccattcataagtgctctaccttcatgacctaatcacctcccaaaggtcccatctccaaataccaacacataggggattaggtttcaacatatgaattttaggggaaacaaacatcagtctattgcatatactacctaaagcaatctacaaatttggtgtgatctctattaacatcccaatggattttttttttacagaaaaaaacctctgaagtataaaaaggaccacaaatagctaaatcagttttgaggaagaacaaagctagaagcaccatacttcctgatttctaaatatattatactcccatggtcatagcagcactatttacagtagccaagatgtgcaaacaacctaaatatctaggatggggaaagaaaatgtggtagtcacataaaatggaatattatttgccttataaaggagggaaattctataatataagacaacatggatgaatcttgaagacattatgctaagtgaaataagccagtcaccaaaagacaaatactgtatgattctacttacatgtggtatctaaagtagtcaaatttatagaatcaaagagtggaatggtggttgccaggggctggggaggggggaaatgagttgcctgtcaacaagcataaagttttagttaagcaagatgagtaagttctagagatctgctgtacaacattgtacctatagtcaacaatactgtattgtacacttaaacatttgctaagagggtagatctcacttaaatgttcttactacaataaaatataattgataaagcaatagaaaaggattcctatacataggattcctatacataaaaaggtcaatacctaatttccatttaattaaaagcaatgaatagtcaatttacacacaagacaatttctgttattgaggcagctataggatatagaagagatttcccaactcactttgcaaggtgcacatagccttgaatccacaagcataatgtaaataatttacttttaagaaactcagacagaaaaatcctataatcatctcaaaagatcctgacatttctttttgataatttaatgcccctttctgatttttgtcaaatactaggaagctaataggtaaggaaaagtccctaacttgataaaaatacctaccagatgcccaaatcaaaaatcatatgaattaggaagttctggagtgcttctcattaaactcaggaacgtgtaatatcgttattaatgtattgttccaccctgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtctgttgagggagtgaagggtcggggggcagcaatcccctgtttggcctgccaggtaaagcctttgtaattgctaatggctgggcctgacagattacacataggattttggcctggagcccaaataattcctaaactccatcctttgatttttcagagcccaagcgagaaacataggctaccccatcatggacctgaatgggttggattttgagggtctctgttaggagccaggttattagtctgcagttacaataaatagaccatggtcaggatcaagatcacttccagcatcgtgtacagattaatatgcctggggtagcttaggtaccagaaaaatccatgtttacagaaatgtttgtttgcagcattcagtggcacaggaacaaaatatttatttgtggggatacatccagcattttgtcaaattcactggggaactgcctgggacaggcatatcaatgaatttagtgacttggaagtcacacagtctattctgtaggagagagagaaggaaggttagattcccacttctccctcctctgtaccctggctcatgggttcataggcgctcacgttgggggaattttccccaaccactgtgacatgggtaagggtagcatcttccgactatcctccagggaggtgggctgtaatctggcctggatcctctgatgactaaaaaaaaaagtttctcttctgtacattgatatccatcccttgaaaataaccaggcaaagcaacaaagccactttatggaaaacattgaattagaagcctcaagttgatagtgattattttttgcaggcaaaaaaatccatgctcagcaccaaagggataactgatgaagagggttactgtctctcatgctttgttttttaatagctaatctaatctctcacctatctgagtctttagaaaggaattgaagggggtggggggcccttgtagggttccccagagagactgaggctgtgcaataaaaggaagcaggtagacagtctgatcaaatatgcagcgcaaatgatgactgcccctttgaggaatgccacactgggaccccagactgttcccctgagatgcatagtccaggccgaggttcttttattccctcctgtcagtcacttaaccctgtccttcaattgtctactaaaacactcaatcatccctgctgcttggaggcgatagagagcatagggcgtccatcatatatgccccatgcttgggcccattgatgtgtggcttgggccacaaatctggggccattatcagatgcattctatgcctgggaatcaaccatctaagatctgaaattgtgtcaccgattgattgacctgacctcacaaggaggttttttatttgtttttgtttttttttttgagacagagtctcactctgtcacccaggttggagtgcagtggctcaatctcactgctacttccatctcccaggttcaagtgattcttatgcctcagcctcccgagtagctggaattacagacacgcaccaccatgcctggctaatttttgtatttttagtacagacagggtttcaccatgttggctagcctggtctcgaactcctaacttcaagtgatccgcccacctcggcctcccaaagtgttgggattacaggcgtgagccactgtccccagccactggacttgataaccatccggagtatcatgaacaaagctagaaatctgagtctggttgcaacctcatcatctgctgcttccacttccttatcatagacccaggggaccaccagtgtagcctgccacggctccaggtttggagtgaggcgtaggttccaggcagctcctgttgaccctgctgctgcaggccaggtcagctgtccttgcccaggtgtgaatcatgggcatgtatctccctgctgggcttccgctttgctgccctttcctggccctttggccagagagagcaggcttttctttctgttgcttttccttgtttgttcttttttttttttttttttttgagacggagtttcgctcttgttgcccagactggagtgcaatggtgcaatctcggctcaccgcaacctctacctcccaggttcaagcaattctcctgcctcagcctcccaagtagctgggattacaggcatgtgccaccatgcccggctaattttgtatttttagtagagacggggtttctccatgttgaggctggtctcgaactcccaacctcaggtgatctgcctgccttggcctcccaaagtgctgggattacaggcgtgagccactgggcccagccatttgttctttctaatttaggcctgttggtggttctggattgcaggcctctttcgttttcagtctggcatgtgtgggaataaaaagacagcccagggcacaaaacagggtgttgttcctgcctctgggtcccccgccagtctgcctctactttccacctctcagggttgtgtgattgtctgttgatttattcccagggtatttaggtgtccttagaggggagaagcagggaaaagtgaatctatgccatcgtgtctcggaactggaagtccacccccatccccacacacactagaattgcagaagaaaaataagatgagaacttgagtgaaaaaaacatattattatgcaatcatcaaatgtttggacagaaagtgttcttagacaacctctagtctaatttctcacatttggaaatctggaagttggactaagacctgaatcgaccaccctcacccccagttcagctgactgactccccagcctgtattctcaccattccacaccaggatctgtcctgaggctttgaaaaaatgtgaactgcatgtcctgctcagatcccaaccctcccacaccactttgctaagagtctgttctgtctgcaaaaatcccaaaagttgtgtcaactggaacgcaaaatgttcttcatttgactttcattgttttttggaattttggggggccagggaggagcaagaaaggagctgcaattgcccttgggtaagatttgcttagaattttaggaagaagttgtctgggcacagtggcttactcctgtaatcccagcactttgggaggccgaggtgggtggatcacgagatcaggagttcaagaccagcctggccaagatggtgaaaccctgtctctactaaaaatacaaaaactagctgggtgcagtggcaggcgcctgtattctgctagggagctgaggcaggagaattgcttgagctggcggggtggaggttgcagtgaaccaagatcacaccactgcactccaggctgggcggcagagtgagactgtctgtctcaaaaaaaaaaaaaaaaaaaaaaaaagaagaattttaggaagaaatctatctgattctagaattatctaggctgttgaggatgtgtgtctggtggccactgggacatcagggtgagacttttcttttaactgcatgtatgtgaattaggttgcttctggagcctactgagagctcactgggtccccatagcatccatgctgaaggcgccttccttctgtctgtgaccttgaccctcagctccacatttccccaggggctgcaggatttctcagaatcctcattagcacaacctatttttttttttttttttcctgaaacagagcctcactctgttgcccaatgcagtggtgtgatctcggctcactgcaacctctgcctcccaggttcaagtgattctcatgcctcagcctcccaagtagctgggactacaagcgtgtgccaccattcctggctaattcttgtatttttttttgagatggagtctcgctctgttgcccaggctggagtgcagtggtgcgatctcggctcactgcaacctccacctcccgggttcaagggattctcctgcctcagcctcccgagtagctgggactacaggtgcccgccaccacacctggctaattttttgtatttttagtggagacagcgtttcactgttttagccaggatagtctcgatctcctgacctcgtgatccgcccgccttggcctcccaaagtgctgggattacaggcgtgagccactgcgcccggccaacttttgtatttttagtagagatgggggtctcactatgtttgtcaggctggtcttggactcctggcctcaagtgatccacctgcctcagcctcccaaattggtaggattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagaacaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtggttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgccccccaccatgcccagccaatttttgtatttttagtagaggtgggggtcttgccatgttggtcaggctagtcttcaactcctgacctcaggtgatccacctgccttggcctcccaaagtgctgggattataggtgtgagccaccacgccctggtcaattgcttcctttttatatttagattgactatccatctggatttgaattttgtgtgggtaggaaatcaaggctcattttatttttatatggctatcttgttgatctgtcgttatttactataaagacgatccttttttcacttcacctcattgtcacctttacccatgtatcaagtgagaatagagtgtgagactttaaaaaattaatggattattttttaagaacagtttcaggtttagagaaaaaacagagcagattagctgggcatggtggtatgcacctgtagtcccagcttattcatatgcttatttgccatctgcgtatctttttgtgaggtgtctgttcagacctcttgcccacttttcaatcgggttgttttcttattgttgagtcttaacagattagcttaatcagattggcttcgggaggctaaggcgagaggatcgcttgagcgcgggaggcggaggttgcagtgagttgagatcacaccactgcactctagcctaggtgacagagagagaccctgtctcagaaagaaaaaaaaagaaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttctacccttctaagttcatggctgagaaccctataacagaagacagattaataagagaaaagtgcataaacatatttaagttttatgtgacatggaagcctttataaggaaatgaagactccaagaagcagttacagtttgatgtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggagggcatctctcacctgagggtcttatgacctggcttcaggagaaggtcagaaaacccttcctgcacatgctgcttttgcaaattccttcaccttaaaatattcaatatgtcattgtgttagtctgttcttgcattgctctaaagagatacctgaggttgggcaatctataaagaaaagagttttaattggctcatggttccacagactgtataggaagcatgatgctggcatctgcttggcttctggggaggcctcaggaaacttacaattatggtggaagacaaagggggagcgagacatctcatgtggctagagcaggggaagcaagagagcggggaggtgccacatatttttaaacaaccagaatatcatgagaattctatcatgcaaacagcactgtggggatggtgctaaactattagaaaccacccccaagatccaatcacctcccaccaggctccgcctccaacattaggaattacaactggacatgagtttgggtgaggacacaaatccaaaccatgtcagtcgtggtgccatattttgtggtagcacgtcctgaatcccatcaataaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgcctttgcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtgggatcacctgagatcagcagtttaagaccagtctggctaacacagtgaaacctcatctctactaaaaaaaatacaaaaattagctgggcgtggtggcgtgtgcctgtaatcccagctactcaggaagctgaggcaggagaatcgcttgaacctgggaggtggaggttgcattgagccaagatggcgccactgcactccagcctgggcaatagagtgagactctgtgtcaaaaaaaaaaaaaaagaaaaaaaaatggccaggcgcagtggctcacacctgtaatctcagcactttgggaggcggaggcaggtgtattatttgaagtcaggagtttaacaccagcccgaccaacatggtgaaaccctgtctctactaaaaatacaaaaattagctgggcgtggtggtcatgccggtaatcccagcaacttgggaggctgaggcaggagaatcgcttgaacccagaggcagaggctgtagtgagccaagatcacacttgccgttgcactccagcctgggagacagagtgagactccgtctaaaaaaaaaaaaagcttcatgacaaacttccagactttcttccaaagtgtccgtatgagttttcattcccacgagtaatgaatgagagttcctgttacttcacatccttgccaatgtttggtggtgtcagtgtttcggattttagcaattttggcaaatatgtagtggtatctcactgttgttttaatttgcaattccctaatgacatatgatgttgaacatcttttcatatgcttatttgccatctgtatatgtttttggtgaggtatctgttcagatctcttgcccacttttcaattgggttgtttgttttgttattgttgagtgtcaagagttctttgtatatttttggataacagcatggtttttgtttttgtttttgtttttttttgagacagagtctcgctctgtcaccaggctgtagtacagtggcatgaacttggctcactgcaacctctacctcccaagttcaagcaattctcctgcctcagcctcccgagtagctgggactacaggtgtgtgccaccatgcccagctaatttttgtatttttagtagagacgggctttcaccatgttggccaggatggtctggatcacttgacctcgtgatccaccagtatggttgagttttaagagttctttgtacgcttttgggtaacggtcttttgttttgcaaacattttctcccaatctgtggtttgtctcttcactcttaactgtatcttttgaagggggatctcaaagaacatctggtcccccacaacaacatgtcatgtcaggtgagagatgactcattttctcagaaactaggattttgtgtcatatgttgtaaaccacgaaaagttaattttataacccaccttctagatctactgagaatacgtggtgttatcactaacagttttgaggaaagaaataattgcctaattcattttgtagtgaatgtgttttgttactaccacagatactcttaaaatccacttattatggagggggaaaaaaaaggaattttctttacagaaagtgaggagtgaaacctaatggagaaaatatctgtttcagggaataaccctcccaacatctgatttttttttgttttagacaggggctcgctccgtcccccaggctggagtgcagtgatgcaatcatagctcactgcagccttgaactcctgggtttaagcaatcctcctgcctcagcctcctgagtagctgggaccacaggtgtgcaccaccactgcaccaccacacccgactaatttttttgatttttggtaaagacagtatgttgcccaggctgatcttaaactcctgagctcaagtgatcctcccacttcagcctctcaaagtgctaggattataaatgtgagccactgcacctagcctgatcttttttttttttttttttttttttttttttaagaaacagtcactagtgctgtatgtaggttacagtagctatgtaggcccttcagagtcacttcacttttctgagctttcgtttcttcaacgtcttcctgtctgtaagacacatgctcttctacccctgagaccaaaaaatgttaccagtgaggatctaatgatataaaatagggaaaatgctttaaaactgcacagtgcttaacaaatgcactgttattatatcattaaaagtgactcctgggtggtgggaatggttgcataacgacgtgaatgtacttgatgtcacttaaaactggttacaatggtaaattttatggtatatatattttaccacaattaatacattttaaaagatggttcttgacaattattcttagcgtctgaggtgccccatttcttgggtatgggcatatagtgcctcaagaatattggggatcctcacctcttctatgcccaaacctttaagaaaattctgggccaggcgcagcggctcacagctgtaatccaccactttgggaagccgaggtgggtcgatcacctaaggtcgggagttcgagaccagcctgaccaacatggagaaaacccgtctctactaaaaatacaaaattagctgggtgtggtggcacacacctgtaatcccagctactcgggaggctgaggcaggagaatcgcttgaacccaggaggcggaggttgcggtgagccgagattgcaccattgcactccagcctgggcaacaagagcaaaactccatctcaaaaaaaaaaaaaaaattctggaaaagctaggtcagtgacatgaatattggaatcagagtctaacaaactcaatttcttcctttctaaatccgtggtacggattcatgtctgcagtagtttttctgagaaagcagaaggggtaggtattggcaatcaacaagctgcagagtatgcagattgaggtcagtaactgtaaatgccccatgactgtctgatcattttaataccaaaagaaaaacttaaaatcccagttgctaaaatctttgtcttagacaactctttgagcctctccctacaaggcccagaaaggaatgagatagatgtgaatggaatctgttttcccttcccttgccacgctctggaggaggagtctagggcagtagccaaggccagctgccagtcaaggaaaggggagcggccccgttgaatccacaaaccacaccatcctggcccatgggttatatacaaactcccacattggcaacaaacaaagggcatgcacattcaggggattttgctttcactgtgagtgtttatctttgaagggtgtcacatcaagatgaatgggaagggtgtgttgcagttgagctgaggtttggtctttcttggcttttttagggacacttacaggtccaaatctgctttcagccggctggtggacatggtaggagacacagtagtctcaggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggtttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccactgtgcctggccataattcatttatcagtcatatatatatacacacacactgggagaatctagggtcagtgccttacaaatggcacaagttgaagccctgagactcccactcctaccctgctccccccattctcagtactgctcctcagatgcctccagcagatcatccatttctgctaggctgggcctgggtacatgcagggagatgtgtacaggggctaagagcagaaacttttgagtgagacactcctgagttcatgcactggccctgccatttgtcagctaattgatgttgcatttaattgcatcatctgtatgtaagcctaataatttatagccatcttagagatgttgtgagcttaaataacatagtagtgaatatttatttatttgtttatttatttatttagacagggcctcgctctgtcacctaggctggagtgcagtggtgtgatcatagctcactgcagccttgacctcccacactccagttatcctctcacctcagcctcctgagtagcttgagacaacagatgcatgccaccataactgactaattttttaaaattttctgcagagacagtgtctccctatgttgcccaggctggcctcgatctcttgggctcaagcgatcatcctgccttggtcttccaaagtgctgggattactggtgtgagccactgcacccacagcctatttattgagaaatgtggaaggcccaggcactattctaagtgctccagctgttttatctcccacagttttgctcagataggagttccaaagctggagctggaagactcatatttttagaaatgttacagttaattctgaggtgggtcagattgagattcatggctatgcattaatgtttaggtggtgactaaccactcagggttttagagacaaacagaccttattctgtcactcactgactgagcgtggccaagtctttcagcctctctaagcctcagtgtcctcatccataaaatgggaccaatcgtagcatccacttctgagaactgttcagaagtggaaatgagctagtttaggtggctgtgtctggcatacgccaatggtttgataagtattagcttgtgcctttattaggccaactcctttttgttaggtgactgagaaaccaaggaccttctgccctttatgcaccagtcactattagtttaaatttgttgctcttccatccacatgattcattccaaatttgaagtgttggagaaagggagttagtatgtcatagaaaaatctctgtttttggctcagcaggactgagtttgactccatgtaactgtctgagtcttagtttcctcatccataacatgggagaacaataccctgaattagagaattctgctgccagaattagagatagttcatgtcaaggtgcaacatataggtaatgtgttattgctggtgttctggttataaaatgtacaagatgtgaaagcaaaagggcagaaaaccctttttaaaaattcatggctgggcgcgctgcctcatgcctgtaatcccagcactctgccaggccgaggcgggtggatcacctgaggtcgtgagtttgagaccagcctgaccaacatggagaaaccctgtctctactaaaaatacaaaattagccgggcatggtggcgcatgcctgtaatcccagctacccaggaggctgaggcaggagaatcgcttgaacccgggaggcggaggttgctgtgagccgagatggcaccattgcactccagcctgggcaacaagagcgaaactccgtcccccgaacaaaaaattcaaatgggaaagagaggcagatggcagagaacaggggaggggctgggcaccgtggctcatgcctgtaatcccagcactttgggaggccaaggcgggtggatttcttgaggtcaggagttcaagaccagtctgaccaacatggtgaatccccatctctattaaaaatacaaaaattagccgggggtggtggtgggtgcctgtagtcccagctactcgggaggctgaggcaggagaatcacctgaactcaggaggtggaggttgcagtgagtcaagatcgcaccactgtactgttgcctgggcaacgcaccgagactccgtctcaaaaaaaaaaaaaaaatgagagaacaggggagggtctagggctcagagctttggagaacagacctcagtagcaccaacactccaggatcaatgctacaaagacacgggttacaactaaactggagaacatggccaaggatgggaactcagcctgagcagggctgagccgagcagggctaagccaagtagggctgagccagaacacttcctccttttttctgaacaatctacctacatttcagctacagggctggctttacccagtccggcgggagggaggagagggctggtctgtgacttcagtgctgaggtttgatcaaggcaaagggaaacttcctattcccagaccctttgcaagaaagaatggcatattacttgccaccgacaggggttattattactaaatggagtcagtataaatgctttccaataaagcatgtccagcgctcgggctttagtttgcacgtccatgaattgtctgccacatccctcttctgaatggttggaaattgggcatctgttcctttaaacaggaaacatttcttgttcgagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatccacttttttttctttttcatttggccctggggccgacggttaagtactttattctgtcattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccagctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtccttgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttgaatttctggttcaaattcttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagcgcccctcacctcccagatggggcggctggccgggcggggggctgacccccccaccgccctcccggacggggcggctggccaggcagaggggctcctcacttcccagtaggggcggccgggcagaggcgcccctcacctcctggatagggcggctggccgggcggggggctgttccccccacctccctcccggatggggcggctggccgggcagaggggtcctcacttcccagtaggggcggcccggcagaggcgcccctcacctcccggacggggcagccggccggaaggggggctgacccccccacctccctcccggacggggcggctggccgggcagaggggctcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagggggctgaccccccctcccccctcccggacggggcggctggccgggcggggggctgacccccccacctccctcctgggcggggcggctggccgggcagaggggctcctcacttcccagtaggggcggccgggcagaggcgcccctcacctcctggacggggcggctggccaggcggggggctgaccccccacctccctcccggactgggcggctggccgggcggggggttgaacccccacctccctcctggacggggcgactggccgggcagaggggctcctcacttcccagtaggggcggccgggcagaggcgcccctcacctcccggacggggcggctggccaggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggacggggcggctggccgggcggggggctgacccccccacctccctcccggacggggcggctggccgggcagaggggtcctcacttcccagtaggggcggccgggcagaggcgcccctcacctcccggacggggcggatggccgaccacccccccccgcctccctcccggacggggcggctggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctcctcactttccacactgggcagccaggcagaggggctcctcatatcccagacgatgggtggccaagcagagacgctcctcacttcccagacggcgtggcggccgggcagaggctgcaatctcggctctttgggaggccaaggcaggcggctgggaggtggttgtagcaagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacggggagagggagagggagagggagacggggagagggagagggagaggggtcaaattcttatctatcaatgttatgcccactgtgctctccagctgtggtctgtgaattactgtggtataacgtgactgttcaaatttcacttttcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcggtaagttttgcctactcagccctcctcactgttacactaccttccccccctactccatcacactactatctactcatattcagagcctattagaaagtgctatgtgatttagatcacattaacaggtcagagaactgtccaaggggagtggtttccgttcaactctaaatgtctagctgtagatcacatagctgcatttcccaggtcagttacaaagtgggagagtggcaagtgttaacatccttagtttatagatggaaaagctgagatgctttattcctttattcagcacctcaaaggacaatcagggtatcacagagcaggaaaggataggaaagtcatatactccagctctctgtctttaggccaaaacatgactgagccaattcaactagttttggaaatcttccaagaaggcagtaacccaattcaatgtttaaacatcctccaactctgtcaaaagttctataatagcaaaccatcctcaaaacctcttggtgcattatgggagataaatagcaggttccttctagccctgtatttcatgttttgagtatatgaagagtgagaatttcccgtaacttagatcatgaatctaacttagatttcgtaacttagatcatgaatcctgcaaggtttccgcggctagctaccaaggtagaagaagaggttgcctaacaaaaatgctaagagatcctggtgagaagaaggtgggagtagctgcaggagacgttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatattatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 1566 - DNA, 54269 bp, Homo sapiens; identical to SEQ ID NO: 1565
  source 1..54269: mol_type = genomic DNA

SEQ ID NO: 1567 - DNA, 54269 bp, Homo sapiens; identical to SEQ ID NO: 1565
  source 1..54269: mol_type = genomic DNA
